United States Patent 11,337,426 (BIOLOGICAL CONTROL AGENTS AGAINST FIRE BLIGHT) - sequence listing, part 2

SEQ ID NO: 14 - DNA, 4049378 bp, Pantoea agglomerans NY60 (residues 2,024,690-4,049,378 of 4,049,378)
tttaaaagcgctgaaggaagaactgggcgagaatatttatacggtacagctcgatgtgcgtaaccgtgccgccatcgaagaggcggtggcgcagttaccggcggaatggcgcaatatcgacgtgctggtcaacaacgccggtctggcgctgggcgtcgaaaccggcgcacaaagccaacgtcgaagactgggaaaacatgatcgacaccaacaccaaaggcctggtctatatgacccgcgccctgctgccacagatggtggagcgtgatgtcggtcatatcattaatatcggatcgattgccggcagctggccctatgccggcggcaacgtctacggcgccaccaaagcctttttgcgccagttcagcctgaatctgcgaaccgatttacacggcaccgcgctgcgcgtgaccgacattgaaccgggtctggtcggcggcacagagttttccaacgtgcgctttaagggcgatgatgacaaggcgggtcaggtctacgaaggggctaccgccttaacgccggaagatgtgacagaagccgtatactgggtggccacactgcctaaacatgtcaacatcaatagccttgagatgatgccggtcagccagacgctggcggggctgaaagtgcataaaccttaactccctgcagcgccagccctcacggctggcgttacccgcgtccccagcccatcacgataatcagcatgccgctgaatgcgatcagagccccgctccagtcccacacacttagcttcacgccatccaccacccgcaaccagagcagcgcggtaagcacatagacgccaccgtaggcggcataaacccgtccgctggccgcgggatgcagcgtcagcagccagacaaacagcgccagacttgctgccgcagggagtagcaaccaggctgacccgccttttttcagccataaccacggcagaaagcagccggtaatctccgccagcgcggtaataaaaaacagcaaggcggttttaatcagcatccttacctctccttaacgtaaacaaacgactcactgctggtgagcaaagaaacggcgatgatatactaagagccaggcccatcaggctgttttatttgtccgtctgaacccgggcagtgctcatcctcctcacgtacaccctgtacgcgccggttgtcatgcgctgtctgtgtccagactgtctgcctcaatgacccctgatgagccaggctctaagcatgcccgctgcaaccgctgtcgtggatggcgatgtttgcgttaactaaaggatagtgtgatgaaaaaaatgatccctgccgtgctgatggttctcctctccactgcggcattcactgccactgcgaatactaatcgtctgattatcgaagatggcagttccgcgctgagcaatgaagcagcgcgccaggataaagagcaatggaatgacacgcgcatgctgcgcaacaaagtgaacacccgcgtcgaaaaagagtttgataaaaccgatcgtgcgtttgatacccgcgacaagtgcgagcagagcctcaatctcaacgcatactgggagcccaacaccctgcgttgtctggatcgccgttccggtcgcccggtagcgccgtaaatttgagctatagtaatgacgacgactaacataaggaagacgtgatgaagctacagagggttttgttaagcgcggcgttatttgctctgccgctaatggcgcaggcatcctgtgaatcggtaaaaaccgaaatcagccagaaaattattcagaacggtgtgcctgagtcgggttttagtctcgacatcgtcgccaacgatcaggttgatcaggcgggtggccaggtcgtcggacattgtgagaacgacacacaaaaaattgtttataagcgctcaggcagtgacaacgaagccagcgtacctgccagtgccggcagtttcgcaggactcatctgcccagtagttctgttcaaatcagggcgacatcctgtcgccctgcctgttagtccgcctgttccggccgctgacgcggcatcatccatgccacacacaccgcaaacagcgcaatcaccagtgccaccacgaacacccagtgcagtgagacggcaatcgaccctaccatctgctgcagggtttccggctgtaactgctgacggctgggttcggacataatcttctgaaccggatcctcgacctgcggcaaacgccactgcagattgagattcagcaccgcgcccatgatcgccgtccctaccgccgacccgatcatccggctgaacataattgaagcggtacagatgccgcgaatctggtaatccgcctgattttgcactgaaaccaggaacgtggtgctggtcattcccatgccggtaccgatcagaaacgccgtaaagcccgcctgatagagtgagcttgcgggctgtaaaaacagcagcaaggcactgccggtcaccagcaacagcgccccaagctgggcggtgaagcggtaggaggtgtgcagcatcagtctgccgctgagggtgctggccagcggccagccaatcgacatcatcgccagcacactgcccgcctgtaacggtgaaccgccgctgatcccctgaatccaggtgggcagaaaagcgctgatgcccatcatggccgccccgatgatgaggttgcccgcattgcccgccacgataagccggctgcgccagattatcagcggaaacagcggtgccgctgaattcagctcgtggcgtctgagctgccagccagcgaacagtgagaagagcagaaacggcaccagccagacgcccagctgttccgcctgcaacagcgcaatcagcaaggccgtcacgcagagcatcagccagccgctgcccgccaggttcagcggctgcgatttctcctccttctggtgcgacggtagccagcgccacagcatcagcatgctgatcaggccgatgggcagattgacccagaaaatcaccgaccagctaaagtgctgtaccagccacgcgccggtcagcggtcccactatcgccgctacaccccagacgctggagagccagccctgcacgctggcgcgttcgcgcggcgaatagatatccgccacgatggtggagctgagcggcatgatcgcccccgctcccaggccctgaaacgcccggaacaggatcagccaggtcatggtatgggcaaagccacacagcaccgaccccaccaggaaaatcgacgtgccgacaaaaaacatcgttttgcgacccaccatatccgccagccgcccatagagcggcacgctgaccgcctgggtcagcagatagatcgagaagacccagccaaactgcgaaaaaccgccgaggtcagcaatgatggtgggcatcgcggtggccacaatagtgacttcaatggccgccataaacatcgccagcatgcaggcgattaagatccagtggcgatgtccggtctggagttgtgcgctttcagtcatagggttccttttttaatctgcaaggctagctgaaaaacagacaatgcagtttcccgcgcgtgcgcattttctgcgccctctgtgacagtgtcaccagaagtcgatgaaaattttttattgtcgcattagcccagcggctacgcggctttaacaccattttaacctatttctatctctctgatttgtggcttaaaagctggcttgtgcaataaagggctgctatagcattacaccatcttattcagtattcactgaaaaagagtgggtaaacagtcattttatctacattttatcgcagtttcggtattgggcgcggcggcaatttttgccgtacctgtcgggctgtttatggttgttataacaattgagatcgtaatcagggagattctccgatgcaaaatgcttcactggcccgacgcgccggtctggcactgcttgcagtggtcgcggtgatcgcggtgctgatctggggccttggctgggatcagctggtcgcacgtaaagtcgatctgctttatctcgggcaacaacacctcttcttagtcttctggtcaatgctgttcgctttgctggtcggtatccccagcggcatcctgcttagtcgcccgtttgcacgtcgctgggcagagtacgtgatgcagattttcaatatcggtaacaccctgccaccgctggcggtactggctctggcgatggttattatcgggattggcgaccgtccggcgctgattgcgctgtttctggcttcgctgctgcctatcgtccgcaacaccttctctggtctgagcgcggttcccccgtcgctgattgaggcggccaacggcatcggcatgaccaaatggcagcgtctgcgtcaggtagagctgccgaatgccttgccggtcatcctctctggcgtgcgcatcgccaccgccatcaatgtcggcaccgccccactggcgttcctgattggcgccagcagctttggcgagctgatcttcccgggcatctatctgaatgactttccgacgctgatactcggcgccgtcgccactgcactggtggcactggtactggatatgatgctggccgcgctgggccgctttctgagtccgcacgctgcggcctgaccacaaggagctttgcaatgctaacgcgttggattaagaaaagcgttgtcgcgctgaccgcgacactgctgttaagccagacggcacaggctgctgcaccgctggtgatggcgaccaaaagtttcaccgagcagcatatcctgtcagcaatgacggtgctctggctgcagaagaaaggcttcgaggtggtgcctaaacgcaatatcgccaccaccattggccgtaatgcgctgctgaataagcagattgatatggtctgggaatataccggcacctcgctgatcatctttaaccatatcaaccagccgatgtcttcacagcaggcatatgagacggtgaaaaagctggatgccagactggggctggtctggcttaacccggcaccaatgaacaacacctatgcctttgccatgacccgtgaacgggccgaaaaagagggcatcagcaccatgtcgcagctggttgcgaagattgagcaggtgcgtaaaaccgatccggatcataactggcgactgggtctggacctggagttctcgggtcgttcagacggcatgaagccgctgcagaaaacctacaacctgacgctggatcgcccgcagatccgccagatggatccgggcctcgtctataacgcgatacgcgacggattcgtggatgccggtctgatctataccaccgatggccgggttaagggcttcaacatgaaagtactggaggatgataagcacttcttcccaagctacaacgtgacgccggttgtgcgtcaggatgtgctggcgagtcatccggggctggataccgcgcttaatcagctttctgcgcaaatcaccgatgaggcgataacggagctgaacaagcgggtcgatatcgatcatcagtcaccggaaaccgtggcgcgtgatttccttaaatccaaaaacatgctgtaaggaggcactgtggatacccttcactacatcatggataactggagcaccctgctcaccctgagctggcagcacagctggctggtgctggtcgcggtcggactggcaattgtgattggcgtgccgcttggcattctgatcgtgcgtgtaagatggctggcaacgccgattctcggtatcgccaccgtagtgctgactattcccaccattgcgctgtttggtctgatgatcccgctgttttcactcatcggtcagggcattggcgcgctgccggcgattaccgccgtgttcctctactcgctgctgccgattgtgcgcaacacccacaccgcgctggagaatctgccggacggtctgcgagaagcgggccgtggtatcggcatgacgttctggcagcgcctgcgctgggttgaaatcccgatggcgctgccggtgatcttcggtggcatccgtaccgccgtggtgatgaacgttggcgtcatggcgattgccgccgtgattggcgcgggcggtctgggccagctgctgctggatggtatcagcggcagtgatattcgtatgttaattgccggggcattgatgatctgtctgctggctatttttcttgactggctgctgcaccgtttgcagcaggcgctgactccaaaggggattcgataatgattacgctggaaaacctgacgaaaacctttacacagaaaaacggcacgaccaataaagccgtcgataacgtcagcctgcacgtgccagccggtgagatgtgcgtgctgctgggaccctcgggctgcgggaaaaccaccacgctgaagatgattaaccgcctgattcccgccaccagtggccggatcctgattaatggtgaagataccagtacacaggacaccaccaccctgcgccgcaacattggctatgttatccagcagattggtctgtttcccaacatgaccatcgaagagaacattaccgtggtgccacgcatgctgggctggaacaaaaagcagtgccacgagcgggctaccgagctgatgagcatggttgcgctggatcccaccaaattcctgcatcgctatccgcgagagatgtccggcggtcagcagcagcgtatcggggttattcgtgccctggcggcggatccaccggtgctgctgatggatgagccgtttggcgccgttgacccgattaaccgcgaagtgatccagaatgagtttctcgacatgcagcgtcagctgaaaaaaaccgtaatgctggtgagccacgatattgacgaggcactgaagctcggcgatcgcattgcggtatttggtcagggtaaaatcgtgcagtgcgccagcccggatgaactgctggcgacccctgccaatgagttcgtcggctcgtttgtgggtcaggaccgtacgcttaagcgcctgttactggtgcaggcgggcgatgtgactgaccagcagccgaccatcaccgtccgccgctctactccgctggaagaagcctttggcaccatggatgagaacgatatgcggtcgattaccgtggtcgatgaggatggcaaaccgctgggcttcgtgaagcgtcgcgaggcgcgtaacgtcagtggccgctgtgaagagcgactgcacacctttaaggtcaccggtaaagcggaagagaacctgcgcgtggtgctgtcaaaactctatgagcacaacacggtctggatgccgattgtcgatgaagagggtcggtacagcggtgagatttcgcaggattatattgcggattacctcagtttctggtcgtacccgccgtcgtctgaatccataatttcgtcacctaaatgggtcttaccggcccattaaaacagcagatataagcagatatacccaagcctgggtaaatcagacagcaacaaacaagcttaacgcgcagggaaccgggtcagaggaggaaagcgtcccgcgccatggacaaaaacgccgggagcgtttttgaacaacgcaacgcgttggcccggtacgggcgcacctcagggatgaggtgcgtaattgcgcgggccgagcgtgccacggatggcggcttttgcgactttccgatctgaccctgttcccttcgcagactccatcttaaagccagttaagtcacggcctgtcctgtctgtcaattcaggtagtagctcagggagcatacgcctgtagcaaagacgcaaaagatgccatccatggcatgctcagcgcggcccatccctggtccgcgatgctttgatacaggcgtatgctcccatcgctttggatttttgagccgtatgtgagagatacatcggctcttctgctttttagctctccgtcagcgtttccgcctccacctcttccaccacaggcgcctcgtccggcagcaccatgttcagcacaatcgccagaataccgccggtcgtcaccgcatgaccaaacagactgttaatcagcggcgggaactgcttcagcacatccggcaccgcctccacgcccagaccaataccaaaagcgatcgccacaatcagcatctcgcggcgacccagcggcgtctgggtcatcacacggatgcccgcggcaaccacgctgccaaacatcacgattgtcgccccgcccagcaccggcggcgggatctgctgcaacagggagccaataaagggaaacagccccagcagcgccagcatgattcccagcagcataccgacgtaacggctggcgacgccggtcatctggataacgccattgttctgcgcaaacgtggtgttgggaaaggcggagaagaccgctgccagcacacagctcaggccgtcggcgacaatgccaccctgcaaccgctgctgaaaaggtttgccggtgatcggctgctgtgaaatcaggcagttagcggtaaggtcaccgacggcttcaattaccgcgatcactgacaccagcgcgatcggcaggaaaatggtccagtcaaaggcaaaaccaaaccggaagaacgcgggcagcaccagccagttgctctccggcgcaacattaagttgcagatgaccggtcaaggccgcggcaacgcatcccaccgcgattccggccaccaccgccaccagccgcgcccagcgatttcgcgagcggttcagcgccacgatcaccagcaacgtcagcgcccccagcgccagatttcccggcgatccaaaatctgtggcgttgtgcccgcccgcccagtcggtaatgctgacttttatcaggctgatgccaatcagggtgatcaccgtgccggtcaccaccggcgtcagaactttgcgcagcgagccaacgcagcggctgatcagaatcggaatcaacgccgccaccaggttacagccaaacagcatcgccataatctcttccggcgaaccaccgcgccctttcaccatcagaccaccagagaggatcacccccagaaacgcgaagctggtgccctgcagacagatcatgcccgccccgatgccataaaagcgtctggcctgcataaacgtgcctaagccggaaacgaacaatgacatgctgatcagataaggaatataggcctgcaaccccagaacggagccaataatcagcggcggcgtgatgattcccaccacgctggcaagcagatgttgcagtgcggcaaaaaacgccggggcggggccaatgcgggcttcaagcccatataacaaacctttctcgtgcgagtgcgacatgatggggctccagctcagtgtgataagcggagttaatgcattttctgcgccatgacgccacgatttcgcgatatccgagccaggtctttcaattctaaatggaaatagttaaagacagccgacaacgagcctgaaactttaggctcactgccgactcagatgacttagtttgtttcataatcaggcgatctttgcactcacagcatgcagattgttctgctccagcagagaaatatcgatgtaagacgtcagatcacgctgttctgcacgcggcagataaggcagctcgcccagcagcggcgcactaattttttcacgcagaatctcaataatatcgctgtactgcgccagtcccggattgatgcgattggccacccagcccaccagtggcagtccatcctgcgctatcgcttctgctgttaacagggcatggctgatacagcccgactggataccgaccaccagcaccaccggcagctgctgctcaacgacccagcaggagagcggacgtccgtcgttcatcaggctccgccagccgccggtgccttccacaactacgcgatcggcctgcgccgtcaggctgcttaagccctgtgtcagcaatgcgtaatcaatgatctggctcggatgggtgcagatctcctcttcctgaaaggccagcggattgatcgcctgatagggtaaatcgatggatgaagcgctttgcagaacctgtgcatctttgttacgcaggccgtcagcggttttgaccgcgcagcgcgcgacgggcttgtagccgacggcactgagcctggcctggataaaactttgtaacagggcgcgtgacaccaccgttttgcccactgcggtgtcagtgccggtaacaaatagtctgttcactcaacttctcctctcgaaccgttgtggttaatcggtgattaaccttgctgcgaaccggcattttaaggaatggaggatgagaacagattgcgttagcgcaagattaggcccgcttaaccttgcaacagtttcactaacaggtgtccgttatagagcgcgtctttgatcagcgctgcgccgcctaacgttcccggctcgctaaattcggtaggtgccagctggatactcgcgctgtaggccgggagtgattgctgcagaatggtgttgctcacggccggaaacagcacatccgcggcggcattcaggggggaaccgataagaatatgttgaggattgaagatgttgaccatcatcgccagaatccggccaacatgatgacccacgctggcgatggtgtcgcgcgccagacggtcgccagactgcgccgccgcgcacagcgactcaagcgtcagcggctgattattgagcaggctgtcgggctgggccggcagacgctgcgccgccagcgccagcagactgccggtgctggccacggtctccagacagccatgattaccgcagtagcactgctgaccatacgggtcgatctgagtatgcccgatctcgaccagcgccctgccacttttatgcagcagctgaccgccactgatcaccccggctcccacggtttcatcaatcacaatctgaatcacatcctgcgccccacgtgaggcaccaaacagcgactccgccagcgtccaggctgaaatatcgtgctgcacaaacaccggtaagccggtttcgtgccgccagcgcatcgcccagcggcatatcgcgcacctcataacccggtagccgatgcaccacacctgacgcggcgttgatcagccctggcaatgtaatggcaatggccgtaaggcgttccagcttcttctgatgacgaataaagaaggcatcaacctgttcaatcagcgcggtaagtaacggctgagcagactcatcaggcagcggcaggctctcttccaccagttccttgctgctgagatcgcgcagcgtaaacgtcatggcgccgcgatgcaggcgaatagccagatagtgccaggcgtcggtatccagtatcaggcctatcgccggacgaccacgactgccgggatcctgaaactcggtctcctgcactaaatgtgcgtccagcatttcacgcacaattttggtaatgctggccggagcaagctgggcacggcgggaaagttcgatacgcgaaatgggaccataacggtcaattaatcgatatacgacacctgcattagtctgcttgatctggtcaatgtggccaggttgactgtccggattcacaaccctgctcccggttattttcgcgcttctaaataaacatgcgccatggtgagccagatccggcgacagcgtcaaatatttgattagaaatgtgatttatcgcacagattgatgcggtgttgcccgcgcatcagtgccggtttcgccgcagcaacgccatcatgttttccatctgcgcatttatttcgcgtccggctgaccagaccagccacagctctgaaatggcatcctcttccgttaatggcaaccagaccagatcggccagccgcgcccgacgaaatgaggcaggcagaatggagacgcctaacccggttgccaccagcccaaggatggtcatcgcctcacccacttcctgagtaataaagggcttgatatggtagcggtgcagcagcgccagaatatcgctgtagagcgcggttccgccctgagggtcaaagaatacaaagggttccgccgccagggcagtgacagagattttatcggcgtcagccaacggatgcgccttatgcaccacggcataaagcggctcactcagcagcagctgatgacgcagatcggcgggcagcggcgtgttgcgcatcacgccaagatcgagccgtccatcatgaagcggtgcgagctgctggcgggtattaatctcctgcatctgaatatgtacctgcggccagcgctgacgaaaccggaatagcgcgtcagagaccacggcggtaaacggggccgaggaggtaaagccaatccgcagctccccctcttcaccacgatgcagccgggcggcgcgatcggccgcctgttcaacctgtaacagaatcgcgcgggcgtcactcagcagttgctgtccggcagcggtaagctgcacgctgcggttagtgcgattgaacagccttgcgcccgtttctgtttccagctgaataatctgctggctgagcggcggctgagaaatgttcagtcgctgggccgcccgcccgaaatgtaattcttccgccaccgcaacaaagtagcgcagatgacgcagttcgatattcatatcttaaacgtctcatttgagattattaatatattagacatcataatgccgctttcctaagctgacgataggttttctaaatttgaggaagatgtgtgagtcgctcaacacatgctgtcacagtggatgagaatgcggtctctgcgccgccagagtcagttgccgcttcaggtcatatccgccgggattcgccacagtttatgcgcgtgacgctggcgcttttctccgccgggctggcgacctttgccctgctctactgtgtgcagccgattctgccggtgctgtcacagcagtttggtatctctccggcaaccagcagcctgtcactctccatctcgaccggcctgatggcgctgggcctgctggtcaccgggccgctctctgatgctatcggtcgtaaatcggtgatggtcacagccctgatgctggccgccatctgcacgctggtctcggccaccatgaccagctggcacggcattctgatcatgcgggcgctgatggggttgtcgctgagtggcgtggcggcggtcggcatgacctacctcagcgaggagatggatgcacgggtcgtcgccttttccatggggttatatatcagcggtaactcgataggcgggatgagcggtcgactgctgagcggcgtgctgactgacctcttctcatggcgactcgccgtggcggtaatcggctgtttttcgctggcctcggcgctgatgttctggaagattctgcctgcgtcgcgccatttccggcccattacgctgcgtccgcgtaatctgctgattaacttccggctgcactggcgcgatccgggcctgccctggctgtttgccgaagggttcctgctgatgggagcctttgtcaccctgtttaactatattggctaccgtttactggatgcgccctggcatctcagccaggctgtggtcggactgttatcagtggtctatctcaccggctcctggagtttcgcctaaagcgggcgcgctgaccaaccggttggggcggggtcccgtgatgctgggtgctaccgccatcatgctgctgggtttgctgattaccgccttcaactccctctggctgatcctgcctgggatgatgctgttcaccgccggtttttttgccgcccatgcagtcgccagcggctggattggcccccgggcgcgccgggcacgaggccaggcctcttcgctctatctgttcagctactacgtgggttccagcgtcgcgggtacgctgggtggcgtgttctggcataactttggctggagcgggattacgctgtttatcagcgtgctgctgatcctggcgttactggttgcctggcgtctgcacagtaaaaaactctgagaacgtcttctcatgccaggcctggcttctcctgcgggcctggcggtttatcacaataaacgcgctattcagagccacagcaaacaaaatgcaggtttcccgctataatcgtttttattgtaataattcatctgctttgccttttaacacggcaacaaggaacgcctgtggctctctactactacgtcaataaacaatcaggatataacaataatcatgtggttcatgccgcaggctgcccccatcttcccgacatcgataaccgtatgtttctgggcagtttttaccatgtgaatgccgccatcctgcaggctaaaaaatattatgctggcgcaatcggctgtgaaaattgttgtccactcaaaaatgttgaccagcaggccacccagctcagcgtggccctgaagcacaccccggcttcgcgttaatctgatccacctggtaagggggaaaaaatttttcccgctgcgctaatttgttaagaattaccgctgttttccgttatgttaatctttctgattctctttaatggaatgcacaatgcgggataagtttgcacgcgctcagatagcccttcactggctcacctttttactggtggtgacggcctacgccaccattgaactgcgcggttttgcacagcgcggatcctggcagggttatgccatgatcattacccatttcagcgccggcgcgaccatcctggtattgatgcttgcccgcctctttttacgcacccggcatcgcacaccgcccattactcccgccgcgccgcgctggcaaaccgggctggcacatctgactcataccctgctctatgctctgtttatcactctgccgatcctcggcctgacatcgcgttatcttaaaggtcgggaatggtggctgtttggcatcagcatgccggtcgcgcctgaacctgactttgatatggcggatatgctgattggctggcatgaaaccctggcaccgctgggttactggctgatcggactgcatgctgctgccgcactgttccatcactatctgcttaaagacaatactctgctgcgaatgatgcccgcccggcgtcgcggtcaataacctcaggctatcgccctgtgatggggcgataaaaaaatttcagcattaaaaggcgtttataaggtttctcttcccgctttattcactacaatggtcagtaatttgtgacgcaggtcactttcgctggatgtttctgccacatccgattcgctgtactgactgacttgactcctcatgcaaccaactactgtttcacgtaaaactgcctggctacgcgtggtattgctggccatcgccgcctttgtatttaataccaccgaatttgtgccggttggcctgttatctgacatcgctgctgacttttcaatgcagacggctgacgtcgggatcatgctgaccatctatgcctgggtggttgcactgctctcactgccgctgatgctgctgacccgcaatattgagcgacgactgctgctgggtgtgctgttcctgatctttatcgtcagccacgttctttctaccgttgcctgggatttccgttcgctgatggtgtcacgcgtgggtatcgccttgtctcacgcggtgttctggtcgatcaccgcctcgctggcgattcgcgtcgctccggccggtaagaaaactcaggcgctaagtatgctggcaaccggtaccgcgctggcgatggtgctgggcgtgccgattggtcgtgtggtgggtcagtatcttggctggcgtacgaccttcggcgcgattggcctttcggcactggtgctgatgattatgctggtgcgcatcctgccgcgtctgccgagtgaacataccggctcgctgagcagtgtgccgatgctgtttcgccgtccggcgctggtcagcatgtatctgctggtgacgctggtcgttaccgcgcattacaccgcttacagctatatcgagccctttatgcaaaccgtggcccattccagtggcaacttcaccaccctgctactgctgctgtttggctctgcgggcattgtgggtagcgtactgttcagcacactcggtaataagtttccctccggactgctgattgcggccatcgcgctgatcaccctgtgcatgggcctgctgatttttgctgccgtttcgccctgcggctatttcaacgctatgcgttgtctggggaatggcgatgatgatgatcggactgggtatgcaggtgcgggtgttgtcgctggcaccggatgccacggatgtggcgatgtcgctgatgtccggtatctacaatatcggtatcggcgcgggtgcgctgctgggtaatcaggtcagcctgcatctgagcatggcggaagtcggcaatgtcggcgggatgattggcctggtggcgttactctggtgtgtttatatcttccgtcgttatccacagttacgcagtaacggataataaaaaaggcttcagataagcgggttatctgaagcctgttcagggttatttaccgatcactttatctataaagaacggctgtgccatgcaggttgttgctgccagaggtcgaagtgatgcggaaagactttgctcctgcatcgctggccttttctgacagttgctgctccagcgaaagcagattagtactgcccgttgcgctgatgacaccgattttttgctgatccagcggtgtgctgctgacctgctgggccgctacgctggcaaatgacagaccgcttagcaccgccgccacgaccatcatattgatatttttcataacgaaccccttctcacttattctgttgaaatcaaaattactgataaatcacagccgtgccgtgcagtttgttctggccgctggttgaggtgatgcggaacgatttcgcacccgcttcatccgctttagcactcaactgcgcttcaacagaagacagattggtgccgcccagtacagaaatggtgccaactggctgctgattaacaggttcgctggtcaccaggtcagcggcagatgcgccaaaagtcagagtcgtcagtgccagtgctgccagggtggttttgatgtttttcataataatctctctattcaatattgaaattcggttggtctgaatgggttgtcactatttaattaatgaccgttaaacaaatgatagaccccgatacggtttgtcgtcaacatttatttaatgagcgttattttattcgcgaagtggcgtgattatgggcttcagcctcttttctgacttaacctaaggggctgtaataatgcgctggcgcacaaaatggcaacccctgccggcgacatccacgccaggccttgcacatttttataatgatcggtaatttaatagggtgttttactgtcagtgagggtgtatgagtcaggttcaggattgcgatgtaaagaaatgccgcggccgaccaaaagtgttcgatcgcgaagcagcgctcgataaagctctgaccctgttctggacgcacggttacgagggaacttctctggccgatctggtggccgcaaccggcgcgaaagcgccaaccctctacgccgagtttgttaataaagagggactgtttcgcgcggcgatggagcgctacgtggagaagttcagtgcatggcgtgaagcggcattgggcgatgaccagttaccggtggatcgggctattgaagcctatttccgcgccaccgcggcctgttttaccgaacgcgactctcccggcggctgtttctttatctgcacctcaaccgccctgtcggcggcttcagcagagattgccaccatgctgcaacagcagcatcagtcgcaggagcatgtgttaaaagattttctgctggcgcgtcagcagcgtggtgaactgagtgcgtcagtaaacattcccgcgctgtcacgttatctgagttgtatgctgcagggcatgtcggtgcgggcgcgtgaaggcgttgagcgtgacgatctggagagcattattgatacgctgatggcgatgtggccgacactcaccggcctgtgtcaggctaagcgttaaaaatatcagggcggcgatgccgcccttttcatcttttattcccgattttattccagaaagaaaaccggttttaacggctcactgatcgggctgttatctgcattagacggcatcaaatctttcattgatgcccaccagcgctgacagacctccgtttccgccaccgcgttccagcgctcctcagattcaatctcaacactggcgaaacagcagatgccgctcggcgtccagccagatggcatagttatgcgcgccgtgcgctttcagggtttcggccagttcaggccagatcggtgagtgccgacgctcatactctgcatggcaataaggattcacctgcatcacaaaggctttacgcagcattagcaggccctgcatccagcgccggttgccacggcttcacaccaaagcgctcacccaatgcaaccagctgttctgtggtgatactctgacgaataccgcccatcgacagcactttgacgatcacttctgacgatttctccgccgtatcaatcagaccaaaagtctcatcgagtgtcgggcccgtgccaaagacaccgtggaatggccacatcaccagggtatgtgactgcatctgtccggcggtcgcggtgccgatttcatcggtgccgggtaccatccagggtaaaacacccacaccgtccgggaacaccaccagacattcggtactcccttcccacagcaggcgggtaaagcgggcggaatccatctcaaccacatagcttaaggccataaagttggtggcgtgacagtgcatgatcacccggtctgcacccttgctgaccgctttacgcaccgcatgagactgaaagtgtgacgccagttcagaggtcggcaaaccgccattcgacaggccccagtgaattttataagagagccctttgtcatcgacctgcagcagtgccagacaatccgccggatcaagctggacattacgcatgaattttcctgacccggtcaccagaaaccagtcgttcgccagcgccggcgcaggttgtgtcagctcaatacagcgcggttgcaggcagaaatcagcggcaaatggtttaacctcctcttccagcagacgcaggctgacgttgccgccgttacgttcgtcccagcccttcagccacatatcgctggttgctttgaccattcccttaacaaacccggaagaaagaatgctttgcatagtgaaatccttaacgttggctcaaaatctgttgttcataatggcggacgtcgcctaaccagctggcatcagccgggacgtcatggcgcaggcaccaggcttcccataccgcctgccacggcaatgatttttgctcttccagcagcgtcagccgcgcggtgtaatcaccctcgttctcggcctggcgcagacgatcggttggctccagcagggcacgcagcagcgcttttttggtgttacgggtgccgataacccaggcggcaatccggttgatagaggcgtcgaagaaatcgagtccgatatgcactttgtcgaacagttgatggcggacgatctcgctggcgatcgcctgagtttcatcatccagcagcaccacatggtcgctgtcccagcgcaccgggcggctgacgtgcagcagcagatgcggcacatagagcatcgcggcagaaattttgtcggagatcacttcggtgggatgaaaatgtcccgcatccaggcatagtgccgtctggcggctggcggcgtaaccaagataaaactcattggagcccacggtgtagctctctgcgccaatgccaaacagcttgctctcaaccgcgtcgatatggtgctgcggattcagtttttctgagatgacctcatccagtgcgctcatcagacgctgacgcggggccagtcgatccacggtaatatctttcatgccgtccggcacccagatattcatcactgacggcgtgccaagctgctcaccaaacgaagcggagatgcggcgactcgctttgcagtgatcgatccagaactgacgcacggttttatcactgtgcgacagcgtaaaaccgtcggcactcatcggatgcgagaagcagctggggttaaaatccagccctaagttgtgctctttcgcccaagcgacccagttggcgaaatgggcaggttcaatggcatcccgatcgactggcttgtcactttccagatagatagcgtgcaggttcagacgttttgcgcctgggatcagagacatcgccttgtcgatatcgctgcgcaattcactggcattgcgtgcccgccccggatagttgccggtcgcctggatgccgccagtcaatgcgccctgtgggttctcaaagccccggacatcgtccccctgccagcagtgcatcgagacaggaatgctgtccagctggcgaatggcctgttcaacatcaactccattgtcagcgtagcgttgtttagccagttcaaaagcctgttcaatctgcttagtcataagcgggttccttagcgggttgactcagcgtcgcgaagcgtgcctgactggcactgaagacgctgtgagtttgcggttcgaatttttccagtgggaagttgttgatgacgctgcagcggaaatcagccacatcgatcagttcgccaagtgcaatcagctggcaaccaacgttacccagcgtggaggcttcaaccggacctgccagcaccggaatctggcaggcatcggcacagagctggttaagaaaacggttctgactgccgccccctaccacgtgaagctggctgaaaggtttgcctcgcagctctgccagctcctggatcacctcgcgatagagcagtgccaggctgtcaaatatgcagcgggccagcgcggcggcagattgtggcaccggcattccctgctctgcgcaggcgttctgaatctcgttaaccatgctgtcgggattgatgaagcgcgcatcattgggactaatcagtgaaacacaggcgggctggcgggccgtctgatcaatcagtgcgctgagatcgtcaatctgcagttcgccgcagatgcgctgcaacagccataagcccatgatatttttcagtacgcggtagccttctgcgccgccctcattggtgatattggcgcgtaacgcgccatcgcaggcataaggctgcaaactttcaaagcccatcagcgaccaggttccggaactgatataggcggcatcgtcctgcatcagcggcgttgccagaaccgcgctggcggtgtcgtgggtggcgacggcaatcaccgggaccgggacacctgcgctattgacccagtggccgacggtgttgcccggtgcctgcggctggccgaaccattcagaagcaacgcccgcccaggcgagcagatcacgatcccattcgccgctgtgaatattgagcatttgcgtagtggtggcgttggtgtattcccagttgagattaccggtcaggcgataatgcagatagtccggcatcatcagcgcatgcgccacgcgggcctgccagtcgggctgctgctgatgcagggcgcgcatctgatagagcgtattgaatggcaggaactgaatgccggttcgggcgtagatggcactgcggctcagttcgtgctgcgcctgctccatcaggccgtgggtgcgcgcatcgcggtagctgaccgcctcacccaccggctcgccctctgcatccagcagcaccatatcaacgccccaggtgtcgataccgatactgtctggcacgatcttctcttcatctaactgagccagcccggcgcgtatctcctgctcaagcattgtcagatcccagcagtcataaccggcacgacgctggcgcttatttttaaagcgccggacctcacgaagcgcgagctggcgctgcgcagcatcccagcttgcgagcatgacccgcccgctggatgccccgagatcaatagcaacaatgtttctcctggtcatggcgacttttccctgtgattgagtggtcacagagtaaaaacctggccggttaaagaccttccccggagtgccagcggctgataagccctggcagacttgcaaagaacttcgtgagagagatcacagaggcgaaaggcaggaggatgtgacccctgccgcaaatctgttaactgctgaggatttcttgaaaaatcagcatgattcctgctgagtcaggctgaaaattcaaggtaaggttagagcgtgctgattagactgcgttacggttttgttaagcagcgagagatgaccatgaccatattgcacagtgcggattttttccccgaaggcgattacgccattgcgattgaaccccgcgtaccccaggccgccttcccggaacatcatcatgatttccatgaaattgtgctggttgagcaaggctctggcattcatgtgtttaatggtcagccacaaacgctgtgcgccggttgcgtctgctttgtgcgcgatcacgatcgtcatctttatgagcagaccgacaacctttgtctgaccaacgtgctttatcgcagccccggcgcgtttcgctttctctccgggttacaggctttactgccctgcgatcaggacgggcaatatgcttcccactggcgcatcaatcaaaaggtgatgacgcaggcgctgagtgtggcggcgcagatgcagccggatgatacctggtcgatggaaaaacaggcgcgccaggaacagctctttttacagttgctggtgctgttgcgtgaggcgtgcattgatggacagagtcaggatcaggaggcgcggctgcatcgtctgctcgactggctgggtgagcattacagtgatgagattatctgggatgaactggctgaccgcttctccctgtcgctgcgtaccctgcatcggcaaatgaagcagcaaaccggcagcacgccgcagcgctacctgaaccgtgtgcgactgttgcaggcccgtcatctgctgcgtcacagtgatatgcgaattaccgatatcgccttccagtgtggatttggtgacagcaaccatttctcaaccctgttcaggcgcgaatttggctgcgcaccgcgagcggagcgccagcagatgatgtaaaggagccaatcatggcgttgatactcagtcgggatgactattttcccgccactactctaccggtggcggtcgccgaaaggatgccacaaccctctttcccgccgcatcgacacgagttcagtgaaatcgtgattgtctggcgcggcaatggcttgcacgtcctcaacgatcgcccctggctgattacctgtggcgacgttttttatatccgcgacagtgactgccacagctacgacagcgttaacgatctggtgctggataacatcctctactgtcgggatcgctttggtcttgcccttgactggaatcagctgctgccgcaacagggaccggatgcgccaggcggctggcggctgaccacgcgagggatggcgctggcccggggagtgatcagccagctggagcgtgaaagccgcaaaagcgaccccctttcagttcagctctcggaggcgctgtttttacagctggcgctgattctgcgccgccacggctacgcggccgaccgcccctgggcgttgccggagggggaacagctcgatctgctgatgtcagcgttacagggtgcgattgcccgcccctttgatctcgcggagttttgtcagcagaaccagctcagcgaacgggcactgaggcagcttttccgtcagcagaccgggatgaccatcggtcattacctgcgtcagctgcagctctgtcaggcaaaatatctgctgcgcacccaggattgtctgattagtgaggttgccgcccgctgcggctttgatgacagtaactatttttcggtggttttcacccgtgacaccggtttacctcccagcgcctggcgacagcaatttatcgcgccacgccaggcactgaaaagtgccgagtcttaataaaacgggccttcattgaacgctgtcgagcaatttactgcacaaaagcagcaataaatcagctaaaaggcgcagggaacacgctcagaagaggaaagcgtcccgcaccatggacaaaaacgccgggagcgtttttgaacaacgcaacgcgttggcccggctacgggcgcatttcagggatgaggtgcgtaatcgtgcgggccgggcatgccatggatggcggcttttgcgtctttccgatctgaccgtgttccctgagcgggcacgatctgaccgccattctgctaacgctaagggcctgcatagcaggcccgtttctgtattaaaacagcgtctctgtattcgcaatcaggccgccatgccaagtcccactatattggcggcaatgataatcaccacacagccgattgataacacgctgaccgggcgacgtcccgcagacttccactccttcatcagcagccccaccagaccaccacacaggacgtatagactcatgtgcagcatccagctgacatagtcatactgcgccgggattctggcatggccccaggcatagaagaagaactgcagataccacatggtgccgccgagcaccgcaaaagcggtattggtaatcagcagcgacttcccgaccgagaagtctttacgcaccgacagctctggccgggtggccagccgccagaaacagaaggccagattaaccagtgccccgccgcccataatgatcacgtagctgggcagagctacatacagcggatcgatgccaagattagcggcggcctgatgcatgggtttagccgcatccatggcaaaggacatccccgccgagaagatgccgcacatcaccgccagcatcagtccttttctgagattaaactcttctgcgttaatccccagcgcccgctcttttaacagcccggcacgcgacacaatcccgacgccaatcagtgccaccagtacgcccagcagggttaaccggccacccgccgacgcgaagagctcaccaaagcgcccctgcagaagcggtgtcatcagcgtgccgaccaccagggtaatgccaatcgcgataccgattcccatcgacatgccgagataacgcatggtcaggccgtagttgatattgcctatgccccacatcgcgccaaacagaaataccggcgtcagttgcgaaagcgagaagctgctgtaataggccataaaatctggcagtaaaatggcacttaccgcccacggcaggatcagccacgacatcaggccaccgatcgaccacatggtttcccatgaccatcttttcacctgtttaaaaggcgcgtagaaacacgcggcgctggcagctccgacaaaatgccagaagatacccgcaataatggcactgttcattgttattccccggttaggttgaggcctgtcggaaacctgtctgcttccgctcagcaggcagtctacgttcagcaggaattcctcagcctttggataaatgccggaagccacagtgaagtggcaatatttacccgttgtgcccatcagggatcacaatttcaccgttgtcagaaaaccggacgattagttaagtaagtaacttattattcaatgtttttttcatttttgctgtgtggcgcagcacaattctgatctgactgccattcacaagggaaggttggcaaatgtgctaagaagcctttcattaacgcgggcaaggtcgtataaactggggaaaattgatcggatcagggaatgggatgacgacaaagtggttaacgctgtttctttcgcagtcagtcagccaggtcatgctggatgatctgcgcgcgatattacctgcagatgcgataaaggtgtttgtgaatggcctggatgaaacccactatgccacccttgagtgtgtgcaggcggatcagcattgcgccctgatcgcctcagcgatagtggtctggcgtcagctcggacatgttcaccatattctctataaaaaaggtgaggtgttgcgggaggaaaatgatgcaacgcagttccagctgttcactctgctgaaaacccaccgcgccgtattgcagatctcatgataagatcgcagcccctgaaatcgctgtttgcagcaggtaaattatgagaattggaattctgtttccgatcgccatcattgtggcgggcgtgggctttctggcgtggtttattggcagtggcctggcgatgccaggctcctgaaggtcagcgcaactgactgtctttactgccccgacggttatataaactgctggtctgctgctgcttgtcgattttttcctgacacgccacacaatagtgcacgcctttaagcgcctgacgacgcgcttcgggaatcggctcgccgcagagctcacattcggtggcgctttcgccctgtccgatcgactgtcttacccgctcaatgccgtcattgacggtgctatcgatctgttcctgtactgcgccttctgacgcccatccatttgccatgatttaacccctttattaccacttcactcctttaaatctacaacatattgacgtttttgccgcagaactcaccgatatctgtgattggctgccagccgctcccggcagctggcaatcagctaaaggaagccctgagcaatctgtttcaccctgctatcacattactgcaacgtatcgatagcggagagctaagcgaatgacaacacatcatcaacatttcattaatggcgaatttgtagcccatcagggtgaccggtggattgaagtgatcaatccgtccacggaggcgttgctgtcccgtattccccagggcagtcgtcaggatgccagccttgccatcagcgccgcagaagtggctcagcctggatgggaagcgctgcctgcagtagagcgcggcgtctggctgcacaaaattgccaccgccatccgccagcgtgagcctgaaatgacggcaaccattgtggctgagggtggaaaaacccaggggctggcgaagaccgaagtgatgttcaccgccgactacctcgactacatggcggagtgggcgcgtcgctatgaaggtgagatcatcaacagtgaccgccccaacgaaaatatcttcctgttcaaaaaagcgatcggcgtcactaccggaatactgccgtggaatttccccttcttcctcattgcccgcaaagcggcaccggccctgatcaccggaaacaccatcgtgatcaaacccagtgagctgacaccgaataatgcggcactttttgccgacatcatacaaaagctaggcctgcctgctggcgtcattaactttgtttatggtctgggaccggaagtgggacaggagctggcagcaaatcctaaggtcggtctggtgagtctgaccggaagcgtcggtgcgggcattgccaccatggaagccgcggctaaaaatgtcaccaaagtgtcgctggaactgggtggcaaagcccctgccatcgtgatggatgatgccgacctcgagctggctgtgcgggcggtcgtcagctcgcggatcattaacagcggacaggtctgcaattgcgtagagcggctctatgtgcaggaaggcatttacgatcgttttatcagcgcactgaccgccgcgtttcagcaggtgacatttggcgacccggccgaacgcagcgatatcgatatgggtccgctgattaatgccgcagcacgggatcgggtggagcagaaggtggcagaggccgtcgccgcaggggcgaaagtggttctgggcggcaagcgcgccggagacagaggcttctttttccaacccaccttgctgactgaggtgcgccaggagatggcgattatgcaggaggagatttttggcccggttctgccggtgatgagttttaaaacgcttgacgaggcgattacgctggccaacgactgcgagtatgggctgacctcctcgatttatacgcagaatctgaataccaccatgaccgcgctgcgaaagctgaagttcggcgaaacctatgttaaccgtgaaaacttcgaagcgatgcagggatttcatgccgggtggcgtaaatcgggtgtcggcggtgccgatggaaaacatggtctggaggagtatctgcagacccatgttgcctatttacagttcagttaatcactggctcgatcttacctcctcccgtacctgacgttgtcagtaccagagtgggccagtaattggcccactcttttatgccacccgcttactgcagcgcagcagcgcgatgccactcagcaccgccacagccatcaggtagtatccaggcgccagactgctgccggtggcggcaatcagcatgctgcaaatcagcggtgcaaacccgccaaataccgtcacggccacgttgtagctgatcgccatgccgctggcgcgcgtggtcgccgggaagagatcggccatcaccgacggcaccgtggagaaatagaccgacttgagtagcgccatccacgccaccagcaggatcagcgtggtgggcgtagtgtgatcgaccatccatttgaaggcgggatagatcgtgaccatcaacagcagcagcgatccccacatcagcggcaatcggcctatccgctccgcccacaatcccattatgggcgtcaccaccgtcaggataatccctgcgaccagcgtggcggtgaaggccaccgatcccggcagatgcagcgttttggtggcgtaggtcggaatgtaattgagcatgtagttgaccgcggtcgagatcaccatcaccccaatcgccagggtgatcagcgctttctgccgcccgaacagcgttttcagcggtgcggcttccttctcctgcgtcgcaaagctggcgggctcctgcacgtgacggcgaatgtagatccccagcggtccaatcagtaagccgaaagcaaacgggatacgccagccccacgcctgaatctcgctttcgctcagccagtgtgtcagccccaggccgaacgccgatgccatcagagtactggcgccctgtgtggcgaactgccagctggcgataaaggctttgcgctcgggaaagtgctctaccaggaaagcggtggaactgccaaactcgcccccggcagagaagccctgaatcaggcgcgccaggataatcagcagcggcgccgccagaccaatagtggcgtaacccggcataaaggtaatgatcgccccgcccagcatcatcagattgattgagagcagcagcgcttttttacggccatgacggtcggcatagttgcccagcacgatggcacccagcggacggatcaggaatgagatgccgaagctgccgaaggtcagcagtagcgacaccgacggatcgctgaccggaaagaagacgtgcgcgatgtagctggcgaagaagccatacaccgcgatgtcgaaccactccagcgcgttaccaatgcaggtagcgaacagcgttttgtgcaggctcggtttcacctgcggagtactctgtgcgatgctgctcattgttcacctctccgccactgatggtggcgcgacatcagttgttcgccctcttcacccagttgccagaaaaggcgggtcatgatcgccagcccttcacgtgcaacagaggtgagcatgtgttcgttaacgccgtgctggccgcaggccggataggaatggggcacccacagcgtcgggaggccgaggatatcggcaaatacctcattgggcagtgaaccgccgagattgggcaacagcgccggttttttaccgctgctgcgggccagcgtgtccagcgcccaggccaccagcggatcctgcggatcgagtcgcgttgcaggtgaaccgcgcataaactctacgctgacgttatcgaagccgtgctgatgcaggtgactttcgacatgccggaccagattttcccagtcggtgccgaccacaaatcgcagctgacacaccgccgtggcgctgccgggaatggcgttcatcgggcgcgccgggttaccggtttcaaacgccagcacctccagcgtgttccagccataaagacgctccgcaggcgtcaggcccggttctccccagccgtcggccagcgccggatcgcccggcatgccgcccacctcgatatcactgaggatggcgcgcaccgcatcggtaagggagtccggtttcagtgcggcgacctgcaaaacaccctgtgcattcaccaggcaggcgagcgcattcgccagctgggtgccgggattgctcagcaatccgccccagttgccggagtgataggcgttgtcgcgcgccctgatagtcagacgaaagttcgccgcgccacgcgaacccaggaacagtgtcggccgcaccgcgttcagtcgcgggccatcagaggcgataaagaggtcggcctgtaacagcgcccgctgctgctgacaaatctccgccagccctggcgagctgatctcttcacccatttcaaacaggattttgcagttgaagcccagtgcgccaccgcgtgcctgccacacctgctccagcgccgcgagattgatgcagtgctgtcctttgttatccgcactgccgcgcccatacaggcggtcatcttcagccgtgagtcgccaaggtgataaaccgtcgcgccagtttctcatcgtcgccgaacaccacatcgccgtggccatagcagagcagcgtcggtctggagggatcttcaatgagcgtggcaatcagaaacggcgggctgccgggctgcggattctcaaacgggtgcagcgtaaagcccatcgccgccagctgcgggccaatctcctgctgcagatagctctccagctccacctgcctgctggcgtgctggctttcggtcacgcaggaaattcgtcgtgccagcagctgctgaaactcgccactgtcgaaatagtgcatcgcctggtcaacggtctgttgctctgtcatgtttgccctgtctgttctttttatcgtgctttatctttgacaaacttctctctttgccacaattattaatttatcgagtgagccttgcttttaaagcaagccacgcctgcccttttatgatgcgttttgccggagtgaccatgttaagcagtgagatccgctatttcctggcggtcgtacagtgcggatcgctcagcgccgccagcgagcagctctttgtggcggtgtcggcgattagtcgccagatccagcgcctggaaacgcaggtgggtgtgccgctgtttgagcggcatgcacgcggcatggtattgaacgaagccggtgaaatattcgcgcatcatgtgcgcaagagtcagctcgatatggaatatgcgcttgcggagattaaggggctgaaagcaatacggcgcagcctgatccgcatcgcctgtaccgacggaatggcgttcagtctgctcccgggtctgctggcggagttccgtcaggccaaccccggcgtgctgtttgcgcttaacgtgacgcactctcagggcgtggcggcatgcgtcagagctggtgaatgcgatgttgcgctgcagttcagtctgcaaccggagcgcagcgttgaggtgctcggctcgtggccggcgccggtgttactggcgatgcatcagtcacatccgctggcgtcgcgtcaggtgacgctggccgatctgcatggctggccgctggcgttgccaggtcagcatactaccgtgcggcagttgtttgacctctcctgtcagatgaacgactgcgtggtcgagccggtgctgacctgcgactatttcgctacgctctaccactttttgctgcataccccgcaggcagtaaccatttgcagtgcgtttaccctgttgtttgagcgcgacacgcaaaatctggtgttgcgttcgatgggggtggatcagctgagtcagcgtacgttgcagcttcagacggtgtccggccgccagcggaatgcggcgctgacgctgtttctgcattttttgcagcagcggctaacggagatggatcagcaggtgaggatgggatgaggggtacagggttgtgggttaaccagctcggtaccagattgccatgtgattcaggttgctaagggaatatgggttaacgtcctggctgcttccgtgagagggtgctggctaaggaacacgggttacgtctgcaccgattcgctgtgagagggtgccggcgaagggaacacgacccgatcggaaagtcgcaaaagccgacctccatggcatgcccggcccgcgcgattacgcacctcatccctgaggtgcgcccgtagccgggccaacgcgttgcgttgttcaaaaacgctcccggtgtttttgtccatggcgcgggacgctttcctcttcggggcatgttcccttcgcattgaacttatttattgctgtcggttctttttaagctgagccagacagcagaggcccacatgtgtatgcgcccctgctgatagctgttaccgtttactgcttaatatcaacctgatagaagatgtgtttgccgaacggatcgacctgatagccgctgaccgatttgcgcaccggctcaaagatggtggagtgcgcaatcatcaccgcaggcatctggtcatgcatcatctgctgtgcctgcagataaagcgcggtgcgtttgccctgatccggctcggcgcgggcttcggtgattaacttctcgaacggctgatagcaccattttgaagagttggaaccgccctgtgccgaggtacagctgtaaagcgggccaaagaagttgtccggatcgccggtggcggtggtccagcccatcagtgccgcctgatgctcgccgctgcgcacgcgtttcaggtattcgccccactcatagctgacgatattggctttgatgcccactttagcccagtccgactgaatcatctccgccatgcggcgcgcattcgggttgtaaggccgctgaaccggcatcgcccagagcgcaatttcggtacccggtttcacacccgcctgttgcagcagggctttggccttctctgggtcgtagtcgtaatctttcagatctttgtcggcgctccagacgcccggtggcaggatatttttcgcaaccgtgccggtgcctttaaaaatcgcctcgattattgccggtttgttgatcgccatcgccagcgcctggcgcactttgacgttatcggttggcgctttagtagtgttaaacgccaggaagccggtattcagacccgccttctgttccagggtgatatccgggttagcgcgcatcttttcaagatcggcgggattagggaatggcattacctgacactcgttcttctccagcttggcatagcgcacggaggcatccggcgtgatgctgaacaccagccgatcgagcttcgccttgccctgccagtagtccaggaacgctttgtagagaatgcgggaatctttctgatactgcaccagctcaaacgggccggtgccgatcgggttcatatcgaccttctccggcgtccccgctttcagcatcgcgtctgcatattccgccgagtggatcgaggcgaagtaccaggcgagatcggcaaggaaacggcgcttccggatgggacagcgtaaaacgtacggtgtggtcatcgacccggtcgatacttttaatcagcgtggagagctccaggctttcgaagttggaataggtgccgccagagacattgtggtagggatttttagggtccatctggcgcataaacgagaagatcacatcgtcggcgttgaagtcgcggctgggtttgaaggctttattgctctgaaacttcacgttcttgcgcagatggaaggtgtaaaccgtgccatccgggctgatttcccagcgttctgccaggctgggcaccaggttggtggtgccgggcgtgaagtccaccagccggttgaagaccggcaccgcactggcgtcaacgctggtccccgaggtatagagctgcgggttaaagttctctggcgatccctcagaacagaagaccagcgttttggcgttaacgctgccagccagcgctatcccagccgtaacaagcgctaaggtggctatcttgattttcattattatcctcgctttgtattgacttccggtgatcacaatatctaaatgaatcattcagatgcttcattgatagcacgattcggcaccataacgaaccccgccggtggctgactaataaggaatagtgatgacagacaaacttgagtcgcagctcacagaacgttttttccgttacctcgccatcagcagtcagagcgatgccaaatccaccaccctgcccagcacgccgagccagcacgccatggcggaactgctggcggatgagctgcgcgcgtcagggctggatgaggtggtgattgatgagcatgccacggtgacggcggtgaaacgcggcaaccggcctgacgcgccgcgcatcgggtttattacgcatatcgataccgttgatgtcggtttgtcgcccgatatccacccgcagatcctcacctggcagggcgaagatctctgtctgaatgcagagcaggatatctggctgcgccgcgatgaacatccggagatcgtgccctacgtcggtcagcaggtgatcttcagcgacggcaccagcgtgctgggcgcggacaacaaagcggcggtcaccgtggtgatgacgctgatggagaaccttaacggcgaccacggcgacatcgtggtggcctttgtgccggacgaagagattgggctgcgcggcgcgaaagcgctggatctggaaacgcgctttaatgttgatttcgcctggaccatcgactgctgcgaactgggcgaagtggtctatgaaaacttcaatgctgccgctgcagaaattgtgtttaccggcgtaccggcccatccgatgtcgggcaaaggggtgctggtcaatccgctgctgatggcccatgactatatcagcctgtttgatcggcagcagaccccggagcacactgaaggccgtgaaggctatatctggttcaatgagattcaggccaacgccagcaaggcgacgctgaaggcctcaatccgtgattttgatctgaccagctttgcggcacgtaagcagcagttgcagcaggcagcagaggatctggcggcgcgttaccccaccggcaaggtgagcgtgggtatcagcgatacctacagcaatatcagcaatgccctgggtgaggatcgtcgggcgatagacctgatcttcagtgcctttgccgcgctggagattgagccgaaggtgattccgatgcgtggcggtacagacggtgccgcgttgtcagccaaaggtctgctgacgccgaacttctttaccggcgcgcacaacttccattcacgcttcgaatttctgccggtaacgtcgtttgtgaagtcctatcaggtggcggaaaaactctgttatctggcggcggaataagcggaggaatcgggcgcagaaacgcgcccgattgcgattatggcttcgcgctgacatcaatgcctgggaaatatttttcagccagctttttgatggtgccatcgccctgcactttagcaatcgccgcatccagtgactgcttcagctgcgcatcatctttgcgcaggccgtagccgatgcctgaaccaagaatcgcgtcatcttcgactggcttgccaacaaaaccaaagcctttgccctgcggtttatcgaggaagccagactgaccggcagcggacatcaccagtgtgccatccaggcggcccgcgaccatgtcgttgtaaacctggttttgatcctgatacgaggtcacggtcacaccctgcggctcccagtgcttcttggcataggtttcctggatggatccctgtaatacaccgatgttcttgcccttcagaccttcggcggtcggtgccagattttcaccggtcttcgccactaacatggtcggaatacggtagatcggctgcgtaaacgcaatgcttctggcgcgcgcttcggtgatgttcatcgccgagttaatggcgtcgaactttttcgcctgcagtgccgggatcagcgcatcaaaactgctctcaacccagtggcagctgaagttgcccgccttacagatggcattgcccagctcgatatcaaagccttccagttcccctttagcattgcggctttcaaaaggcggatattgtgactccacgccgtagcgtaaatcctgtgccagtgcctgtaccgatgtcatcatgcccagagcgagaaaaagcgcgttcagtttcttcattatgtcatttaccccgaaaagtcctggttacctgttccccgagctgcctcacgcggtggcgtgaatcagcgagaaaaagcacatagcgcagccgcgccagcctcaagtgtcgcctcgtctttagcaaaagagagccgaatcagtttgttatctgtgccatccatataaaacgccgacagcggtatggtcgccacaccgtgatcgacgataagacgttttaccatttcactgtccggttcgtcactgaaatgtccatagctggcgagcataaagaacgaacccgcactcggcagcagccggaacggggagttctgcatcagggcgatcagccggtcgcgcttctgctgatagaaggcgctgagcgacagatagttctctggcgtctgcagatagtgtgcgaaaccgacctgcatcggcgtatcggcggcgtacatcataaactgatgcactttcaccagctcagtcatcagctctgccggtgccagacagtagcctacccgccagccggtgacgtggaaggttttgccaaacgaagagacaatgacgctgcgggctgccagttccggatgcgtcgccatcccacaatgcgggcggccatcaaacagaatatgctcgtaaacctcatcggagagcaccacgatatcggtgttgcggattaaggctgccagctgattcaggtcgtcgggggtcagcacctgcgcgctggggttatgcggcgtattaataatgatcatccgggtgcgcggcgtgattgctgcccgcaactgatcccagtcgatagcaaatgacggcacctgcaacttcaggccaatcggtttaccgccctgcaaccgcaccaccggcgcgtagctgtcaaacgccggttcaaagaagatcacctcatcgccctgatgaaccagcgcggtaatcgccatatagagcccctggctggcgctgccggtgatcagcacttcactggcggcatcatattgttgtccatagagcgcctgcactttgctggcaagcgcgtcgcgtaaggcgggcaagcccatcatggcggcatactgattatgtccttcctgcatcgcgcggctgactgagtcgaccagcgccggatcacaggggaaattgggcgcgccctgcgacaggttaatcgcctgatgctgcgccgaaagctggccaatcacgctgaaaatagtggtgccgacgtccggcaattttgagtggatagcgacaggcgttttcagggacatactctctccgtcaggggcttaaccgctcagatgcggtaaatagctattcaacgggctgcgacttgagtcggcaagcgaaatgtcgtcataatagccatgacaaaaatgcatagctgaggttcaccgtgtcacgcttatcgctgccgcttaatgccattcacgcctttctggtgaccgcccgacatctcaatctgacccacgctgcccgcgaactttgcctgacgcagggcgccgtcagtcgtaagattgccgccctggagcagtggctgggcgtgacgctgtttgaccgccacgcgcgcggtctgcgcctgacccctcagggcgcggcgctgctgcccgacttacagcagggttttgagctgatggttcaggccagcgagaaggtccgccgtagtcaggtcagcattcgcctgaaagcgccaacctgtgcgatgcgctggctggtgccccggctgatggcgctggagcatcatcgtcctgaactgcatgtggccctgaccaccacgctggatcatgccgcgcagctggagaacttcgatgtggcgattgtctatggtaagccgcaccctgacggaatttgcctgttcagtgagtcgctgacgccagtgatggcagccgatcaaccccgcccggactccccggcggcactggccacaatgacctttttgcatccgacggcagatacgcgtgactggcagtgctggctgcaggcgcagcaggtgacactgaacatgaagcggaaccagcattttgccaccatggacttagcgatcagtgcagcgattcaggggtttggtgtggcgatggccgacagcaatctggtggagagtgatatagccagcggcaggctgattaagccgttcgctggcgaggcaaaaaccggtgcggtttacagtttactgaaacggcccgcgcaggatgcgccaccgttcctggcggagctggtggcgtggctgtgcagggatcagaaggtgacccagtcgccgttatccgccggtttagcctgaggcgcattcagcacggttgctttcggcgcggcaggtttattcgtgatgaccggtgcggtctggcggttgctggagagacggaacttcgacacagaagcctgcagcgcttccgtctgcaatgccagtgcgctcgccgcggcagaaacctcttcaaccagtgaggcgttctgctgggtcacgctatccatttcggttaccgcagcacccacctgagagatgcctttgctctgctcttctgaggcggaagcaatctgtttcatgatcgcatcaacatcctgcaccgatttcagaatattgttcatggtgccgccggtggtgctgaccagctcggcgcctttacctacacgctgaaccgaatcttcaatcagcgtcgcaatctctttcgcggcattggcgctgcgctgtgcaaggttacgcacttcagaggcaacgaccgcaaaaccccgcccctgttcgccagcacgtgccgcttcgacggcggcgttcagcgccagaatattggtctggaaagcgatgccgttgatcacgttagtgatttcagcgattttcttcgagctgcctgagatgccatccatagtgctgacgacttcactgaccagctgaccgccacgttgtgccgtggtggtggcggtttctgccagcaggctggcctggcgggcattatcggcgttgaattttaccgtggccgtcaactgctccatgctggccgcagtctgttcgagcgcagcggcctgctcttcggtacgtgaagagaggtcgttgttaccggcagaaatctctgcggcaccgcgcgagatattctcagtgccgctgcgaatggcgctgaccgcttcacgcaggctatcctgcatggcgctcagcagcggcaccagtttaccgacgcagttgcgtccgaaatcggataccggctgactcaggtcgcccgtggcaattaccgcgaagtgggtacgaatactttccagcggacggaccagcatcgccaccagatagcggtcggtaaacagcagaataaacaggccgataattaccgtgatggtaataatcgttttggtcatcgcggtgagatgatccacttcaacccgggttgcatccagcttttcagctgcgccctggctgaatttctctgcgctgatgccaaaggcacgactgagtggcggcgtgacgttattagcctgctgacgataagcatcaggcgaggcctgacgggccagctgcaactgtggcgtgacgcccgcatccagcagcttttgccagctctgaatcaccccatccaccacatccgggttcatcgggccgggtgccagttgtttaaagcgcgccagttgctgggtcatgctgtccagcgcctgctgcaccggagcataagcctcatcgttcagggtctgacctgcggctttgctttccatcacgcgggataagcgcgtgataacacgaaaatattgatcgttgcctttgctcagcaccgtcatttgctcaaccagatgacggtccacatcattcccttcgctgagcgcgccaagagagtgaatgctatacagcccgacgccgctccacagtaaacaaaacagtcccagaatagagagcatcactgcgcgaatggtaaaatttttgagcattcccataccaaaatcctatacacgttgacccgcaagcgtcgggcataggaggtttatcggcatgcgattgtgaagatgtaactgttttgttacctaatattttacagcgtccctaaggcaaatttcactttatagcctttttattcagcaggttaacctttaaaaagcagattaattccattcgcgcaatttgatggttagcaggctaaccatgagccactccttaaagcctgaccatacggctcattaatagccggaaaagccgcatacgggcgcgcataaagttccgcttcagaaccagcccgctcttccgattatcaccaagtgacatcgtcacgtcagagcccgggtgccaggctggccacacgacttccccctccagctgatgcttatattccgtagcatcacgggcaaaggtaaaccagtactcgctgacccgtgccgcaaatgcccgatcggcctcactgaagggtcgttcttcgttgggatccggcatctgactcagcgtgttcagcacataaggcacttcgttgccgtgccaggtgccgtgcggatagaggtcacgggcatgttcagagacataatcaaaccagtagcgccagcctggcattccggcattgtgctgcgcccgcatcaccagccacggcaccaggctgaaggccatatcgcgcgccacggcacgtcccagccgctgatcgtcatgaatgtcatacatccatttcagcgtccggtaagtgagacgatttttatcgcgtagctgatgcaacactgcggtggcatccacgccaaaatattccagcacgctggcttcatcgctgttgctgcccgccatcagcggcagacggtgctgttttgcagccataaaggttttcagcatcggctcaggcagaacagcgtcacccgcaatcggcaccggcgggatcgccagcggcccttccagcgaccagaaggcatcggcaggcagtgcgcgcaggtcatcagcgctggcatcgggcggcagaccgaaatggcgggccaccgccataccctgctgacgcgcttttttcagcggcgtatcaggcaggctgtaggcgctctgcacaatccctttatgaaacagcccttcggccagtggcgaacagcagagtgacagcacgctgcgtgcgcctgaggattcaccgaaaagtgtcacattgcggcggtcgccgccaaaggcaggaatgttgcgctgcacccactgcagtgcggcaatctgatccagcaggccaaaattgttgaccgtgctggcaacagggtattcagcatccagggccggatgagagaagaaaccgagatggccgagccggtagttgagcgtcaccaccaccgcgccgcgtgaagccatcggcttgccgttgtaaggtgccagcccgccagcaccaatggtgtagccaccaccgtgcagccataccatcaccggcaggggtttcacgggcgcgacatcgggcgtccagacattaaggtagaggcagtcttcgctgaactcacccggatcgccaccgcccacggcctggcaataagtgcgattttgccagccggaagccccaaacgcggtggcgtcgcgcacctgctgccagggcgtaaccggctgtggcggacgccagcgcagcgcgccaagcggtgccgccgcataaggtatgcctttgaatacgaaaaggtcatcgtccatgcatccacgcaactccccctcagcagtcatgatcctcagacctgtttcgtttttcattcctgtttccctgttcaaacgtccctccattatttgcaggcccgccagcattgtccaggtacggaagggatttgcagaatatgccgaagcgtgaggggcaggcgtgaacatgctcatcaacaggttcagagagtcagttacggttatgattcaacgttgtttatcttttcgcaattggtcaatgacgctgccagcgccggagtggcgcgtcgttgctctgttatcacgtgcggttgtgcggctgttaatcagtcagcctgctaatagattaagatactcacgcgggtaaacctgcgctgagcggtaaagcgttgtttttccccagtcctgtcagcatattacccgcgttgccccacttcaggtccactggccttagcagggcgggtgcggagaaagcgttgcgggcaacgcgcctgttgcccgcagaggcgtcagtctggccgtaagccgcactgcgccagcgagcgctgctgccgctctccgtatagcgccatctcatccagcacgacagcgcccagcgcggcttcaaatgcctggcggctcgcctgtcccgccgaacgaacctgcgtccgatcgccgaggttggactgaaaaatgcccgccgcgctgacgggcagaaaatcttcgtagatgatagggtctgccagcacacgaccttcttcgatgagggtctccagcgattcaccctgagccggcggcgtcgcgatgcccttttcactcaggcgaaaatggaaccaggccagctcctgctggcgcagcgtggtttcgtcgtcggggaagtcacggaaaattgccgccagatgttgctgatgctgctgattatcctgaccgctgcccgcctcgctgagtagccgatcgtagagcgcacggccttgaggcgtcagcgccacgccgcgctgctcaatttcaccgaagcgtgcagtatgggttccctgatgcccatccttaaagatgatcggctcttccagcgctttaaagctggtctgacgtaacaggatcggtacctgacgacgcggtggtccctcgatcagggttttcggatcgataccgcgcgacggcatcagttgctgtacgcggtcaatatcgagcgtgcgcggcgtgagatggttgatgtggcagccgggaaagcagactacgtcagcgatcagccgatgctgctggttcagcgcctgataggtctgactgtccacgctgctatgggcatgccagcggaaggtttccagtgcttcggtaacaaactcagtggcctgctcgtcggttaatccgccctgctgctgatgcagttccagaagcgcccggcaacggggggtgaaaatgtcgcgcgcggcaagaatctccgccgctttttcacgcagcgcgtggtcgtcgattagttcagggcgtaacagcgaggtaaagacccgaaagggattgcggcgcaacgccgcatcggtgatcggccggaaacgccgtggagtgaaccggcacaccagcctgagagagatcgtaatagccaaccgggtgcattcccatcaccgcaaacagctgccgcagtgtggctaattcgtctgccgtgcccacacggatcgcaccgtgacgttccaggttgagtcggtcgatctcatcggctgcggtgagacgatctttcagcgcgatatccgcttccagcgcgcggtcgttgacggtcgccaccagttgcatcagcgtgccatattgtggcacttcctgctgatacatagctgacatcgcctgagagaaacgggtgcggatgagatccgcactgagaaagttgtccatcttatccacctgacaccgttagcgttgctgctaatgtaatgcaacacgctggcctcagcggaaaaaatcacgaatctgtgatcggcttaaagccgtagcggttttttaacagcagcatcagggtggtgatcacagccggtattgccagcagcagaaagattacgctgaaagaccatccaagagacatcatctctgcgccaacaaaggcgcttaaaatcgcgccgatgcggcccactccatgcatccagctggaaccggtagcgcgggcgtgggtaggataatagctggcggataaggcattcataccggtattggccccgttgaaacagaagccactgcaaaaggcgatcgcactcatcatacccacttccgcgggtgaaaagcccagtgccacaataaacagcccgccgcagccgtagatcgccgccagggccaggttagcgttgaagcgatccatcatccagcccgcaaacagggagcccagcgtcccgccggcctgatacatcgcggtgataatcgccgcttcggtcactgacatgcccagggtgttgaccagcgacggcagccagctgccaatcaggtaaaccatgaacagccccataaagtagctgccccacagcatggtgctgccaaacagatagcggcgtgaaagtacggtgcctatcgcgccgctcaccggcatggtggcctcaggcgcgtgaaacgcacagtcgggcgcggttttgcccggcatcatccggtcgaggatggcgtgaatgcgggcagccggtgcgccacggctgataagaaatcgcaccgactccggcaggccgcggatcagtaatggcaacaccagcagcggcagaataccgcccagcagcagcacggagtgccagtcatagcgcggtaacagccaggaggcagcaaatcccccgctggcggcaccaaaggtaaagccgcagaacaccaccgtgatgataaaagcccgccgccgctcaggtgcatattccgccaccagcgtgccgacgttgggcatcgccgcacccagtcccagcccggtcaggaaacggaacagcatcatctgctcaatgttttgtgacagcgccgttgccagcgtccagagaccgaaaaagaagacgctgaggataatcatcatgcgacggccatagcggtcagccagcggtcctgcaaccatggcacccagcgccagcccgattaacgctgcgctgatgacgaccccgagctgatgattactcaccccccacgcggctttcagtgtcggcgcaataaatcccatgatcgcaatgtccatgccatcgagtgccaccacgataaaacagagcgcaatgagccgcttttgccagtggctcagcccctgctggttgataagctggcggacatctaccgcctcgacgctggtcaatgaacactcctctggagtaacgaaatctgacatcagtttaagtaaaaaaaacggcgctaatgatagccgatcgttaaccttaagcggtcagatttttatatgatattgagaattattcaactttaagctgttaagttattgatataccgtagtcagaggatggcgtatttcagcggcatacccggctgagcgctttttaatcagagagttaaagggtaacgcggtcatttcgactcgtttgttaaaataaatttgcagcaaagttaacagaattcattttaaacagttgcctgaagccggtcattctcattaagtttaggatatggaaaaaaatatccttttcaatcagcgcattcgcttgcgccatctacatacctttgttgcggttgcgcagcaaggcacactgggccgggcggcagagacgcttagcctcagccagcctgccctttccaagaccctgaatgagctggaggagctgactggtgttcgtctgtttgaacgtggccggctgggcgcgcagctgaccaccatgggagagcagtttctgacccatgcggtacgggtactcgacgcgctaaaccatgccggacagagttttaatgagcagccgggcgatgcgccggtgattatccggctgggggcattgaccactgctgcgatggggatgctgccacgcatcctggatcgttttcatcaactgcagcccaacaccaccattcaggtggcgacacttcacaataatgtgctgctggcgggcttgcgcggcggtgagtttcgacatcggcattggccggatggcggacagcgccatgatgaccgggctgacctatgaattgctgtttctggaatcgctcaagctggtggtcaggccggaacacccgcttttaagtgacaacgtcacgctttcgcgtgctatgcagtggccggtggtgatatcgcccgagggcacggctccgcgccggattgcacagcagatgctggatgaacagggctgcacccttccgcctcactgcattgagacctcttcgacttcactggcacgccagctggctcttcgctacgactacatctggttcgtcccttccggggcgattaaagaggatctgagccacaacgctgtttgtgcgctgccgatcgcctcttccgggccgggcgaaccggtgggcatcattacccgcaccggcgcagaaactgagcctgagtgctgaagtgctgatgtccaccatccgtaagtttcacagttagcggctgcgtttcgcatgccgctcgcggttttcaagccgggctttatcggttttgcgcaatccgacataaagcgccccggccccgccatgacgggtctgggccacgcaaaaggtctgtacgtcatcaaactgctttagccagcgcgccagatagctgcgaacaatgttggcatgcgattcatcatcacgacctttaccgtggatgatcagcagattgcgcaatccctgtttgtgcgcctgcatcataaagttaaagagcgcctgacgacaggtttcgaccggttgccgcaacaggttgaggctggcatccagctgatactctcctctgcgcagtttatccagaatcccctgctgaatgccgtcggctttatattccagcggggtattgagtggaacgatctccagatcgccccgggtcaggaaattctccagctccgattcacctggcggttttcgtggcgccttcgttgagggtgctttaagccacaaggttgtggtggtgtcttttaacggcgtgacatcgcccatggcatcccgaaagagatcattatcatcaaggttcatggttttctcacacctggttaaaattgatggaatgtgcaaatcacgctttacccgttagcgtagcaaaagctggaatcaccggcccaccccactttttcgaaagtcactgccagtgcagaagcgtgtgacagatcacataagcggaaagttttcttgacagtcggccctgtcgggattctgagaagcccgtcacatcagcgtttgtcgttgtgtgcttagtccataatatttgtaagtgtaaaactgctcggatgagttcccttcagcacaaaaaatgttaaaattgaccccagtcaataatcgtcgagcaaaccattatgatccctgaaaaacgcagcattcgtcgtattcagtcgggcggttgtgccattcactgccaggattgcagcatcagtcagctctgcatcccctttacgctaaatgaacatgagctggatcagctcgacaatatcattgagcgtaaaaaacccattcagaaagggcaaacgcttttcaaagcaggcgatgaactcaagtctctgtatgcgattcgctccggcaccattaaaagctacaccatcactgaacagggtgatgagcagatcaccggtttccatctggcgggcgatttagtcggctttgacgcgattatgggctccagccatcccagctttgcgcaggcgctggaaacggcaatggtgtgtgagatcccttttgaaacgctggatgatttgtcgggcaaaatgccggccctgcgtcagcagatgatgcgtctgatgagcggtgaaatcaaaggcgatcaggacatgatcctgttgctgtcgaagaaaaatgctgaagagcgcctggcggcgtttatctggaacctttcccgtcgttttggccagcgcggcttttcacagcgcgaattccgcctcactatgacgcgtggcgatatcggtaattacctgggcctgacggttgaaaccatcagccgcttgctggggcgttttcagaagtccggtatgctggcggtgaaaggcaagtacatcacgattgaaaaccatgccctgctggaagagctcgccggtcagagccaccaggccgcctgatcctcagccggatcaataaatcttattttgttgatccggcagtaactttttcacttcttccgctgtgcaacataggctatctttattccagtcgctctggtttaaggagaaacgcctcatgtcccagtaccaaaatgttctggtcgccattgatgcccagcaagacgatcagcccgcgctgcgacgtgcggtctatctgaatcaacgtcttggcggaagaattaaagccttcctgcctatctatgacttctcatatgagatgaccaccctgctttcgccggatgagcgcgcgtcgatgcgccagggcgtgatcagccagcgtaccgaatggatccgcgagcaggcccgcgcttatcttgatgccggtgtcgaaattgatatcaaagtgatctggcacaaccgtccctatgaagccattattcaggaagtgctcgcccatcagcatgacctggtgctgaagatggcgcatcagcacgatcgccttgagtcagtgattttcactccaaccgactggcacctgctgcgtaaatgcccgtgtccggtgtggatggttaaagatcagccgtggccggaaggcggtaaagcgattgtcgcggtcaatctagccagcgaagagccgcatcacgatggcctgaatcagaagctgattcgtgaaacggtgatcctggcggaaaaggtgaatcagaccgaagtgcatctggtaggtgcttatccgattacccctatcaatattgctatcgaactgcccgattttgatcccagcgtctataacgacgcgatccgtggtcagcatctggtggcaatgaaagcgctacggcagaagttctcgattggtgaagagttcacccatgtggctaagggcctgccggaagaggtcatccccgatctggcggcacatctgggagctggtgtggtggtgctgggcacgattggacgcaccggactgtcggcggcattcctcggcaatacggcggaacaggtgattgatcatctgcgttgcgatctgctggcgcttaagccggacgatttcaaatcgccgattgacctggatgatgaagaggatgaggaagattaatcctcctcagaaacagagagggcggctgattagccgccctttttttattacagcgctttgagaatcgcttccacgctggctttggcatcgccaaacagcatctggctattctctttgaagaacagcggattctgcaccccggcatagccggtgttcatcgagcgtttgaacactatcacgttgtgcgccttccacacttccagcaccggcatgcccgcaatcggactgcggggatcatcctgtgccgccgggttgaccgtgtcgttagcgccgatgaccagcaccgtgtcggtgtcactgaaatcgtcgttgatctcatccatctccagcaccacgtcataaggcactttcgcctctgccagcagcacgttcatgtgacccggcagacgccccgccaccggatggataccgaagcgcactttgatgccaagcgcacgcagtcgggcagtcatttccgcgaccggatactgcgcctgcgctaccgccatgccgtagcctggtgtgataatcaccgagctggaagccttgagcatctcggcggtctcttcagccgtaatctcacgatgctcgcccgcttcctgactttcatcgccactgctggcttcagtaccaaagccgcccgcgatcacgctgataaacgaacggttcatcgctttacacataatgtaggagaggatcgcaccggatgaccccaccagcgcaccggtcacaatcagcagatcgttgctcaacatgaaaccggcagcggcggcggcccagcctgaataggagttaagcatcgacaccacgaccggcatatccgcgccgccgatcgacgcgaccagatgccagccaaacgccagcgcaatcaccgtcatcagcaagagtgcaaacacctgcacagccgtgctgctggtgttaacaaaccacaacagcagcaggaaacgaaaccaccagcgccagcagattcagcttgtgacgatgcggtaacgctaacggccgtgaagagattttgccgcacagtttgccaaacgccaccagcgagccggtgaaggtgacggcaccgataaagataccgataaacacttcgctgagatggatattctccatcaccgctggcaggccaggcgcatggtcgatatagctgttgatgcccaccagcactgcggccaggccaacaaagctgtgcagaatcgccaccagctctggcatttccgtcatttcgactttcttcgccagacgaatgccgatagcgccgccgatgaccatcgccagcaggatccagaccacattaccgctgtccgggccaaatatggtggcgatcagcgcaatcgccataccgctgataccgaaaatattaccccgcttagaggtctcatgacgcgaaagaccagcaaggctacagatgaacagaatcgcagccacaatataggctgcagtgactaatccgccagacatgtgttaccccttacgaaacattttcagcatgcgctgggtgacggtgaagccaccaaagatattgatgctggcaatcagcacggcaataaaggagataaaggtgacccagccaccgtggcccatctgcaagaccgcaccgataacaatgatgccggaaatggcattggttacggacatcagcggtgtatgcagcgcatgactgacgttccagaccacgtaataccccaccacgcaggcgagcgcgaacacggtaaaatgggagaggaagtcggccggtgccacgtttgccaggcagccaaacagcacaatagccagggcgatcagcagatatttacgccacggtgaaacgggcttcgcctcaatcttttctgacggcttggcggcggcagcggcagcctgtggcgcggcggagacctgaatcggcggggctggccaggtcacttcgccatcgcgtaccacggtgacgccacgcaccaccacatcttcgaaatcgacctggatttcgccattcttctctttacacagcagcttgatcagattgaccagattggtgccgtagagctgggaggattgtgtcgccagacggctgggcagatcggtgtaaccgatgattttcacgccattcggcgtgacggtaacctggtcagcgacggtcagcgcgcagttgccgccggtctgcgccgccagatcaacaatgacgctgcccggcttcatgctggcgaccatctcttcggtgatcagtttcggagccggtttgcctgggatcagcgccgtggtgacaatgatatccacgtctctggcctgactggcaaacagcgccatctcagctttgatgaaagcctcggacatgactttggcatagccgtcgccgctacccgcttcctcttcaaagtcgagctcaaggaattcggcgcccatactctgcacctgctctttgacttcgggacgggtatcaaacgcccggacaatcgcacccaggctgcccgctgcgccaatcgcggccagcccggcaacaccggccccaatcaccatcacttttgccggtggcactttaccggctgccgtgatctgaccggtaaagaagcggccaaattcatgggcggcttcgacaatggcgcgataaccggcaatgttcgccatagaactcagggcatccagtgactgcgcccgtgagatacgcggcactgaatccattgccattaccgtgacctgacgtgcggccagctttgacagcagttcgggattctgtgcgggccagataaaactgaccagcgtgctgcccgcacgcgtcagcgcaatctcttcgtcatccggcgcattcaccttcagcacgatatcggactgccagacctgctctctgtcgctgagtgtggcaccggttgcgatatagctttcatcatcgaagctggcacgtttaccggcgtcatgctcaagggtgacgctgaaacccagcttgatgagttgttccacggtcttaggcgtggcggccacgcgcgactcgtttggcaacctttccttgggtattccaattaacatagtgtttcctttcatcggttaaaggatgatggcccgaaacctgcaccacgagagcgcgactgaaacgcgatttcagccgcttttggacgaaacgcaggtatttcaaagtgtttataacctactgaaaatgtgacgagcgatctacagcgactacgcagagtgatgacattcacccaattatgcagtgttctgttaagaaacctgcgttatcccactgcaaaatagtctcacaggcagataatctgccagagataattgtatccggacgaattaataaacaacaaaaacctttatttaacaacgcattaactattttagcgctaacagttaccgcttttagtggtaactgtcactaaaactggccataactgcgtttgatgacaaacaaatgaaaaaatcatggttgaataacgcgatctgacacaaaaaatcgctgcgacagtctgtttataacatgcaataatcagcggctattctgttatacatcaagagtccagcacgttttcgtactcatttttgcgtaaggcgaaggattatttttatgaagctgaagaacactattctggcgaccactctgttgtccctgctggcagccaacgcattcgctgcgcaggaacttacgccagaaaaagcggccgcgttgaagccattcgaacgtattaatatcaccggccgtttcaacgcaattggcgacgctgccgatgcggtatcaaaacgtgcagatcagatgggcgcggcctcttattacatccaggcgatcaacgacagcaacggtaacagcggtaactggcgcgttacggctgacctctataaagccgatgccccggcagccacagagtcaacgacttaccgtcgtttcaacggcgtaaacgaactgccaaaagcagaagcgtataaactcgaacccttcgataccgtttcggtcagcggcttctttgccagccagccggatgtaaacgacgcaatttcgaaagccgcaaaacagaaaggcgcagcctccttctttatcgtttcgccagatcgatgccaacagcggcggcaatcagtatgtcaccgcctatgtctataaagcggatgctaaagagcgcgcggtgcagacaccaaatgcgattcctgccgattcagaagcgggtaaagccgcactggcaaccggtggcgctgcggcggctaacgtagagattccaggcgtggcctcgtctgaaacgccaagcaacaaagtgggccgtttcttcgaaacccaaagctctaccggcaagcgctataccgttaatctgccaaacggcaaatcggtgcaggaagtgaatgccattactgctgcgcagatgcagccgttcgataccgtaaccttcaccggtcacttcggtacgccaactgagatttcagaagaagtggcgaagcgtgcggcggacaaaggtgctaagttctaccacgtcacccgccagtggcagaaccagagtggcggtaacctgaccgtcacggctgacctgtttaagtaatccttctcagggcggcgcctgccgccctgctgtttgcataattcctgcgctgttttgcatagtcacgcattgccatcccctgccacactccgtaaaatccctcgcctgttttaccggatattttccctgtattgtgcctttggtgtgacataacccagcgacagaatccgatttacccagccatatatgctagcgggaaggttgttttggagaaaaaattaggtctcggtgcgctgacggcgctggtgctcagctcaatgctgggcgcaggcgtgtttagtctgccgcaaaatatggctgcagtggccggtccggcggcgctgctgctgggctggctgattaccggcgtcggcatcatctttctgtcgctggcgatgctgctgctgacccgccttaaacccgaactggatggcggcatctttacctatgcccgtgccggtttcggcgagctgatgggcttctgctccgcgtggggctactggctgtgcgccgtgatcgccaacgtctcctatctggtgattgtcttctctgccctgagcttcttcaccgatacgccggaccggattatctttggcgatggcaacacctggcaggcgatgctgggtgcctccgtgctgttgtggctggttcactggctggtgctgcgcggcgtttcagaccgctgccagcattaatctgatggcgacgctcggcaagctggtgccgctgctgctgtttattgtgctggcggtgatggcgttcaactatgatcgcttccgctttgacttttccggcatcacgctggggcaaccgctatgggagcaggtcaagcagaccatgctgattaccctgtgggtctttatcggcgtcgagggggcggtggtggtctctgcacgcgcgcgccagaaaaaggatgtgggccgggctacactattcgccgtgctggcagcgttgctggtctatctgctggtgacactgctgtcgcttggcgtggttccacgtgctgaactggctcagatgcgtaacccctccatggcgggattgatgacccgactgatgggcaactggggcgatgcggtgattgcggtgggtctggttatctcggtgtgcggtgcctatctgagctggacgattatggccgctgaagtgcccctgattgctgcgcaacagggtgcatttccacgcagtatcgcccgacaaaaccgccataacgcgccagccgcctcactgtggctgaccaacggcagtattcagctctgcctgaccctgattgccctgaccggtgcgaactacaacaacctgctgaccatcgcctctgagatgattctggtgccctatctgctggtggggttatatctgatcaaagtggtacgcggacagcataaaccgctggcgatggcgaccggtatcggtgccagcctgtatggcatctggctgctttacgcctcggggccattgcacctgatgatgtctgtggtgctctatacaccgggcctgctgctgtttctgtttgcacgacgcggtggccgcgcagagtttgcgctgacttcgctggagcggattgcaatgggattgctgattgccgcgacgctgcccgccgtgtggcagttgacgacttagcgcctggcccggcaggcgtaatggttgcaggcactccggacccggccagcgcgaagcaacccggcgtacagatagtacgtgaggatggtgagcactgcccaggttcagactgagaaatcagatagcctgatgggaaaggctctcagtgcgactgcgcaggtattgagacacacagcaggtcatcctgctgtgtcagattcagcggtctggaatattcatgatggatcgcgtccagctgctccgccgaaagcggataaggaagctgaatatcgaagcgactaatctgctgttgttccgcaagggtaatcaggcgcgcgatattaatttcgtcgctgacctgagtagaaatgatttgtaatgctaattcttttaacgggtcgtcactgccctgtaagcggtgtgccgatttacgtgtcaccatgccaaatatcggcatcacaccataaatagcatcgacgaagctccagcgctttttgcaggaagcggagagaaagtcactgtaattgaagcagatgcggtcggggtatatggctgatgccagctctttatcagacacactaacgctcctcatgataatcatcaatatcccaaacctggcgcaaaaaggccgcgctaatgattgcacattttgccggttatataccagcaagctacggatatttcgtgcggtaacgtagagctcaggaccaggaaaagatatgcttccgtccatccctgtctctgctttgtgaactatgaacaaaattgtttatgtagaagatgaacccgaagtgggctcactgattgcggcctatctgggtcgtcatgatattgaggtgattgtcgagatgcgcggcgaccgtgctgaagcggtcattgccgaacagcagcccgatctggtgatgctggatatcatgttgccaggcaaagatggcatgactatctgccgtgacctgcgggccaactggcaggggccgatcgtgctgctcacctcactggacagcgacatgaaccatattctggccctggagatgggggcgcaggattacattctgaaaaccacgccgccggcggtactgctggcccgcctgcgccttcatctgcgtcagtcgcagcagggacagccggacgatgcgcccagcgcacccgccgccaaccgtatgctgcgttttggctcgctgaccatcgatgcgctgaaccgccaggtcacgctgtttgacgagcagatcgccctttccaccgcggatttcgatctgctgtgggtactcgccagccatgcgggccagacgcttaaccgtgatgcgctgctgaaaacgttgcgcggggtcagttatgacggccttgaccgcagcatcgacgtggctatctcccggttgcgcaaaaagctgcacgacagcgccaccgagccgttccgcattaaaaccattcgtaacaaaggttatctgtttgcgccccaggcctgggatacccgcggactatgagaaagctttttattcagttttatctgctgctgtttgtctgctttctggtgatggcgctgctggtggggctggtctacaagttcaccgctgagcgtgcgggccgccagtcgatgaatgacctgatggccagtttcgctctacctgattcgcagcgaactgcgcgagatcccgccacgcgactggaataaaaccatcaagagtctcgatctcggcctgtcgttcgatctgcacatcgagccgatgaacaaatatcagcttgatgaaggcaacatgcgtcggttgcgcgccggagagatcgtggcgctcgacgatcaatacacctttttgcagcacattccgcgcagccactacgtattgtcagtcgggccgattccctatctcttctatctgcatcagatgcgactgctggatattgccctgctgatctttatagggatgtcactggcgctgccggtgtttatctggctgcgcccccactggcaggagatgcagcgactggaaaaagcggctcagcgctttggccgtggcgagctggacgtgcgcacccatttcgacagcacctccagccttttccggctcggcatcgcctttaaccagatggccgagaacatcaatacgctggttgccagtaagaagcagctaatagacggtattgcgcatgagctgcgcacaccgctggtgcgcctgcgttaccggctggagatgagcgacaacctcacggatggcgaacgggtggcgctgaatcgcgacatcggccagctcgaaagcctgattgaggagctgctgacctatgcgcgtcttgaccggccgcgcgtcgatctcaatctgaaaacactggatttggccaactggctgcgcgagcggcttgacgatttccgcactatcaatcccgacgtgcggctcgaccttgagctgccgcagcgtgaaaacatcggcatttctgatacgcgcctgatggagcgggtactggataacctggtcaacaatgcgctgcgttatgcgcaacagcggctgcgcgtcagtttgtggttcgacggtccgatagggtgtctgcaggtggaagatgacggtcccggcattccgcctgaagagcgtgagcgggttttcgaaccctttgtccggctggaccccagccgcgatcgcgccacaggcggctgcggactgggacttgcgattgtgcactctattgcccaggcgctgagcggcaatgtgaccattgagtccagtccactgggcggcgccagcgttcgcttttgctggccggttgatctaaccttgcgggaaattccgctgcgttaaaaaccacaaggagtcttacgtgacctcagcgtatcaacaacttaccaagacgttccagcgcctttcccgtttcagtcacgtcacggccatcgccggatgtgacatgcaaaccaccatgccgccgggcggcagtcaggcgcgtggtgaagcgctggccgaaatgagcgtgttgcagcaccagatcctcactgcccctcaggttggtgagtggctcagggctgcagagcagcagtcactcaacgatgttgagcgggccaatctcaacgagatgcagcgcgcttaccagcaggccaccctgctgcctgatgattttgttgaagccaaatcaatcgccggttcggtatgtgaacatgcatggcgcactcagcgtccggccaacgactggcagggcttcgccgccaatctcaaagaggtggtgcgtctgagccgcgaagaggcccagcgccgcgccgacgccactggctgctcgcgttacgatgcgctgctggatctttatgagccggggatgacccgcgcccggctggatgaaacctttggcgaactgaaaacctggctgcccgctctgttacagcaggttgtggaaaaacaggcgcagcagactgttgtcacgccgcaggggccgtttcgccctgcctgctcagcgtcagctcggcctgagcatcatggaaacgctgggtttcgactttaaccatggccgtctggatatcagtgcgcatcccttctgcggtggcgtgccggaagatgtgcgcattaccacccgttacaacgagaatgagtttctcagcgccctgatgggcgtgatccacgaaaccggccacgcccgctatgagcaaaatctgccgcagcagtggcgcggccagccggtggcgctggcgcgctccaccgctatccacgaatcacaaagcctgtttatggagatgcagcttggtcgcagccgcgaattcctgcagcgcattctgccgcaggtgatcgccacctttggcgaccagcctgccctgcaggcggataattttgtgcgcctgacccagcaggttaagcctggcctgatccgggttgacgccgatgagctcagctatccggcgcatgtcattctgcgttatgaaatcgagcaggccctgattgaaggcgagattgaggttgaggatattccggcgctgtgggatgagaaaatgatgcagtcgctgggtctggatacccggggtaactaccgcgatggctgtatgcaggatatccactggaccgacggcgcctttggctacttcccgacctatacgctgggcgcgatgtacgccgcacagctgttccgctcggtacatcttgcgattcctcagctcagcgagctgattcagcacggtgagctgcagccggtattcgactggctgcaacagaacatctggcagcacggcagccgtttctccaccgaccagctgctgatcaacgccaccggcgaagcgctgaatccggctttcttccgccagcaccttgaacaacgttacctgaatagctaagctctcgggcggtcagctgaccgccctttcccgcctttgtacaatcggttacacgccgataccaaacacccacggacaccgttcattgatatccctatagtctcttcaccggccccgcagtgggctacacatgaaaaaatagtcttcgagggatttgcaatgaaaaaattatttgcactggttgtcgccgctgctatgggtatgtcttctgttgctttcgctgctgacaccacagctgctccagctgctgcgccagccgcaacaaccactactaccgctgcagcaccggctaaaaccgttcacaaaactgcgcacaagaaacaccataaagcggctcagaaagcgcaggctgctaagaaacaccacaaaaaagctgtgaaaaaagatgccgcgcagaaagcgcaggctgctaaaaaagttcaccacaaaaaagtagctaaacctgctgcacagaaagctcaggccgctaaaaaagttcaccacaaaaaagtcactaaaccagctgctcagaaagcccaggccgctaaaaaagttcaccacaaaaaagccactcagccagccgctcagaaagcccaggctgctaaaaaagttcaccacaaaaaagtagctaaaccagctgcacagaaagctcaggctgctaaaaaagttcaccacaaaaaagttgtgaaaccagcagctaaaaactaaggtcgccttcagcgcacggccacgagatgatgattaaaaacacccggttctgccgggtgtttctttactggagtggatgatatggtgcgtcgctatcgcttcgaaattattctgctggtgatgatcctgtgtggcattgttgcagcaagcttttttgtttagccgctgtagcgtactgattaaccaataaaactccctttttcaacgctcaccgactatagttaccgtacttacgtaataacaataacgttaattttttctcgccattgagatttctatgcgcctggctaccctgttaatggttggactcttcagctttgccaccacggttcatgccgatgatgacgatgactcgcctactcctgctgaaattaagatgctgttcttcggcaaggatcatcgccaggcaatcaccgatattaccgctgccccctgggatgccattggtcagctggaaaccgaaagcggcaacctctgtactgccacgctcatctctccgcatctggcgctgaccgccggacactgcctgcttgccccgccgggtaatttcgataagccggttgcgctgcgatttatggcgagcgataaaggctggcgctacgagcttcatgatattgatgcgcgggttgaaccctcgctggcgtcaaagttaaaagcggacggtgaaggctggatcgtgccgagcagtgcagccccctatgattacggcatcgtgattttacgcaatccgccctccgcgattacgcctattccgctgttcgatggctcacgcagcgaactcactgcggcgctgaagctgaccggccgcaaagtaacgcaggcgggctatccggctgatcatctggacacgctttactctcacagcgattgcctgatcaccggctgggcgcagcgcgccgtgctgtcgcatcagtgtgacaccctgccaggtgacagcggtttcgccactgctgctcaacagcgataaaggctggcagttaatcgcggtacaaagctcagcaccggcagcgaaagatcgctatctggctgataaccgcgcgatttcggtcacttcgtttaaagataagctggaatccctggcgcagtagtccgcactctcactcgccatcatcggatgcgcgcctgttacggcgcgcatcccggcgtttaacccgctatctgctccatcatctgcagaatacgcttatctgagatgggataaggcgtacccagctgctgagcaaagtaactgattcgcagctcttcgatcatccagcggatgctctgcacctcttcatcatcctgacgctgcggcggcaacttgttgcgccacgcctgataagcctgttccactgcctgtacttttaacatccgcgcacgatcgctgtgcggatcggcaggcagtttttccagtcggcgctcaatcccatgcagataacgcagcgtatcggccagtcgctgccagccgttgccggtgacaaagccgcgataaaccaggccacttaactgcgctttgatgtcagataacgccagcgccatggtcatatcgacccggcccttcagacgcttattaatgttgaagactgccgtcaggatctgctcgacctgcttcgcgatggtcaccacggtttcattgagttcgcctcgcactttgtcacgcaactgctcaaacgaggtttgatcccaggccggaccgcccgcttcccccatcagcttgtcgatgccacaggcgatgcagtcgtcaatcagctccagcactttgccataagggttaaagtagagtccgagcttggctttgttcggcagcttctcgtgcagatatttaaccggtgacggcacattcagcagcagcaggcgacgctgaccgcgccacatcattttttgctgctcctgctcgctgtcaaacagacgaatggcgacgctctctttctcgtcgaccagcgcaggccaggctttaacctggtagctgccgcgcttctgttcataactgcgtggcagatcgccaaaactccagatatgcagcccactctgctccagcccgtcatccgccactttcgacagcgtttcctgcactttgtctttcagctgtgccttaagcgcagtgagatctttgccttccagtagcttacgattgtgctcgtcgactacccggaacgtcattttcagatgatcgggcacctgttcccactgccagttttcccgctccagcgtgacgccggtcatgcggcggaattcccgcgccagcgcatcaggcagcggcatctccatcgctttcacccttcctaaaaacgcctcggcgtagttgggcgccggcaccaggttacggcgcagcggcttgggcagagacttaatcagtgcgatgatcagttcacggcgcacaccggggatctgccactcaaaaccgctatcctctacctggttcagcagcggcagcggaatatgtaccgtcacgccatccgcatctgcgccaggctcaaactgataactcagcttcagtttgaggttgccctgatgccagaagttggggtagtcgagctgactgactttatccgcgccctctttgatcagcatctgcttgtcgaaattcagcagtttctgcgttttcgcgactggcctgtttccaccagctgtcgaaatgcttcgctgagaccacctctttgccaatgcgctggtcataaaaagcaaacagcgtttcgtcatcgaccagaatgtcgcgacgacgggatttgtgttccagatcttccacttcgctgcgcagcttctggtttgcgcggaagaaggcgtgtcgggtctgccagtcgccctccaccagcgcgtgacgaataaacagttcacggctcagggtgggatcgatgctgccatagttaactttacgggcggcgacaatcggcaggccatagagcgtgactttttcggtggccatcaccgcgccctgcgatttctcccagtgcggttcactgtagctgcgcttgatcagatgctgtgccagcggctcaatccactctggttcaatacggcccgccgtgcggccccacaggcggctggtctcgaccagttccgccaccatggtccacttcggcggctttttaaacagcccggagccagggaagatcgcgaagcgggtattgcgcgcgccggtatactcctgcttatcggtgtctttctgcccgatatgcgacagcagaccgcttaacagcgcgcagtggacgggctgcagctcagccggttcactgttaaccggaatgcccagttcacgcaccacctgccgcaactgggtgtagatatcctgccattcccgcacgcgcagatagttaaggaaatcgcttttgcactggcggcggaaaacattcccggacagcgctttctgctgctccgccaggtagttccagagattcacataggcgaggaagtcggagtctttgtcggcaaagcgccggtgcttctcatcggacgcctgctttttatctgccggacgctcacgcgggtcctgaatcgacaggcctgcggtgataatcatcacttcgcgcacgcagccaaatttctgcgcttccagcaccatccgcgccaggcggggatccaccggcagctgcgccagctgacgcccggaaccggtaagcttgtagtgaccggtctcttcgttcagggtcagcgcgcccagctcttccagcaggcggacgccatcctggatattgcgcttatcgggcgcttccacaaacgggaaggcggcgatatcgccgaggcccagcgaggtcatctgcaggatgactgacgccaggttggtgcgcaggatttcaggatcggtaaaggccggacgactcaggaagtcatcttctgcgtagagacggatacagataccgtctgaaacacggccgcaacgccctttacgctggttggcagacgcctgtgatatcggttcaatcggcaggcgctgcactttggtacggaaactgtaacgactgatacgcgccgtaccgggatcgatcacatatttaatcccaggcaccgtcagcgaggtttccgcgacgttggtcgccagcacgatacgacggccactgtgcgactgaaacacccggttctgttcagcgtttcgacagccgtgcatagagcggcagcacttcggtgtgtggcagatcgcgtttgttcagcgcgtcggcggtatcacgtatttcacgctcaccactcatgaagatcaggatatcgccccgactttcccggcccagctcatctacggcatcaaaaatcgcctgcagctggtcacgatcgccatcatccgcctcttcgatcaccggccgatagcgcacttcaaccggataggtccggcctgagacttcaatcaccggcgcattattgaaatgacgcgagaaacgctgtggatcgatggtggcggaagtgataatcactttcagatcggggcgacgcggcagcagctcacgcagataaccgagcaggaaatcgatattcaggctgcgttcgtgcgcttcatcaataatgatggtgtcatattgcatcagcagacgatcctgctggatctccgccagcagaatcccgtcggtcatcagtttaatctgcgtcaggtcactgacctggtcgttaaaccgtactttatagccgacgcagccgcccagcgaagtgctgagctcatcggcaatgcgattcgccacggtacgtgcggccagacggcgcggctgcgtatgaccaatcagacccgtcacaccacgccccagcgccagacagattttcggcagctgcgtggttttacccgagccggtttcaccggcgacaatcactacctggtgatcgcgaatcgcctcagcaatatcctgctgcttctgactgacaggcagattgtccgggaaggtaatggctggcgtggccgcacggcgctgggccacgcgctgctcggcagcgataaagtcctgctcaagctcgctggcaatgccctgctgtgcctcggggtttttagcttttctggcaccctgtaaacggcgctgtaaccgctggcgatcgcgcagcattacaccgtcgaggcgtgaccagagcgctgccagtggggaagtatcgggagatgacataatagtgacgtaccttactcagacggtgtcgctgcctgaagcagcgccctgcaagccgggataaccagctgattcaataaaaaataattgcgcgcatcatagcacattctgaactgttccggcggctggccccggttacgcttattcaataaattcgaacatgggtctcgaaatattgcgctttcaccgcgccatcgataaccgtagagtgtaaaccattgagcggaaagtcttccgcgtaacagacaggaaaccaccatgagcaaagttttagttctgaaatcaagcattcttgcaggctattcacaatcaagccagctcgctgacttctacatcgaacaggcaaaggcccagggtaaagaggttaccgtacgtgacctggcggctaacccgatcccggtactggatggcgagttagtgggtgcaatgcgtccctctgataccccgctgtcacctcgtcagcaggaggctctggacctgtctgatgaactgattgcagaactgcaggctcatgatgaagtggtgattgccgcgccaatgtacaacttcaacatcccgacgcagctgaaaaactatttcgacctgattgcccgtgctggcgtgacgttccgctacaccgaagcaggcccggaaggtctggttaaaggcaaaacggcagtcgttatctcgagccgtggcggcattcataaagataccccaactgacctgctgaccccttacgtcaagctgttcctgggcttcatcggcatcactgacgttgagtttcgtgtttgctgaaggcatcgcttacggtccggaagtggccagcaaagcgaccgctgaagcgaaagacgctatcaagcagatcgtgacggcataagtctcactcatctcaggatgacgctgtaaaagaccgggccatgcgcccggtttttttcgccggttactgactgctctctgccgtttttctcagccactgaccgttaatgccgcgcacatattcccccgctgccgcacggctcaccagcttctgtccggcaatactggcgacatcggccgtggagagattattctgttctgccagtcgctgatactcctgctgacgtccggcattaatacgctgcaccagtgccagcgtttcactatcctgcgcacgtgccgccagatagccggagagcgtttcacctgctcgccccgattgccgcgcctgatccagcgtcagtgcccaggcaggctgcgccatcgtcagggcgaggaacagcaccgcgcttatgcgtttcatcgttgctctcctcagaacagaccgctctggtttttcaatagcgcttccacgtctttatcgactttgatgtggatctcatgttcgattttcacgttcatgttgatggtgatgggatctttaggtgccgtgacttcaatgcgcggcacgcagccgatgctcagcagtccggccgccagaaccagtagtgccctcaggctcatggtgaagtgtccttgttggatggcaaattcgcatgttgctctaaccaggattgcaaattatcgccaaagcgcaggctgcgccagagctgaaacaggttttcctgatgatgatagttgagattgactgtctgacgacggttactgaactggctgacgccctgcacctgcgcctccatagtgaggtcgccaagattatccagattgatcgtggcccagctgcgggagacttccatatagcgtaaccagtccagcgcggcgcccgtcgccacgttattgcgggtaatcgcatccgccatatctttatccagccggaaggtcagcggaccgctgttggcaatccaccctttctccaccagccagtgtggattattgagccacagcggcagctcaccgttgaccttgcccgacatggcaaactgtttaggtttcagcgccgtcaccagctcgctgaggctgatattgcgcagcgacacccgggctggctcatgctgtggcatgcgcaaagcgggcagcgtaatttgtccgcccagcagatcaaggctgacatcctgcaacgtcagcggcgcctgttcagaccacggccagttaccctgcaggtcagcgcgaatattctgcatcgcaaactggttcttaacctcggcaatgcgcagtgataccgggccatgctgaccaaactgccattgctgctcatggaatctgaacggcagcgagaagtcgataccgttaacctggctgtcgggcgtccagatgctgccctgttttaccgtccagtggcctcccgcctggaaaccctgttcacttgcggcggaaaaagcgacctgtgcctgcaaacggccgccctggatctgcattttcatgtcggggctgagcaacggctgaaacaccgtcagcgactgtgccggccaccaggcctggccgcgcagccgtttcgccatcccagcggccgttaacccgcagcgggccaaccttgcccgcctgtaaactgcctcgccagataaaataaccgggatcacgacctttagcctcaaagtcgagcgtggaatctgccagatgtccgccatagctgaagcgggtctctcctgcctgcaggcggaaatgcccattgaacgccggatgcgccgcatcacgctgccagtttaccggtttagtcagtgtcagacgcggttttgcaacgttgacactgccatacgccagctgattaaaaccggtggacaaggtatccagatggatcagggtgtcgtgccagccgcccgtgcctttaacatcccagcgcgcctgcagcggcagcatctcgccacctccccagtagcgccagttccattcgcccttatcgggccagaaatcattggcgcggccatcgagatgcaaccggaagcggccaaaactggcatcgtgcgcattcagaatggcctgcaggcggccatcaataccctgcgaggagagtcgtacgcccgccagcggccagcgcgcttcgtccacttccagcgttgacagcaaccggccccgcaggcgcagcagcgatttaggttgcagcaccagttgaggatcgagcagcgagccgctgagcacgcccggaatggagccgtaaagttgcaggtcggccagcttgctttcgccggttagctgaaacggcaggttgctgttggtcaggctgagattgccgggcccgacgccgagcaccacgttgcccttgccgccgcgcccctgggtcagcaggttaacgcgaccgctaatctggctactttcaaggccagactgccagttatccagcgtcaggttaacaaaccctgatagcggctgagcctccagcggccagaagtattcgcccttttcaatccgaatctgatcgcggctgatctgccacggcagtctgagaagcggcctggtcacttcggccattgccacgcgtagctcgccctgctgctgctgccagttaagcgtcagcttcaggggatgcggcagcgcgtccagcgccagctgtccggtcacctcgccgttcaccggcagatcggtggcaaaggtgggtaacgccagatgaccactcagcgtgacaggttcaggaagtgcaggatgggtgagcgtcaggcgactgatagcgagctgctgaccggtcagcgttgccgccagctgcagattatcgccctgataactgagttgctgacgatctttttccagcgtcagatccagcgcgcccgcatacgtctgccacggcgtaacgattaatttgcccagatgaacgtcggcgccaggcagcattgcctgccattcggccagcgttttgggggctgccgtgctgccatcactggccggtaatttttgcaggcaggtgctatccagcgtcagctctgacgcattcagtttccagcgcgactgatgccagcccagcgataccccctttaccgttgccagggagcaatcccctgcgagataacgaagttgtggcaaccacaggccaccctcccgccagcgcggtgcgcccgacagctcaatgcgggtatcttcaggtagccagatgccgaccagccgcggcagccattgcgtgacagtcaagatcaggccgagcagcagcagaatcagcgccagaatggcggccagccgtcgccggaacatccgtggcataaaagccataatccttttccttacagtatcctgacaacgatgatggcatgtaatctgccagaggtgaaggtctgcgccggacacaagtcagctgtttcagcaaagtcagtcagaaaacgttatccttgctctatcacctctgcaggagcacaacgatgaaaatcgcggtttacagcaccaaacattacgatcagaaataccttgagcaggtcaatcagcagttcggctttgaactggtgttttttgactttttactctctgaaagcaccgccaaaaccgctgtgggttgcgatgccgtctgtatctttgtaaacgatgacggcagtcgcccggtgctggaagagctggccgggctgggtgtgaaatatatcgcgctgcgctgtgccggtttcaataatgttgatctggctgctgcaaaagagctgggtctggaagtggtgcgcgtgccggcctactcaccggaagcggtcgctgaacatactatcggcctgatgatgaccctgaatcgccgtattcatcgcgcttatcagcgtacccgtgacgcaaacttttcgctcgacggcctgaccggttttaacatgcataacaaaaccgcgggtgttatcggtaccggtaaaatcgggatcgcgacgatgcggattctgaaaggttttggtatgcggctgctggcgtatgatccctacccgagtgagcaggcgctggaaactgggcgcggaatatgtcgatctgaagacgctgtttgctgaatcccacgtcattaccctgcactgtccgctgacgccggagaatcatcatctgctcaacgccgatgcgtttaaacagatgcgtgatggggtgatggttatcaacaccagtcgtggtggtctgattgattcacaggcggcgattgacgcgctgaaacagcagaaaatcggcgcgctcggcatggatgtttatgagaatgaacgcgatctgttctttgaagataagtcgaatgatgtgattcaggacgatgtgttccgccgtctgtcggcgtgccataacgtgttgttcaccggccatcaggcgtttttaaccgccgaagcgctgaccgccatttctgaaacgacactgaataatctcagccagctcgaccggggtgaaaactgcccgaaccggctctctgcctgactgtgcgggccggagcaatccggcctgatcatcagcgcgcgcaattcccgccaattaacgcctgctcatcacagcgacggccattcactaactgacacatccccactcttgagccatccagctgatgcgaaaatgccagcgttccgcccgcattcgaacaggtgctttctgccagggaagacatcaccacccgtggctggatgtgggcggcggtggcttgttgcggtggctcgttatcatcactgttgctgctgcaggcagagagtaataacgcggcaccggccagcaaaaaggtggctgctttcatcagtcggactccgggaagtaggggaaaaggctggctcagcatatgtcaggcagcacaacgggtcgagaggtgaaacagctttttacaaaattctccggcgtcatttgcaagcagaattatcttgtttacctgttatcgctgaactgtcaccctttttcggcccttattaattcggagtaaagccatgttaatggatatgttaattcgcatagcgctggccggtattctcggcggcctgatcggcatggagcgccagatgcgggccaaagaagcgggactgcgtacccatattctggtcggtatcggcagtgcgatgtttatgctggtatcgaaatatggcttcgccgatatgctcaatagtgaccatgtggcactggatcccagccgtattgctgcccaggtagtcagcggcatgggtttccttggcgcaggcaccattatgattcagaagcaggtggtgaaaggcttaaccacggcggcgggattatgggtgactgcggcgattggtctggtgattggcagcggcatgtatgagatcggcatttatggcacggtgctggcgctggtggtgctggaagtcttccgccgcctgagccattttctcatcggtaaacatcatacgctgctggtttttcttaagcccaaaagtgtgccgctggtgctgctggtcatgcagcgggaaggcattcgctatggcaatgtgacggtgattaatcgggatgaggagagtggtctgtgtgagctcagcgtttcaggtaacgctgtcccgcaaatcaaacgatgctcacctctatgataaggtcatggagatcaaaggagttcagtcgctggagatgatgtaaattcctttccataaagatcattcctgctgaacacaggccggtcagcgccaggacgttgcagaagggggttatccgtactcactgccttctgccctctccatcagattcatctattatcataatcatgcagcctgacctgagatatagagcccgccgggaattaatgtcataatccgtgattgtttattaaggtaacaatttatacggtgaaaaatgcgccagaactctgaccatcgtgacgaaaccctgtccgcttctgtacgtaaaagtagctggccagtactaagcatgcttatctttacgctgattgcgggcgctatggccatcatgatgatcctggatcatcgtaattccgtaaataatgcgcttgagaccggacagtgtctggtgggggaaggcgctgaaagtttgctggaagtgctcagacattttttacatcatgcttatcgctggatttttaaagcctgtggctagcaataataaattcagtgcagcaggaaatgcagtaatccgtgtcggtttaccagcaacaaaacgccgcaatacatgactgcaacatagcagagtaaaaagagtatcagcgtcaatataaatcggacaccataattttttatatcgtgagtgtttaccggatgtctcatcgaatttaaagtttgctccgtccttattcacatatatagccagcaatttaacgatttgtttcgctgcccgcattaccatgatgtgcggaacgatgaagtcacagctggtctctcaggaaaaacagttatgagtgtaaaaattaaagccgccctttttaattttcacattcactttaatggctttaatttcacccgtctgttttgaaaagcaacagctttggacgtggcgatatgtgccagtaaaatcgattcagacttaatgggatacaaaaaaacactgatacctgtgcatcttacgtattcccaattataacccggcagtgtcaacgcatattcaacagcagcgtttttcagattcaggcgttaatgaaattaacagtgcatcaggatatttaactccctgcgaatttatagcaacaattcgaaggaaattctcaaatcagataagcataaaaagaacgccgtttatgcatgattgattaatagtggtgcatgctcttttttttgttaactggtcgctctgatgaaatatctgttaattatctcaatcatttttatgactgcgggttgtgcggcaaaaaaagagaatgcgcgggctgatgcttaccaggcatcactgccatcctgtttctgcgcacaatgatgaaatcgattgccagtggaaagatgtgccagccagctgacatcgtatagttgaacgctatccgtgacacatcagcccgcaattattgagtaatgacctggtaaggcctgccctcttttttcactgagtaccgccgcatcgatttacgtcgctgctcccttaacgggtagtctctgccggattccccgggcggctatccgctgattacttcactccagtactggcattcgcggcaacaatccgtaccatacgctgcatattcgtgacaccgcagtgaagtgtctggctgaacgcgcacggcaatttgccctttagctacgctttctggattttgagataggtaaaaatgcaagataatcaaacggttgacaagaaagaacagtacaacctcaataaactgcaaaaacgtctgcgtcgtaacgtcggcgaagccattgcagattttaatatgattgaagaaggcgaccgcatcatggtctgcctgtcgggcggcaaagacagctacaccatgctggaaattttgcgcagtctgcaaaaaagtgcgccggtcaacttcagcctgattgccgttaacctcgaccagaaacagccgggcttccctgagcatatcctgccggaatatcttgagtcgcagggcgttgagtatcggattatcgaagaagatacctactccatcgtcaaagataagatcccggaaggcaaaaccacctgctcactctgctcgcgcctgcgccgtggcattctctatcgcgtcgcaactgagctgggctgtactaaaattgcgctgggccaccatcgcgatgacattctgcagacgctgttcctgaacatgttttacggcggaaaaatgaaaggcatgccgccaaagctgatgagcgacgatggcaagcagattgtgatccgtccgctggcttactgccgcgagaaagatatcatccgcttctcagaagcgcgtcagttcccgattattccgtgtaacctctgcggtttctcagccgaacctgcagcgtcaggtggtggccgatatgctgcgtgactgggataagcgctatcctggccgtatcgaaaccatgttcagcgcgatgcagaatgtggtgccgtcacatatggcggatatcaacctgttcgattttaaaggcattaagcatggcgatgcggtggttgacggcggggatctcgcctttgaccgggaatctctgccgctgcagcctgttggctggcggggtgatgaagaggatgccccggataccagtgcgcgtctggatgtgattcagattaaataagtgctggaaaggttaagggcgtgctgctggcagcacgccctttttttatatgttgcggtgcggtggtggatccattatcggcggaaattccggatctgtcggcggatcaggctggggttgtggctgaggaataggctcaggaatcgggatcggatccgtggggatcggctcgctgttaagaatcgcgctcatgccgtactccttttgttgcgaatggactttaagcttaggtaaggaacggcgttacagccaggcgggcaaaaaaaaagccggcacacgggccggcatgtttcgaattaaatgtgctatgcattaattctaaattaggaagtaagacaatatggagcgcaacgcccatcgcttgacgttgcattcacctgcgggagagagtttgcgtcagcagcgacaatgggttcttgatgtcgatcagcttttgcgtcctttacgggattttcagcgcagataaccgatacgctacggataacgctagagccagcgccgtttgcgcaggtaccccgctaccccgacggccagtgccaccagcagcagacagaagatagagaaaccgtatcgccattcgccgccaggaataccgcccaggttgacgccaaacaggccggtcaggaaggtggctggcagaaaaatcatcgccatcagtgacatggtataggtacggcggttcatcgactccgccatcgcagaagcaacctcatcagccagaatcgcggtacgcgccacccctgcatccagatcatccagcccgcgtcccagtcgatcggcgatttcctgcatccggcgccgtttcgctgtcatccatccaggccagtttttcactggccagccgcgcatagacatcacgctgcggcgccatataccgccgcatcacaatcagctgtttgcgcagcaggccgagttcgcctcgtgccggcatccgctggtcaagcagcgcatcttccagctcaatgattttgtcatgtaaatcttcgataaactcgctggtgtgatcggtcagggcatcacagatatcgaccagccagctgccgcagtcaatcgggccgttaccattctgcaaatccgtgaggacttcatcgacggcagaaactttacgccgccgggtcgagacgatgagcttatcgttgataaatacccgcatcaccaccagctggtcgcgacgcgcatcgctgttgtggttgacgctgcgcagcacgatcataaagccgtcgcccagccggctgacgcgtggacgcatactgtcgcccgctaaggcgtcacgcacggcatcagggatctgtgtcgtcgactgcagccattccgcgctcttacggtgggtatagttcagatggagccagcagggctgctcacactggatgacttcatcttcagcaatcgggatcatcccgcccttgccatccagctggcaggaaattatggcatctgaaacctgtaacgcttttccttcaattacgtccacaccgtcgcctcactactaaaatcaatacgatacagtctagcgtgacggtgttgagttgcaatctccgggctgtgtagaaagatgtcagagggtggccggttgaccggccacctgcactcagtgcttttcaatccacagttcgcgactgtaggcgacatcttcagggttagtgatgggatagcctttgacccagggtttaatcaggcggccattggtgtactgatagatgggggcgatcggggcctgctcagccaggatctgctcggcacggttgtaatcgctgttacgtacctgatcgctggtctcccggctggctttggcgataaccgcatcataatccgcgttgttaaagcgcgcgatgttgctgctgttgcccgacgtcagcagattaaggaaagtggagggttcattgtagtcaccgacccacgaggcgcggatcacatcgaagtttccgctgttacggctgtcgatataagttttccactcctggttctctagcgtgacatccacacccaggttctttttccacatcgaggccacagcaatcgcaatcttctggtggctctcagaggtgttatagagcagcttgagtttcagcggcttgccgggaccgtaaccggcagcagcgagcagcgatttggcctgtgcattcaggttgttctgatcgtgctgttgcatgaacgtgggcaatggcttaaagcctgctgtcacatctggcgtaaagtgccacgccggtttctcaccggtgcccagcactttttcagcaatcactttccgatcgatagaccaggagagcgctttgcggacccgcacatcggccgtcggccctttctgcgtgttaaacgcgtagtaataggtgcctaactggtcaggtgtgtagacctctccgggcagagttttcttcagtagcgcatacatgtttttcgggaaggattcggtgatatcaatatcgttggatcgataacgtttagtggcgctcgactcttcattaatcggcacgaaagtcactttcgtcagcaccgaatgggcatcatcccagtagtgaggattacgtgtcagtacgattttttcgttcactacgcgttcgctgagctgataggccccgttgcccaccagtttgccgggtgacgtccagctgtcaccctgttgcgcaataattttctgcggcacggggaaaagtgccacgttagccaccagcgccgggaaccacggcaccggacgatccagcgtcaccttcagctggtttttactctgggcgaccacacccagcttgtcgggcgtcatttcgcctttggttatcgctgccgcattttgaataccgcttaagcccgcgaaccaggcaaaggctgaactgtttttcggatcgaccaggcgctgccagctgtagacaaaatcctgagccgtgaccggatcaccgttcgaccagcgcgcgttattacgcagcgtaaagacccaggttttgttatcgctgctgctccagctctgcgccacgcccggcacgattttgccctgcgcatcctgattggtcagtccttcaaacagatcgcgtatcacctgaatttcaggcagtcctaccgctttaagcggatcgagcgaagcgggttcatctttaatatggcgaacgatctgctgctgttcagccagctgtgcgccagcgggtggattcgccgcgatggcgggtgtgatgatgctgctcatgctgattgctgccagcgtcatgcgaaaggtcttgaccattatcactcctttaccccaaagaagcgctgcatcagtctgttgccgatgcaacttgtgcagggcactttagcgcaaatggctgacagataaatagctattttccgcgcacggcttttccgctacttttagtaaaaccctttgaggaaataactatgtcgccactccatccacgtcccctgcgcggcaaactggacgtcccctatcagcagtatggccgctcagtgctgggtgcgccgctgctctggtttccggcgccgctgggcgatcccgagagcggtttgattctggcgggcactcacggtgatgagaatgcggccatcgccaccctctccgccgcattacggacgctgcctgatggaatgcgtcggcaccacgtggtgttagcagtcaatcctgatggctgtcagctcggactgcgcgcgaacgcaaacggcgtcgatctcaaccgcaactttccggcggcgaactggcagtcaggcgagacggtgtatcgctggaacagcgctgccgatgatcgtgatgtggcgctctcgaccggcactcatccggcttctgaaccggaaacccaggcgctctgtgcgctgattcatcagctgaaaccacgctggatcgtttcatggcatgaaccgctgggctgtattgacgacccgcatcaggcagagattggtggctggctggccagccacaccggccttccgcgagtcagcagcgttggttatgacacgccaggctcattcggcagctggtgtaaagatctcagcctgccctgcgtgactgctgaaatgccggtgatttcagtggatgaagccactgaaacctacctggagatgatggttaatctgctgcgctggcagcaatgatcagctgaccgttgcgcactttaatcgccggttctgcatccaccgccagccaggtcggcccgtcgagatcggcaaagcgggtctgcggcaccagcggcagtgcggcgcgtatcgcccgcgaggtgcagagcatgcagccgagcattaccgcaaacccctgctgctgagccgcatcggccagcgccagcgcctcggtcagcccgcccgctttatccagcttgatgttgaccatctcataacgacctcgcagtaccgccagactttcgcgggtgtgacagctctcatcggcgcagatgggtaatggatggataaagttctccagcgccgcatcctcacccgctggcagaggctgttccagcatcgccacattgatgtccgccagcagctgacagcgcgccgccagaccttcggcgtgccaggattcattggcatccacaatcagggtcgcgtccggcacggcggcgcgaatcgccatcagccgttcggtaatgaaattattatccagcttaatcttcagtagtgttgccccatgctgccacagcgccagcgcgctgctggccatcgcctcgggagtatcaatgctgacggtctgcgcggtcaccacatcctcaggtgcggttacgccgctaagctgccagaggcttctctgctgctgatgtgcggcgagatcccacagagcgctgtcaatggcgttgcgcgccgccccggctggcagcgcctgttgtaacgcctcgcgcgtcatgccctgttgcagcgcgggcagcagcgcggcgatttgcgccagtaccgacgcctcgctttcaccatagcgcgcataaggcgtcgcttcgccaacgccttttactccgtcttcctcaatttcaaccaccaccactttgacttcagtccgggttccacgggcaatgacaaacggcgtgtgcaacggccaggcttcgggataactttttaccgttctcatttccactccacaatgtgcgacgcagtggcagaccgccacgttaaattccacaattgaactcgtaaacccttaacatttatgtcataaacaacggctatctttagccgttttgtgtcagatcttttttatcattaaaaggaatcactatgtctcagactgttcattttcagggtaacgccgtaccggttgctggtcagtttcctcaggctggcgataaagccaaagctttcacgctggtagcgaaaaacctggtcaacgtcgcgctctctgagtatgcaggaaaacgcaaaattctgaacattttcccgagcgtagataccggtgtctgtgcttcatcggtgcgcaagttcaatcaggctgcaagcgaactgaataacaccgtggtgttatgcatctctgccgatctgccgtttgcccagtcgcgattctgtggcgcagaaaacctgaacaacgtggtgacgttgtcgaccctgcgcggctcggagtttaaatatgattatggcgtggaaattgccgatggtgcgctggaaggtctgaccgcacgtgccgtgattgtgctggatgagaacgataaagtgatctacagccagctggttgatgaaatcaccactgagccagattatgacgctgcgctgaccgcgctgaagtaataaaaaaagcggataaccaggttatccgcttttcatcttctgtttgtcgtttattcgctttcggtgcgcttctgccccagaccatactcccgcaatttattcgcaatcgccgtatgcgacacaccaagccgttttgccagttttcgggtgctgggataggagagatagagccgcgtcagaattgaccgttcgaaacgactggtgatctgatccagcgtcccttccagcgcctcatcgcccagtgacacatccagtgcctgttcaggcaacacaatatcctgcggacgcagttcgtaaccttccagttgggttaacgcccgataaagcgcatttttcagctgacgcacgttgccaggccaggcgtagcgggtcagaaaagcgttaagctgcggcgagagtcgcggacgcgccatcccctgctcatccgcaaagcgggcaacaaacatctcggtcagcggcagaatatcctgcggacgatcgcgcagaggcggcagttgcagcgtcagcacattgagccggtaaaagagatcctcgcggaattctccgcgctgcaccagctcaatcaggtttttctgcgtagcgcagattacccggacattgacatggacttcatgctcttcaccgacgcggcggaaggtaccatcattgagaaaacgcagcagcttggtctgcattctcggcgacatctcaccaatctcatccagcagcactgagccgccgttagcctgctcaaaaaagcccttcttaccttccagcgcattcgggtaggctccggcggcatgaccaaacagctcgctttcggcgacgtcatcgggcagagaggcacagttcaacgccaggaagggattcttgccgcgggcactgcgcagatggcaggcgcgtgccagcatatctttcccggtgcctgtgtcgccaacgatcagtaagggcgcatcgagcatcgccagtttacgcgcctgatccaccacctgacgcatcttcggcgtgacagcaatgatatggtcaaactccgattcatcggtgaccaccagattctgcaactgacgacccatgcgggctgtcgacttcagcattaccatcgcccccactggcctgtcgatctggccctcttcgcccggcagataaataggacgcgcttccatcagaaaatcgcggccctcaatgaccacatgctgcgcctgcgcttcaacccgatcgctctccagccagcgcatgaagttgaagccgttaatcagattaccggcgctgaagttgcgcatcttctcttcatcgagattaaacaggttctgtgcggccggattagccagttcaaccttgcttttcagatcgatggagaaaaccggatccggcatcgccaccagcagggcgctcagcgcacgatgctcgcgttcagagggcatgtacgctaccgtgcgcacatctgttacgcccggtgtacgccggatttcagccatcagattgctgaaggcgtcaaattccagtgcagaaaagttcaggtagatgcggcccagcgccgtgatttcgataccgcgtaaatcaatgttgcgtgccaccagcagatcgagcagttcacgcgtcagaccaagtcggtcctgacagaacacttccagacgcattgcgttcgccttaatcaggttcagataagacaataatacgctaagtcgcgcacctgcagaaagggatctgtcaggaaaagttgacagctccggcgcgtatggcggacttttgtactgccggagaaaatcctgatgagtggtcacaaatatttgccgggatggcgcattttatcagggagaaaaatggaatggcctacacgctgccagcggatccggtgatcactgatgagtcgggctgtcggggtgagtgtctggtcatcgactcccgacaggtgctgcgccagccacactaaagaataaaggcggcaatgccgcctttaatttgtcacgagagcgtcaggctgacttattaccgcccttctgcaacgcctctttcaactggcccagcagctcacgacggaaatcgccgagccgtggtttatcctgctccagccacggcagtggacggcacagctccatcgctttgatgcccagtcttgcagtcagcaaacccgcgccaatgccctgcgcggcgcgcgtggaaagacgggcggcaatatcctgcgacatccagtccatacccacttcccgcaccagttcggaagccccggcaaaggccatgttgagcagcaccagacggaacagccggatgcggctgaagtaacccagctcaatgccgtaaatagccgcgatgcgattgaccagccgcagattacgccaggcgataaacgccatatccaccagcgccagcgggctgaccgcaatcatcagcgtggcttcagcagcatgacggctgatttcgcgccgcgcctgccgatccagcaccggctgcaccagttgcgcatataagcggacaatttcactgtcattgtgggtttcgtgcagcgaggcatgccagcgctgcagggccggatgcgcctgatccagctctgcctgctgcgccagtttttcgcagaaggcccggcctttgccgatgccatgactgtgcagcaactcacggcccacatcccgctcctcggcgcgctgacgcagctgatagagacgacgccactcggtggtcagcgcacccacacccgccaggacgatcagaccacccgccacgccgctgcccagtgaaaaccagtcgcgggccagccaggcgtcatgtgtccactggacaccctgcgcaatcacgctgacgccaaacagcagcgcgccagcggtcaccagtttgcgccacaggctgcgcttaggtttcagcgcagcttccaccgcccgttcacctgcgccctcctcttcgacagcgacttcttcatcctgcaccgccagaaacgccgcctgcgcttccgcttcaaaagtctgtgccgggcgcagcggcgtggcgctgctctcatccagcggacgggcaaaatcgatacgcggcttcagcggatcactcatcgcaatttatctcccaataaaaattccagcgcggcatccatgcggatatgtggcagcgggcgatcgacgtcaagctgctgcggccggaactgttcaaactgaaacccctgctgctgccagaaggcattaccgggcagacgcggcgggacttcacccggatagacggtgagcggctcaccatcatccagccggtttccgcgcagggccgggatcttctcgccccggtgatcgaccagcccgctctgcgtcgcctgcaccgacgccagtccgatgcaatccatgctaatcccctcaaacgccgcgtttctgccaggcatcctgcaccagctgctgcaacagtgacaccatattgccgtgctgatcgctggtgatgtgatccgccttggtggcggcaaacagcaatttgtcgattaccggtgaaaagagccgacgaaacagggttcgctgaccgtaatgaaaactctgcatcagctgcgtcagtgccagccgcatatcgttaaacgcctggggtcctctgttaagcggttgcaggcagtcaaccagcacaatctggcggtcaaagcgcaggaaatggtttttatagaaacctttcaccacatgctgacagtagtagttaaaccgctgctgcagcatgctgaagttactgcccttgtccgcctgcgccagcttagtgagttgcgcttcatcagccgtcggccaggggaagaactgcagcgcgggagcgcctgccatatcgccaggcagcacgaagcgaccgggctgaataaagtgtaagccttcagatttgcagcgatgcagatagtcggtccaggcagcggcaatctctgccagctgggtttcatcggcgggtgcaagcgggtcgagtttttcgcagagggttcgccagggctttgcccactcagcacgatcgccctgcagcagaccgttcatctgccgggaccagtcgagataatcctgcgccagcatcggcagatccagcagccattcgccgggatagtcgacaatctccagatagagtgtcgcggtctctttcaggtgacgcagcagcgaatcattgggacgataacgcagcgccaggcgcatttcgctgacgccgcgtgtgggtgtgggccaggcaggcggcgtgctgtagagctgtgccagcccttcgtcataggtgaaacgggccgtgcccatgtcacgctggggtacccgctttacgcctagcaggcgctcatcccgcaccacggaaaacagcggcaaacgcgcgccgctgtgaacggttaaaagctgattaaccagtgaggtgatgaaggcggttttgccgctgcggcttaatccggttaccgccagccgcaggtggcgatcaacgccacggttcatcaacgccatcaattcagtttgcagtcttttcatctttctccctgatgaagcgcgatgccacccggttcatcacgcgtttcagcaatggctcaagcgccacagccaacagcagacgtaacgggcgtcgcgctaccgatttcactgcccagccagtgacaccggcgggaccgtaggtaacagcattaataatgatgaatttagcggccgacttcaatgcaggtgccgcgcggtgacgaaaagcagtggatcgcgaaaaagacatcaacacctccattgagtaagcgaacgggcctgaaacaggcccggcaataacagtagcagaatcaaatctggcggaagcggctgcgcacgctgaaggtttcagacgtcacatagcgttccaggtcgcgcacgctgcgctcatcccgttgcagggtgctctccagctgatccagcagttcactggcactgggctggcgctcagtctgggaggcagaggcgggtttcacatccagtacaaaacccagcacaaagtaggcgatcaccgtaaagagaaacaggccaaagaacagtgataacaccacgatgacacgcagcagacgaaccggaatatcgagatactctgccaggcctgcgcagacacccataaatttcccttcatctggcttgcgccacaacttgcgtcctttaatcatggctgcctccagtttggatgttcagcgtccagaatcgcttccagcgcgtcaatacgttcgcgcatccgctgcgcgtcctgggtcacgcgctgcaggcgctggatttcgctttgcgacagtttccgaaccgccgttgcgtttgttgttgtaatgcagccataaccagatcggtgcgacaaacaacacgaagatcgttaacggtatggcgaaaaaaagtgcgctcattgactctccttaatcacttatcgcaacgtcgatgattactcactgcggttcattttggctttcagcgcattaagctgctcgctgatttcatcgtccgctttcaggtcagtaaactcctggttcagcgtctttggtttaccaaaaccgtggctttctgcttccgcttccatatggtcgatgcgacgttcaaaagattcaaaccgggccattgcttcatcgatcttaccgctgtccagctgacgacgaacatcgcgtgatgaagaggccgcctgatgacgcagcgtcaacgcctgctggcgggcacgtgtctcactcagttttttctccagctcgctgatttcgcctttcatgcgctccagcgtctcttcaacatgacccacttcctgtttcagggaggcgataagatcggtgagtttctgtttttcaatcagcgcggaacgggccagatcatctttatctttgcgcagcgccagctccgctttttcctgccactcagcctgctgaatctccgcctgatcaatacggcgtgacagctgtttcttttcagccagtgcgcgtgcagaggtggagcgcacttcaactaaggtgtcttccatttcctgaatcatcagccggaccagtttctgcggatcttccgcacgctccagcagggaattaatgttggcattaacgatgtcggcgaaacgagaaaaaatacccataatgatgttcctcttttaatgttttaaaacgtgaagtcctgctgagttagtacaaaatgcgtgccaattttatagttaattgatttttatcatattttaaattttacagccctttccgcttgttttaagatagtcaaaatgattaaggggtggcgaaattcatcatgacaggcactagcgataatctcctgggggagtcgaacaattttcttgaggtgctggagcaggtttccaaactggctcctcttgagaaaccggtactggtgattggtgagcgtggaacgggcaaagagctgatcgccagccgactgcactatctctctgaccgctggcaggggccgtttatctcgctgaaactgtgccgcgctgaatgaaaacctgctcgattctgaactgtttggtcatgaggctggcgccttcaccggcgcgcagaagcgacatcttggccgttttgaacgtgctgacggcggcacgctgtttctcgatgagctggcaacggcaccgatgctggttcaggaaaagctgctcagggtaattgaatatggacagctggagcgagtcggcggcaatcactccctgcaggtaaatgtgcgactggtctgtgcgacaaacgaagacctgcccgcgctggcggcggcgggaaaattccgcgccgatttgctggatcgtctggcctttgatgtggtgcagttaccgccactgcgcgaacgacgcagcgatatactggtgatggccgatcatttcgctatccagatgtgtcgcgagctcggcctgttactttttcccggctttaccccacgggcacagcaggctctgcttgattaccactggcccggcaacgttcgcgaacttaaaaatgtggtggagcgctcggtctatcgtcataacagcagcgagcagccgctggataatgtgattatcaacccgtttgcttcacgccctgaaccgattgctgtcatccggaccagtcaggaggcggatagcagcgcgctgcctgccctgccgctggatctgcgtcaatggcagaatcagcaggagcgggatctggtggaagccagcctgcaacaggcacgttataaccaacgccgtgcggctggcttattaggcgtcacctatcatcagttgcgcgcaatgatgaagaagcacgatataaaagcagagagttaattaacgccgccccaacctatgatttttctctgctttgtgaattaacaacccggtataaaccgggctgtttttcacgttgagccacctatccattatgtgttgtgcgacttagtccccattttttcaggttgcctgatggcaggaaccagaccgacgccagcggtagccatcaccacggccagcgctgacatcagcaatacagcactcataccaaagtgtgttgccagcggacccgcgaccagttgtccaaagggaatggcgataaaggaacccatcgcatcataagcgtacacgcgagccagcttatccggtgggatatgagtctgtaatgagtgcgcccaggttacgccgaacaggcccaatgacatgccagcaatgaagaaccctactatcagcagtgctgctgacgcattctggctcagcataaatattgggagtgcgtaaagacctgccagcatcgcgccaatcaagagatcacgacgtggatgccatttcatagccagaaatgaacctgcaattaaacccgcgctatgggcggccacaataattccccatcgtgcccgtccgaaagaggcgtcggcaatcatcgggccaagtaccaccacaatgccattaaaagcgacgttgataatggcgaaactgaaggactatcgaccaaatccagcttcgtccggcgaactctgcccagccttctttgatatcgcgcaggatattgccttgcgaagccgcggctttattcgatttcacacggatcaggaaatagagcggcgcggaaacggcaaaacccatcgcatcaattgccagcccccagcccggcccgacagcgctggtgataattccccccagcgatgcccccattaccgtaccgccataaatcccgagctgaattaacgcgttagcctgacgcaaatccgttgcaggaactacctgcggaaccagcgcagatgatgcgggcagtgcgatgcctgccgccgcaccattcagggcacccagcaaagtcaggctaatgacggttgcagagccatcgagtacagaccaggcgacgatagcctgagaaacagcggcaaccactgccgatgaaactaatacccgactgcgtgagtagcgatcggcgacaacaccgcccaccagcaggaaaagcacgttacacagtgaacgggacgcaaccactatccctaaatcagaagcagacccgccaatatccagtaccgcaaaagccagcgcaatgggtgcaatcccattgcccagcacggtgaacaggcgtccaaaaaagagatagcgaaaggatgtatgctgaaaagcctgaacgtttttttggaatttattcattgccaggaggtgggtgaccagaagatgagcttatagtacctgcgtttttgtaatagttaagtgcggtttaattcaggacccgcttagctaaacgggaggccagcagagataacatcagcattacctcacttttctctcccttttttcatcgccacaccgcattcaaagcgccggctctttcagcagctttcccttccccgtccaggctggcatgccactctgcaaaagccaaaaaaaagcccgccaacaggcgggcaacgatactggaagcaatgtgagcaatgtcgtgctcttctacggcagagctaccgtcgaagcgcagatgaataataatcattcttattatcatctgtaaacaagttattgagaatttttctcattaccacaccttctgtacgctctttttaccgccgcgatgatgaaaatcagtctggcagcggttgcaggttttgggacaatgcccgctttgcgatacactctgtttaatgcctcaaaatcgttgagttctatgtcaaaactattatgttcgctgttgctaagtctcagcgtgttgagtgcccctgcgtggtcagcgcctgcgggtgatatccgccagaccggcttcgtctattgcgtcagcggcacgctgaacacctttaatccgcagatggccagcagcgggctgactgtcgatacgctggcggcacaactctatgaccgcctgctggatgtcgatccttacacctatcgtctcaagcccgatctggcgtccagctgggaagtgcgcgataacggcgcaacgtatcgctttcatctgcgcagcggcgtgcagttccagcagacgaatcagttccgccccacccgtgcactgaacgccgacgatgtcgtgttcagcttcgcccggatgtttgaccgcaatcacccctggcacaacgtcaatggcggcaactatccctactttgacagtctgcaattctccgactccgtgcagagcgtgaagaaaatcgataacaggacggttgagttcaggttaaacagcccggatgcgtcgtttcctttggcacatggcgacccactatgcgccagtgctgtcgaaagagtatgccgaccagcttaccgcgcagggccggcaggaagagatggacagacaaccggttggcaccggtccttatcagctcagcgaataccgcaccggtcagtacatccgcctggcgcgcaatcctcactactggaaaggggtgccgcgtctgcaacaggcggtgattgatctcggctcgggcggcaccgggcggctttccaagcttctgaccggtgaatgtgacgtgcttgcctatcccgcggccagccaactcaccatcctgcgcgatgacccgcgcctgcggatgacgctgcgtcccggcatgaacatcgcctatctggcctttaatacccgcaagccgccgctcgaccgccctgaggtacggcacgcgctggcgctggcgatcaacaatgagcggttgatggagtccatctattacggcaccgccgaaaccgccgcctcgatattacctcgcgcctcatgggcatatgataatgatgcccgcattaccagctatgatccggcgaagtcccgtgccgcgctggcggctctgggcatcagcgatctgcatctgcggctggtggtgcctgccgcatcgcagtcgtggaatcccagcccgctgaaaaccgccgaactgttgcaggcggatctggcgcaggtcggcgtccggctgaccatagtgccggtagagggccgttttcaggaggcgcagctgatggcgatgaatcatgatctgacactgtcaggctgggccaccgacagtaacgatcccgacagtttcttgcggccgctgctcagttgtgcagcgattcgctcgcagaccaattacgcgcactggtgctcgccggcctttgacgaaacgctgcagaatgcgctgttatcacaacaactctctggccgcatcgacagttatgacaaagcgcagcagattctggcgcaggagttgccggtgctgccactggcatcctctctgcgactgcaggcgtttcgtcatgatattaaagggctggtcctgagtccgtttggcaacgcctcgtttgccggggtttatcgtgaaagcgataaggaaaagtaagtgattatctatattttgcggcgcctgctgctactgatcattaccctgtttctgctgtcgctggtgagcttcagcctgagctactttacgcctgacgccccgctggaaggcgcggcgctctcggacgcctggtggttctggtttaaagggatgctgcagtttgatttcggcgtctccagcaccaacggtcaggagattggcctgcaactgcgtgaggttttcccggccaccatggagttgtgcatcctggcgtttctgttcgcgctgctggtcgggatcccgctggggatctgtgccggcgtgatgcgcaataaatggcaggacaaaaccatcagtgcactggcgctgatcggcttttctgcgccaattttctggctggcgctgctgctgacgctgtttcttctcgctgacgctgggctggctgccggtgtccggtcgtcacgacctgctctatccggtgcagagtgtcactggctttgcgctgattgatgcctggatgagtccttcgccctggcgacatgagatgataatcagcgtcctgaaccacctgattttaccggtgctggtgctggcgatggcaccgacgacggaagtgatccgcctgctgcgtaacagcaccagcgacgtgatggataaaaattatgtcaaagcggcggccacgcgaggtctttcgccgtttaccgtgatccgccgccacgtgctgcataatgcgctgccgccggtgatcccgcgtctgggtctgcaattttccaccatgctgacgctggcgatgatcaccgagatggtctttaactggccgggtctgggacgctggctgatcaacgcgattcgccagcaggattacgcggcgatctccgctggcgtgatggtgattggcgggctggtgattctggtcaatgtgatttctgacgtgattggtgcggccatgaacccgctgaaacataaggaatggtatgccctgcgctaacgctcagggcgcttaggcaaaacataaaataaacatatgaattttgtctttcagaagtcgtgctgaaagcaggcattgatgtacacgaatattgttcctgcagaaaccgatttaagttcgaagcgtaaaaattaatgaggagatgaacatttatggatgaagttgatctggcacaggagcgtgaagaagcgcatctcgctgcctctctggcagctcgtaaggccaaacttaaaagcccaaacggcttatgcatctggtgtaaagatgagcccgtagtggctgaaactgctttctgttcaagcgagtgtgatgaggattatcataagcatcgccgggagcagagccagcggattgtttgaaagagaatgaagtcacccggtcaggctattacgcgggtgactcagataaacttgatataaatgtcaggcagccctcacaaatataaagcaataaaacgacatcgcttgatagattcttgatatttccttgcctttacgttgataaaaaaaatacataatgccctgattaaaatgtcacagcagagaccatctgtccggagttagtgacaggaaaagatagcatagggtggctgacattcaggagccatctttttaactcgatttatcagaacaactatcaggtttaacattttatatgagccacttcaaaagaatgctttacggctgggaaaaatccgacgctggcatttatgagcactgttttaaccgttttggcgggagtgttaatatgcatcctgacgtgatcaggtttttctcatctcgcacaggtcatgaggcaacgtattttcataaagtaaagcaaggtggctatattgccgcatatgccctgctggatcactcacggataggtgtcgatcaatggaaaaaattcccgctatcttatgatgagattatggtgccagcggctaaaaatgcttctatgtgtttccctgaaagaaccaataaaatgtcacatttcaacaggcacaacttcataaattttaacttttcatttgcccgaaaaaataaagtatgctttgtaaaagagagctattcagttaaaacagaaaaaaatcgccgcaacgaatacaaccggttcatacgtgcgggtggccgctgctgtgatatgaatcaattcagccctgaagagctggcagactattatatcttcctttttaaatcccgtttttctgacagcataacctgttattccagggagaacctgatcacgcttatcaatgccatgaaaaggatgctcttcggctatattctttttgtagggaacgagccctgcgcgatggatctgctcttcatggctgagagtgaacacattatctattttgatgtgccaaacggcggcgttaacatgaaatattcggaccttagtccgggtagtttacttatgtggaaaaacattggtgcggcaagggacttctgtaaacagacgggcaaggagatgaggctttcaatcggttcacttgataaagaatggacgtataagcttcgctgggcggatgcgcactccacggggaaaacaattttttaatctttcttaggaatcaggcttattttctgcaacaaagcggctaaaaattagcacaaaaccgcgcgttcctgaattgccaggcaccaatgaagggtgtttaaagataaaacgtttaatctcagggccgattttaattttttatgcatcgcggtccttccccgccgtcctgtagataataatttgctgcggatacaatccggtaaacctacggcattacgtaagctattaacctctgcctgaaaatggtgtcatcgctgggaaagcagagagagtttttatctgattttttttgcagcatcagtgactcgccagatgccaggaggcataccaaaatgtcgcgagaaggcgcgcgtgaacgtttgctgtgagtcgtagttgaactgatcagctacctctgcaatagtggcttcagtaaaccttaaactcagcgaggccgcctgcattctggtgttattaatatatttcccgaggctgactccgcaatgttttgtgaacattctgttaaggtgccattttgaatatccactttttttagcaactttatccaggcttattttttcatccgcatgatcatcaaccattttattaatgcattaaagaagtttttatctgtcatgccatcccccttttgcgttttttgcggtctcttttaattcaaatccattatcacacaaaatttaattctatattgatcgtttgcaattcccttgtctaagctcctttcattttattctcgtcaccgatttatctcctttagtaaaaggctctatctcagcacgagactatcccctaaagtcatcaatgaacaatcaggaaatgatgaagaatctgtcaatgctgcacaaaaagtgatctctgttgaggcgaacgtcttaggtgttggatgatccgtcttccgtggaagatttacggtgtattactcatgcagcatcatgaacgatttcctgtgcgggtttccggcagggtttcagtagtgagccattcgcgcatagcgtctgcacctgaaaccgccaggcgggcatgcttccacaacggtctgaacaccgggacacctgaagccagtcggtaatcgcgcataatatcggcatgaagtaatccactgagatgcctgatattttcaggataggctaaaattctttgagtaggcgtcagcaacaaacctcgcggtaacgacgcggtttatcagaaagaggacgaaaaatgaaattcgctgtaatttttgaagataccggcgttgaagaggaacatgagtttgacaccaaacctgttgccggagatttagtgacgttaacgcgcgatgggataggtaaagattatatcgtgatcattgagccggatcctgaccacactcatgacgatgggcctgacggacacccgacaaaggccagggtccggccagcgtagcctctgctaagatctactccgccgcccaacagggcggtttttattgcctgttatccggaggtgaatatgacttttttcaggctgttcaggatgatatgccgacgcggatcataaccctttgcaatccagagccgaaattgctgacgccgtttccttgcctgtaacagggatatcgacggataatcccctgtagtcagctgacgggctaagcctcccagcgataacggtagaaaaatgtcacgccgcctcgaatggatagcctgacattcagtccggacgagttgaagataacctctgctttgtcgcggcgcttacccagcgctttcctgagcttagtgtctgtctgcaatgtgtacatcttctttgcgtctacgcagaggtgtacacaaaacacataaattaccgctactcagagtcagccatgataaagaaacataaagcatgtcctcaggataatcctctgatatgagtgacttttataaagaaacgttgtccgaactcaagcacaataaagtgaaagcgtatgccctccgataatatctacgccgaaaaacgcctgcccagcgcgtttcgtcagagctggcaccatttctatggcaacccgatttcgatggtcgggctgtatggctttggcgcactgctgctgctctgtctgtttggcgggctgatagcgccatacgatatcgatcagcagtttcctgggttatcagttgctgccgccgtcctggtcacactacggcgatgtctccttctttctcggcaccgacgatttgggtcgggatgtgctgagccgcctgctgagcggtgcgggcccgacggtgggttcggcgattctggtgacgctgttcgccacgctcggcgcgctggtgctgggcgtactggcgggcatgacgcatggcatacgctcggcggtgatgaaccacgtgctggacaccctgctctctattccgtcgctgttactggcgattatcgtggtggcgtttctcggaccgcgactcgagcatgcattgctggcagtctggctggcgctgattccacgtctggtgcgcgagatttacagtgccgtgcatgatgagctggaaaaagagtatgtggtggcggcacgtcttgacggtgccagaggccgcaacatcctgcgctacgccattttgcctaacattttaccgttgctgatcaccgaaattacccgcgcgctgtcgatggcgattctggatattgccgcactcggatttctcgacctgggcgcgcagctaccttcgcccgaatggggagcgatgctgggtgattcgctggagctgatctacgtcgccccctggaccgttatgctgccgggtgtggcgctgatggtcagcgtattaattgttaacctgctcggtgacggcatccgtcgcgccgtcgaagcgggagtggaataaatgccgttactcgatatccgtaatctgaccattgaatttatgaccgctgacgggccggtcaaagcggtcgatcgcgtcaatctgacgctgggcgaaggtgaaatccgtggcttggtcggtgagtccggctccggtaagagtctggttgccaaggcgatctgcggcgtaactaacgataactggcgtgtcaccgccgatcgcatggtgtttgatgatgttgacctgctgcgcctgtcgtcgcgcgagcgccgccgcattatcgggcataatgtctcgatgatttttcaggagccgcaatcctgcctggatccctccgaaagcatcggtcgtcagctgatgcaggtgatcccgcgctggacttataaaggtccgtggctgaaacgcttctggttctggcgcaaaacccgcgccatcgaactgctgcatcgcgtcggcattaaagatcacaaagatataatgcgcagcttcccctatgagctgaccgaaggcgaatgccagaaagtgatgatcgcgattgcgctggctaatcagccgcgtctgctgattgccgatgagccgacgaatgccatggaacccactacgcaggcgcagattttccgcctgctgagccgtctgaaccagaacaacaacaccaccattctgctgatcagtcatgacctgcgcaccatgagccagtgggcagaccgtatcaacgtgatgtactgtggtcagacggtagaaaccgcccagagcgaagatttaatgagtacgccgcaccatccttatactcaggcgctgattcgggcgatgcccgattttggacgatccctgccgcacaaaagccgtctcaatactttgtcaggagcgatcccgtcgctggagagcctgccaattggctgtcgtctggggccacgttgcccttatgcgcagcgcaaatgtattgaaacgccacggctcaccggcagcaaaacgcatctttatgcctgtcatttcccgctgaatatggagggccagtagcatggagaccctgctggaagtgcgcaacctgagtaaaacctttcgctatcgcacgggcctgttccgccgtcagcacgttgaggcggtgaagtcggtcagttttaccctacgcgagaggcagacgctggcgataatcggcgaaaacggctccggcaagtccacgctggcgaagatgctcagcggcatggtcgcccctaccgaaggtgagattctgatagacgatcatccgctgaccttcggcgattatggctatcgcagtcagcgcatccgcatgattttccaggacccctcaacctcactgaatccgcgtcagcgtatcagccagattctggagttcccgctgcggctcaataccgatctcagcgcggaggatcgagagaaacgcattatcgctaccctgcgtcaggtgggattactgcgcgatcacgccggctattatccgcacatgctggcacccggtcagaagcagcgtctggggctggcccgcgcgttgattttgcaacccaaagtgattgtggccgatgaagcgctggcctcgctggatatgaccatgcgttcccagctggtgaatctgatgctggaactgcaggagaagcatggtatcgcatacatttatgttacccagcatctggggatgatgaagcacatcagcgataaggtgctggtgatgcatcagggcgaagtggtcgagcgcggcggcaccgctgatgtactggcctccccgctgcacgatctgacccgacgactgatcagcagccactttggcgaagcattgagtgccgaagcctggcggcgagagcgttgatttttgctgcatatcgcggaaattgcgggccgatttacctgatttatgagagacgtgctagaatccgcacgtcgattaacgtcggtcgcttactttttaaccatgcggccgccaactacaatgaccataaggattacagctatgggttttctttccggtaagcgcattctgattactggcgttgccagtaaactttccatcgcctacggtattgcacaggcgatgcacaaacagggcgcagaactggctttcacctaccagaaacgacaaattaaaaggtcgtgtggaagagtttgccaaagatttgggttcagacatcgtgctgccatgtgacgtagccgaagatgagagcatcaaatctctgttcactgaactggcaaaaacctggccgaaatttgacggtttcgttcactctatcggtttcgcccctggcgagcagctggttggcgactacgtgaacgccgttacccgcgaaggctttaaaatcgcgcatgacatcagtgcttacagcttcgtcgcgatggccaaagagtgccgcgagatgctgaatccacactctgcgctgctgaccctctcttacctgggtgctgagcgcgcgatcccgaactacaacgtgatgggtctggcgaaagcgtcgctggaagccaacgtgcgctacatggcaaacgccatgggcccggaaggcgtgcgtgttaacgccgtttctgccggtccaatccgcaccctggcagcatcaggcatcaaagatttccgtaagatgctggcacactgcgaagcggtcaccccgattcgccgtaccgttaccatcgaagatgtcggcaactcagcagcattcctctgctctgacctggctggcggcatcaccggtgaagtggtacatgttgatggcggcttcagcatcgccgcaatgaacgaactggaactgaaataagttctgcaagggcgagcctggctcgcccttctctttgctcccgcctcgcccttcctgcctgatttcgctgccgttataccgtaacgctattaattatcaccgatcaatcttttgccctggactggccatcagcgacgataagcctgcccttcggtttatgcacattttcagattctgccgcctgcataccgaatccgaatttgcaaaaggattgatcatggaacaacgccgctatacgggccataaccactggttttacgagagccagaccagtccacgtacctcacaggccgcaccgctggtgcccgaggccgcccatatcgatgaccgttttttgctgggatgttacacagataacatcgtggtgcagtcactgctgcgcaccaatcagcccgccctgctggcggcgcgcgatctggcacagctgctgttccccgaccgcgtcgtcaccacgctcacgcataccttaacgctttacgatcgcctcagcacggcgctgacggtggcgcaggtggcgggtgtacagcggctgtgtaatcactactctgcccgcctcaatccgttgcccgggcccgactcctcacgtgaaagtaataatcgcctcacccagattacgcagtatgcacgccagctggcgatgcagcctgagctgatcagcgccagcgcaatcactgccctggatgcagtcggcctgacagagcccgatattgtgacgctgaatcaggtgatcggctttgtcagttatcaggcgcgggtggtcgccggtttacaggcgctgcaggcccagccggtacgctggctgcccggcagcactgcaccaccggatgctgaggccgcaggttttgatcagcctgcccgctggcagcccgtgctgaaaccgctggagttgcggtatgccagtgctgagcagctcgctgccattacccgctgtcaatcgctgccgggaatgcaggacgcggtatggctgctggcacacgatccctcagtgctctatggctgggcgcaactgcgtcagcatctcactcaggacaatactctggcagaagcgacggccgcccgtattctgggcagtcgctgggcgttccggctgctgtccggaaatgagatcttaattgagggcgtggatgacgcggcggcaaaagaggaagagcagcagattattgcgctggcggcgcagctgacccgttcgccagagcgtttcagcgcggcccatctgcagccgctaatggaggcgggctgggaagctgatgcgctgttcgcgctgatacagagcgtggcgataggcaactggaacagccgcctgttttatgcgctgggcgaggcgcagtaactggaattacaccggcagcaggccccgtgcttcatcgaaaaagtgctgcgccagcggtgtggctcggcccggtttcggcaattaccagcgccgcctggcgcgccatcggcggcagcgtaatagcgcgctgctgcagcccctgtaatgaagcggataggagatgaccgaccggcgacaccagcagcccgagaccgacctgcgcgcattgcatcagttgcatgacagaggcgctctcgacgatcacccggggtaccagcgccgcctcgcgaaaagccatatcaagataacgccggaaataacgcgtcggctccgccaggcagagcggctgttgtgccacttcatcaagcgtcagcgcggtttcccccaccagctcagggaaatggtcgggatggaatatggcttcaacgccccgatctgccagcatctcggtctgaaaatggagttcacgcagggttgccatctcgaaaaaaccgatcccgacatccacggtgtggctgttgagcgcttccagcaactggtcagcactgagtaccgcaatgcgatagtcgagctgaggataacgcgcctgcaccgctttcagcagcagcggcagtgccatgctgcactgcggcaccacgccaacccgcagcgtaccgtttaccccatgcttcagcgattccacttccagcttcagcccctgatagaccgaaacgatttcccgcgcccatgccagcacacggtcgccctctggggtaaatccggcaaagttattgctgcggttaatcagcggcaggcccagctcgcgctcaagatttttcaggcgcatagagagggttggctgtgtaacaaaactggcttccgcggcccgcccgaaatggcgttcacgctccaggttacacaagtaaataagttgtttaatgtctattatctttacctatcatatagttacaaagcatcattccatacatctatttttttctgtactaatggatgtactaaataaaatttcgcctcctttttttatcttcttctcacattatattatgccggataggagtgagcttcaaatcgttggcctgtcggctcatgcacggacacaacctccgccgtcaccttccccagaacgataatcccctccagcccctctccgtcgatcgtctcaccgtccaaagtaatgatgcccgtcctgaacagccttcccagctgcgggaactcaccgagctggaatgcaacattatcgccatttactggcttcacggatttgtcggccagtacgaacccgtccggcgtctcaataagtatcatgttgttccggtgtggcatcagtatgtcgttcaggtcgatgcgcttttcgatgtagtcgttcgcaggtgatggaaatcccatatctacctcacgtatcccatgttgcgaagagcgtacgttttgttctcactctgctacgtgaacaactcgaagaagaagttctgatagtaacggatccacctgttgcactcctgcagtgtccacacgtgattggcgtcgtccaggtttttctgaaacgccgctgtagtgactatctgccgccccatgccgtcttttttaatcgcagccatgaatgcgccgcgtatgtcactttctctcgccatgtcaaatccccctctgataaatactgtatggataaacagtaatatcgatcggtggatttgatcaaggcgaaacgggtagcaaatttgtaaagctgctgagggtgctggatttttagtttctggtggacttaatttgagttaagactggctgaatacacagatgtgaaaaaatacagcagttaagctgatctttttattgaggtttttgtgctgcctggatattatcccgatgttgtgcggttaaatagtgatctgcacataagggaaggccctaaactgcgtcaacagttaagggccggaaaaacagtcagtgcttgaatgttttcttgagatctcgccaaagagactatctcaagcgagatcccgtgtaaagcgttcggcaccttatttttaaaggtgctttatgaaaaagatttgcaaacaaagtcatcgccgcaaccagatgtttgaggttcttccggagaaccagggccagacaggacgtcacaaatgcgctggatgtgcatatgatttaggcaaatggcacgcaatgattggtgttcctaaatcaagtgacgatgccgtacttagcgaattggcagaaagccaggcaagttatgttcgccacaaggatgccttcacagcatacctgatgggctatgatgacggcctaaagctacaaagcgttgcataagattccaacccggccactgcgccgggttttttgtgcctgaaatatcgttcaatgcaaattgttgaatgattatttccttaattatcacagaccacgtatcctcgctgtcgtcagctgctgctgacagatggtttgccccacttgaacaaattcatgcccgtgtaacgcggttttttttgtgcctgctgcacccagcgactacccttacctgacccaccccgtatcctgctcagagagcagcagtttcgtgcctagacatggttaaaaaatctatttattaggtttaaaccctactaaaaagatgttgcaacgcagctaaagtaatttcttcctattcttgtaggttattgttatgttaacgtcacttactaattcactcattgaatggactccttatggcttttaatcgcgttaaagtatggctgctatttgttattgtaatatcatatttttatgttgttggtttttcgctaatcgggcttctttcaagtacggatttaatgtatgcaaatgataaagctttttggagctttttgcttctcttaataaatattgcatattgtacagttgctttcattcatctatttcgatttgacagaagaaagctccttacttcagaggctacgctttctaaatatgcaagtttaatgctcactatttgcccgttattagccgctcttttcgatccattcaaattaatcttattaaaatggaatatcaccaatgaaaaaacttacttcgctactggagtgatatccttatttattatatttggccttgcacttacttcaagtttatttttgatatcaaaatctactgatagaaagaaagcttaacttagcaaatatatctcaatcgcattttagggtttaagtctagaaaggcgccccgctgctggggcgttatccttcgagtccgtcaagggcttcaagtctgacacccatagatttgataagctcggactgtttatcaattaatttctgctgcgaatggcataccgtcaggagaaggccaagctgttccagcgggtcaagggatttcttgccatcagagtttgtaattaccccttccggcaggagctcttcgaactcctgagcaatcactccgtatttatgggtagagccaacctgcctgccttctgcgaggaacatctctcctgtaatggggtctggcgactgataggtgaaagttttatctttgaatttgtatgcaaccgggcgtattttgcgaataatatttaatgccagattctcatcagcttcttcgatcccttctttcaaagttttatccgagtcgaaaaaattaatacctttggcggccccatcaaccttcacctcaagataggtactgttaactgctgaaaatgctcttacacgaccgccgactgaaaatgatccattgggtgcatataaaagtccatcaaccgtgaactgaaaattcgcgttctcaacagtattagatgagttcactatgcggatattaaacccaccggttccactccctcggttcactacgatagagcctttacctgtagagttatcctcattccaaacaagatgtgccccttgttgtgccatatttgcgccattagacgttgccgagacaccgtttctggcaacgatagttgtgccaatcagaccaccagtcagcgttcctcctgatagcggaaatccaccaagattgctcaatgcagttgatttatttgagacatcgttgagattctggcttttatccatctttcctgaaacagagctcacgacgctgctccatgatggaccgctgtactggctgccatcaggcagtgaaactgtaatatttccgctagcgctatatacctgctgccagttagccttatcgaggttgagtccgcggatggcattggctacatctgcagctacctgcgccgtaattccaaccagtgcagcgttaggtacagccgtccaagcaacacctgatgcagtcgggccattatatgctgttgtcagtgctacgcctgtagctgagttaactgactgcacaccgagcgtataggtaacaccacctacaatagcaacgatgaaatcgtttgctttcagctctgttgtgaagctggtacctgagccagttacagccgtcgagttgttggttaatgcaatagtgcctgctggcatagcgttctccgggcaataaaaaacccggctcggcggccgggttcattgggttatgatttttttcagaagtaatagctggcgtcgatacacgggagctggcaggacgcctgaatggcctttggatattggtataccgcaatctcccggcctgtcgatttagctctggcagtcgtaacagcattgccgttcatcttcagtccggactcaaggcatatacggaacgtgtagttattattgttccgactgtaatcgcctctctgagtgccaaggctgcataaaggcaccatgggctgtgaaactgaaccggttggatttacccaggattgaaactcgccggtggacccgtcaaagttctcataccctccgatatcgtaataagcatcagtccacataacggtgcctgaccagatgccaggctgaccacgatgtcggtcatctgagctggaaccatcctcatgcttgcggccaactgcttggatgacattcccgcctttccggcatcagaagaataagcatttaatccattgcgcgtctgctcaatcttcttcgagtattcattgaatgtctcggtgtctagaaagcctttggcctgaaacttggcaagctgccgttgctggtcgtcaagtcggtttaaggcggcattaacagggtcaatcctgtcgagcaggtcggagagtgatttggcttcctgctcagttgccttagctgtcttaccagctgtgtcagccgctttttgcccggcctgcgtcatctttgtcagtgcgccagctaggccttctgcattgcgttgtgcacctgtactgtcgatgactattgcaagtcgtgattgttgttcggacatgttttctccgggcataaaaaaaccccgccggagcgaggtttataggtttgcattgcttttatagttgggatgaatagtaattacgaaaatcttgccgaaaccgcactgggaagacggttcaccaactcatctacactcccctcgtacttttctttgacattgcttgggtgcatattggggcttgcttttttcatgcgagaaatcatttcatcaactgagggcctgttaagcgaaaagtcatcattcccacggatgaaaaaggcatcaaagggcatatctgtaggcttaaaacttgccgactgctggtcgttgagcgcagatttaacatcgctcccgcagtgcttgcactttacagcttccggtttgattgcctctgcgcaataagggcacttaaccagtccctcgttgagctgagattgctcaatggctttgtagtctttcccaatgcataaggaatgaatgagggcgacaatgaaaagaagcgccccgtaaatccaccattcaaagaaattacgaccttttccttttgcgatcgatgcaggtatacacccaagaatcgcacaaatcaccaacagttccatttaattgccctatgaggtttcataggagtaatcctaaagggaaagtgatgcaaaaggaagcaagaagcccgccgaggcagggttatggttttttgcagctttcgctctatttggccactagtaaatcattcacatttatcagcgaacatttttaatttatccaacctgctttgcagtccatcaccatcatcgaccttaaaaaagtcagatgttgaatatgaaagacctaacagcgggattacccatcgaggctctgcctcgacatggacataaattctctcaaagccaacatacgcgccaaatgagtttttaccatttagctcaccgcatacatagccactagtgtttgaaccggtatcgtctttactagcaacaaaatgcatatttctgaattgggcgcttgaagggtctttaagagactgcgctacatcttcttgtgcgattttgatgaattgttcatctgacggcttgcatccagaaagtaaaagaacaccaaaagcgataaataaaagctttttcacatccctatccccataagtaagtatggcgattatcctaaagcggatctgatgcaacgggaagcaaaaaacccgccgaagcgggttttaaggaggctttaggttagcggagtcgacccgcaggcagcattgactacaaagcacatcatggcggcagttgcagcgtcaaaaaatgataatacccatacgtaagtgtttttattcataagcttctccttttcctcaggactaacagtggctagatagtttttgataacaaaaaaaacaaacataaccatgaggacgagtagccaaaaaagctgcgcattaagattaccgactaaccctagcatcgctagcctaaagcagagtaaatattaccttgctagcgtgtttttaacaagtttaaaggccttaaaacataagcactgatcatctatcaggattacgccgatttactttagaggatatgttgagcactcagcccgtccatgttaggggcatggtcgcacacagcatttcataccaatcgattacctctgaggaatatatgcctaatattcaaactaatgcagatgatgaagacaggattgtggctcttcagattggctttgccgcactggttgatttgtgggggagagacaatcctgaaatgaaatccaagctcatagcttatttagagtctacagggatggatcccgaaaacaaaaagtcctcttccgcattccatgagctgattgaagttattcgaggactggaagatatgcgcggatagttccatcggggttatacaaaataaccccatctttacttacatcgttcatatttctctccggttcaatgagccttttcctgctttctctcccactcatcacgagccgcgtcatcaagtgcgaagatagccgcatcgaactcattgcgatctataagcagcggttcgtgactgaggtaagagtttatgtcttcgagcgagagaggtagtggtgcggcggccataccagcgtagcgtcttctgcgactgattactgcataagcgttcagtatctcagagcaaacaccgtcgatttctggttcaggaatcggcggcaggcccagccgttcccgcgtccatctggctttttcacccttttcgccgccgtaagtactgagccagctctgcgctgctaggactttcccacggtttcattcttctgctcttccttgcctgcagcgatgtcagacgccgttccgaggacagcccagtaaagctcaggatgctggagcaacagcgctttgcccttctccgctgaatactcgacggccttttcattgccgccatcattagcctcgcctacaccctcccaatcaatcagcagatgcttggcgactgaatcaatcaggaggtcatcggagatttcagtgacgtcaatttctgccggattgaagtctggcgtgccaactttgaaacgggcgtccagcttgtcgatgtgacgtcgcacgattgcgttgtgcgatcggaatgccgggttactgatagacccgacctttagcttcaggccttccataggcgtaatccagcgctctgaattgacatccagcttaggtgttttgaggataagcatgattttctctgtgagcagcccgccgcaatggacgggcgggtgagttaggaggccgtgacggtgatcgcagtggtagccgtgtagctacgggctttagcggtgatggtggctgagccttccttaactcgcgttacctgcgccgttttctgtccggttgatgcaacggttgctacggatgggtctgacgactcccacacaacagtatcagtagagcctgcaggcgtcagagtagcggtcagtgtggtattagaacctaccgctccggtagaagtggcaggagctacggtcagcgcagttgctgccactaccgccgagcgcgtaatggttggcggagtatcggctgctgtgatgttcagctgaacctgcacgatgtctgtgttaccaccgtccggccagtcgccatcaacctgtacagcagggaagtcaaagacatacttaccttcgtcgttctccagcgtgaagccgaactgcatcgtctcgcctgacagtgttttcttccaggcattgtatgcctcttttgaccaggacagcgtgacgctgccggatggcgtaaacgtggtcgggatgttggcaccggcgaacgggttaccactgccgatacagcgctgcgtctgcaggttgttatcgaactggatattgaaggtatcgacacagaacccttcgccaccggtatcgccgttcagcgagatggcagtgacctgcttgaacgtgtagcggagcgagccagcgttatcagccgggctggtgaagtagctcgtgtcatccgctttggtttcaaagccgagaccggcaaaagtcaccgttgcggtaatgtcgccatcgttggggatcgccagctggaaggtgccgacctgacagccgcgggcgattgaggcaacgccaatgtcttccgcatacgaagccaccgagaatgcgatgcggtcattacccatagtcagcacattgctcacccattccgcgccaaagcacgaagcaaggaagtcatcatgctgcgcccagcggaatttagtaccgacatcaccgcctacatcaaccgtgccggtcgaacgtccctgcgccatgcgtgagccgccaatctcgtcgttgtcgatcatgttttgtgatggcccgagaccgaagctactgcgcttgagcaggctccattgtccggtaccgggagtcgtgccgggcgtagtttcgcgaatgtacgcgacgacgaccttagcgcctgagctcatagtgtttctccagatttatgcgccctatacggcgcgataaggtatttgaatgttcatttgcgcccagctatcggtttcaccggcatcgacggctgatacagcgaagtaatccagtcggccatctgtctggaactcgaaaagctcgcgcagcttgtctgcggtctgcgtgatgagaagcgagcctgaaccagcaggaacaaagatttgaatgactgctatgccggtacgctgcaccaccggaccggcgccgatttcgtttgccgcagccataccgggaatatttgtcagccgcgcccagatgggttttccggaagggtcgtaatttggcccattcggatagctgacatcttcagaggcaatagccgtctgcgccgtcatccgggagatgatggcgttcctgatttcagtgagcgtcatttgtaagcccgagttacaccgtggaatgcgttcgcgtaaacacctgttggtgcctgttgagagtgcccgttttcaaggcgttcgctataaggaaggtttgactggatataaatcaccgagtacggcttaccctgagcgatgactgctgaaccctgctggattgttttcgtgccaaccttatccggctcagcaggctcagaatagtccggggagccgatactcacgatgtgagaggccctaaatgaaccgcctgtatatcctttcggtgccgggctcatccagatgtcgggattgcctaccggtgagcctgcatgctggcagaggttactgacagcggaacggccacgtcggtgtaaacgtcgttcgagtagttggactcaacggacgcatccagatcaacccaccacggaatggtgaaggtgtttgaaggagacgcaagcaatgtgctcatgtcgcggttgttggtcaggatgcctgactgaaagaaggcggtcttttctgcggtattaacccgcatgtagtcgcgcagtttcgtcacgaaaaactacgtcagaaagaatagttggcattgcttaaatccttattgggtcgcctcatgagccttcttgagtcgctcatattcggctgggttatttttgcggagctcaacgcgctccataccacgaagttcttcccattttttggcaacccggtcaccactcttaggcgcggccccgccgccacctgcctgacttccacgcactagggatgcgtaacgcggagaggtttcgaactctttttgcaggtcagcgagagtgctgaccgtgagattgcctgactcgtcagtaatgcgtacctgcccttctgccaccttcaggcggcgggcaataaactcggtgaggatttcagcgttagagccatctgcaatggccgtagctacacgagtggcggcaaggttgatgtctcgttgctcaatggagcggcgaagttcgacgaggctgctacgttcgcgatcaagctcagcctgagagctttcaaacaactgctgatagttgccttctgcgcgggcacgttcgtcggcctctcgctgcgcctgttcttctgccgcacggcgacgctcctgctctgccttcttctctgccagaagctcgtcgcgctggcgcttgaggccgctgacgtcttcctgggggatgccatcaacctgaagctgatacacctcgccctgctgcacatacagcgcctgtttggcttcttcgagctgagcgaattcctcagcggtaagctgatacttcagagtcatacattctcctgaatggatgtgtgctggccctgccagcattgatttaaagccagtgaaacattaaattaatttaattaataattactggccgggtttaatgtgaaatgagtgaaacaagtgaaacaagtggatttttaagtagagttgcaacccaccctggatttgcagtgttctgcacattagctggagtcgcattaaccagtttttttgggtggctgggtgctcatcagacagcagctattagtgaaaagaatgcatgcattttgcgaattgatactaacgagaaaatactaagggatcagtcagcgcagtttatgtcttcgattggcgacctagttaattacactgttttccctccatccgataaaccagaggatttagccaaggttgcagggcctgtaatgaagcaaggctttgcgataagcgcttacgccccactcccgctatcacttatagctttaaagatagtcgctaatgttcagcaagcatccttggcatcaatgggttatgcagacaaagaaaatgctatgaagcttatcgatgaatcatttggtaaatggccttctactttctcagatacagtgagtgaccttgataaacaaagacaaaaatgtgggggttaatctaattcggccatctcaaaagcatgcggctctaaatctttgagttgatcgagggtgtactgcctgccgttatcatcgacgaatcggtcaatgctcaggtcacctttactgaacagcttgtagcgcgccgggccgagcacttctttctgaaatgctgcaggctgtcttgccagccattccccataggtcgtcttactactgacctgctcaacgccgtcaggcccgactgctggtcgcgttgatccggaaatgtcccgacgatactcagctttcagcaccggaacctccgacgtacggcagccccagtgaaacggtggcgatatcgcatccagtggcaccaccttgccgtccagcgaccggcagagcggtgttgttcgcccgtccagcgtggctatcgacggatattcgcgcttcatgtcatcgccgagggttttctctttggcgtaataccatgccctctgacgctcatctgtcaccaccccattctttgcctcaatatcagcgaaataatcgctcaggcgctgcggtattggctctactgggtcgattgcataaaggggattcttccaccatgagaagaagaaaaacttccagtctaactgtgagagctgcttgccctgaatgagcgccttttctgccgactggcagtaatcgaagaagtagccagccctgccttccgcagtgctttcaatcgtcgtgaaacaatcgcctgatactgcttcaaatgcaccggtaacaatctcacgtgccttgtcagggaacttagcgcatatcttgccgaactcggaaacatgcagataacgaagcgtgccaccacggaaagacgtgctgatatagagcgagccacctttgctgaataccagttcgccagctgcatcattgctcgcagggttagcggccttaatctcatcaggaaggcggtcataggcatatttaatcttctcgcggaataggcgttttgcatcgttcagggtgtgggcaatcagggcgcacttggctgcttcgaacaaagcggcgtcgagctggataatgcagacttcagttgtaaatcctaactggcgcgccttcaggatgatgtttcgggtatgcatgccatcgaagtattcgagctgctccggcgtcatccggaagcgtactggcttgccttctttgtcggttattaagtagaggtgattcaggcgccagagcttatcccgcaggagcttgaggtgttctggcttcatgctcaccccttagcgagatcgtccatcaggtcagaaagagtgcctaccacatcgtgctcagttttaacctgctcgcggaatgcctgcacggctacatgcttaccgagcagctcaaggtttttcaccttatccggccacttaatctttttgaggatgttctccatcgtcgtttcgtcaaagttggtgactgtagtgaggatgtccaaaccactcagcgtggtgcgccataccttcggccattcatgaaccatcttcagtccgccgtcatccttcaagatgtcgagcacgtccatttcgtcaatctcgaccaggcggcgcagtacataatctgcgtttacctctaccctttcgttgcgctctgatttaaggtcaatgatgcgttgcgcaatgtcaggttttgacaggttttcggatccggtacggtttgcagttttatcgctgtaccccgcccgaatagccgcttgcgtggcgttcaaatcgatgaggtactcgcgacagaacatttcttgtttgtcggtgagtgccattgatatacctgagaaaattatgaaattagaagatttcgcagcttataatcgccctcaatcgaagatgtccggagagaggaaatttcttgattacattcacagcaggaacagatggactgaacttgttaaaagcttgagtaacgcagagccggcatcaattgccatgaaatattcattccatagtcagtgggttgagtctggggcttttatacgcgaaagtatcaacaacgacttaattctcatcaagctattaacgctcttattgccaccttatgatggcgacagccttgtactttatcgtggagagaataaagcaaggttcgatgaagggcgtattggcttttgctggacacgggatctttcaatcgccgagatgtttggcagtggattgaattcatacaaatcacctggcttgcttttaagggctgaagctccagcctgttctatattagctggcccgaatgaacatagtcgttaccttggtgaaaatgagttcacggttaacccttcacttctttcaaacatcacagtttcttgagatctacccagacaactctttgttcagttgatgactacatagatgatccatgccacgcctgacaccggtaagccgattcgatggcctcccaatctagtggtgcaacaacttttccttttaaaacctcaccaccttgattttttcgaaaaaaaaccaaatatataaatatcaaaattcagcaaaaaggaatctcgatatgtctacaaacgcgcatttcaaatccggtgatcaagttgtgttgaaatcgggcggacccgagatgaccgtaaaagcggtttattctgaagaaatagtttgccaatggttcgctggtaagaaactagagcaaggacgttttgttcccgactccttgacttatccggccccaaagtcgtaagcccaaacacagttaaactatctgttgccgatgtgtcattatggatgatgaccaacctgcatgtggataagtgcctttattagcaggatgtcgttgattacttagtgaaagcaggtaatgagcagtaccttaaagaaaatgcagatgggaacttagtcctgtcagtatccactattaatcaattccgcaaagttagtggtaatgatgttgtttgggttaagcctgaaaagtactggcgtttccgcgtctctgaagatgaggaaggtcgtgaggccagaggatgagtcaatggcggctaatatgtccattagtcgccattaacatcactgcaccagctctttattgatcctatcccaaagagtctcaaatttaattttttgagcttcccctagtggtttctcaaccttaacccggctagcgccataatacaaatagctattagacgcactgtataattcatcccagacctttcgctcctcatctgaaatctgatgaactgaatacccagcccaagcctctgaacactttgtaaaagaattgattgcatcattgcgatgcctatcactagagctatagtgctgcgcgctatttaaagggctaaaatcttttggaagcattgtcaatgctattcgatacacttcgagtgacattttgtatgtttggaaggctttatgcttctcttgtacacgccaacttctcatcgccacaatagcaacaactgcggcaaaggcagttgcaatagcagctccacatgttgcaatagcactaaccattgaccaagtattttccacagaatcatacctacaggttataagatagtaattatatcgtcttattctgcgaattatttaatttaatctgacttgaccgtcatgcatctaaagtaaaactcattcagctgctctataccacgcctgccatcggtaggtattgagacgcaaagttctcacgcaatctgcattttcaacgtccgattgcaagtccatatcactgttttttcccgcctggctgagcttgcacggcgggctcatcaaatcctgagatatggttggcagcgtcgactgcctgttgccgcaaccggatagcatcatcatcaaagttacaaagagtgcgattcggattttgaacataggtcaccacgttacgggtaatggttcggtagatgacttttccatctgcgctggcggctgccgctttctgctcagtgggaaccagcttggcttcggccttctgctttttcagctcatagtcggcgttcacttttgcgctatgcgtaaaccagccattcatgtagcggatttctccgtacccgatggcaatagctatcatcaccgcgatggtgatcaggtagatgcgcaggctaaatgtcatcagggccatccgccaggcacattgagcgttccatgtcgcggcggttcatcaatccgcgccatttctgcccgcctgcataaatccagcggcgcagctcttcacacgcaccatcgacatcgccagagttgagcttcttaagcagtgatgatttggagaaacgcaccagaaccaacgttataagtgaagctgtagagtgctgcgcgctgatattcacccagcggcactttaaccatgccatccaccgacttcttaaccggctgcaggtcattccacagcaggcgatcgcattcgcggtcggtatactttttccccttgatgatgtcggtgccggtatgaccatcacagacagtccagacaccagccacatccttgtagggctcgtacactctgccctctaccccatcctttccgccgaggaataccgtagcgatagccatagctccgccacccgcgacagcaataagcttattgcgcaggctgtttgacatagccatgagttaatcctcgttgatgtctggtgcagtaggccagcgctgaagggctttgatttgtgccagggtggccttgcgcttgtaataccagttgatgccgagcgtgaaaagcgcgaccagaataccggccaggacgcctacagcactccattcatcgggactcagccgggtcaacagaccattagcgattgtcccggcagatgcgccatatgctgcgcctgaagccagtttgctcatatcgatactcatatcgccgataacctgccagagagcgagctggaatgcattgctgctgaagtcgatgcgcggatgaaccagcacaagacaaacccgctgatgccagctctgtgcgtcttcctgacgaagcattacgactacccggctattgagatgttcgatgaagacgacgagcagcacgaagccgccgaggcgtttttgcgtgaggcgatggttcgggttgggcgccgtgaagtggcaatcgaaatttaccgtaacaagcatggaaatcaggaggcggcgtaatgcagcctggcatctactacgacatcagcaacgaggactatcacggcggcgctggcattagtaagtcgcagctggatgacatcgctattaacccagccatattccagtggcgcaaggaagcaccagaagacgatgagaagaaagccgctctggatatgggtaccgcgctgcactgtctgctgctggagcctgaagagttcgacaggcgtttcattgttgctcctgagttcaaccgccgcacgacagccggcaaggaggatgaaaagcaattcctgaaggattgtacaaatagcggcatgacagtaatggatgctgagcaaggacgaaagctgaagctgatgcgggcgagcgccctcgcccatccagcgtcccggtggctgcttgaagctgaaggtcatcaggaagcgtcaatctactggaacgacgaacagaccggcgaactttgccgtatccgcccggacaagttcctgtcaggtcagcccgtcatcgtcgacgtgaagaaagtggcggatatgtcccgcttcgcccgccacgttgaagagtttcgctatcacgttcaggacgcctattaccgcgaaggcttcagcaagcatttcggcgaatatccgcttttcgttttcattgctgtcagcgagtcgatcgactgcggccgctatccggtgcgggtgtttcagcttggtgaggatgacgtggcggtaggttatgacctgttccggcgcgaccttattgcctatcacgaatgcatgctgtccggtaactggggcggcatcgaagaaataacacgcccggactgggcaaaaagaaaggattacgcatgagcaacgacatcatcaccgcgccggtcaatgaggctgataccaaggcggcaatcttcagcccgagcggcctgcagaagctacaggcttttgcggaagttatggcgcagggtaaagcaacggtacctgctcacctgtccggaaagcccgctgactgtctggccatcgcattgcaggccgctcagtggggaatgaacccttacgctgtggcgcagaaaacgcatctggtaaacggaacgctgggttatgaggctcagctggtcaacgcggtaattaccagctctacagccgtacagggtcgcttcaagtacgaatacggcggcgactgggagaagctcaagccgggcgcagccaatgcatcgaatgagcgcggcctgtctgtgcgcgtcggtgcattgctgaagggtgaaacgggaatcacctggggtgagccgatttatatggaatacgtcaccacgcacaactcccctctctggaaaacggcaccaaagcagcaactggcatacctggctgttaaatactgggcgcgcctctactgccctgacgtgattctgggcgtctacacgccggatgagtttgagccggcgcagcgagcggaacgtgatgtgactccagcacgcagccgtgctgacctgaacaacctgattaacagcaagcctgaaacgcagcagccagagcgcgaaattaacccggcgacgaataccagtgcggcagcgcgaaccccggatgaactgcttgccgatttcaccgctgcagctgctgaagctgagagtgttgcaggccttgaccgttgctataagtacgcggcacgcatgctggcaagcgaggctgaaacgctggaaaaagccactgacgtttatctgcttcgtaaagcggagatcgaagaggcgcttagctagtcacaggagaagatatgcaatcacctgaataccggcgtcgcggcaatcagttaacccttggccgccgctggtcacccaatgagataggccttcttaaagaactagcagcaaccatcccacccaaacttatagcccgacagcttaaccgctcttatgagtccgttcgccagcgcgccagccgcagccggatacgttttctggaagagcgaagcaaagttattgctggaactaagccaaatttatgacacaaatttactgtatatataaacagtatttggcttttaattttctttgttaaagcgtaatgtggctatgtaaggcaagaacataacctactgacggtaaatgattttaattgctgtaagccagtagaaatcaatttagtaatttcaccgaaaaggaatcaaatatggctgacacaactcaattagcacaacaggctatcgatagcgtaaaccagcttaaggaaatggctgatcaggcgggacaaagccaagcagcgtatgaagagctgtatgaggaaaatacacgcctgaattccgaggtagactcactgaaagaaaatctttcggacctgagtgaggttttccatcagaaagtcatcgaagaagacgattacctcagttacgcggaggacatgctgaaagatatcagcaacatgatcgacaatggtgagcttagccctctttcgattgaaaaagcagaaacgctacgcatgactctgtgggtggtggcatccatccgaaaccagcaatcaaaataacgatccccgccgtccgggcgattcgcctaagcggacgctgcgtcaggttgccggttacgatgactgatctgatgaaaacctttaagccgcctacgggcggtttttttatttcctactatctgactattttcgccgcggcatttagcatgacggcggcataaggggtaagagaacgaatcaatacaaaatattattagagctttgtttgatgaagatggattgcgaaggcaataactatcgcagacaaatatcagcaaaggcgtcaaagcactgtcacttcaaatctgagatcgccgtaaatggcggctggcgtgatattcaaatcgctgcctcaaagcaaagtgtgacatgctaacgtgagctttcacggtagcgactagttatatctttttgatagttgttgcaatgagttcttagccgtatcgaggctgtccttgcaatcgcttaactcaataataagtgctctattttggctattaacagaagctatttgctgtttaccttcttcaatttcttttctatatctgtcaacttcatcaagcatgtcttgataaccactttcaaattctttaatctctgatatttttttatctttttcggttaattggttctcaagcgcttcagataaaagaacaaggttatttacctcctcaaccttagatatatattccttttcaatgtcttcaagcttttttatatttttacgtgccaacgctgcttctaaattcaactgctcagttcttttctcggcttcagcaatttcttgcttttgcaaagcgagcgttttctccctttctgtaattattttcgcagaaaccctttcttttcttaatgagaatacagaagtcatgtaagagtcatatagatctgagaaattatgtagacctttaattgccacgttaaataacgcataaatagcattcagtgcaggtataattaataccagtacaaatgtcatttttgaggggttgtagaggagactgtttatgtttgtaactgtttcgatgtcatcaatttttaagtaaatgctcctttctgagaaaaggaatattgcaatagctttccagttaaatgagagccaagaaaatataaaagccccatacaaagggttgcttattctctgttcagagctatctctaagagaaatcattaacctgccccaaaagctactcataaaacacctgattgataaagaatcttgatgaatcatacctataaaaattgattaggaaaagtcttggtgctgctgttttgatacaaaaggccgcatggtgccggggtgtgtagtttgtgacttaatttgcgaaattgaggctttaggtaggtttcaagtaggccgtcgccgccctagatatgagcatcatatttaacgacacagtggtattggtcagtgagccagtcggtgcgcagttgagaatcattcctttacgacgcaaaccacatctcatcacgaatgacgacattgcgccgggcaatcactctactcgctgccaattcaatgtagtttatctaatccccacccaccctattcactatcgcgctctgcgtgaggagttgttatgtctgaagttagcatattggatatgtgctgtggctcgcgcatgttctggatggataagcaggatgaccgcgcggtgtttactgaccgacgcgccgagcagcatgttttatgtgatggccgcacactgcagattagcccggatatcatcgccaatttccgcgcgctaccttttgctgacaacacctttgcccaagttgtattcgatccacctcatttacagcacgccggcgaaaacagctggatgcgaaagaagtacggagccctcgataaagcgacgtggcaatacgatatccgcgccggctttgcggaggcgttcagggtgttgcggccacacggcacgctgatatttaaatggaacgagacacagattcccgtcagcaaagtgattgcactgaccgaccagaaaccaaccatctggcagcgctctggcaaaggcgacaagacgcactgggttctcttcctgaagcctgcagcatgaacaccctcagcgacatatcccccgacgagttcaccctgtggctcttcgtttttatttgcatcgtgctggtctggaactggccgtataaggagtagatatggaatccccatacatgacatttgaagaaacggctgcattcttccgccgctcagttaaaactatccgcagctggaacagccgtgatcggcgtacgggggaaaaacgcatgtgcggatttcccgacccggctcatcacggactgttcctaaaaagcgacattgagaagttcggtaagctaacttgtcacgattgatcgaactttcgcctcaccattcactatcttcattaccagtgcccaccaggcggtataggcctttctctgctcatccagataatcgttatggtcgtataccgcccagatgcccggtaaggcatgccccatcatcacttcgcaaacatgcggtggcgcaatggatgcccaccgcgtcctcgccgttcttctcaaatcatgaatcgaccaatgcggcattatctcacccctggtgcgctggtaatatgatatcactgtcttgggcaggcccattgcagatgcgctattaagcgccctttccctgtccttcttcagcgcgctctggaatatgaactccttatgcgagctcagcgccattgcttcctcaatcatcgcctgcgcagccggtatgatcggcctttttagtgatttgcccgtgttgccgcccttgtggttttcaggcggaacagtccatataccggtatcaaaatcgaagtgctcccttttgctctgaatcatctcaccagaaacggcagccaaaaagtaaaatcagctgcatgagaagcgcgtttttcctgcgcattccggtattctcaaaggtctcataaagcacgcggatctcatcatcattcagaactcgtcgggtaatgtttaccttcatgccgaaatcatgcggcttaagcccctcaatgggagttgtttcaaccagctttctgcgtagcgcccatgagtgtgcctgtttagcgtttgtcagcagccttctggcgatgccgggcttgttgctctgcacactctcaattatttcaatccaggcgtgtgtgttaacagagtcgtgcggcaggtggccaatgcgtggatttcaaaagaccggataatgtcggcggcgttctttatattaacgcctgcatagaccctgtcccattcccgcatcaccttttcaactgtcattgcgctgacgttcttctcgtatctggcagccatataaagctgagggtctacaccctcctcaagcgatcggcgtatcttcagaatttcatctctcgcctctttgagcccaagcgacggatagctgccgatatctacacgacgctgcttgccggaaaacatgtagcgcatctgaaaaaccaccttccctttttttgacacacgcacagaaaggccgtccctgtccgtcttttcaaataccctttcatgctcacgcccgtgaatagagcgcaggtagctatcggtgagcgccatgtcatcctcgttagtacataaaaaagtgaggatcgcagactaaccgattttctgtactacggcatgtacataaatcacagggatgcatcgggatgcctagtgaatggaaatgaatatgaaggactgaaatgagttgatgggtcttgttgttcagggaggatttgtgatgcgcggggatgatgaaggataaggcgttatttatcagttaattccacaagtaaatgagttgtttaatgtcgatgttaattatccatcagcaggttgaaggctgttcgcattactgtctcgttcgcaggatcaaccagagtataaggctgaatgttaccccgcgcaggctcggatgttttaaccgcacggttcatttgcgcaggcggatcgatgaaaacagggctagacatagccctgatctcagcagcagagtatatggtgcacttaaatcatcgcgccctgttgttttgctggcttagtaaagatggcattcagcgccagacagattaacccgaaccctactggcagcaggaaatcgtagctaagcagccggtaaagcccgattccggctatccctcctgcaaggaaagaaagcagggtcagacagtgcagtcgcaaccggctcagatagagcggcgcctctttcggtgacgctttacgtcgcagcacctcaaacagcattgccagctcaataccgatatcggtcgccgtgccggagatatgggtagtgcgaacgcgggcattggagatccgcgtcaccaccgcattttgcagccccattaaaaagctcaggctcattatcaacacgacaccgggcgactgcggcggaaagtgattttcaatcacccccagtccaatcagcgctgcgccctcaatcaggataacaaaggcatagatggtgcggatatttctgcggtgtccggcattaatgatcagcgttgaaaacatggaacccgcaataaacagaagcacgatcgacagaaaaaacaggccaggccccagattcgcttttgccagatgatcggacagcagcgagacattcccggtcatgttggctgaaaaaaaaccgacgatctcaaaggctgcggtattcagtgcgcctgcggcagcggcaagcgtacaggccagtcgggtatccgcgctgttgctacgggcactttccgtgctgattagcatgaccaccccatatttactggaaagccttataatccgccgattagccctgcgccacaaggcactgaatcaaactatcccctctctgtggggcattactcagcatcagggctccggactccgcgctgcataaactcagcgcggagccccctgattaacggtttgccagacggaaggtggagaccgactgcgtcagatactgcacctgctcttccagcgaggcagatgccgcggcagactcctgcaccagcgccgagttctgctgtgtgacgctgtccatctcggtaaccgcctgctcaatctgaccgataccgcgactctgttcatcagaagcggttgagatgtgctccatcagcagattcacgcggctgacagaggagataatggcgctcatcgcctcaccggtccggctgacctgatcggaaccggcgtggatgatcgaaacagattccgcaatcagcccctcaatctctttggctgcggtagcgctgcgctgggccagattacggacttcccctgccaccaccgcaaaaccgcgaccctgttcacccgccctggcggcttcgactgccgcgttcagtgccagaatattggtctggaaggcgatgctgtcgatcacggtggtgatctcctcgatcttcttcgagctggcattaatcagcgccatcgatgtcactacttcctgcgagactttttcgccactttccgcatttttcaccgcttcactggtcaggcggcaggcttcaaagacgttttcggtgttctgtttcaccgttgcgcccagctgctccatgctggcagcggtttccgtcagtgcggcggcctgctgttcggtacgtgaggcgagatcgatgttgcccgccgcaatctcctgagaggcggtggagactgagcgggttgaatcgcgcacctggagaataatggcggtcagcgcgctgcgcatctgctccagcgagcccatcagcaactgaatctcactgcgcgaaccggctttgaccggcaccgtggtatccaggacgcccgccgcaatcagcttgcagtgttcctgcgcatcattgatcggcgaaaggacatagcgcttcatgaagatgtaaatggcgacgatgatggcgaaaaacagcaccccaaacagccccagcagggtaatgccggaggtgaagtgactctgtgcatcgctgttaagctttttggcataggtttcatgctgagccagcacccggtccagaatgatttcatactgacgatcaaggcgaactacggtggcaatctgatttttaaagcgcacctgatcgtgcgcctctgccgcctcaatcaacggctgtaaaccctgctgacgataggcctgataagcctggctataggcgtcggcttcagcctcttcgcccggcagacgcggcgcgttcatataggcctgaaatgcagcatccgctttgctggccacggtccgaacgctgtccagcgtggcgggattatttgcgtcactgccctcaatctctttcatgtactccatcagacgcacacgcagcgtgcggctgtggttgatcgggtcaatcaccgagagcaccacgcggatctctttgttaaccgcattcagcgagtgattgctctggatcagcagccaggtactgattgccacgctggtgagaaacagcgccagcaggaaggagaagataatcagggaggatttttttaacgacatcgcggtgttccgaaaagtaagaggattagtcgctatatcggcagaaaggtgcgccccattagggctgggctttttttagttacaataagcgggacggcagcgggatgagcgcccagggaacaggcgctaaccgcccacgggcgtcggacggttagcgttgtgacgaagagtgaaacaggctgccgttaagcgacgcccagcgccatttttacctcgttggcgatcttctcgacctgcgggccgtagatcacctgaatgtcatgctcgctgacgcgattgaccccgttggcaccggtgctcatcagcgtctgatcgaccacctgattcatctctttgacccgcacccgcagccgggtaaagcagcaatcgacatcctcgatattggcctgcccgcccagcccgctgataattacctgagtccgttcatccgcggcgacctgttgcggtttctcatcctccgattcacggccaggcgtttcaacactcatccgggtaatcaccagccggaaagcgtagtagtagatcggcgcatagatcacacccagcgccagcgtccaccaccagtgggtttttgccccacccagcatgccgaacaccaccaggtcgataacaccgccctgcacgttgccaatcatcagatgcagcatcgacatcagcataaacgacaggccggtcaggaaagcgtgcagcagatagagcaccggcgagacaaagataaagcagaactccagcggttcggtgatgccggtggtgaaggaggtcagcgcccccgccatgaccagtgctttcacccgctgtttatgctcgggtcgggcggtgtgatagatcgccagcgccgcggcgggcaggccgaacatcatcaccggaatcttgccctgcgccaggaattgcgtggcggtgcgcagcgtctcatcggggatcgatcccggatgagtcagcgacgcgttgaagatgttcagtgcaccaacaacagtctgaccatcgaccaccgccatgccgccaataggcgtgaaacgcacggtttcgttaaggatgtgatgcaggccggtggggatcaggatgcgctcaaaggcccccagcagaaaagcgccatactgcccgcttttgccaatcatctgtccaatccaggcgataccgtcaccaatggtcggccagatcagcgccagcaagaccccaatcagtggcagacagaccacggtcacaatcggcacaaaacgccgtccgccaaagaagctgatcgcggtaggtaattgctgggtataaaagcgattgtgcagcgccaccgttaccagtccggcaatgaccccacccagtacgctcatgttgtaggtaaagacgcccagcatgttgatatattccgccgaggtcatcatggcggaggtctgatccatccccgcctgctgcagggctgcaggtgtggtggtggcggcggtgatccccttggccgccagcgtcgcgctgataccaacgttcatcacgatatagccaatcaccgcggcaaatgcggcggtaggtttttccgctttcgccagtccgatggcactcgctaccgcaaagaagaccggcagattagcgaatagcgctccggcaaccttgcgaataaagccgattattaactgcggcacctgcatctgcgcaaaggcatcgccggtgaccgcagggttctgcatggccgccgccagcccaaggaagatacctgcggcagcgatgacggagattggcatcatcaacgctttgccaaatgcatgaatctggctggtcagctgtttcatggagtcgtgccctctctgattgtgaacagcaagtattagcctgttgtcgggagaaactcccgttatcagcaggttaaaggcgggtaaaatctgaccatcatcacatttctggcttatgcacgataaacgccagctatcgcaccattaagtcaatcaattagacaaggtatgaggatagctgcagacttcctttcaccatcaggatataacctgataacaaacaccaaacaataattcctactataaaaagcctgcactcaatatgaaatttaaacgccaaatcaaaccctatcgcgcggcagcgggcggctggggttcactggaagccaccacgcgtttcgttcttgacagcaaagcggccctgaaaaatatgcgcaacctgatgcgcatgaacaaagcgcgcggttttgactgtccgggctgcgcctggggtgatgacaataaaagtaccttcagcttctgcgagaacggcgccaaagcggtgacctgggaagcgacacgccggatggtcgacaccgactttttcgctaaacacagcgtaaccacgctctatacccagagtgactacttcctggagtatcagggacgtctgacccatccgctgcgctacaacgcggaaaccgatcactacgagcccatcagctgggatgatgcgtttgcgctgatcgcgcagcacatcaaggcgatggatcatccggatcagatggagctttacacctccggtcgcgccagcaatgaagcctcctggctctatcagctgtttggtcgcctgatggggaccaataacttccctgactgctccaatatgtgccacgaagccagcggcaccggcctgaagcgcagcattggcgtcggtaaaggcaccattcgtctggatgatttcgaccacgcagatgccatttttgtcttcggtcagaatcccggcactaaccatccgcgtatgctgcacagcctgcgtcacgctgccgatcacggtgcgaaaatcgtcacctttaatactctgcgtgaacgcggtctggaacgttttgccgatccgcagaaaccgctggaagtggtgacttcgaaagcgggcaacatcagctcctcctattaccagccgaacctgggcggtgatatggcggcggtgcgcggcatggtgaaatccctgctggaaacccaccgcgcgcgtctggcggctggcgaaagcggcctgttcgatcagacctttatcaatgctaaaaccaacggcattgaggcgtatctcgacgccgtggataacaccagctggatgcagattgtggcgcagtcgggcctgacgcaggcgcagatccgtgaagccgcggcgatctaccagagcgctgaccgggtgatctgtacctgggcgatgggtatcacccagcacaaacactctgtcgacacggtgcgcgagatcaccaacctgcagttactgtttggccagctgggtaaaaaaggcgcaggcctctgcccggttcgtggtcacagtaatgtgcagggcaaccgcaccatgggaatcgatgagaaaccggcgaaagccttcctggatgcgctggggaatcatttcaatttcgagcccccgcgtgcggcaggccacaacaccgtggaagcgctgaacgccatgctgcgtgatgaagtgaaagtgctgatcgcgctgggtggcaacctggcggcggccgcacccgactcaccgcgcaccgaagaggcgatgtcacgctgtggtctgaccgtgcatatcagcaccaaactgaaccgcagccatctggtgccgggtcacgatgggctgattctgccgacgctgggccgcaccgagcgcgatctgcaggccaccggcaatcagtttattaccgtggaagactccttcagcatggtgcacgcctctgaagggatcggtattccgctggcggaaacacagcgttctgagacctggattgttgccggtatcgccgaggcggtgctgggtgatgaaaaagtgaaatggcgcgagctggcgggtgattacaacctgatccgtgagcacatcgccgcgacgattccgggctttgccgactttaacgccaaatgtgacatcccgggcggtttctatctgggcaacgcagcagccgagttgcgcttcaataccccgagccagaaagcggaatttaacgcctcagcgctgccgacctcactgttcccgaatcttgatcaggacgtgccttttaccctgcagacgctgcgttcgcacgaccagtacaacaccaccatttacggcctcgatgaccgttaccgtggcgtgtttggtcagcgtgaagtggtgttcatcaacccggacgatatggcagacctgggctttaccgaaggccagaatgtcgatatcgaaacgctgtggaatgatggcattacccgtcgcgtcagcggattcaaactggttccctacaatattccgcgcggtaacctggcggcctattatccggaaaccaacccactggtgccgctgaacagctttggtgatgacagtggtacaccgacctctaaatcggtgccggtgaagctggaactctctggggcactggccgatcagcgcatcgcctgacagccctttcactcccccctaaaaagccggctcgtccggctttttgccttgccgcgcgacgtcgattcgcgtaaaactgtcagccgcaatcagccaacgaaacgtaaaaattatgttccaggataacccgctgctcgcgcagctgaaagagaagctccattcgcaaacgcctcgtgctgaaggcgtcgtaaaaggcactgaaaaaggcttcggctttctggaagtcgatgcgcaaaaaagttacttcattccgccaccgcagatgaagaaagtgatgcacggcgatcgcatcaccgccgtgatccacagcgataaagatcgcgaaagcgctgagccggaaaccctggttgagccgttcctgagccgctttgttggccgggtacagaagaaagacgatcgcctgtcaattgtgccggatcatcccctgctgaaggatgcgatccagtgtcgccctgcgcgcgatgtcagccatgagtttgaaaatggtgactgggccgtggcggagatgcgtcgccatccgctaaaaggcgatcgcggcttttatgccgaactcaccgattttattgtcaaagctgatgatcatctggcgccgtggtgggtgacgctgtcgcgtcataaccttgagcgtgaagcgcccgatgtcagttttggcgagatgctggatgaaaatctgacgcgtgaagatctgaccgcgctggatttcgttaccatcgacagcgccagcacccaggatatggatgatgcgctctttgtggagtccctggacgatggcgccctgcgtctgactatcgctatcgccgaccctaccgcctatgtgccggaaggcagtcagctcgataagctggcggcgcagcgtgcgtttaccaactacctgccgggctttaacattccgatgctgccgcgcgaaactctctgatgatgtctgctcgctgcgccccaatgtgcgccgtccggccctggcctgccgcgtgaccgtggcagccgatggcagtttaggtgatgacgttgagttctttgccgcgtggatcgaatccaaagccaagctggcgtatgacgacgtctctgactggctggaaaacagcggcgcatggcagccggaaagtgaggcgattgctgaacagattcgcctgctgcatcgcctctgcctggcgcgcagcgagtggcgtcagactcacgcgctggtgtttaaagatcgcccggattaccgcttcctgctgggtgaaaaaggtgaagtgctggagattgtggctgaaccgcgccgcatcgctaaccgcattgtcgaagagtctatgattctggccaacgtctgcgcggcgaaagtgctgcgtgaccgtctcggttttggtatctacaacgtccatgccggtttcgatgccaccaatgctgaacaggccgcggccgtgctggccaaccatggtattaccgtggatgcgcaggcaatcaccacgctggaaggtttccgcgtgctgcgtcgtgagcttgatgcccagccaacccagttcctcgacagccggatccgtcgcttccagaccttcgctgagatcagcaccgagcctggcccgcactttggcctgggacttgaggcttacgccacatggacctcaccgattcgtaagttcggcgacatggtcaaccatcgtctgctgaaagcgattattcgcggtgagcagatcgctcgtccggatgatgcgctgacggtgacgatgagtgagcgccgccgcctgaaccgcatggcggaacgtgatgttggcgactggctctacgcccgttatctggcgccgtttgcagcaaccgaccgtcgcttcagcgccgagattatcgatgtgtcacgtggtggcatgcgtgttcgcctgctggagtttggcgcggtcgcctttatcccggctccgttcattcactcggtgcgtgatgagctggtctgcagccaggaaaatggcagcgttcagattaaaggcgaagtggtttaccgtgtgaccgatgtgattgatgtcaccatcgccgaagtccgcatggaaacccgcagcgtcgtggcgcgtcccgccgtctgagtagtgatgtactgagcagtcaatcgggcgggataactccggttatcccgcctgtttccgccccgcccgcattgcaaaaaagttaaatttgtaccccgcttcacacttctccactgattaactttcacttacattccattacattaagtttgactcgttgttttcgatcgctttcctctcggtcctcacaaggagttagtcatgaaaaacgtcaaaaccagtgcgatctggttagtggtggcgttaatcggcgcgggcgctttcgccatgctggccctcagccgcggcgaacacgtcaacgcagtctggctggtgatagccgctgtcgcctgttacagcatcgcttatcgcttctacagcctgtttatcgcccgcaatattttcgaactggacgaccgccggatgacgcctgccgagcggctgagcgacgggctcgattatgtcccgaccaataaatgggtgctgtttggccaccacttcgcggctatagccggtgccggcccgctggtgggtccgattctggcggcgcagatgggctttctgccgggcaccatctggatcctggtcggggtgatgctggcgggtgcggtacaggatttcctgatcctgtttatctcaacccgtcgtgatggccgttcactgggcgagatggcacgacaggagctgggtgcgtttgccggtgtggtaaccatgctcggcgcgctgggcgtcatgatcattatcctgtcggcgctggcgctggtggtggtcaaggcgctggcgaacagtccgtggggactgtttaccatcgcggccaccattccgattgcgctgtttatgggcgtctacatgcgctttatccggcccggtaaaatcgccgaagtttcactgattggctttgtgctgatgatggcggcgattatctatggtggtgacgtagcccagcatccttactgggggcccttctttaccctgaaaggcacctcactgacctgggtgctggtgatctacggctttattgcctccgtgctgccggtctggctgctgctggctccgcgtgactatctttcgacctttcttaaaatcggcgtgattgtcgggctggcggtggggattgtctttgccatgccagagatgaaaatgccggcggtcaccaaatttatcgacggtaccggcccggtcttctccggcgcgatgttcccgttcctgtttattactattgcctgcggcgccatctccggcttccatgcgctggtctccagcggcaccacgccaaaactggtggagcgggaaagtcatatccgctttattggctatggcgcgatgctgatggaatcctttgtggcgatcatggcgctgatttgtgcctcagtgctcgatccgggcgtctactttgccatgaactccccggctgcgctgattggtaccaccgttgaaagcgcctctcaggtgatcaacggctggggctttgtcgtcacgccggaaatgctgagcggcatcgcccgtgacgtgggtgaaggctcgatcctgtcccgcgcaggcggcgcgccaaccttcgcggtgggaatggcccacatcattaccgagatctttaacagccgggcgatgatggcgttctggtatcacttcgccattctgtttgaagcgctgttcattctgacggcggtcgatgccggtacccgcgcctgccgctttatggtgcaggatctggcaggcaccgtggtgccttctatggcgaataaccgctcctggctgggcaatatggccggcacgaccgtggcggtcgcgggctggggcttctttgtctatcagggcgtggtcgatccgctcggcggcattaacactctgtggccgctgtttggtatcggcaatcagatgctggcgtccatggcgctgatcctcggcaccgtggtgctgttcaaaatgaaaaagcagcgttacgcctgggtgactatcctgccaactgtctggctgtttatcacctcgatgactgccggctggcagaaaatcttccatgaaaaaccgtcgattggcttcctggcgcaggcgaataagttccgcaaagggctggatgaaggggtgatcatcgccccggcaaaaagcgtggcggatatgcagaccatcgtcttcagtaatcagattaacgcggccctgtgcgccttctttatgctggtggcggtcacgatgctgatctctgcgtttctttgtcattcgccgggcgctgcgcagcgatcttcctactacgcatgagtccgttgtgacgctgcgcaacaaggaggtgcgtcatgtctgatgctattcatcagtcccggcgtccgcagggagagtggcagattatccgctgccagcctgccgccgccccgcagccacagacattcagctggcggagattctggcgcggcctgcaacagtgttttcgcttaatggtcggggtgcaggattatcaaaaatatctgcagcatatgcgactccatcatcccgatcagccgccgatgaatgagcgcgatttccaccgttactgtctggatgcccgcttccccagccaggcaggcaaactgggtaaatgtccctgctgaccgcactaaacagccccgcaccgtcggggcttttttgtgccattcttatctggatgggaaaatatattcggtttgcatcttgtgctggcgtcagatgatgaatactgttgctaaaataatgagataacgcctgcagagcacttcccggaggaagtttccatgaccgatgaacaagggcaaacgttgttgtacacccttttcggtacaaccagccctcattggcgtctgaccgcggacagcgatgcgttgcattttgccgaagatgagtcgtcacaaactaatatcgccctgccgttaacccccggccaggcagccatgatacgcgcgatgccggtcatcacttcaagcatcaatctgactatgacgctgcagggcattgatgttccgatgcattttgtcggacgcaaagtgaaccaggcgacctgggcaggaaccgcttctgcctggggcgatacctcagcggtcgcccgcgacttaaccctgggtctttcattcgccgaaacaggtggtttctgaagccaactcggtgattgtgatcctcgatcagcgcggcaatattcagcgttttaaccgtcttagtgaagaatacaccggtctgaatgagcatgaggttatcggccgtaacgtctttcagctctttatgaccaaacaggaggcctctcagtcacgacgcaacattgcgggcttcttccgtgacggtaactcctatgaggtggagcgctgggttaaaaccaaaaaaggtcagcgactgtttctgtttcgtaataagtttgttcacagcggcagtggcaaaaatgaaattttcctcatctgttctggcaccgacataaccgaggagcgacgcgcccaggaacgcctccgggtgctggcaaacaccgatacggtgaccggtttgcctaatcgcaacgcaattcatcaacagattagcctggcgctggagcgatctgagcgcgatgagaccggcgtggtctacctcgatctcgataatttcaaaaaagtgaacgacgcctacggtcatatgttcggcgatcagttactgcaggcggtctcactggcgattcttagctgtctgggtaaagaccagactctgggccggctgggtggcgatgagtttgtggtgctggctgagcacaccagccaggctgcgctggaggcgatgtcctcccgcattcttgagcgcctgcgtcagcctttccgtatcggactgatcgaagtgtacagcggctgctctatcgggatcgctttcgcgccgctgcatggtgaagatcgcgagagccttattcgcaatgctgacaccgcgatgtatcacgccaaagagaacggtcgtggcaagttctgtgtcttcgcggcagagatgaaccagcgggtctttgagtacctgtggctggacaccaatctgcgtaaagcgctggagctggatcacctgctggtgcattaccagccgaaaatcgacagtgatggtgaagtccgcagcgccgaagcgctggtacgctggaactcacccgagcgcggcctggtctcccctgctgatttcattccctatgccgaagagtcgggactgattgtgccgctgggacgctgggtcatgctcaatgtgctgaaacagattatcgtctggcgccagcagggcatttttctgcgcgtcgccgtcaacgtgtcggcacgtcagctgattgatcaaagcatctatactgacctgaaacaggcactgcatgaggcgaatatcaccgactgtcctatcgatattgagctcacagaaagctgcctgatagagaatgaagctgaagccctgcggctgatgaagcagtttcaggagctgggcgcacaggttcatctggatgacttcggcacgggttactcatcgctttctcagctcgcacgtgtgccgatcaatgccatcaagctcgaccaaagctttatccgcgatattaataaacagcccgtctcacaatcgctggtacgagctattgtcgccgtcgccaaggcgctcgatttgcaggtgattgcagagggtattgagaccccggatgaagagaagtttgtccttaacagtggtgtcgatgggcgtcagggctactactacgcaaaaccaatgcccgcggaacagtttgggcattggctggctaagcatcctgcccgcgtttaacgctaattcagattaacccgctttacgcagtgatgcgctgtggcggttttgtaactgaaccaggcgttccatgtaagcaatgtctttaggttcgatggtaaaggcgtaatcgacccaatcttcggtaatatccatcagctcagcgcgtgacaattgcagcacgcgctgacgcgctttcagcatagcccgcacgccattgagtttaggacgtaacgtatcgataaaggtgcgggtggcgcggtaactgtcgccaggctggaagactttatccaccagtccgcgcgtttcataccactctgcgctgtgggactccccttcacaaattaactcctctgccagtttcatgccggaacgacgcgcgaccagtgagtagccgcccatgccgggaaagaggttaaacgcaatttccggaaagcccatccgcgcgttgttctgcgccagaatgaagtgatgcgccagcgccgcttcgaatccgccgcctaaggcactgccctcaatcatcgccagcgtcaccgcgccggtatcaaacccccgtgctgccgaatggatgcagtcaacgcaggcacgggcataggcccgcagcgcctcacggcggttattgcgaatgcactcgacaaagaagcgcagatcgccaccggcgttgaacatctgtggcaccagagagccggtaacccagaagtcgatcggcagaccggaacgctgagcggcgtagctcagattcatgatctcctcaatcagttcatggttgaagctcggacggggctgtgcacgcaacatcatccacatagtacgacgcccttcttcgtaataggcgactaactgcgtggtgttgccgacttcggtaaataatctgcacgttgcttggttaataactgtcattgtctcatcctctgtttatatttgatgcgttaaatacgccacatcagcgtaatgcagagtgaggccagaccaaatgagagattgatttacaacacaaaatccagagagatccccgactcgcgcgtcggggattgattaggcgggttacttaatagcggcacgctgctccacggcaacatgaagacgcttaacacgttttgaatagatggccgtgatgatcggcaccagcacggaggtcacaatcacggacgtcgccaccagcgccgtggcagcaggggcaatcggtttaaactgcggcagcatctcggcaatcagcaccggtgtcgccaccgctgcgcctgccgtactggatgcagctatgccagccgtgccatccccgcccccaatcagccgatcggtcagaatgagtgggatgccggtaataatgatcaccgacacgcccagcatgatgcccagcagtccggtttccgcaatgacacccaggttaatggtgttacccagagcaaaggcgaagaacggaatcagcgtatggaccgcttttccgaagaagtcgcgcagctccggatcaagattccctaatgcaaaccccacaataaacggcaggaccgcccccacaaacacgtgcggctcgaatgaggcgatgccggcggtgcccaggataaccatggtcattaatggcccggactccagagacatcagcacaaacgcacccgcctcctctttggaaccatattgctgcatgatcgaggcataaaggccgccattggtcatatccatggcagccaccagcgccagcgtcgataagccggcaaacatccctacttctacgccattctccggcatcacccgagaggcgatggcagctacaacccaggcgacggcaatcttggtaagcaccagcgtgcccgatttacgcagtaccgtcccggtggcgctgagtttaatcgacgcgcccatacagaaaaaccagacggccagaatgggtaccgtgccggtcatcaggccgttggtgaaagaaccgaaatatttcccggcgcctggagaaaacgtatgacagagtgcgccgataaagagcggaatgagcatcataccgcccggaattttgtctattgcacgtttgatatgcatatggatgtcacctttgctatgccagagggtggagcaggaagtgcccgaaggcgatgcaagcaaagtagtgacttgaggtaatcaaaacagtgatcgcctcgataaaatgaaacgctgttttatttttaatgacctgttgttttgataactatgatggagatcgccataccagtctcagatgagactaaaaaaaacgggacgccgtggcgtcccgctcgctatttttgcccgtaccaggcgttctcgccatgctttcgcaggtagtgcaggtcaagcagcgtctggttaatcggcggcagattagcggtcagctgctggctgaacaggcccatatacgccacctcctccagcacaaccgcgctgtgcaccgcagcatgagcgtctttcccccaggcaaacgggccatgagagttgaccagtaccgccgggatcgccgaaggagacaacccacgttgcgcaaaagtctcgataatcacctcaccggtgttccactcgtagtcgtgctgaatctcttcattgcgcatcgaccgggtacaggggatctcaccatagaagtcatcggcgtgggtggttccccaggcaggaatcggtcgtcctgcctgggcccagatggtcgcatgccgcgaatgggtatggacaatgccacccacttccggccaggcgaggtaaagcgcgcggtgtgtcgccgtgtccgaggaggggcgtttatccccttccaccacgtcgccactcgccagatcgaccacgaccatgtcgtcgcgcttcatcacttcatagcgcacgccggaaggtttaatcaccagcaaaccctgttcgcgatcaacagcgctgacattgccccaggtgaaggtcaccaggttgtatttgggtagatccagattcgcttccagaacctgttgtttcaggtgttccagcatctattttctcctgctgacaatcgtccctgaattttgcggagtcggacgcgaaagagttatggagcaaatggctataaacgcagaaggaatggctgtgaatgcaaaaatgtgtcgtgatttcagaattttctatcttcggaatttaaccagaacgcttagaatcctctcaggcaatgcgtggccctgtcgggtttacattgcgactctcccgctacaaacggtttgtccatggtgatcacatttccatgccgacacggatgcggcaatgatgcgacacaagcgggctgaggaaatatcggagctatactaagagtgttgcctctgtgagcacatcaaaggagaagtgtatgacaacaacaatgaaacgaatcactgccgttgtactggcgactacgttagctgttgcactgagcggctgttctaactggtctaaacgtgaccgcaacaccgctattggcgcgggcgcgggtgcgattgggggttcagtattgactaatggtagcgcactcggcacagtcggtggcgccgctgtcggtggtattatcggtcatcaggtccactaaagaccttattaaaagaataatcggctacgctaagcatctacacaacaatcgggctacttcggtagcccgattttttttcagccacccgccagtttgaccttcatgcctttggcttccagcaggcttttcagtaaatcgcgcttatccccctgaatctcgataacgccctctttcactgaacccccacagccgcacttctttttgagttcggccgccagcagcgtcaatgccgcgtcgtccaggtcgataccggtgatcaggcagacgccttttcccttgcgaccactggtctgacgctggatgcgcacaatgccatccccttttggccgttccttcgccggctccggctgggtaatgcgcccgctgtcggttgagtaaaccagtggattatccttcgccattattgtgtctccagactgtgcaggatcgcctgcagagtggcggcgggatcggcggattgggtgatcggacgcccgataaccatatagtccacgcccgcctgcttcgcctgctcaggtgtcatgatgcgacgctgatcgcctgcatcactgcctgccgggcgaatccccggcgtaaccagcgcaaactcctgacctaaaacctgtttgaagcggacagcctcatgggcggaacagaccacaccatccagcccgcacgacagtgtcagcttcgccagtcgctctgcctgttcggcaggcgaaagcgtaatgcccagccctttaagatcttctgcatccatactggtcagtacagtcaccgcaataagcagaggcgcatccttaccaaagggaagcagtgcctcacgcgccgcgttcatcatccgtgccccgccactggcatggacgttgaccatccagaccccgagatcggcagcggccgccacggcatgagcggtggtgttgggaatatcgtggaatttaagatcgaggaagatttcaaagccgcgctgctgcagagtgttaaccagcgaggggccaaatagcgtaaacatctctttgcctactttaaggcggcaactgcggggatcgatctggtcgacgaaacgcaatgcgctgtcgaggtcatgataatccagcgctaccagaatcggcgaagcggtcacgttgtggggtgaaggcatggcatttcctctgcaacaggcgcccgcaggcgcaatagacaaacggcaagcattctacctgcggtgtctgaccatcacaatcgccattgcccttctgcctggcaaattctgctctgttgctgagggttgtaagctaattcaacctatagtatgttgtaactataatgagctattaatggtgcggctgcagcggccggtttactggccgtcgaggccgcggataggcttaaccgaagaccaggtgcggcaggatgggcaatgccagtagagtgcgtgggcggtaaagccgcacttctggcagcgatagcgcggcttggtgcggatctgttcgccgaccatgtcacgcaacaccatcaggctctctttcgcccggccatcttccgcttcatgcagatttaaatccatcaggcggtggaacacccgcatggtaggatgacgctgcagctgacggctgatgtaattctgggccgcttcgggcccctgctgctgctcaaggatgtcagacagatagagctccgcagccgcgccggtgttctcttcaacacagcgatgaagaaactctgaccaggcgtcgggctgattgagctgctggaaacaggtttccagcatccccagcgtttcactcaccagctctttatcctggtccagcacccgctgcagatggcccaccgctttagcgtaatcgcctttttccatcaggatacggcccatcatgatcgagatacgtgcgctgttgcgatcggccgactcccctttcttcagcaggctcatggcacgatcgagatcgtcgctgctcatcgcctgcagagccagttcgcagtagaagtgggctatttcgcctttctgcttctctttgccaagcttaaccagccgctctgcgacttcaatcgcctgctgccagtcgctggttgcctggtggatcagcagcagttgctgcagcgcacccacgcgaaagtcagtttcatcggtgagctgcttaaacatatcttccgcgcggtcatataagcccgccgccatatagtcgcggcccagttgctgtacggcaagcagtcgctgctcatagctcagggaggcgctttccattaaagcctgatggattcggatggcgcggtcgacctccccgcgcgaaacggaacagattgcccagcgtcaggtgtgcttcaaccgtgccgctgtcctctttcagcatctcaaggaagaggtcgaccgctttgtcctgctgattggagagcaggaagtttacgccagcgacatattcacgtgacagtcggttggcttcctgttgcttatcctgatgcgcgctgcgacggcccatataccagccatacgctgccgccaccggcagtaacagaaacagcaattcatgcatcagggattattcccggccagccggagaagatggcgtggtcgccagggcagtactctgctcgatttgggtctgcatacgcttaattttccggttggcattcgccagggagacgcgggtccgtaaccagaacagaccgcagatgatccagccaagcacgaaacctgcgccaaacagggatgccagtaaggtcgagatgctgaactcaccctgcgccagcagatagttaaaagtaatgacctgatcgttatgcgcacccagggtgacggaaataatgaaaatgaccagtaccactaaaaaaatcagcaaatatttcacagtgcatcctgttgtgaggttgtcgggtagaattatgccaaaactccagcaaaaatgctgctcccagcagcatcgggcgggtcgcttttacgcaggcccgtctaataatatggggtcttacgggtgaattacaatcagggctcccgctgcgccacctctttttgctcttccggcggcagcgtcagcgggccacagaatcgctgcgccagccaggtggcaatggtgaccagtagccaggagagtatggttgccatcgccagatcccgtggccagtgcatgcccagcagcagacgactcgccattacgccggtggcccacagaaagatcaccaccacggttttatagtgccgacgcggccagagcagacccaatgccagcagcgcccagctggcggcaaacatagtatgtcccgaagggaaagcgaaaccggtttcaaacgcccagtgccgtttcagccagcctgggatctgtgtctcatcggcaatcagtgaggttaccatctcgccacgctgtttgcgcttcagctcgtagaaggtcttttcatccagcccgtgatgctgttccagccagatcacatagggacgcggctcctgaatctgctctttgatataggatttggtgtattgcccggccagaatggtggcgttcatgatcagcagcagtaagatagctggcttcagccgaaagcgcaggcaccagagcatccaggcactcagcacgacgctggtaacaatgccccaggggttggtgacggtctcggtcatccagaagagacctttcagcagcgcattgctttcgcctggttgccagcgccagccgctcagccagactgcaaccggcatgattagcagcagcagcattccaaaggtggtacgacgtgaaatcttaaacatcctcttcccttatcccggcgtcaaaagacagcaattgcataactttagcttaaaaaagaataacataaccgttgccgattggataattgtgctttatcactgcaattggtatcagagattaccagcccgcttgcgggttgtggcacaatattgcacgtttgtcgggccacactggcctgtgcactatcatgatgatagtgcatcctctgaaggtttctggagagtcacatgcagcttaaacgggtggcagaagccaaactgcccacgccatggggagatttcctgatggttggttttgaagaactggcaaccggacatgaccacgttgcactggtttttggcgatattaatgataacgagccggtactggcgcgcgttcactctgaatgcctgaccggcgatgcactcttcagcctgcgttgcgactgtggttttcagctggaagccgccctcaatgccatcgcagaagagggtcgcggcgcactgctctatcaccgtcaggaaggccgtaacatcggtctgctgaacaaaatccgtgcctatgcgttgcaggacaaagggtatgacacggtagaagcgaaccatcagcttggctttgccgccgatgagcgcgacttcacgctgtgcgccgatatgttcaaactgctgggcgttaatgaagtgcgactgctgaccaataacccgcgtaaagtggagatcctcagcgaagccgggatcaacattgttgaacgcgtgccgctggtcgtgggacgtaatccaaagaatgcgcactatctggatacgaaagcggaaaagatggggcatctgctgccgaagtcataaataagctgggactcactggcatctgacccttgaagaagccaaatctgagagaatcctgaagcaacggatcagctcaacgcgcagggggcacggtcagaagaagaaagcgtcccgtcgcccggataaaaacgccgggagcgtttttgaacaacgcaaagtgttggcccggtacgggcgcacctcagggatgaggtgcgtaattgcgcgggccgggcatgtcatggatgacggcttttgcgtctttccgatctgaccgtgttccctgtgcagccacggtctcacagcttcttattacagactttgtaagctacataaaaaagccgggtttccccggcttttttatcagtccagcatattgcggataacgtagtgcaggatgccgtcgttgcggtaataggtcagctcattaccggtatcaatgcgacagcgggtgtccagctcttccttactgccgtcagcacgggtcagcgtcactttaacgctgcaaccaggcgtcagtgcctgaagattttccacgtcaatgcgctcctcaccggtcagccccaggcttttgcgggtcacgccctgcggaaactccagtggcagaatgcccatcccaatcaggtttgagcggtgaatacgctcaaaagattccgcaattactaccctgaccccctgcagacgtggtcctttcgccgcccagtcgcggcttgaaccagagccatactcaagtccagcgatgaccgccagcggcacgccttccgcctgatatttcattgccgcatcatagatggccagctgttcgccacttgggtagtgtcgggtataaccgccctccacgccgggcaccatttcattacggatacggatgttggcgaacgtgccgcgcatcatcacttcatggttaccgcgacgcgaaccataggagttaaagtctgtacgctccacgccgtgtgacagcagataccggccggccggactttccgctttaatgctgcccgccggtgagatatggtcagtggtgaccgagtcgcccagcatggcgagcactcgcgcaccgcgaatatcctgcaccggcttaggctctttctccatatcgtcaaagaaaggcgacagacgaatataagtcgagccctcatcccagtcgtaagtcgcggcttcactcaccttaatctcctgccactctggcgtaccgtcgaagacttcagcgtactctttatggaacatgtcgctggtgacctgctgcacggccgtagcgatctcttccggcgaaggccagatatctttcaggtagaccggctggccctgacgatcgtggcccagcggctcggtctgcaggttgatcttcatgttacccgccagcgcataggccaccaccagcggcggcgacgccagccagttggttttaatcagcggatgaatacggccttcaaagttgcggttgccggacagcacagcacctactgtaaggtcgccggctttaatcgcagactcgatttcatctttcagcgggccggagttaccgatacaggtggtgcagccataaccaaccagattaaagcccagctcgtcgagataggaggtcagttgcgcgacggccaggtaatctgaaaccactttagaaccgggtgccagcgaggctttgacccacggctgacgtttcagaccccgctcgaccgctttcttcgccagtaaaccggccgccattaagacgctggggttggaggtgttagtacaggaggtaatcgcactgatcaccaccgccccatcggtcagcttatgcgtcagtccggtatcactgtcggtatactcaatgattttatggggtttctgcgcctgattcacttccagctcgttgctggcatcaaacgcggcgggcacatcgcccagcgacacccgatcctgcggacgttttggtcccgcgagactcgattccacctcgttcatatccagcgccagagtgctggtaaaacgcggctcatcgccaggattgcgccacagcccctgcgctttggcataggcttccactaatgctacctgttcggcatcgcgtccggtcagggtcatgtagctcagcgtgacgtcatcaaccgggaagaatccgcaggtcgcgccatattccggtgccatgttggcgatggtcgcgcggtccgccagcggcagatcggccaagccatcaccgtaaaattcaacgaatttaccgacaacgccgtgcttacgcagcatctgggtgacggttaacacgaggtcggttgccgtaatgcccgcccgcagtttgccggtaagtttgaaacccaccacatccgggataagcattgagacaggctgaccgagcatggcggcttcggcttcgattccccctactccccatcccagcacgccaagcgcgttgatcatggtggagtgagagtccgtaccgaccagcgtatcgggccaggcatgctcttcaccatcaacggtttcatgccagattgccttgccgagatattccaggttcacctgatggcaaataccggttcctggtggcaccacgcggaatttatcaaacgccttctggccccagcggagaaagacgtagcgctcatggtttcgctccatctccagccggacgttctcttcaaaggcgtcatcattgccaaaatggtcgacagtcaccgagtggtcgataaccagatcaaccggtgacagcggattaactttcgccacatcgccgcctagccgattcactgcttctcgcatcgcagcaaggtcgactaccgcaggcaccccagtaaagtcctgcattaatacacgggctggccggtaggcaatttcacgatcggcgtgggcatctttttgccagtcaaccagcgcctggatgtcctccgtcgtaacagagtcaccatcctgatagcgcagtaaattttccagcaggaccttgagggattttggcaggcgatcgatattgccaaggtgttgagcagcatggggaagactgaagatgtgatattttttggtgtcgacctgcagtacttcctgactctgctcgcgtagggtagacgacatagctcctcctttcattcatggtctttaaacctcagagagacaaaggtttatgttaaagatagaccacaatttcgttaacgttttgattacaacacaaattgctacaatcgatcgcaaacgaaaatgccccgtgaagtcacgaggcatcatgaaaaggtgattttaattcaaattacagggttatccacaccgccgcagaccagaaacgcaaaggagaatgcatacgcgctgagccaggacattttaataatattcatttggttcactccttcgccggaatcgggcgtaaaagtttttgcggtcaccttatagaaagaggcgacaccctttggtcgtacaggatgtggtaggggcatttataggcccaccggaaattccggttttaaaagaacagtgacgaagaaatggtctgaaaacgttatttgtttttagggtccagaaacgactcaataaaaagtctctggttatcactcaaatcccatgaatcggggatagacactttttcgtcctttgcaaggggttcttttcctttacaggagaccgtcttgtgctgacccgaggtcagggaacgtttatggctgagtgtatttgcccacatggctttagccccagatacgccaaatcattaacgcgacaactacccaaaacagcgcagaggcagcgaatacggttaaccaggctttgcgacgagtgttgccggtacgctcaaccttggtgctttttgccgggaaacccggttgtacagtcagtcgtgtattcatagtttttgataatcactctcaacaaaatgattgataacatcgattaagatttaggaggaatcctaaacgcgttaaggccaaaaatccagttatttttattgagtacaacgattaacggtattaatcaatgagctcaggtaacgtaagaaatcattaataccggaactaatatttaattaaaaaacccgctaaaaaatttgagttaatttaaaaacagatccactcaaaactatagatgacacttaagaaccttatgtttactggcttcccacgttagctcttaactggagtatgggaatattcctggcaagccgcaaagtgacatagttaaaaatgtgttgtaattcgcatttaagaaagcccgatgaggaaacatgtgatcaatgtttcatttacaaaaaaatcataaaaacttttgagtctcatttggcgctaaagcctggagacaaaaaaggctgcaccaggcagccttatgtttacgcggggaggttaaattctatttaaacggcagtttgatatctttaaacatcgcttcaatgtcttcattggagcgcaacgcaaccgcagtatctaccacatcgcgcgtcaggtgcggcgcaaaacgttggataaaatcatacatatagctgcgcaggaaggtgctgcggcggaatccaatcttagtggtgctgttggtaaagatatcggcggcttcaatgcgaatcaggtcaggatcggccaccggatctactgccatgctggcgataacaccaacccccagacctaagcggacataagttttgattacgtcggcgtcggtcgcggtaaagacgatgcgtggcgttaaacctgcacgattgaaagccgtatccagttctgagcgcccggtaaagccaaaggtgtaggtcaccagcggatattcggccagctcctcaatggtgacctgcccttttccggccagcggatgatcggcagtcaccacaattgcgcgattccagtggtagcacggcagcatgattaaatcgtcatagagatgcagggcttcggtggcgatggcaaaatccgcattacctttggagacggcttcggcgatctgggttggagaaaccctgatgcatatgcaaagagacgcgaggatagcgctcaataaatcctttgatcacaccaggcagcgcgtagcgagcctgagtgtgcgtggttgcgacatagagcgagcctttatcaggccaggtgtgttcaccggctaccgatttaatcgcatccactttggagagaacttcacgcgctatacggatgatctcttcccctgcaggcgtgacctgggtgagatgtttaccgctgcgggcaaagatttgcacgcccagttcatcttccagcatacgcacctgtttactgatgccgggttgagaggtgtagagaccttccgccgtcgaagagacgttgagattgtgattaaccacttcaacgatatagcgcaactgctgtaatttcatatctattccatcccggtaagttacagagtcgcatccccggttgacgtatagtcgcgagggtaaagagatgctatgcatcaggaaaggtcggaaatgctataacaactatatcagtttaagtgagagagtagaacggattgatataaggctcagaaaaaggccagcgagcgctggccttcagggattactttttcgcttcctgccatttgccatctatatagaaggccgaccagccggttgccttgccctctttttctgaggagacatactgctgtttggtcttgcggctgaaccgcaccagcgttttgttgccttccggatcggctgctggcgcatcggccagatatttcagcttctcaggcagacgatctttgaagcgctgaagctcttccaccagcggcgcacgcgtctcgcgtgatttcgggaaggtgttggccgcgaggaaaacgcccgccgcaccgtcacgcaacacgaagtaggcatctgacttctcacacgccagctctggcagcggaaccggatcctctttcggcggagcaacttcaccactacgcaggatcttgcgggtgtttttgcactcttcattggtacacgccatgtacttaccaaagcgtcccatcttcaggtgcatctccgaaccacacttctcgcactccactaccgggccgtcatagcctttgatgcggaattcgcccttctcaatctcgtaaccatcacactccgggttattaccacagacatgcagtttacgttcgttatcgatcaggtagctgtccatggccgtgccacacttctggcagcgacgacgggcacgcagggcgttggtttcagcatcatccccttccagaatattgagaacttcattttccgggatcaggttgatggtctgtttgcagcgctctttaggtggcagcgcatagccggaacagcccaggaagacgccggtactggcagttcgaatccccatcggacggctacaggtcgggcagtcaatcgaggtcagcaccatctggtttcggctgcatcccgccctcttcaggatctttctcagccagttcaagctgctgggtaaaatcggtgaagaagtggtcgagtaccgctttccattgcgcctggttattggcaacctggtcaaggttgctctccatgcgggcggtgaaatcataattcatcagttcgcggaagttctcttccagacgatcggtgacgatttcacccattttttccgcataaaaacggcggttttcaacccgtacgtagccacgatcctgaatcgtcgaggtaatggcggcgtaggtggatgggcgaccaattccgcgcttctccagctcacgcaccagtgacgcttcgctgaagcgcgccggtggcttggtgaagtgctgaccgggcagcagttgctgcaggtccagaacatcacccacgcttaccgcaggcagcgtacgatcttcatcattcttacgcagcgcaggcatcactttggtccagccgtcgaaacgcagaatacggcctttcgctttgagccggaaatcaccggcggcggcagtaatggtgctggagtcatattttgctggtgtcatctgacaggcaacaaattgacgccagatcagctgatagagtttctgcgcatccgcttccatatctttcagcttttccgccaccacttccacatcagaaggacgaatcgcttcgtgcgcttcctgggagttctctttgctggcgtaagttatggcgttttcaggcagatactttttaccgaaattgctttcgatatagccacgcgccatggcgaccgcatcctgactcaggttggtcgaatcggtacgcatataagtaatgtggcccgcttcgtacagccgctgggccatcatcatggtcttcttgacgccaaagccgagacgggtgctggcagcctgctgcagtgtcgaggtgatataaggcgcgcccggcttgctgctggtcggcttatcttcacgatccacgatctcatagcgcgctttttccagcagcgcgacggcggcatacgtctcgtcgcggttgaccggacggaaggctttatcgcctttgtgcgtcacgtccatcgacagctcatcgcctttcggcgtggtcagcgcggcattaacttcccagtactcttcgggaacaaaagctttaatctcacgttcacgttccaccaccaggcgaacggcaacggattgcacacgtccggcagagagaccacgggcgatctttttccacagcagtggcgagaccatgtagcccaccacgcggtccataaagcgacgcgcctgctgagcattaacccgatcaatattcagttcgcccggcttttcaaacgcctgacgaatcgcattcttggttatttcgttaaacacgacgcggctgaagcgcgagtcatcaccaccaatcacttcccgcaggtgccaggcgatggcttccccttcgcggtcaaggtcggttgcgagatagatgtggtcagcattggcggctaacgccttcagtttcggcaaccactttctctttgccgggcagaatctgatagtccgcttcccagccgtgataggggtcaacacccattcggctgacgagtgcggccttctcatcttttttaacttttttgacttttttgtcagtcgaagcgtctttgactttcttatctgtcgaggcgtcagcactttttttcgcggttgaaccactggtcggcagatcccggatatgacccacgctggatttaaccacgtaatcactacccaggtatttattgattgttttagcctttgccggggactcaacaataacgagtgctttacccatatttacctttacctaatgaaaacatcctgcttaacgggagaggattggatgcccaaaaacccaatgggttcaatattgctgcgcctgtttaacatttcaaggcggaggggtcaatctcagatcagatgatgtggcgttatgcaactgcatgataaagagtgctttttctatctgaactcatcgcacatcctggtgcaaaatccctgaaatcggaatcgcccacactctacctgataaaatctgttacgcaacttaattagcactcagcccggacttacgccaggttttcatcgattacaccgatttgtcacaccctgtgactcgccagtaatatagaaaggattggagtactgtcaaacaggagtgaataaatgcagagttcaactcaggctatttcccgccaggcgttgctggaaaaggccaatgcgctgatcaaagaacatgatgattattaagcgggaatgcaggcggatgaggtgattcagcagggtgaagtgctggtatttcgcggaccgttttttctcgatgccgatggagtgccgacggctaaaaccacggcggtgtttaacgtgttcaaacaccttgccgtggtgctgtcgccgctctaccacctggaatgaaaaaacccggcgcaggccgggtttagcatcatcagatcatcagagcagtggcttttcgccgcgctgccagagtttcagcagcaggcgctctgccaccgagccggcgctctgcgtaaagcgatccatcaccttacggcggcgggcataatgcacgccgagcacgctgaacttatccatctgacggatgatcagatcatcgctggtgccgatttcgtcaaccaggccgaggtccagcgcctggcggccataccagtgttcaccggttgccacctgatcgatgtcgagtgacgggcgcatctggtggacaaactgcttgaacagcaggtgcgtttcgtcgagatcttcctggaatttctcacgtccctcttcggtgttttcaccaaacagcgtcagcgtgcgcttgtactgtccggcggtatgcagctcaatatcaatatcgttccgtttcagcaggcggttgaaattggggatctgcgcgaccacgccgatggagccaataatcgagaaaggtgctgccacaatacgatcggctacgcaggccatcatgtaaccgccgctggccgccactttatccacggccgccgtgatacgcagaccctgatcgcgcagacgctgcagctgcgaggctgccaggccatagccatgaaccacgccgccagggctttcaagacgcagcagcacttcatcgccaggctgcttgacggccagcacggctgaaatctcttcgcgcagtgaagtcacctcatgggcgtccatgctgcctttgaaatcgagtacatagagcgtgggcttcgcactgtctgtctgcccctgcttcgccgcctgcttttccgctttggctttcagcttttcacttttcttatgatttttcagccagactttttgtgcctgaggcttcatttttgccagctgcaaatcctctttcatctgttgatagtcatcatccagatgtgtcagtcgaagctgaccgttttgtgcccgtttgcgtaacgcggcattcatcacaatcatgacaatcacagcgacggcaaccaccagtgtcaccactttcgctaaaaacagtccatacgttgaaataaaatccataggtcgccttagtgaactgagaatcaaaaacagttcgccagtttagccgttttgccccgcttcgtcgcctgaaatgccagcagctggcacagaatgcgtgggttggcgattgcgcccattcgtaaattcaggcataaagcggaatcatgctgttttcgctggaggaccccgctgtgcattatcaaccgaaaagcgacctgctcaatcatcgcattatcctggtcactggcgcttcagatggcattggccgggaagcggcgctgacttatgcccgctatggcgcagaagtgatcctgatgggccgtaaccctgagaagcttcagcaggtcgaacaggcgatcaatcaactcaatctctgcccggctcacactgtggtgttcgatctggccgaagcaacaccggaacgttgccagcaggtggcagaaacagctggcacagcagttcccgcgtctcgacggcgtgctgcataacgccggtatcctcggtgagattgtgccgctggctgaactcgacccacaggtctggcagcaggtgatgaacatcaacctggacgccaccttcttcctgacgcaggcgctgttgccgctgctgttaaaatcggatgccggttcactggtgtttaccacctccagcgtgggccgtaccggtcgcgcgggctggggggcttacgccgtctctaaatttgctaccgaaggcatgatgcaggtactggctgatgagtataagaaccagtcgctgcgggtgaactgtattaatccgggcgggacgcgaacaaaaatgcgtgccagcgcgttcccgcaggaagatgccaataagctgaaaacccctgccgatttgatgccgctctacctttatctgatgggtgatgatagccgtcgtaaaaccgggatcagctttgatgcccagccaggcagaaaaccgggagccgctgaataatggctgacgatcgtcatcaacagcgtcagcagcggttaaaagaacaggtagatgcgcgtattgctgcagccacggaggttcgtggcatcctgatggtctttaccggcaatggcaaaggcaaaacgactgcggcctttggcaccgcactccgcgccaccggtcatggcaaacgcgtggcggctatccagttcattaaaggtgactggccgaatggcgagcgaaatctgctggaacagcacggtgttgaatttcaggtgatggcaaccggctttacctgggatacgcagaaccgcgaaacggataccgccgcctgtctggcggtgtggcagcatgcaaaacggatgctggccgatgagcagctggatctggtggtgctcgacgaaatcacctatatggtcagcatggattatctgccactggaagagctgatagcggccctgcaacagcgcccggcgcatcagagcgtcatcattaccggacgtggctgtcatcgcagcctgactgagatggcggatacggtgactgagatgcggccggttaagcacgcttttgatgccgggatacaggctcagcagggaattgactggtaacagaaaaagaaaacgcagccctggggctgcgtttttagcgatcgggcaacgtgattaaccggagttacgtttgctgcccggattgcggcgtggtgcacgtggggtgctgctcactttactgtgacgtttcacggcacgacgaatctggttcgctttggtgcgacgacgatctttttcgaccaccagtttggtaaccgtttcatcatccatctccaccagattacgcaggtagttaaccgcaggcagatccagtttcggtccagccaccgcgtggcaggccttttggtaaggtgatatcgccgtagcgaacacgcatcagacgactgacctgcacgccgaccgcttcccataaacgacgcacttcacggttgcgtccttcggtcagggtcacgttgtaccactggttgatcccttctccaccgccaaatttcagggttttaaaggcagccgggccatcttccagctgaacgcccttgctcagctgacgaattttatcatcgtcgacctgaccaaagacgcgcaccgcatattcacgttccacttcacggctcggatgcatcaggcggttcgccagttcaccgtcagtggtgaagagcatcagaccacaggtgttcacatccagacggccaacggcaatccagcgtgaaccgcgcagacgaggcagacggtcaaataccgttgggcgcccttcaggatcgctgcgggtacagagttcaccttctggtttgtagtaagccagcacgcggcaaacttcggttgctgattcagcaatcgagaccagatggccatcaatacggattttcagagatttgctgctttcaacgcggtcgcccagggtggcgatcttgccgtcgacgctgacacggccagcggcaatcattgattcgatttcacgacgcgagccatgaccggcacgcgctaagactttctgtaacttttcgctcattgagcttcctctttgtcgccttcccaggcgtcacggtagggtgataattctttctgaatcaacaggttaacctattaattcggccccattatacaggcatttacccctgaagtaacgcgctttatgagtgggtctgaagcgaattaagaagggtcagcctctgatagttttagatctgataatatctgacgctgatttaaataatccccgtgcatctgacaggaataagattaataaaatgcatgtattaaaaactttatagctgatgacaattaaattttctaaccactttagtttcatcaacgtaatgttctggtgataaaaaccttaacactatcttacactttcgctggttttcccttgcttttattcttcttaaaaaaacattaaagttagcacaaacaactgttttaatgacttaatccattataaccgctcggtaaatacaaaaaacccagattttttctaacgcagatttatttaaggccttattttcaaggacatttgattcttattagctttaataaattgtacgacactattaagctgatatactttattcctgtagcacaataaaaagcaggactcacgacagaggggtcttgcaacaatgaagtccggcttttgttattcgtttataaaaatagtctttttagattaatccaataaaccggcgcatccggagttgttgcgttaatacggttcagtgatgaaccttgcttgcatgtcaaaaatcttcaccagggatttcccgacatgcctgaataaagaaacccatcatgaaaaacctgttgctgtgcccggtgcttgctgcactggtgctgagcgggtgttctgtgggccatactgagtacagtcgtacggcgatgcagcacgtagatatgagcgtgactggcattccgacgatcctcggtctcggcacactgggcaccagcattcctctgacgcctgaatatagcctgacagctgcgcacgttgccaaaactgccgtgcagcgcgtcaagtcttatcacccttattgcgaccttgcgattatttatcacaagaatgacgccagcacgctgactaagtttccgcagcagcgacatcggcgatccggttaaaatgtatggctacagttttatttcagcgatgccggttgaatcgaccggagttaatttagcccgtacggctattcggaataactggaataaaagtccctgtatagccatggcctccaatgcaggtgttgttcaggggatgtcgggcggcggcgtttataaccgtgatgatacgctgggcggcgtgattgttggctattctgactcgattaaaaatgggcgtaataacaaagtgatcctgaaagatgtgtcactttatattccttacggccagtttaaaagctggctagagtcgaatctggcccagacaccgacacgcggtgcctgagcctgagggcttacaggaaacgggcgggtatcgcccaccccttcacgcacaatttccggcgcatcggtggtcagatcgaccaccgtggtcggctgctggcccagcgtgccgccgtcgataatcagatcgaccagcttgccgatgctgtgctggatctcttccggatcggactcggtgaaatcgttgcccggcagaattaatgaggtcgacatcatcggctgattcagtgcttccagcagcgccagcgccacgggattagagggcacgcgcagaccaatggtcttacgtttttcattcatcaggcggcgcggcacctctttggtcgccttgagaataaaggtgtagttgcctggcgtgttgtttttcagcaggcgaaacgctgagttgcccacctgcgaatagaccgacagctcagagagatcccggcacatcagggtaaagttgtggtgcccgtcgagctgacggatacgacagatacgctccatcgcgcccttctcctccagccgacagcccagcgcatagccggaatcggttggataaacaatgacgctgcctttgttcaggtagtcaaccgcctgattaatcaggcgaggctgcgggttgtccggatgaatatgaaacaattgactcatagaaacctcgtgtcacctttccgtgattgccaggctgggagccagatccgggaagcgctcccagaccggctcaaccgccgcgggcagccagagtttgcggcccagttcaatccacggacagggttgatgaaaatcagaaccttgtgatgcggccagttcattatctctggcgtattgcgccagcgtcgtgcgctcattaggtggctgctggcactgcgcgacttccatcgcatcaccgcccacttcgcggaaatgggcgaccagccgtttgagccactttgccgataaaccgtaacggccaggatgcgccagcacggcgcagccaccagaatgatgaatagcatcaatagcttgtttaattgtacaccattgtggcggcacgtaaccggttttgccacgcgccagataatttttgaatacctgcgccatattctctgctttaccctgctcaatcaggaagcgggcaaagtgaccgcgggtaatgatgccgccatcagccagtcgcgtggctcccgccagcgcatccgggatacgtgccttcgccagtcgctcaccaatctcttctgcacgtgcttgccgacaggcatgttgtccggccagaaacgccaccatcgccggatggcggatatcaatgttaagtcccacgatgtgaatctcatggttctcccacagggtggaaatttctgcgcctgccagcacttttatcggtaaatcgtgatcgattgccgtttgctgcgcttcatctacccctgcaacgctgtcgtgatcggtgatcgccagtacgccgacgcgcatctcaaccgctcgctgcaccagggcggctggcgtcagtaagccgtcagaggcacgcgtgtggctgtgtaaatcataaaccgggaaacgggcgatatcgctcaagagaaactcctgcaaaaactaaaccggccagcatgataacgattttcacggtcagtgaaaaagtgtattgacatttccgccctgaacccgttaactagtacacaagttcacacgtaacgggtattcaatcatggctgttgtaatcacgcatttaaacggttggcgcgatgttcccgaaaacgggcgacagggtcgtgcacactttgcgtaaacgctgtgctaatacctgagcccgccaccgagcgggcttttttttgagcgaaattcagagaaatcatcatgccaaatgcgaaacctacagtgaagttgattaccggcaccgcaccctaccgcgaagatccggccgcagtgtttcaccagctgtgcggcgcacgtccggcaaccctgctgcttgaatccgctgacatcgatagcaagcgcaacttaaaaagcctgctgattgtcgacagcgcgctgcgcgtcagcgcaatgggcaataatgtcaccgttcaggcgttgtcagaaaatggccgcgccctgctgccgctgctggatgaggccctgcctgcgtcggtcagcaatcaggttcgtcccgatggacgcgagctgacttttccgcagagcaccgaccatcagcaggatgaagattcccgcctcaaggccctgtcggtgtttgatgctttgcgtctgattccacaactggtcaactcccctgccgatgagcgcgaagccgtactgctgggtggcctgtttgcttatgatctggttgccggttttgaaaccctgccggagctggataaccagcaacgctgccccgactactgtttttacctggcagaaaccttactggtgatcgatcaccagacccgcagtgcgcgtcttcaggccagcctgttctgcccatccaccagcgagttccagcgcctgcagcgccgcatcgagcagttgcacggccagatgctgcagccggcaccggctctgccggtccagccggttgaacagatgacgctgaccaccagccagagtgatgaagagtattgcgacgtagtacgcacccttcagcaggcggttcgcatcggcgaaattttccaggtcgtgccgtcacgtcgcttctcgctgccgtgcccgtcgccgctggctgcttatgagacactgaaaaacagcaatcccagcccctacatgtttttcatgcaggatcaggatttctcattgtttggcgcgtcgccggagagtttcgctgaagtatgacgccacctcccgtcagattgagatctacccgattgccggtacccgcccgcgtggccgccatgctgatggctcactggaccgcgatctcgacagccgcattgagctggagatgcgtaccgaccataaagagctggctgagcatctgatgctggtggatctggcgcgtaacgatctggcgcgtatctgcgtgcccggcagccgttacgtggctgacctgaccaaagtcgaccgctactcgtttgtgatgcatctggtttcccgcgtggtgggtacgctgcgcgcggacctcgatgtgctgcacgcttatcgcgcctgtatgaacatgggcacgctgagcggagcaccaaaagttcgcgccatgcagttgattgccggggctgaacgcacccgtcgcggcagctacggcggcgcggtgggctacttcaccgcccagggcgatctcgatacctgtatcgttatccgctccgcctatgtagaagatggcgtcgccaccgttcaggcgggcgccggtgtggtgctggattctaatccgcaggctgaagctgatgaaagccgcaacaaagcgcgcgccgtactgcgcgctatcgcgactgcccatcactgcaaggagatcttctgatggccgatattctgctgctcgataacatcgactcttttacctataacctggttgatcagctgcgaacctttggtcacaacgtggtgatttaccgcaacaacctgcccgccgaactgcttattgaacagctgcagcggatggagaacccggtgctgatgctctctcccggtcccggcgcgccaaaagatgctggctgtatgccggagctgctgcgggtgctgcgtggtcgtctgccaattatcggtatctgtctgggtcaccaggcgattgtcgaagcctatggcggccatgtgggccaggcaggcgagatcctgcacggcaaagcctcttcaatcgaccatgacggcgaggcgatgtttgccggtctgagcaatccgctgccggtggcgcgctatcactcgctggtgggcagcaacacgccggaagagctgacggtgaacgccagttacaacgggatggtgatggccgttcgccatgaaaccgatcgcgtatgcgggtttcagttccatcctgaatcgattttgacttctcagggcgcgcgcctgcttgagcagacgctggcctgggcgctggcgaagtaacagggagaataaacatgcaacagacactggaaaaactttaccaggcgcagacgctgaatcaggctgagagtcatcagctgttcagcgccatcattaccggacagctggagccaacgcagctcgctgccgcgctgatcgccatgaaagtgcgcggtgaaacgccggaagagatcgccggagccgccaccgcactgctggaagatgccaaaccttttccccgccctgattatgcgtttgcggacattgtgggcaccggcggcgatggcagtaacagcattaatatttcgactgccagcgcctttgtcgccgcgacctgtggtctgaaagtggcgaagcacggcaaccgcagcgtctccagcaaatcgggctcctccgatctgctggccgcctttggcatcaatctcgatatgcccgctgaccgggcgcgccaggcgctggacgatctgaatgtctgcttcctgtttgcgccgcagtatcacaccggttttcgccacgcgatgccggtccgccagcagcttaagacccgtacgctgtttaacgtgctgggcccgctgatcaatccggcacgcccgccactggcggtgattggcgtctacagcccggaactggtgatgccgattgcccagacgctgaaagtgctgggttatcagcgcgcggcggtggttcacggtggcggaatggatgaggtggcgctgcacgacgtgactcatgtggccgaactgcgtgaaggtgaaattacgcgctatcagctctcgccagaggactttggttttggcttccatcccaaagaggcgctggcgggcggcacgccggaagaaaatcgtgacattctgacctctttactccagggtaatggccagcaggcccatgaggaggccgtcgccgtcaacgtggcgatgttgcttaaagtattcggtcaggaagatctgcgtgaaaacgcacagcaggcgcttaacgccatccgcagcggacaggcttatgagcgtgtcgtcgcactggcagcaagaggataatcatgaaaggcaccgtgttagaaaaaattgttcaggacaaagcgatttgggttgaagcccgtcagcagcagcagcctctctctacctttcagaaacagcattgaacctgccagccgtcatttctacgacgcgctgcagggtgcaagaaccgcgtttatcctggagtgtaaaaaggcctctccctcgaaaggcattattcgtgaggatttcgatccagccgccattgccggggtctaccgccactacgcttccgcggtatctgtgctaaccgatgagaaatattttcagggcgacttcgcctttctgccgattgtcagcgcggccatcacccagccggtgctgtgcaaagattttatcatcgacccctatcagatctatctggcccgttactaccaggcggatgcgattctgctgatgctgtcagtgctggatgacgagcagtatcgtcagctggccgctgtggcgcacagcctgaagatgggcattctgactgaagtaagcaatgaagaggaactggagcgggctatcgcgctgcaggccaaagtcgtgggtatcaacaaccgcgatctgcgtgacctctctatcgatcttaaccgcacccgtcagctggcaccgcgcctgtcacacggcgtcacggtaatcagcgaatcaggcattaacagctatgccgatattcgcgagctgagccattttgccaacggcttcctgattggttctgcactgatggaagaagccgacctgaccgcagcggtgcgtcgggtcacgctgggcagcaataaagtgtgcggcctgacccgtgccgaagatgcgcgtgccgcctatgaagccggggcaatctatggtgggctgatcttcgcggaaggttccccgcgccagattgacaccgctacggcgcagaccgttatcgctgcggccccgctgcgctacgtcggcgtgttccgcaatgccgctataagtgacattgtcacgcaagccggtgcgctttcactctctgcggtgcagctgcatggcaacgagacgccggcgtttgtggctgaactgcgtgcggctctgccagcagagattcaaatctggaaggcgctgcgcattgaaggcaccttaccggggcgcgactggcctcatgttgaccgttatgtgtttgataatggcgacggcgggaccggacagcgtttcgactggtcgctgttgcaggggcagacgctcaacaacgtgctgctggccggtggcctgagcgcggataactgtgttgaagccgcgcagctcggctgtgccggactggacttcaactctggcgtggaaagcgcgcctggcatcaaagatgcccgtaaaattgccgctgtgtttcagacactgcgagcctactgatttgcctggcctgctcaacggcgggcccgagaaaggaagataaaaaatgacgttacttaatccctactttggcgaatttggcggaatgtatgttccgcaaatcctgatgccagccctgcgccagctggaacaggcgtttgtcgacgcccagaaagatcctgagtttcaggccgagtttaccgacctgctgaagaactatgcgggtcgccctaccgccctgacgctgtgcaaaaacctgactaaaggcaccaaaacccgcctctatcttaagcgtgaagatctgctgcacggtggcgcgcacaagaccaatcaggtgctgggtcaggcgctgttagccaaacgcatgggcaaaaacgaaatcattgccgaaaccggtgcgggtcagcacggcgtagcttcagcgctggcctgtgcgctgctgggcatgaaatgccgcatctatatgggcgcaaaagatgtggagcgtcagtcacccaacgtcttccgtatgcgtctgatgggcgcagaagtgatcccggtgcacagcggctccgccacgctgaaagatgcctgtaatgaagcactgcgcgactggtctggcagctacgagacatcacactatatgctcggcaccgcggcgggtccgcatcccttcccgacgattgtgcgtgagtttccagcgcatgattggcgaagagactaaaaagcagattctggaaagagagggtcgcctgcccgatgcgatcctcgcctgtgtgggcggcggctccaacgccatcggcatgtttgccgactttatcgatgagaccagcgtgaagctgatcggcgtagagcctgcgggccacggcattgagaccggcgagcatggcgcgccgctcaagcacggtcgcgtcggcatctacttcggtatgaaatcgccgatgatgcagacccatgatggccagattgaggagtcttactcgatctctgccggcctcgacttcccgtctgtaggcccgcagcatgcgcacctgaacagcatcggtcgtgcggaatatgtctccatcaccgataacgaagcgctggccgcctttaaacagctctgtcgcgatgaaggtatcattccggcgctggagtcatcccacgccctggcgcacgcgatgaagatgattcaggctgagccggaaaaagagcagttgattgtggtcaacctctctggccgcggcgacaaagatattttcaccgttcatgacattttgacagcgcagggagaaatctgatggaacgttacaatcaactgtttacgcgtctgtcagcgaataacgaaggggctttcgttcctttcgttacgctgggcgatccgtcaccggagctttcactgcgcgtgattgacgccctggttgaaggaggcgcggatgcactggagctgggtattcccttttccgatccccttgcagatggcccgaccatccagaatgcgacgttacgcgcctttgcggcgggcaccaacaccagccaatgctttgaaatgctggccactatccgccgtaagtatccggatctgccgattggattgctgatgtacgccaatctggtcttcaccaacggtgtggatgagttctatgcccgttgtgcagaggcgggtgtggattcggtgctggtggcggatgtgcccgttgaagagtccgcgcccttccgtcaggcggcgctgcgtcatggcatagcacccatcttcatctgtccgcctaacgccagcgatgagctgctgcgcgagatcgcttcacacggacggggttacacctacctgctgtcgcgcgcgggcgtgaccggtgctgaaaaccgtgccagcctgccgttgcagcatctgatcgacaagctgcgtgaataccatgcagccccgccgctgcagggctttggtatctctgagcctgaacaggtgaaggaagcgatcgccgcgggcgctgcgggtgcgatctccggctctgcgattgtcagaatcatcgaaaaacatcattcagagcctgaggtgatgctgagcgagctgaagaactttgtcagccgccttaaagccgccagccgttaatcctgccagcatgccttatcgcgcgataaggcatgatttgtttccttttttttcattcccccatttgccctttttgcaaaatctgcaccacaatgacaatgcgccgttacggtaacgtcgcatccattttgtgacagggagagaaagcaatgaaattcgttaaactgctgacaggtgctgtactggcgggcgtggttgcgctgacactgagcgcctgtgcgccaaccgcaaccaaagagggaaccggtggctatattgatgacaccgtggtgaccacaaaagttaaaggtgaactgctgaaagatgactcgctgaaatcaactgaaatcaacgtagaaaccttcaaaggtaaagttcagctgagcggttttgtttcatcaccacagatggctaaccgtgccgttcaggttacgcgcagcgtggcgggcgtgaagtccgttgttaacaatatgcagatcaaataacgtcttaacagacaaaaaaaggccgctgattcagcggcctttttatcatctttatcatcagaaacggtaacccgctccgaagaagaagacccagggatcgatgcgcatattgatattctgctgctcgccaccctctttaaacttcacttccgtatcaatatccatgtaccacaccgacgcattcagcatccagtcacggttaatctgataatccagaccgacctgacccgccacaccccaggaatccttcacgctgagatcggtcaggcccgcatcgcggcccgtttgattgaaatcggcatcgtaaaaggtggtgtagttgatacccacgccaacataaggacgcgctttgctcttgctgtcaaagaagtagtactgcgccatcagcgtaggcggtaactggcgtaccgttgccagtgttccggtcgggcccaggcccaccttgtgacggaaacggtgtggcggccagtaattcgacaccaatgttgtccgttgccatgtaagtaaaggtcaggcccagctgcgtgtcgttggatgcgctgaactcgcccatccctaacacattatcggaaccttcggtgggccggacggtggcactaccggcacgcataaagaagtcgcctgcttcgtgggccatcgacagctgagggaaagccagagccagcagcatcgcgcattttgccagtttcatcatcactcctttgcttaatgttaatgtcgcgaacgtcatcgctttttgctggcaaatatttaacgtgatttacagaaaattgcactctgtacccttcagataaattacttaaaaaacaatgaattgatttagatcaatttcggctcgggctggcgcagcaaaattccccttgctgaataatttcgccaggcctattttgcttatcttctctggtgattttggttcgatgccctgggaggggcgggtgatcaaatgagtgaaataactaacccttgtgtcagctgtggcgcctgctgcgcccatttccgcgtctcattttactgggccgaagccgatgatgcaggcggcccggtgccgaccgcattaaccgaaccgctcagcctgttaatgcgcaatatgcgtggaacgaacgatcgcgcgccgcgctgcgttgcccttgaaggcgacattggcggctgtgtctcctgcggaatttacgaacaacgtccgacgccctgtcgggaattttcgatgtcgggcgaagcgggtatccacaatgaagcctgcgatcgcgcccgcgcccggtatggtcttcccgcccttttttctccatctttacctgtcatgacagaaagttatgccgcagcgggtgcccgcgagctgtcagaacatgtacaatcgccgggttaattaacccggttcctcaaaggagtgtacatgtctatcacggcaagctcgttataccgtgacacaggaaatttcgcgcgccatcaactggctacggtgctgttgatgtcgctgctggccgcttttatcaccgtcatgctggtgcatgtgctgacgccaggtgccgatcagatggccctcctgcaacagggtgacgatagcgccggttcgctgtttgagatggtgcagaatatgtcaccggaacagcagcaggtgctgctgcgcgcctcggcggccagcaccttcgctgcgctgatggggaacacgctgctgcttggcggaatgctctatctgatcccgatggtctcttccggccagcgtgtcagtgcgttgcgggcgattggtgcttcagcgccgctgctgccaaagctgctgctgctcaccttcctgatgacgctggtggcgcaactgggctttatggtgctggtggtgccaggcattctgctgacgattctgctgtcgctggctccggtgatggtggccagtgagaagatgggtgtctttgccgccatgcgggccagcatgcggatggcgtggaagaatgtgaagctgattgcccccgctattctgctctggctgctggccaaagtggtggtgatgctgttcttctcttcgctgacggttttaccgctgaatgtctcgtcggtgattttcaccgcggcaggcaatgtggtttcggcgatgttgattatctatctttatcggctctatatgctgttacgttgattgacgatgtgccttcgggcacatttgcagccaactctgaatggaaaaactatgaagcagctactcgactttcttcccctggtggtctttttcatcttctacaagctgtatgacatttttgtcgcctcgggcgcgctgattgtcgcgaccggcctggcgctggttgtcagctgggtgctctatcgcaagctggaaaagatgacgattttcacctttgtgctggtggcggtttttggcaccctgacgctggtgttccacaacgatgagttcattaagtggaaagtcacggttatctacagcctgtttgccgccgccctgctctacagccagtggtttatggagcagacgctgattcagcgcatgctgggcaaagagctgcagctgcccgacgcggtctggcgcaggctcaacgttgcctgggcgctgttcttcttcatctgcggcctggtaaacatctatgtcgccttttggttatctcaggcgttttgggttaactttaaagtgttcggtctctccggtctgaccttactgtttaccctgctcagcgggctttatatctggcgacagatgccgcagcaggaacaaaaataatcatctgcccggtccgccgggcatttttttagcattcacctgcatagaagtggaagcaatgggcgaaaaacatacattgccgaaaggcgaaatggtgctgcgtacgctcgccatgccagcagataccaacgccaacggcgatatttttggtggctggctgatgtcacaaatggatatgggtggcgctatcctggcgaaagagatcgctgaaggacgcgtggtgacggttttcgcgtcgacggcatgtcatttatgaagcccgtcgcggtgggcgatgtggtgagctgccatgcgagctgtcttcgtaccggcaacagttccatgacgattaatgtggaagtgtggatcaaaaaagtgtcgtctgagccgattggacaaacttacattgcgacggaagcggtgtttatttatgtggcggtcgacaatgagggtaattcccgtcctctgccagccggtcgtgccaaccagcaacccggcgaatgaaaaacaggtcaggctgttttagcctgacctgacgctttattccaggctggccccaccattaatcttaaacacgatattcatggtcagaccctgccctggccgtccgctctgatagcgccactttttcatcgcctgcttaacttcacgctcaaacatattgcgcggctcagcagagaggatctggatgttatccacccgtccctcactatccacatcaaacttcacccgtacccgcccctctacacgcagtgcaaatgcgcgttgtggatagccaggcttactgacgttcagtgcttttgggccggttgaggccgatgaggtgggtgacggcgtagattttggcgccgtggtcggtttgttctgcgtcgccggggcttcctgcttaaacggatcggcctgcggtttgctctcctgacgcggcttcacctcgcgtttaggctgctcccgcttgtgctctggtttcggtttgggctttggcttaggcttaggctcaggtttgggaatcggcaccggctccgctttcggcggttcgggcacgggctgaggttccggcaccggttcaggttctggctgaggttctggctgtggtgcaggcggctccacgatggccggtgcaggctcaggctggacttcaggggcgaccatggtaacgctgatgggctgcgacgctttgggcacctcaatcacctgctggaatgaagcatacagaattccggctatcacggccccatgcaaagcaacagacaacaacatggagacaggcgtgcgtttaggtaatggcatagtcagcgtggtcataacagtcgcagtgattgaatgaagcagcgattttaaatgcaaatagcaatcagtttcaataactcccgccatcccgcctgaagaaaagcgctttttagccctttatgctgagccattaaccactctgaggtttcgtttgcactctgaggggcaatcccttaacgtgttgcgaaattctggttaatgggagttccttagtgctttacgtcatttatgcagaagatactgcagattcactggaaaaacgtaacgccgtgcgccctgcccatctggcacggctcaaactgctgcaggaagagggacgcctgatcattgcaggcccgatgcctgctgtcgacagcaacgatcctggtgtagcgggctttaccggctcaaccgtgattgctgaattcccgtcattagaagaagcacaatcctgggcacaggatgatccctacttcgccgcgggcgtctataagcaggtttcggttaagccgtttaaacgcgtcttctgatcgtgactcagcattgaaaatggcttctgtgcctggcacagaagccatttttattttgatcgttcaagagaggaaagatgcagataatcattctggggctactggccattatcgctttactgatcggaagcgcggtttatctctggcgaaactcagggctggcgtaataaaaagcagtggattgtcatgctgatcgtgctggcggcggcactgcagctggtgaacgtaacgctgatgatgacgacacaacgtctcgctggttaatcagacctgaggtttcattgcgacagagcagcacatcactctctgtcgcagcaaccggccggtctgaatattctgcctcgcgaataaacgcagcgaccaactgatcttaataaattaaagcgttgttctgaacgacattgataataaaccggcagtacatcggcctggtcattcagtaatacacgctctttaatatcccgccactggctattttcagtgatgagttaaccgcgatccagaatcaggccaatcagcgcatgatagtgctgttcttcttccgggctggtgacatgctgtaagcggccgatcagttttgagcagatcgctttacgattcagactacggcccgaactgataatttccgtcacgacggagccaagaatggcctgttgtgagggctgcgcggcgctgtgtaaatacgcggagatgtcagagactgaagcgggaatacgaacgttagtttgcatggttgaccctcataggattcatttaagattactaaccgatgcgataaagttatacaacaacgagctatctgtacagatatttagcttaaaaaatcagatcgtcacgttttaatgacaataaactcataaataacagcacattacaacattgtaaagttgtacaacttgttagcctgcggtttttatcctgttaatattccctctttagtccgcgcctgaatgacctgttttactattaaaatatgatctttccgccctttttttagtattaaagaggaattatctcgcagagctgtctacatttaccccttgtgagttgaacctctgaatggatgcacagcacagtcgcgggcacattatgcataaaacttattctggccagtcccttacattgctcgacccgctgttatcccggctcctttctattgttgaccccaaaatagaagtaatgagtggttaccctgctaattgctcagtgtggctcactgtttattatcagcgtaaatcgcgtcagtggtcttacgaatggtacgatcgtgtgggttaccacaggccgactgagctgggcagctcaatggaatgtctgatgcgcgaagtcagcgatcgtggcgcgtcgcatcaggagcacctgatagcgcgacgggcgatggcagaatcggttttttttgaagcctgatttgaagtctgaatagcctgctttgtccgacaggctgaattcactgggctttcgctatattatctgcgtaataaacagaatcgaacgacgctgctgttgtgccagctgatggcgaatgcagtggatacgcttataccgccgcgactgcccttccagccagcgtgagcggcggcgatgcacctgccgtaacattctccagcgcgccacttcatttctgcttcgtttcatcacttcctctctgacgtcatacacacgagggcattatagagatctctgcggtaatgccaaatcggatccttcatcgaggatgtccgggataaagggttccgttagccgtcatctgcacgtaaacttgccggacgaaagcgcgaacgggatgtccactttatgaccactttttataccctgatcagctggttgctggtgtttggttactggctgctgatcgccggggttacgctgcgcgtattgatgaagcgacgggcagtgacatccgcgatggcctggctactggttatctatattctgccgctggtagggattatcgcttatctctcttttggcgaactccatctgggtaaacgtcgtgcggagcgcgcccgcaccatgtggccatccactgcacgctggcttactgaccttaagcagtgccgtgaaatttttgccaccgaacacagcgacgttgcgcgttcgctgtttgagctttgctaccatcgtcagggcatcgccggggttaagggcaaccagctccagttgctcaccagcgccgacgacgtgatgcaggcgctgattcgtgatatccagctggcccgccacaacattgagatggtgttctatatatggcatcccggcggtctggcggatgaagtggcggaatcgctgatggccgcatcacgccgtggcgttcattgccgtctgctgctcgactctgcgggcagtgttactttcttccgcagcccctgggtcggcatgatgcgcaatgccggaatcgatgtggtggaagcgttgcaggtcagcctgctgcgcgtcttcctgcgacggatggatctgcgtcagcaccgcaaaatcgtactcattgataactacatcgcttataccggtagcatgaacctggtcgatccgcgcttctttaaacagagcgcgggtgtcggtcagtggattgacctgatggcgcgaatggaaggcccggtggcgacggcgatggggattgttttcagctgcgactgggagatagagaccggcaaacgcattttaccgccgccgcccgatcgcaacattatgccgtttgaacaggagagcggccacaccgtgcaggtgatcgcctccggccccggcttcccggaagatatgatccatcaggcgctgctgactgcggtctattcggcgcgtgaacagttgatcatgaccacgccctacttagtaccgagcgacgatctgctgcatgctatctgtacggcggcgcagcgtggcgtcaatgtcagcgtgattgtgcctcgtcacaatgactcgctgctggttggctgggccagccgctccttcttcagtgagttgctggaagcgggcgtgaaaatttatcagtttgaagatggcctgctgcataccaaaagcgtgctggtcgacggacaactgagcctggtgggaaccgtgaatctcgatatgcgcagtttatggctgaattttgaagtgacgctggtggttgatgatgcgggttttggcagcgatctcgcctgtgtgcaggatgactatatcgcccgttcccgcctgctggatggcaagcgctgggcaaaacgtgcctggtggcaacgcatcgtcgaacgactgttttacttcttcagtcctttactgtaaaacgagccagattgtgtaaatggccgcaggccgacaggacagactatggatttaaataatcgccttaccgaagatgaaacgctggaacaagcctacgatatttttctcgaactggcagtcgacaatcttgatccggcagacgtcattctcttcaatctgcagttcgaagagcgcggtggcgcagagctgttcgatccctctgaagactggaaagatcatgtcgatttcgatctgaacccggacttcttcgccgaggtggtgattgggctgggtgaagcggacggtgaaccgatcaccgacgtctttgctcgcgtgctgctgtgccgcgagaaagaccacaaactctgtcatatcctgtggcgtgagtaagcgtcagatttgataagaaaacgccgggcgattgcccggcgttttgcattatagcgggtcgactttcagacaggagaccgcgtgattgaagctgccttccagcagcggccgggttttcgcacactccggaccggcaatcggacaacgggtgcggaacacgcagcctgatggcggattgatcggcgacggcagctccccctccagcagctgaatctgcttgttcttctccttgtccggatcggggatcggcaccgcggacatcagcgcacgggtataaggatgctgaggattactgtagacctctttgtaggtacccagctccaccgcatgccccagatacattaccagcacccggtcagagatatgtttcaccaccgccagatcgtgcgcaatgaagatcagcgataagcccatttcgcgctgcagctgctgcagcaggttaaccacctgggcctgaatcgagacgtccagtgcggagacaggctcatcacagataatcagctttggctccagaatcagcgcgcgggcgataccgatacgctgacactgaccgcccgagaaactcgtgcggatagcggttaatcaggttaggcagcagccccactttcatcatcatatttttgacgcggtctttcacttcctgacgcgccatttttggatgataggtacgcagtggctctgcgatgatatcgccgatggtcatacgcgggttcagcgacgccagcggatcctggaatatcatctggatatcgcttcgcgccttgcgccactcctcttcactttgccccagcagatcacggcctaaccaggcgacccgaccttcggtcgccttcaccagcccgataatggcgcgcgccagggtcgatttaccacagccagactcgcctaccacgcccagggtttccccctcatacagacgcaggctgacaccatcgactgctttcagggtttttgatggctgccagaaccactgcctgccatctttgatgtcgaaatgcaccttgaggtcggcgatttccagtaacactcttttttcagctacggtgctcatactaactcctccaccggcttaaagcaggcgcgcagacggccttcgccaaagggttccagcggtggtgcctgggtgcagatatccatagcgtgcggacaacgcggctggaacgggcagccctgcggcagacgcagcaggttgggtggattacccggaatcgtcgtcagactttccccttccgcatccagacgcggcaccgcattaagcagaccaatcgagtaaggatgtgacggctgataaaagacatcgcgggcacgaccatactccatggtgcgtccggcatacatcaccagcactttgtcgcagatccccgccaccacacccagatcgtgggtgatcatgataatggcggtattgaactcgcgcttgaggtcgttgagcagcgtcataatctgcgcctggacggtaacatccagcgcagtggtcggctcgtcggcaatcagcagtttgggacggcacagcagcgccatggcgatcatgacgcgctgacgcataccgccggagaactcatgcggatacatcttcatccgcttgcgcgcttccggcattttcaccgcatccagcattctcaccgactcttcaaacgcctgcgcgttgttcatccctttatgcagcttaagcacttccatcagctgctcgcccacccgcatataggggttcagcgaggtcatcgggtcctggaaaatcatcgcaatctgttcggcgcgcagtttattgagcttgttctcgggcagattcaggatctctttgccattgaacatcgccgaaccgccaatgcggccatttttcgccagcagccccatcagggcaaaggcggtttgtgatttgccggaaccggactcaccgacaatgcccagcgtctcaccggcgcgcagcgagaagttcaggtcgttaacggcggtaacatcaccatcgtgcgtgccaaaggtgacgcgtaaatctttgaccgtaagtagctgttcgcttcccgcgcgggccgccattgctggctggaattcatgaatagtcatcgggaaactccttaacgatctttcgggtcgagggcatcacgcaggccatcgccgataaagttgaaacagaacagcgtgaccaccaggaagcctgccggatagagcagcagccacggcgacacttccatcgagtttgccccgtcgctgaggagtgcgccccagctgctcagcggctcctgcgtacccaggcccaggaagctcaggaatgattcaaacaggatcatgctcggcaccagcagcgaggcgtaaaccaccaccacgcccagcacgttcggcacgatgtggcgcaccacgattttccaggtcgataccccacccacatgggccgcttcgataaactctttgcgcttcaggctcagcgtctggccgcgcacaatacgcgccatatcgagccacgaaaccataccgatggcggcaaaaatcagcaggatattgcgaccaaagaaggtcaccagcaggatcacgaagaacataaacgggaaggagttaaggatttccagaatacgcatcatcaccgagtctgttttaccgccgagatagccagcaatcgagccatagagcgtcccgacaatcaccgcgatcagcgcagaagccacgcccaccatcagcgagatccggccaccgatagccacacgcaccagcaggtcacgacccgaagaatcggtgccgaaccagtgaccagaggtggtatcgggcggcgaggacatcatggcccagtcagtatcgtcgtaggtgaactgcgccagcatcggcgcaaagatcacgaacagggtgatcaggaacagcaccagcaggctgatggaggcagcgcggttatgaataaaacgacgacgcgcgtcctgccagagactacgcccttctacttccagtttctcactgaacgcatcaagagcttcgctgtttttcttacttaacatcatggcgaaactccgcaatcagtaacgaattttgggatcgataacggcatagagcacgtcaacaatcgcgttgaatacgatggtcagcaaacccaccagaatggtcaggctcatcaccagtgagtagtcacggttcagcgcgccgttcacaaacagctgaccgatgcccggcagaccgtagatcgactcaatcaccatcgaaccagtgatgatgccgacaaatgccggtcccatgtaggagatcaccggcagcaacgcgggcttcagcgcatgacgcattacaatgcggcgcagcggtaagcctttggcgcgcgcggtgcggataaagttggagtgcatcacttcaatcatcgatccacgggtgatacgcgcgatactggcgatgtaagccagcgacagcgccaccatcggcagcagcatgtagttccactgcccgccattccagccgccgcccggcagccacttcagggtgatggcgaacagcagaaccagcaacggcgcgaccacgaaactgggtatcaccacgccggtcattgccacccccatcaccgcaaaatcccacaagctgttctgtttgagcgcagcgataactccggccgtgacgccaagtaccaccgccagcagaaacgcggccaggccaagtttggccgagaccgggaacgcatgcgcgaccaggtagttgaccgaataatctttgtatttaaaggatgggccgaagtcgccgtgcgccagctgcaccaggtaatcgacatactgcttaccgataggatcgttgaggtgatatttcgcctcaatgttggccatcacttccggtgccagggtgcgctcgccggtaaacgggctgccgggcgccaggcgcatcataaagaaggagatggtaatcaggacgaacagcgtcggtagcgcttcaagcaagcgacgcaggatgaattttaacattgccgtacctaccaggctgttgcttcacaacataaaaaaaaagtaaaaggcggcgccagacgcgccgccactgctgatagcctgaatgctattagtgtttgatgatgtagaagtttttatccagggttttatccagtggatctttaccggtataaccgccgacataaggtttcaccagacgggtgttcacgtagtagtaaaccgggacgatggtgctgtctttatccatgatctgctcggcctgctgatagtcagctgcacgggctttagcatccggggccttaatcgcgtcgcgaatcactttgtcaaacgcatcgctcttatagtgcgaggtgttactgctgctgttggacagcatggtgttcaggaaggaagtcggttcattgtagtccgcacaccatgccgcacgggaaacatcgtagttaccctgatgacgggtatccaggaaggttttccactcctggttttccagcttgatgttcacgccgatatttttcttccagatcgacgaggcggcaattgccagctttttgtgcagatcggaggtgttatagagcaggttaaaggtcagcggtttgtcggcggtgtagcccgcttcggccagcagctttttcgcctcggcattacgcttgtcctgtgaccatttgaaccagtctggcggcagaatgtccatgccgtcggtcgctggtggcgtgtagctataggcaggtttctggccctgcgccagcactttattcaccatgatgtcacgatccagacccagcttcagggcagcgcgcacgcgcggatcggtgaatggcgctttctggttgttgatttcgtagtaataggtgcagagatatggatcgacgtgcagctctttaccgttgtcacgctgcagctttttaaacagctcaattggcaggttgttataggtcatgtcgctgccgttctcggagaagtagcggttaacgtcactgacttctgaactgatcggcaggaaggtgactttgttcagcaccgtatgctcattgtcccagtagttcgggttacgcaccagggtgatacgttcgttaatcacgtgcgcttcaagcttaaaggcaccgttgccgacccagtttctgcggctgcgtccactgatcgccaaatttctcaatcgccggtttgtaaaccggtgacatgacggagttaatcagcagcttatcaaaatagggaaccggctcactcagggtgacttccagcgtgtggtcatcaatagcttttacgcccagatcggtaactggttttttaccggcgatgatgtcatcgacgttcaggatatgaccatactgcggatagctggcatacggtgaggcggttttaggatcgaccagacgctcccagctgtagacgaagtcctgcgcggtgaccggctcgccattggaccatttggcatttttacgtaagtggaaagtccacactttgaaatctttattttcatagctttccgctacggccgggatcggtttaccgttgctgtcattgaccagcagaccttcgtaaagatcacgcgctacgttgtcttccggcacaccttcaattttgtgcggatcgagcgactgcacttcatcgccattgccgcgaaccagctcctgttttgcggccagctcaacgcccgcaggcactgttgctgcgaaagccgcattccctgccagggcactcactgcggcgaaaacgcccgctgcaatcaggctttttttcgtgatgttgttcattattacactccagttttattatcgtcaccgtggcgatgctctgccccggcgtcccccgtctgcgggctccctggcctgttaccagggagattgaccccaaaaaaaggtctgtttgctgatgcgctttccgactgtctcgccgaaacaggcgatcagatcagtgttttttgatgaaatagtacttcaggtctgtcatgtcctgcgggtctttgcccgtgaagccgccaacccagggcttcaccaggcgcacacttacgcggtagtaaactggcacaattggtgagtctttgtcgagttgtgtttcagcctgctgatacaggctggcgcgctgcgcctcgctgcccgccgtcagcgtctccgccatcagacgatcaaaggtcgcgctgctgtaaaacgcggtgttgatcgaggcgttgctgatcagcatgttcaggaaggttgagggttcattgtagtcagcacaccaggtggcgcgcaccacgtcatactgcgcctgatgacgggtctccagcatggttttccactcctgattctgcagcgtcaccttagcacccaggtttttctgccacatcgacgcggccgcaatcgcctgccgtttgttctgatcggaagtgttgtagagcagcgtaaaggtcagcggatgggcagcatcaaagccggcctctgtcagcagcttcttcgcggcttcattacgctgcgcctgcgtccaggtgaaccaggcaggtggcgtgagtttgataccggcggtaaaaggcggcgtcaggctgtaagccggaatctgcccctgggccatgatcttattggcaatgacctcgcgatcgagggtcatcttcagtgcagcacgcacccgcgcatcggtaaacggcggctttttgttattaatctcgtagtagaaggtgcagagcagtgggctgaccttcacttcatcgcccagctctttgcgcagcttgccaaacatctctggtggcaccgcactgttggtaatatccgtgccgccgctgcggtagcgattgatatcgctgttttcagaggcgatcggcaggaatgtgccctgctcgatcaccgtgtgtgcattatcccagtagcgaggattgcgcttcacgataattttttcattcactacccagtcgctcagcgtgtaggcgcagttaccgatgtaatgacccgggcgggtccaggcttcgccccactgcttaatggctggcgcataaaccggcttcatcgccgtatgcgctaacatcgccaccaggtaaggcaccggctcactcagggtaatttgcagccgatgggcatccagcgccttcacgcccagctgatcgggtgacgctttaccggcaaggatggcatcgatattggcaaaatgggctgcctgcagatagctggagtaaggcgacgcggttgtcgggtccaccagacggcgccagctgtagacgaaatcagtggcggtaaccggctcaccgttgctccacttcgcatcctcccgcagattaaaaatccagacggtgggttgcgggttttcccagcttttagcgacgccaggaacgacctgtccgctgttatcggtattgaccaggccgtccagcaggttgtgaataatattggattccggcacgccttcggttttatgcggatccagcgaggagacttcactgccgttattgatcacaatctgttgctgcgcggccagtgttgtgcccggcggcaccgtggcggcataggccggagaaaatgccattaacaaaacgactgcgagttttgaccgctgctgctgcaaattcttcatcccaatcatgcgaaacgccaaccttaaattaagtatcccgacaggcttaagcaaaaagcgttctcactttgggctttcggagaaaaaattttacgttgggccaaaaattatcagaagccgtgaaggcgcgccaaagcaaaatagctaaaatgttaactaattctcttttatcatgagaagtcaggcagcgaaagtgttaattttcgtcctgaaaatatcatatcgatatgaaaaatagactatttagctggaaacccctctcaggagcggaaagcagcgacaaacagcctcttttttggcacttatattggggaatctggcttcagcgtgatgaaatttaagatagcgtgattattctggcagtttgtgaggcttacacgaaaatagagagcagaatatcgtgtgaaaatagtgacattatttcgcagaaaaaagtctgtgagccagcgcgcagtaatgaaatttataattgcctgattctgttaagcacaacgaataattgcatcgtaatggtgcataaaatgcccctcctgcaccattacggatcattatttcacttcactctctgaaataagtgagcgtttaattgagtaagccgggaaaaatggacttcatgccggtgacaacaaattcgatgcccagtgccatcagtaacagacccataatacgcgtaatgacgttgataccggtctggccaagaatacgcaccattaacggcgcggcccggaagagtaaccagcagcagaatgcaaagatcgcaatcgccagagtgaaccccagcagatttatccagctgtggtagcgggtgctccagacaatggtcgagctgatagcacccggccccgccatcagcggcaacgccagcggcacaacccccacactttcacgaatcgccgtttctgacttctcctgcttattctgcttatcttcgcccagcttgccgctgatcatcgacatcgcaatggtgacgaccaggatcccacccgcgatgcggaaggagtcaatcgagataccaaacacatgcagaatcgcatcaccaaggaacagtgacgtccagagaataatagcaaccgccagattggcagtgaggttggttttgttacgctcagccaccccctgataacgggtcatgctgatgaagaccggaataattcccaccggattgaccagcgcaaagagcccgacaaaaaattttatatagcctgataaatctaacagcgcagggttcacgactttactccgtaccacagggggggaaaacgcgcctaatgtatgtgaaaacaggcacggacgccagatgctgactcagctatttatactgttgaatgacggcgcatccagcgcgttaccccagagattaaaaagtgactggatttagccgctaccaggcagatgacgtgaagaggtaaccaatttgataaacaaagggcgtaaaggggagctgaaaggtgtcagcttgcggttaaattgatctgcatcaaaattgccctaccccaaaccaggtaatcttttcgcaacggaagtattagcggcagcgaagaaaatctcactgactgcaacagaagactagttcagtaaacagttgaaaatccgggcgttctgacccagtccaacgccttatggcaacgtgactatactcagggcgcaggattgtttactaaaaaagtttaacttccttcaggagaacaccatggccgtaaccaatgtcgccgaacttaatgcactggttgaacgtgtaaaaaaagcccagcgtgaatatgccaacttttctcaacaacaggtcgacgctatcttccgtgccgccgccctcgccgccgctgacgcccgaatcccgcttgccaagatggccgttgccgaatccggtatgggcatcgtcgaagacaaagtgatcaaaaaccattttgcttcagaatacatctacaacgcttataaagatgaaaaaacctgtggtgtgttagccacggatgatactttcggcaccattaccatcgccgaacctattggcctgatttgcggtatcgtcccgacgaccaaccccacttcaaccgccatcttcaaagcattaatcagccttaaaacccgtaacggcatcatcttctctcctcatccacgcgccaaagatgcgaccaacagagctgcagacatcgtattgcaggcggcggtggctgccggtgcgccaaaagatattatcggctggatcgacgcaccttccgttgagctgtcaaatcaactgatgcaccaccctgacatcaacctgattctcgccactggcggtccgggcatggtgaaagcggcttacagctccggtaaacctgcgattggtgtcggtgccggtaatacgccggtcgtgattgatgaaaccgccgatctgaaacgtgcggttgcgtcgattctgatgtcgaaaacctttgataacggggttatctgcgcctctgaacaatcggtgattgtggtcgattcagtctatgacgcggtgcgtgaacgtttcgccagccacggcggttatatgctgcagggtgccgaactgagtgcggtgcagaatattattctgaaaaacggcggcctgaatgcggccatcgtaggccagccagcgttcaaaattgcggagatggccggtatcagcgtgccaccgagcactaagattctgattggcgaagttaagctggtggatgagtctgagccgttcgctcatgaaaaactctcaccaacccttgcgatgtatcgggcgaaagatttccaggatgcggttgcgaaagcagaaaaactggtcgccatgggcggtatcggccacacctcctgtctctataccgatcaggacaaccagaccgaacgcgttcactacttcggcgacaaaatgaaaaccgcgcgtattctgatcaacacccccgcctcgcagggtggtatcggcgacctctacaactttaaactggcgccgtctctgacgctgggttgtggttcgtggggcggaaactctatttcagagaaacgtcggtccaaaacatctgatcaataccaaaactgtcgccaagcgagctgagaatatgttgtggcataaacttcctaaatccatctacttccgtcggggttcactgccaattgcgctggaagaagtggcaacggatggcgcgaaacgtgcctttatcgtcactgaccgcttcctgttcaataacggctatgccgaccaggtgacccgcgtactgaaatcacacggcattgaaacggaagtgttcttcgaagttgaagctgacccaacgctgagcatcgtgcgtaaaggtgctgagcagatgaacagcttcaaaccggatgtcatcatcgcgctgggcggtggctcaccgatggatgccgcgaaaatcatgtgggtgatgtacgaacatccggaaactcacttcgaggagctggcgttacgtttcatggatatccgtaaacgtatctacaagttccctaaaatgggtgtcaaagcgcgcatgattgccatcaccaccacatccggtaccggttctgaagtcacgccgtttgctgtagtgaccgatgatgcgacgggtcagaaatatccgctcgctgactacgcactgacgcctgatatggcgattgtcgatgccaacctggtgatggatatgccgcgttcactctgcgccttcggcggtctggatgccgtaacccacgcgctggaagcttatgtttcagtgctggcgaatgaatactctgacggacaggcactgcaggcactgaaactgctgaaagagaatctgccagccagctatgccgaaggcgccaaaaatccggtggcgcgtgagcgcgtacacaatgccgccactatcgccggtattgcgtttgccaacgccttcctcggggtttgtcactcaatggcgcataagctgggttcagagttccatatcccacacggcctggccaacgccctgttaatctctaacgttattcgctacaacgcgaatgacaacccgactaaacagaccgctttcagccagtacgatcgccctcaggcgcgccgtcgctacgccgagattgctgaccatctgggtctgagcgcaccaggtgaccgcaccgcgcagaaaattgagaagctgctcgcctggctggatgagattaaaactgaacttggtattccaacctctatccgtgaggcgggtgtgcaggaagcggacttcctggcgaaagtcgataaactggccgatgatgcgtttgatgaccagtgtaccggcgctaacccacgttatccgctgattgctgaactgaaacagattatgcttgatacctactacggtcgtgaatttgtcgaaccgttctcaagcgtagccgaagccattgctgagcagccggtaaaaggtattaagcttgagaagaaagccaaaaaagtctgatagtgccgttctgactgtctgataaaaaaacccgccccggcgggttttttattgcctgaacaatagggttaattcagcggagtctgagcgccatggatcgcctgcaacgatccctgctctatcgcctgtttataatgcttacggcagactgagatataacgttcgttaccgccaatcaccacctgctcaccctcactgaaaggtttgccctcgctatccagtcgcagaaaccatactggccttgcgcccacagtgacaaatagttttgagttcaaccagcttatctgcccacgccagcagatactgactgccaacaaacagttcaccgcgaaaatccgtgcgcagaccataacagagcaccgggatatcaaggtcgtctacgacatctgacagcgctttaacctgctcacgggtcaggaactgactctcatcaaccagcacgcaatggacaggctgaacggcatgttcagcagcgatgtcgctgtagagtgatgtctctgcgttgtatagcaaggccggtgacgatagtccgatacgggaactcacctgcccggcaccaaagcgattatcgatttcagcggtgtaaaccagtgaacgcatgccgcgctcatgatagttatatgaggattgtagcagtgcggttgatttccctgcattcatggcagagtaatagaaatagagttgagccatcggcgcgtatcttcatcaggactgaatggaatggcgcgcatattaccacaaagcggcggcaatacgttgcggttgatgagtgaataaagtgtaacggctggccgtttattcctctgcatgccgtttccagcgcctgttaagtgcagtgccgaacgggataagttttgcttattttacccgcaacaaaagcaatgacatttttgttgctgacctgaatacattaaatttatttgatatcggactaaaggaaaatatttttattctgcacaactgtgcaattttctggtgaaaattatttttagtcacgtgggtaattagtgatatacatatttttatgattgcagttattttatgtcgccactactattagcgggcaacacaacttttcccttattcagagaccaggacaatgagcgaagcactaaaagttcttaataatatccgtacgctgcgcgcccaggccagagagtattccgttgaaatactggaagagatgctggaaaagctggacgtagtagtaaaagagcgccgcgaagaagagtctcattttcaggcagaaaatgaagaacgcacgcgtaaacttaatcagtatcgtgaaatgctactggctgatggtattgacccgaatgaactgattaacacgctgaccgacacacggactgcggcaaaaggtaaacgctcagtacgtccggctaaatatggttacaccgatgaaaaaggcgagtccagaaacctggaccggtcagggccgcacaccggccgtgattaaaaaagcgctggaagaacagggtaaaaagctggacgattttttactgtaaaaacccgcagcgtcactgccttcctggcagcctgatgcgcaataaaaaaggaagccggagcttcctttttttcttttaatcagatactcagacgcggtaaaagtcgcggtaccagtccacaaagtttttaacgccctcttcgaccccggtctgcggtttgaatccaattgccttaaacaaggcttcggtatcagcactggtttccagtacatctccaggctgcattggcatcagatttttcttcgcagtaatgcccagggctttttcaatcgcttcgatatagctcatcaacgtgacaggctgactgtttccaatattataaacacgataaggcgctgaactggttgccggcgatccggtttcaactgtccagttgtcgtcctgttgtggaataacatcctgcaggcgaacaatggcttcagcaatatcgtcaatataggtaaagtcgcgtttcatctggccctggttatatacgtcaatcgcctcaccggcaatcattgcacgggtgaatttgaataacgccatatccggacggccccacgggccatagaccgtaaagaagcgcaatccagtggtcggcagctgatagagatgcgagtaagtgtgtgacattaactcgttggcttttttggtcgctgcatataaagaaaccggatgatcaacgctatcttcggttgagaaacggcatcttgcgattcagaccatagactgaactggatgaggcgtagagcagatgttcaattttatgatgacggcaaccttcaaggatattgaggtgacccgtcagattggagtctgcgtaggcatggggattttcaatggaataccggacaccagcctgagcgccaagatggataacgcgctggaatttttgctgatcgaacagtgacgccattgcgtcacggtccgccaggtccatctcaataaaagtaaaaccaggatcggccttaattaaattgagacgggcatgcttgagatttacgtcgtaataatcattcaggttgtcgataccgacaacctggtgaccggcggccagcagacgctggctgacatgaaaaccaataaaacctgcggcgccggtgaccagaaagttcataaatccctcgttaattatgcagtttgaatagacgctccgcggccgattgcataataaacgaaaccgcgtttgctgatacgctctggatcatacaggttacgaccatcaaaaatcacggcttctttcagtgcatttttgatgatgtcgaagtcaggtgcacggaagttttgccactccgtacagatgaccagaccgtcagcgccctgcagtgcggcttctttggtacccatcagcttaagatcgctgcggtgaccgtagatacgctgtgcttcatccatcgcttcagggtcaaacgcctgaacagatgcgccagcttcccacagcgtttccatcagcacacggctggaggcttcacgcatgtcgtcagtgttcggcttaaatgacaggccccagagcgcaaacgttttacctttcagatcgtcaccaaaatgacgtttgataaaggttggcagtttgtttttctggttgtcattcacatcttccacggcctgcaacagacgtggctgatagccaattgactcagcggtacggattaacgcctgcacatctttcgggaagcaggagccgccgtaaccacagccaggatagataaagtggtatccaatgcggggatcggaaccgatgccctggcgtactttttcaatatccgcgcctaaacgttcagccaggttagacatctcattcataaagctgattttggtggccagcatgcagtttgctgcatacttggtcagctctgcgctgcggatatccatcatgatcatacgatcgtggttacggttaaacggctcatagagctcgcgtaacagttctaccacgtcgtcgttgtcagtaccgacaacgatacgttctggacgcatacagtcattgactgcagcaccttctttgaggaattccgggttagataccacatcaaaagtgatgttggcgtcacgcgctttcagcgcttccgtcattaccgcacgaactttgtctgctgtgccaaccggaacggttgatttgtcgataaccactttgtgatcgttcatatgctgcgcaatggtgcgcgctacggcggtcacatatttcagatcggcagagccgtcttcatctggtggagtaccaactgcaataaactgcataacaccatggtttacgcccagctcagcatcagtgctgaacttcagacgacccgcttcgtaattggacattaccagcggcgttaaacctggttcgaaaataggaatgatgccttttttcagattttcgactttgttttcgtcgacatcaatgcagagaacgtcatgtccgacttcggctaacaccgcagcctgaaccagaccgacatagccgataccaaatacagtgactttcatcgagttatcctgtgtttatgaattactttttgttgccaactgcgccatcgagccattcagaaaaatctttgcccaataccggatgacgaacaccgtactcaacgaaagcctgcatgtagcccagtttgttaccacagtcatggctgacgcctttcaggtgatatgcttcaactgtctctttttccatcagcatcgcaatggagtcagtcagctgaacttcgccgcctgcacctggaggcgttttagccagcagtggccagatctctgaagagagaacataacgacctacaacggccaggtttgatggggattctgacgctttaggcttctcaaccacaccgaccattggtgcgctgtcgcctgggttcagttctgcgccctggcaatcgacaacaccgtatgcagtcacatcggcaaccggctcaaccatgatctggctgcggccagactcttcataacggctcagcatctctgccaggttatctttggttgggttagattcatattcgtcgatgatgacgtctggcaggataaccgcaaacggctcatcaccgatcagtgggtgtgcacacattacagcgtgacccagacctttagcgatgccctgacgaacctgcatgatggtgacgtgtggcgggcagattgactggatttcatccagcagctgacgcttaacgcgtttttccagcattgattccagttcgaagctggtatcaaagtggttttcgatggcattttttgatgaatgcgttaccagcacaatttcgttgatgccagcagcgatacactcgttaacgacatactggattaacggcttatcaaccagcggtaacatttctttaggaatcgctttggtagccgggagcatacgcgtacccaaacccgctaccgggattaccgctttttttactttggtattattggcagacattaagatacctctcttataggccgttcaagttaatacttgatatgtcggtttaaaatcggaaatgagtatatcagttagtatcgaacggatttatcctggaaggcaccaaaccgtcgaaattaagactattacccaactgtaaagctaaactctggccctgtcctcagcgccagaattcctctgtttttacggcttattcttccgtcgatagcatcagccgaatgcgcccgcccgcgccccagacgtggcattgccagttttctgcgcgctgactgatctggttaagatgggtgctgcccatagtgccaagggggacaccattgctgagctgaatctgatgggcatgaacatgaagtgtggcgttcaatccggccgaaaccagaattaagttctttaatccgcgatgatagtacccaaccagtaacgggaactggccgctcaggttcgcctggcgcagtaacagattgacctgtctgagcagcccattaagttccggcagacgctgtttctgcccggtcagttgctcctgcagcaggccattgaacagcgcccgcagcagcaacgctgccagcacgccattatcaccggcacgggtcacgtccagacagtagaaacgccagatctttatcggagagcgccgcgatatcaagcaccagcccaggctgctcggccatcgtcaactgacgatagttaacccggcagttggcaatagtctgctgcaccggtggctggagttgcttgagcagcttggcagccgctttaggatcacgaaccagcgcatcccagtcctggaacagttgttcatcctcttccactttcgaagtgaacatagagggatagagacactcatagaccgcttcacggaagcgctcaaagtttttaagtggtttaagcagcacatcctgcaccccaagacgcaatacatgcgcaatatccgacatgttctcggttgctgagatgattaaaatcggcacgatgttgccgcgggtacgaatgtgctcaacgaactggatgccgctcatgcggggcatttccagatcgcagataatcaggtcgacagtatgctgttgtagttgtgcaattgcttccagaccatcttccgcttgtaacgtcacagcacccatcgataacaaaaattggtccagcaacgaacggaaaacagcctcatcttcgacaatgagtatctttttgccgagtagtggtttttccattctttccccctgcgtaccagatatttcaatagtggttcataaaacgcagttgcgcctttaagaattggctgaagtcaccgctttgaatgaacaacctgattatctgccacggaccagtggtaatagttcatccattttcttctctacggcggccttgccagcttcaatggcttcctcagcacgatgaaagtccagcgtcgaaatttgcggacagaccggctgaatcaaaacatcgggcggatcgcctgccatgcgattccgcttcaggcgattttccagcacctggatagaggtggacataatctccatcgcgccaggtgactgagacgcacggcgctgactgaaattcaccagacgctgacgcagcttcccaccccaactcaatgccgctgcggcggcttcttcttcgctattctgtggtgtcacggaaaagagatcctgctgcattaaatgcgcgtcatgctgcaagtcaacggcgataacaatgtctgcccccagggcacgggtaagtgaaatcggcaccgggttgactacggcaccatccaccagccaatacccattgtagcccaccggcggtaataaacctggcatactgcatgaagcgcgtactgcctgatgcagatcgccctctgtcagccagagttcacgaccggtactgaggttagtcgccaccacgccaaagggtttatgacagtgctctatcgtgtcattggggatcagctgacgaacatggctaaagacccgctcaccgcgcagcagtccgccacgctgccaggagacatccatcaggcgaataacatcccagtagcgaaatgcactgacccatttttccatcagcggcagacggttattcacataggcagatccgactaatgccccgacagagcagcccgcaacgacgtcgatctcaatacctgcacgctccagcgcgttgatcacgccgatgtgcgcccatcctttggccgctccagaacccagagccaatccaatttttacctttctcatttctgtctggtcctgccgtcaatacgtagcatcacaacacggggtcagctaacatagcgcgcttgtaaaaccgacccatcattcccgggagataatgtgtcagaaacctgcccatgttgtagcggagagcagtatagcgtatgttgcgagccctttcttcagggtaaccagattcctgttacagctgaacaacttatgcgatcccgttattgcgcttatgttcagcataatgcggactatctggttgcgacctggcatcctgagaagcgtgatccggcgctgtcagggcttttatctgaaagttttccgggaaccgactggctcagcctgaatgtaacccgttgtaatcatggaagccatgagaacgaagctttcgttaccttttttgcgcgataccgcgagaaaaccaacattcaggccattcatgaatgttcacgctttcttcgcgaggatcaacgctggtactatgttgacggtacagcaccgcccgtggggcgtaacgatcgctgcccgtgcggcagtgaaaaaaaatacaaaaaatgttgtggttaagctgacggctaccccagcggttttacccctaatgctttgacaggactctgattgagatgcaagcgcaaaccatgcaaagaaaagttttacgaaccatttgtcccgatgcaaaaggtctgatcgccaaaatcaccaatatttgttacaagcacgaacttaatatcgtgcagaacaatgagtttgttgatcatcgcaccgggcgttttttcatgcgtaccgaactggaagggatcttcaacgacaacaccctgctcgccgacctcgacagcgccctgccccagggttcagtccgggaaactgcacagcgccggtcgtcgccgcgtggtgattcttgtcactaaagaggcgcattgtctgggcgatctgttaatgaagagcgcgtttggcggcctggatatggaaattgcggcggtagtgggtaaccacgacaccctgcgttcactggttgagcgtttcgatattccgtttgtgctggtgagccatgagggactgacgcgggaagagcacgataagcgcatggtggaagagattgaccgctatcagcccgattacgtggtgctggcaaaatatatgcgcgtcctgacgcctgcttttgtgcagcgttatccgaaccagattatcaatattcaccactccttcctgcccgcctttatcggtgcccgtccctatcatcaggcttatgaacgtggcgtgaagatcatcggtgccaccgcgcactatgtgaatgacaatctcgatgaaggcccaatcatcatgcaggatgtgataaacgttgatcacagctacaccgccgatgagatgatgcgcgccggtcgcgacgtagaaaagaatgtcctgagcaatgcactgtataaagtgctggggcaacgcgtgtttgtttacggcaaccgcacgattattctttaatcagccagtgcgctgaattgtctgcagattcagcgctacgcgtaaaaagtgggcaaacagttgcggttttgccagtgggcgctttacacccttatcgcatttggtatgatgcgccccgctttaagagagaaagattcaggccatggtgggattcccgagcggccaaagggagcagactgtaaatctgccgtcacagacttcgaaggttcgaatccttctcccaccaccatctgaatctgaatcatcttaagccacatcactatcccaggtgggattcccgagcggccaaagggagcagactgtaaatctgccgtcacagacttcgaaggttcgaatccttctcccaccaccatctcgtatgttgcacaccatccccaaaataatacctaagcttcctgtttctgcggggagagggatgagaaccttcgattaaggttcgggtcgagcatcgcgagacaacgcgcttcagcgcggcccgcagggtgaggcgcagcgcgccgaataatccttctcccaacaccatctcgcatgttgcacacaatcaccaaaataatacctaagcttcctgttctgcggggagagggatgagaaccttcgattaaggttcgggtcgagcatcgcgagacaacgcgcttcagcgcggcccgcagggtgaggcgcagcgcgccgaataatccttctcccaccaccatctcgtatgttgcacaccatccccaaaataatacctaagcttcctgttcacccccacattcctgcccgctttcacacaatctcagcctgttccgccatgactttttcagcaaaaatcgctaccatctccgcctgacatttctgaacaacggtcgatctcatgaaatttgtttcatttaacatcaatgggttgcgtgcccgcccgcatcagcttcaggcacttgtcgaacagcatcagcccgatgttatcggtctgcaggaaaccaaggtccatgacgacatgttcccgctggaagaggtgtcaaagctcggctatcacgtcttctatcatggacagaaaggtcactacggcgttgccctgttaaccaaagctgagccagtgtcagtgagccggggtttcccgggtgatgacgaagaatcccagcgccgcctgatcatcgcggaacttcccagcccgattggcgacatcacggtaattaacggctattttccgcagggcgagagccgcgaccatcccaccaagtttccggctaaagagaaattctatcgcgatctgcaacgtctgctgaccgaggatctgcctgctgataagccggttctgattatgggcgacatgaatatcagcagcaccgaccgggatattggtattggtgaggagagccgcaagcgctggctgcgcaccggcaaatgctccttcctgccggaagagcgcgagtggatggaccgcctgctgggcctgggactggttgatacctggcgtgagcacaatccggaggtggcggatcgcttttcctggttcgattaccgttcgaaagggtttgatgataatcgcgggttacgcatcgatctggtgctggcgagcaaaaccctggcgtcgcactgcgttgagaccggcattgattatgagatccggggcatggaaaaaccgtctgaccacgcgcccatctggtcaaccttccgcttttaactgacggtcgcgtggcagagcgccacgcgacggctatttcactattttccagatcaggttattggtgccgatggagtgttcatcacgggtacattgcagcaacaccccctctgatttcaccaccgcgccttccgtgtagttacggtttctcaaagatacagcagcggagacagtctggctgacgtctctctgcctgtgtccatgcctcgggtggcatatccaccacgacatcggtgttgccaccattgctgccctgctgtggcattgactgataacgactgttggcctgcgccacgctggtcgccagcgacagggccacgaccagtaatactgaataacgcctcattccgtctcctttactttacgcctggttttgcgcaccggacgtttctgtccggtggacggtaatccccgaaatgcatgcgccgcaggctgctgtcgcgcctgctggatcagaccggttaaggtctgcacaagcggctgcatgaattcatcatagcggcaggccttttcgctgatacgcgtcagtgtcgattcccactgcgccgtcatatccgggcgtgctgccagatcgggcagggagtgaatcagggcgcgtccggcatctgtagaattgatatagcggcccttcttcaccaggaagccacgacgaaacagtaattcgataatgccggcgcgtgtggcttccgttcctaaaccatcggtcgcacgcagtactttctttaattctttatcctgaacgaaacgggcaatgccggtcatcgcagaaagaatagtggcatcggtaaacgggcgtggcggctgggtttgcttcgccagcacctctccgcgctcacacagcagctcatcccctttcgctaccacaggcaacggcatgccgtcgttctcttcatcccgctctttgttgcccagcagcgcacgccagcccgcttccgccaggaagcgcgctttcgcaacgaattttccgccagcaatatcgagatcgatgacacatttgcggaataccgcatccgggcagaactgcatcagatactggcgcgccaccagttcatagatatgctgctcgttttcactgagcttcaccgcgctggcacgggccgttggaataatggcgtggtgggcatccacttttttatcatcccagcagcgatttctgcgatcggcatcgaaatctgccggtggggttagctgtgactgatgcgcctgtatcgcctttaacaccgcatgacgaccggcaaaatgctcttcaggcagatagcggctgtccgaacggggataggtaatcagtttatgggtttcgtaaagccgctggcaggtatccagcaccgtctgcgcactcagcccataacgtttagcggcctcaatctgcaggctggataaggaaaagggcagcggcgccacctcattttcgcgcttatcgctgtaagcagtgacgagcgccggctggcccgtaatacgcgccaccacatgctccgccagggcgcgtttgagcaggcggccctcttcatcctgccacggttcacaggcttcactggggatccagctggcgataaatcgggcgccgtcaggcgtaaggatgtgcgctttcacttcgaagtaatctttcggcacgaagttctcgatctcttcatcgcgccggaccaccagcccaagcaccggcgtctgcacccggcccaccgacagtacgccatcatagcctgcattgcgtcccagcagcgtccaggcgcgggtcatgttaatgccatagagccagtccgcccgggcgcgggccagcgccgagacgcacaacggaataaactcgcgattttcacgcaggcggtttactgcccggtccaccgcctgaggattgagatcgttaatcagacagcgctgcaccttgctgcgtttttcagccggcaggttcaggtagtcgagcacctcatccaccagcaactgcccttcccgatccgggtcaccggcatgcaccacttcattcgcctgcgccagcaagccctcaaccactttcagttgcttagcgaccgagggacgcggttttagctgccatttttccggaatgatgggtaaatccgccagcgaccagcgcgcataacggctgtcataactgtcgggttgcgcctgctccagaagatggcctacacaccaggtgacgatctgatcgttgccgcaggcaatgaatccatcaccgcgtcgatgcggtttcggcagcacatctgcgatagcacgccccaggctcggtttttccgcaataaacaaacgcattgaatcaggtaatccttaacatcagggggaacgcagtgataaccggttgtccgctgtcggtttgaatactggggctatgttagcctggcaggcccgctggcgtaagtgtgatgcgcggcgttagcgatcgttcgcacaggaaccgtgcaaaaagcagggctgaaatgcaccctgccggaaccggacaagcattgtagtcagaagtaacggacgaaaggcgccgtgtcaggtgggagcaccgtggtgctggatttcagttgcggggtgcccagatagagaaagccgacgatggcatcctgttcgcggcagccaaacccctggcgtacctgctcgtcatcggtccagggaccactgcgccagataccgttgtaaccctgagcgacggccgccatctgcatggccatcactgcacagcttgccgaggcgatctgctcccagcgcggcactttgtggtgctcttcacaatgtgccaccaccgtaataatcatcggtgcgcgaaacggtgactggctcgctttgttaatcgccttttcatccagctgtttatcgcgtgctgcctgctccagcagctggctcagacggtcgcgcccctcattttccacaatgataaagcgccagggttgcagcgtgccgtgatccggggcgcgcataccagcccgcaggatattttccagtgcgtcacccgcaggtgccggctcagtcaggcgtgaggccgaacgtcggttgaccagtaactccagtgcgtccatgtttctctcccgatctctgtaatgttgcagttatcctggcacaggcagattttttgtaacagtgcgcagtgatttcctgctgacttttaacacgccgctctttaggatgagctcgtcggggaagtctggtccgcgcggcggccacttcctgctacatatttatggagagtctgatgcgcacattgtggcgaataattgcaggtctgttccgctggagctggcgggtactgaattttatcagggaatttattctgaatattttcctgattttgttgattgtggtgggtgtagggatctggctgcaggtcagcgggtcgggcggcagttcagcgccgattcagcaaggcgcactgaaagtggatctcagcggcgtgctggtggataaaccgtcggtaagcaatcgtctgagcaaaattggccgccagctgctgggtgccagcagtgaccgtttacaggaaaattcgctgtttgatgtggtcgacgctattcgtcaggcaaaagatgacagcaacattaaaggcatggtgctcgatttacgcgaatttgccggtggggatcagccttcactgcaatatgtgggtaaagcgctacgcgaattccgcgacagcggcaagccgatttatgcactgggcgacagctacagccaggcgcagtattaccttgccagctacgccaccaaaatctatctgtcgccacagggcaccgtagatctgcatggtttcgccactaacggactctattacaaaaccttgctggagaagctgaaagtcacctcacacgtcttccgtgtcgggacctacaaatcagcggttgagccgttcctgcgtgacgacatgtcccctgccgcacgggatgctgacagccgctgggtcggtcagctgtggcagaactacctgaacaccgtggcagcgaaaccgccagattacgccggagcaactcttccccggtgctgctgcgattattgccggattaaacgccgtgaaaggcgataccgcgcaatatgcgctggataacaagctggtcgatgccctgggttcacgtgcggcagccgatcaggagctggtaaaaacctttggtctggataagcagagcaacgattaccgtagcgtcagcatctatgactacagcgtgaaaaccacctccacgcagcaggatggcaacatcgcggtagtcatggccagcggtgccatcatggatggtgaagagacgccgggcaacgtcggtggcgacacgacggcggcgcagatccgcgatgcgcgtctcgatccgaaaatcaaagcgattattctgcgggtgaacagcccaggtggcagcgtcaccgcctcggaagcgattcgtgaagagctggcggcagcgcaggcggccggtaagccgattgtggtctcgatgggaggcatggcggcgtctggcggttactggatctcaacccctgccagctacattgtggcgaaccccagcacgctgactggctcgattggcatcttcggcgtgatcaatacgctggagaacagcctggacagtattggcgtgcacaccgacggtgttgcgacctcaccgctggcggatatctcaaccaccaaagcgctgccaacggaagttcagcagctgatgcagctgaccatcgaaaatggctaccgcaactttgtcggtctggtggcgaagtcacgtcataaaacgccagagcagattgatgccattgcacagggccacgtctggaccggcagcgatgcgaaagccaatggtctggttgatgcactgggtgacttcgatgatgccgtgaagaaggcgggcgagctggcgaaagtcagtaatccgcagctgagctggtatcaggatgacccgagcttcctggatatgatgctgagccagatgaacgcgtcggtgcaggctgtcctgcctgatacgctgaaagcctggctgccagcaccgatgctggatgtgatgagtgctatgaaagcccagcctggtctgttcgacaagcagaacgatcctcagaaccgttatgcattctgcctgaactgcggcgaagtgcgataaacctcgcagcccggccgctggtcgggctgcttttccccgctattccccttatactgcgcgttttatggcgagtctgagttctctaatgcaaaagaaaaacatctacgtagcctacactggcgggacgatcggtatgcagcgttcggcgcagggttatattcccgtctccggacacctgcagcaacagctggctaacatgccggagttccaccgccctgagatgcctgatttcaccattcatgagtatcagccgctgatcgactcttccgacatgaccccgcaggactggcagtctatcgcagaagatatccgtcagaactacgatcgctatgatggttttgtgatcctgcatggcaccgacaccatggcatttaccgcctcagcactctcctttatgctggaaaacctggccaagccggttatcgtcacgggctcgcagattccgttagcggaattacgttcagatggtcagcagaatctcttaaactcgctctatgtagcggccaactatccgatcagcgaagtgtcgctgtttttcaataacacgctctatcgcggtaaccggaccaccaaggcacatgcagacggcttcaacgcctttgcttcgcccaacctctctgcgctgctggaagcgggcattcatattcgtcgcctcaatacaccgccagccccagccggtcagggcgaaactgaaggttcacaccattacgcctcagcccattggcgtggtcaccatctatcccgggatttcagccgacgttgtgcgtaactttctgcgtcagccagtcaaagcattgatcctgcgctcctatggtgtgggtaatgcaccgcagaacaaggaatttctggcagaattgcagcaggccagcgagcgtggcatcgtggtggtaaatctcacccagtgtatttccggcaaagtgaatatgggcggatacgctaccggcaatgcgctggaacatgctggtgtcatcagcggatttgacctcaccgtggaagcggcgctgacaaagctacactttttactcagccaggatctttcggccgatcaaattcgagccagaatgcagcagaatttgcgcggcgaactgactgaagactgaaacggagcgatatgtaatgaagcgggcactcatcattattgatattcagaacgatttttgccccggcggcccgatggcagtccatgagggcgaccatacggtcgaggtggcaaatcgttatgcgcgactgttccgtgaaaacggtgaatgcgtactggcactgcaggactggcatccggccaatcacggcagctttgcctcggtttccggcgagccggtttacacgctgggcgagctaaatggtctggcccagatctggtggcccgatcacggcattcagggctcaactggcgctgattttcatccgggtctcgatcgctcactgttcgatgcgacgttccataagggccaggatcaggatgtcgacagctatagcgccttttttgacaatggccatcgccgtaaaaccgagctggacagctggctgcgtgagcgtgggatcacccatctggtgatgctggggctggcgacggattactgcgtcaaatatagcgtgctggatgcgctggagctgggttatcacgttgaggtggttaaagagggctgccggggcgtcaatctgaatcccgaggacagcgaaattgcctttgcccagatgaccgctcagggcgcgattctgatttaaaatggagctggcatgacgccagcttttttttaatgcagatggatgcgggtcacgtcagggtcaattccaaactcttctttgagctcttttttcgacttcatcaccatttcgccacctttgccgatggtcatgtgctgcggcgcgtcgttgtgccgcgcctgccacatcatgaccagctgcaggcaattgtcgcgctgctcctgggtcagtgccacgccatccggccatttaccaatctcaaccgccgtggcaagacgctgatagacttcaggcgtcatcgatgcaagcattgcttcaagctgttccttcatcgccattaccctttggtctgttcgccttgctcgtcggtaaaattcagcgaggcggagttaacacaatagcgtttcgccagtcggctgcgggccgtcagggaagacatgtcccaggtgcgcatcgcagctgccacagcggatctcaatacgctgcatgccgtgtgaatcatcttcaatatagcgaatcgcatcatcactgaccggctgatagaaactgggccagccacagccagagtcatacttcgtctcagagagaaaaagtggcgcctcacagatcagacagtggtagatcccttcctgcttgttgtgcagcagtgcgccgctgtaaggcggttccgttccgcgttgctgagtgacgtagcgttgcatttcagtcaactgtgcaatttttgcttcgggtgcggtgtctttagccattttaggattccgggcagtgccattctgaaaaattcgactattattctaacaaatgatcaacataacccgggtctttttttgtgctcaccctttcagcctgctctctgctaagcggatttgtgacatcgatcaccttttatccggcgcatccctatatattcggcgattgattcaacgaagcgcgatatcattggcggcgcgcaagcggttgcgcatcgaataattcctttcaggcgaattgatttgtcgcaacaattgacacgattccgcttgacgcctggtaaggtttttgtaattttacaggcaaccttttattcactaaccaatagctggtggaatatatgactatcaaagtaggtatcaacggtttcggccgtatcggtcgcatcgttttccgtgctgctcaaaagcgttctgacatcgaaatcgttgctatcaacgacctgctggacgcggattacatggcgtacatgctgaagtatgactctactcacggtcgtttcgacggcacagtagaagttcaggatggcgcactggtggttaacggtaaaaaaatccgtgttaccgctgaacgtgatccggccaacctgaagtgggatgaagtaggcgttgacgttgttgctgaagcaaccggtatcttcctgaccgacgaaaccgcgcgtaaacacatcaccgcaggtgctaagaaagtcgttctgaccggtccatctaaagatgacaccccaatgtttgttcgtggtgcaaacttcgacaaatatgatggccaggatatcgtgtctaacgcatcctgtaccactaactgcctggcaccgctggcaaaagtgatcaacgacaagtttggcatcgttgaaggtctgatgacgaccgttcacgccaccactgctacccagaaaaccgttgatggcccgtctcataaagactggcgcggcggccgcggcgcatcgcagaacatcattccttcatcaactggcgcagctaaagccgttggtaaagttctgccagagctgaacggcaaactgaccggtatggcattccgcgtaccaacccctaacgtttccgttgttgacctgaccgtgcgtctggaaaaagcggcttcttacaaagaaatctgtgctgcaattaaagcggctgcagaaggtgagatgaaagacgttctgggctacgttgaagatgacgtggtttctaccgacttcaacggcgaaatcctgacttcagtgtttgacgctaaagccggtatcgcgctgaacgacaactttgtgaaactggtttcctggtatgacaacgaaactggctactcaaacaaagttctcgacctgattgcactggtttctgctaaataaggcagccagacatcattgagaataagggcgacttcggtcgccctttttttgatccgctcaggaaggaatcgaacatgcaagataaactgttttctctgccggtggtcacgcagatctccccttacctcacccagcgccagataggtgaactccccgccattgttgtgagtcaccctaaagtgcgggcagccattacgcttcagggcgcgcacctgatcgcctggcaacccagcggcgaaaagccggtactctggctgagtgataagagtctctttgcaccgggtaaggcgattcgtggcggcgttccgatctgctggccgtggttcggcccggcgggcgaaccggcacacggctttgcgcgggttcagccgtggaagctcacggcgcatgatgaaaatgaagatggcgtcatgctgacgctggtgctggagagcaatcctcagacgctgaagctctggccgcatgaattcaccctgattgcccgcttccgcctgggccagcattgtgagattgagctggaagcctatggtgactttgaagcgacggcggctctgcacagctactttaccgtcagcgacatcaacggtgtggaagtctcgggtctgggcaatagctatatcgacaaagtgaataacggcgaggtggccagcagcgacggcaaacagcgttatcctggacgcatcgaccgtatctttaccgtagcagaagattgctcagtgattaatgatactgcgggcgagcggcagatcgaggtgtaccaccatcatcatagtgacgttgtcacgtggaatccgggtgtggaactctcctgcagcatgacggatatggcgaatgagggctataagaccatggtctgtgtggagacggcgcgtatcagcaaaccgttacgcagcgcgggtgaaaagccagcacgactggccacgacgttccgcctcaaaaagaaagccgcagccagcaacaacgttaacggctaaacaatatccagcggcaacttatgctgtggcgctggccaggcgcgatcgatgagctgcaaatcctcatcggtcagttccacctccagcgccgccgcattttcctgaacgtgggccacggaactggctttaggaatggcaatcacccctggctgacgaatcacccaggccagcagtaattgcgccacgctgatgcccttctgctgtgcaatctgagtcagctgcggatcggtgaagagtgagtcacgtagccgtccggcctgggccagcggacaataggccatgaccggtacgccacgctgctgacatgccggcagcagatcaaattcaatgccgcgtgaagccagatgatagagcacctgattggtcgcgcaggcctcgcccttctcttcatcccacagttcggccatatcatcggtgtcaaaattcgatacgccccagtgacgaattttgccctgctgctgcaggcgttccatggcgcgcagtgtctcttccagcggaatattgccgcgccagtgcaaaagatagagatcgagataatcggtttgcagacgttgcaggctgcgctcacaggctgcaatggcatccacttcgcccgcattccacggataaactttggagaccagcagcgcccggtcgcgacggcccagcagtgcctgcccgaccacctcttcggctccgccatctgcatacatttcggcggtatcaataagctgtaatccgcactcaagacccgcctgcaatgcagcgacttcatcagcacgctgcgccgggttttcacccatataccaggtgccctgaccgatcaccggcagctcgctaaaaccggcaaagttaatcgtgttacgcattctgctctcccgccccattctgaggccctgtaaaagaacagagggcattaaatgccctcttttggtgcgttatcagaaggtatagctgacacccgtccagattaacgcctgcccgcttttatcaatcatcgggctgtctttgatttcgctgtcgaagcggacgtaacgtcccatgacgctggcattccactgtggcgcaatctgatagctggcgctcagttccacataaggtgaccagctatcatccggattgtaacggctgatgccggtacgggcgctttcatgcccggataccccatagtaataacggttttgattggcgctgttccacgtggccccgatgcccggcgtcaggctgaagtcacccatctggaagcgatagaggtatgtcaggtcccagatcatcccattgctgttattgagcacatcccccagcaatgaggtacggacaatcccccagtcagcggtgtgacgataggttgcgccacccatcagcgtcatgcggcgtttatccagccctttcatgtcgcccaggtcattgtcgctgggtttgtactcctgcggtgaacccagcagcgtcagtgacagctggttctgaggatctttccacaggtagtagccgccctgcaggctgcggaaccagaagtcttcaccctcataattgataaccggaacggggatataccggtcctggccgccgcgataaggtgattcggcatagatgaccgatgcgccaatggaaagcggtgcggcattcgcgtgcgtggccagtaaataacagggcagaagtgcaacaagcgtcttaaatttgaattggttcacaatttattcattccataaatataacaatcaaacaggaagtctaacgttttttcacggctggattaacttatatcgaaatcctttaagtgacttatcgatgaaagtggcattaaaggttaaaaacacgttaagttaaagcatcacccatatgaacgcatctcacaacagacccgctgtacagttgatcttcccctcattaacccaaacccgtggaggaaatttcctagaagccatctacagttagaagtaacagcagacattttgtacgagcagagtaaccacaaaagttgtgtatcccgataagaaagatcaggttggcataagggttgctgtactcaacagagaatatcttccgggagctgctataagcctctaattacgctccttacctgtgctaaaaacgaaaggacgggcatcgctatgaatatattcgatcactatcgtcagcgttatgaagctgccaaggacgaagagttcacactgcaggaatttcttgctatctgtaagcaggatcgcagtgcatacgccaacgctgcagagcgactgttaatggctatcggagagccggtaatggtcgatactgctcaggagccacgcctttccagaatattctccaaccgtgtgatgggacgctatccggcgtttcgaggagttttacggcatggaggaagcgattgaacagatcgtctcctacctgaaacatgccgctcagggactggaagagaagaaacagatcctctatttactgggaccggtaggtggcggtaaatcctcactggcggaacggcttaagtcgctgatgcagcgggtacccatctatgtactgagcgccgacggggaacgcagcccggttaatgaccaccctctctgcctgtttaatccgcaggaagatgcgcatattctcgaaaaagagtatggcgtgccgcgccgttatctcggcacgattatgtcgccgtgggccgctaagcgactgcacgactttggcggcgatatctcgcgtttcaaagtggtgaaagtctggccgtcaatcctggaacaactggcgattgccaaaactgaaccgggtgatgagaacaaccaggatatctccgcgctggtcggtaaagtggatatccgtaaactggaaaaccacgcgcaaaacgatcctgatgcttacggttactccggcgcactctgccgtgccaaccagggcatcatggaattcgttgagatgttcaaagcgcctatcaaggtcctgcaccctttactgacggcgacgcaggaagggaactacaacggcaccgaggggatttcggcgctgccgtttaacggcattattctggcgcactccaacgaatcagagtgggtgacgttccgtaataacaagaataatgaggcgttccttgaccgtgtctatatcgtcaaggtgccctactgcctgcgggtctctgaagagatcaaaatctacgacaagttacttaatcacagtgagctggcgacctcgccctgcgcaccgggtacgctggaaaccctggcacgcttctctatcctgtcacgtctcaaggatccggataactccagcatctattccaaaatgcgggtctacgatggtgaaagcctgaaagataccgaccctaaggcgaagtcctggcaggagtatcatgattacgccggtgtggatgaggggatgaacggcctttcaacccgctttgcctttaagattctgtcgcgggtatttaactttgaccacgccgaagtggcggccaacccggtgcacctgttctatgtactggagcagcagattgagcgcgaacagttcccacaggatcaggccgagaaataccttgagcacctcaaaggctatctgatccccaaatatgctgagtttatcggcaaagagattcagaccgcctatctggaatcttactctgaatatggtcagaacatctttgaccgctatgtgacctatgccgacttctggattcaggatcaggagtatcgcgatcccgataccggacagctgtttgatcgtgaatcgctcaacgcggaactggaaaaaatcgagaagccagctggcatcagtaacccgaaagatttccgtaatgagatcgtcaacttcgtgctgcgcgccagggcacacaataacggtcgcaacccgaactggaccagttacgagaaattacgcaccgtgatcgagaagaaaatgttctcgaacacggaagagctgctgccggtgatttcgtttaataccaagacctccaccgatgagcagaaaaaacatgatgactttgtcgatcgcatgatggaaaaaggctatacccgcaaacaggttcgcctgctgtgtgaatggtatttgcgtgtgcgtaaatcgtcctgataagagtctgtaagcttgccggtaagtgataccggtctgacgaggtcgggtttcgcccggcctgcttacaatgtagtttgggggaataccatggcctatttcatcgatcgccgactcaacggcaaaaacaagagcgcggtaaaccgccagcgcttcttgcgccgttataagtcgcaaattaagcagtcgatctccgaggccatcaataaacgctcggtgaccgatgtaagcagcggtgagtctgtctctatcccgattgacgacatcaatgagccgattttccatcagggacgcggcggcaaccgccatcgggtccatccgggcaacgaccattttgtgcagaatgaccgggtcgagcgaccgcagggtggcggcggtggcggcagtggccagggcaatgccagtcaggatggtgaaggtcaggatgagtttgtctttcagatatcgaaagatgagtacctggacctgctgtttgaagatctcgccctgcctaacctgcgccggaaccagcatcgccagttgaatgagtataagacccaccgtgccggcttcacctccaacggtgtgcctgccaatatcagcgtcgtacgttcgctgcagaactcgctggcgcgtcgtacggcgatgaccgcgggtaaacgccggatgctgcacgaactggaagaaacgctgctggagattgagaactctgaaccggctcagcttctggaggaggagcggctgcgcaaagagatcgccgagttgcgggcgcgtatcgaacgggtgccttttatcgacaccttcgacctgcgctacaaaaactttgagaaacggccggagccttccagccaggcggtgatgttctgtctgatggatgtatccggatccatggatcaggccaccaaggatatggcgaaacgcttctatatcctgctttacctgttcctgagccgcacctacaagaatgtcgatgtggtttatattcgtcatcacacgcaggccaaagaggtggatgaacaggagttcttctactcccaggagaccggtggcaccatcgtttcgagtgcgctgaaactcatggatgaggtggtgaaagagcgctatgacccggcgcagtggaatatctatgctgcgcaggcgtcagatggcgataactgggccgacgattcaccgctctgtcacgagattctggcgaagcatattctgccggtggtgcgttattacagttatatcgaaattacccgccgtgcgcatcagacgctgtggcgcgagtatgagcatctgcagtcgacgttcgataactttgcaatcgaacacattcgtgagccggaagatatctacccggtgttccgatcgctgttccataaacaggcaacggaagcctgatgcactaagccggctaatcgccggctttttttatcttccgaataacctgctaaaacagtctgttttctgccgcttgcctgccaaccccctcattcttcacattaatctgattccatacgctgttaagcaattcgtataatgatcattttcacaatgacaactccttgataaaacattatctttcagagatagcatggatatttgtcaccagtcgctgcaccgcactgtcatatctcaggagatcgggtttgaaccacactattgtctacagtctgtttatcatcggttccgtgctggtcgcatcgagcattctgctcagctctttctcatccagactgggcatccccattctggtgatcttccttgccctgggcatgctgaccggggttgatggtatcggcggcatcgcctttgataactatccggcggcttacttaatctcgaacctggcgctggcgattatcctgctggatggcggcatgcggaccaaagccagctcatttaaagttgccctggggccagcgctgtcgctggcgaccgtcggggtcatgattaccgcaggcttaaccggtgtggtcgccgcctggttgtttaacctggatatgatgcagggcttcctgattggcgcgatcatcggctccacggatgccgccgccgtcttctcactgctgggtgacaaaggcctgaatgagcgcgtcagctccacgctggagattgaatcgggcagtaacgatccgatggcggtgttcctgaccattacgctgattgagatgatcgaacagggccgcagcggccttgactggatgttcctggtgcatctggtgcagcagtttggtctgggtatcgtgctgggcctgggcggcggctgggcgctgcagcagctgattaaccgtatcagtctggccggtgggctctatccgctgctggcgttgagtggcggcattctggtgttcgccctgaccacggtattagagggcagcggcatcctggcggtctatctgtgcggctttttactgggcaacaggccgattcgcaaccgtcacggcattctgcagacatttgacggcatggcgtggctgagtcagattggcatgttcatcgtgctgggactgctggtaaccccgtctgatttgtggcatatcgcagttccggcgatgatcctctcactgtggctgattctggtggcgcgcccactgtcggtgtttattggtctgctgccgtttcgcagttttaccacccgcgaaacgcgtctttatcagctgggtcggtttacgcggcgcggtgccgattatccttgcggtcttcccgatgatggccggattagaaaacgcgtcgctctattttaatatcgccttctttgtggtgctggtctccctgatgttgcagggcacctcgctgggctttgcagcgaaaaaagccaaagtggtggtgccgcctaccgcatcgcctatcagccgtatcggtctggatatccaccccgaaaatccgtgggagcagtttgtctaccagctcagcgctgacaagtggtgcatcggtgccgcactgcgtgacctgcagatgccgcgtgagacccgcatcgccgccctgttccgtgacaatgtgctgatgcatccgaatgatggaacgcgtctcagggagaacgacgtcatctgcgtgattggccgtgagcgcgatctgccggcgctgggtaagatgttcagccagtcgccgccggtttccctcgaccagcgtttctttggtgactttattctggatgctgaagctcgcctgcgcgatattgcgcagatttacggactggaactggatgagaacaccaacgatcagcagtcgctgggacaactggtgctgagtatgctgggcggcgcgccggtggttggcgatcaggttgagtggaatcagctgacgtggaccgtcgcggagaaagaggataaccgtattgtgaagattggtgtccgtccggctgaagagaaggaataatcctaatcattcagccacgttattttctgtcgatacgctaagcttaaaagtctatgccagcaaaaacgggagaaatgaatgggacacgtggttaaaattggtcgttatgagattgttgatgccgatcttgacagtgagaacctcgacaccgtcagcatcccctgccacaccaatcccggcttaattacccaacttgatggctgggatcgcgataccagcgttccggcatggattgacggagaaccggtggatctgcagattggtcattacgataaacagcaggaccgctggattttaaaaaaacctgcctgagtccgttatcactaccgccagtcgtaagatttggcggtaattcctaaaaagcgtcttaaacagtttggttataacctacccccgccttattttatccagtaaaaaccaaaacttagccatttaaaactttaatcacttttgatgttttcagattttttccgtattaactctgtcaaataactcctgcatactcattctcaatgctgcaacatttcgtgagtactatcacgctttagccgttatcttttttgcagctgcactggctttactgactgcaacagactgcaacagactgaaaattattttttaatttttcagaagcccacccctgagcgcgtacatgattctggtcaggccatcttttacttgagaaagagagcaggttttatggcaagtacattgataatgaatagcccgagccgctcgtggagcggcacgcgtaaaaatatcatcgtgaaattcgccctgagcttttccgatctgattgcacttaacctcgcactgtttttatctgccgcgacgatacagggtatttggggcgagctggatacctttattccacctcatcaaattgaatatcgttttgtggcacagtttattatgtcagtcatgtgtaccggatggtttctgggtacgcctgcgtcactatacctatcgcaaacccttctggtttgagctgaaagagatcattaaaacattatttgttttctcgctgctcgacctcgcgttgatcgccttctctaaatgggatttctcccgcatggtgtgggtcttcagctggacatatgccctgctgctgctgccgctgatgcgtgctctggttaaacgcgccattcacaaggcgggtcagtggcagaaagagaccatcattattggctccggcagaaacgccaccgaagcttacgcggcgctgcagagtgaagagattctgggctacaacgtacaggcctttatctcggtcgatgatgttccggctcagcagagcgtgaatggcgtgccggtgatcacctggaaagatattaactggcagaccattgaccgtgacaacgtgcagtttattgtggctatggagtatgagcagcagccgatgcgcgatcgctggctgaaattcctgtcgaagatgaactgccgttcagtttcagtgatcccgacgctgcgcggcgtgccgctttacggcaccgacatgtcctttatcttcagccatgaagtgatgattctgcgtgtcagcaacaacctggcgaaacactcctcccgtttcatgaagcgtgcctttgatatcgtggtggcgtcgatgctgctgctgttcctcggcccaatcttcgccctgctctgttatatggtaaaacgtgatggcggcaatgccatttatggtcacgagcgtgtgggccagaatggcaaaaaattcaaatgtctgaaattccgttccatggtgaccaattccaaagaggtgctggagaaattactggcaaccagcgaagaggcgcggattgagtgggacaaagatttcaaactgaagaatgacccgcgcgtgacccggattggtagtttcctgcgtaaaaccagcctcgatgagttgccgcaactgtggaacgtgattcgtggcgagatgagcctggttggtccgcgtccggtgattgaagctgagctggagcgttatgccggtgatgtcgactactacctgatggccaagccgggtatgaccggtctgtggcaggtcagcggacgtaacgatatcgactatgatacccgcgtctattttgactcctggtatgtcaaaaactgggcgctctggaccgatatcgcgatcctgttcaaaaccgcaggcgtggtgttacgccgcgacggcgcttactaatcagacctcggcgatgcctgtttacagcaggcatcgcactttccgcacgacttcctctatcttttttgccgctgaatcattaccctctgcgatcgttttttaacagaacgcttaccctctggttgttatgcaaaaatttactctgctgttattaagcctggtgctgctggcacccttaggcatcgatctctatttgcccacgctgccacaaatcgcagaagggctggatacgccggttaatctggtgcagaccaccattcccctgtttctgctggtcatggggctgggacaactggtgaccggcccgctggtggacaactatggccgtaagccgattgccctggtgggcctggcgctttacatcacgggtagtgccatcgccgccaccgccacctcattcccgctgttcgtccttgcccgcctggtgcagggctgtggcgtctgctgcagcgcggtcgtggcctttagcggcgtgcgtgaccgcctgagcggtgatgatgccgcccgtgcgtatggcttcctgaatggtgcattaaacatcgtcccggccctggctccgctgctgggcggtttgctggccagcgcctttgactggcgcgcacccttctggtttctctgcgcctacggcgtgctgattacgctgctggtgattatctggctgccagagacgcgcccggcggataccctgcgggtgaaaggattaccgattaaacagtatgccgcgatcctgcgtcagccgcgctttctggcgttcgcgttcgccaatgccggtgcgctgggcatggtgctgacctacgtgtcgctggcaccgcaggtattaatgaccgaaggcgggctgacgccaatccagttctcttttgcttttggcgccaacggtttctggatcatgtttgtcagcatgttcgtcaataaagcgattcgcaaagcgggtcgccctttctgcctggcgatgggattcttcactatgctgctgggcgcggtgctgctggtagcggggatgcagatcttcccggcggagatgcagacgcactgggcgctttacatgttcccggtggccgtttcagttgccgggctggcctttacggtgggaccggccaccagctatgcgctggagccctatcagcaacaggcgggcgtagcgtccgccttgcagggattcattcagatggccggtggcgcgtcaggcagcctggtcattgtggcgctgccggtggcggagaagctgtcgctgagtctgatgatgctgctgggtgcagcgctggcctttatcgcctggcgctgcagcagaaagatgcgcggcagcctgaccgcgcttaaataacggttaccggaacgcggggtgccagcgcacacatcagctcgtaccctaccgttccggccgcttttgccacctgatcgattttcacctgctcaccccacagctccacggctgagccaataccggcctggggacagggggtcaagtcgacggtgatcatatccatcgaaaccgcaccaaccacctgagtcattacaccatcgacacagacgggcgtacccgtcggggcatgccgtggatagccatccgcgtagccacaggccaccacgccaattcgctgcgctgcactggcgtgatagcggtagccgtaacccaccccatcgcccgcctgtagctgctggaccgcaataatctcactgcttaaggtcatcactggcttaaggccactgcctgcaatgtcctgccagtcaccgctgggcgacgcaccatacagaatgatgccgggacggacccagtcaaagtgcgcttcaggatgccacagggtgcaggcggagttggagagcgatcgcgggcagttcagcccctcagccgcctgctctacgcgctgcagtggcgcaatcagaccctgcggattttccgcatcggcaaaatgggccatcagcgtcatctcacctaccgtgctcagcgcccgcagcttttgccatgcaccgttgacctgttccgggcgaaaacccagccggttcatcccgctgttcattttgagatagatatcaaccggtgctgcaagtctggcactggccagcgcgttgatttgccagttactgtgtacgctggtggtgagacgataacggtcaatcagctgcagatcctctggctggaagaaaccttccagcagcagaatcggctttttccagccctgttcgcgcagctggatcgcctcttccatattaagaagcgcgaagccgtcagtggcagataacgcctcgcgcacgcgatcaatgccatggccataagcattagctttcaccactgaccagacgcgggaggcgggtgccgcctggcgaacaacagtcaggttatgacgtaacgcctgctggttgatggtagcgacaatcggacgtgacatcctctctctccctgaatacttaacgagttgcgttggcgttacgcagcggcgatgaggtcgccgcgaaaccgggtaagtagcggaacaccgctaagtcatccgccgcaatggccggctttttaccggagatgagatcggccagcaactgaccagaaccacacgccatcgtccagcccagcgtaccgtgaccggtattgagccagagattagagatcggtgtggcacccacaatcggcgtaccgtctggcgtcatcggacgcagaccggtccagaaactcgcctgcgcgagatgaccgccttcaggatagagatcactgaccaccatctccagcgtttcccgccgcgcttcggtgagtttggtgttaaaaccaacaatttccgccatgccgccgacacgaatacgatcgtcaaaccgcgtcaccgccactttgtaggtctcatccaggatagttgaaaccggtgcggcatctggatttttaatcggaatagtgagtgaatagcctttcagcggatagaccggaatatcgatgacattttttaacagcgcggtcgagtaggaaccaaacgccaccacatagctgtccgccttgatgatctcatcaccgcacttcacgccatagatgcgattgccatcgcgcagcaggtggtcgaccggagtattaaagcgaaagaccacgcccgcctcttcggccatttttgccagccgctgagtaaagagctgacagtcgccggtttcatcattgggcaggcgtaatccgccggtgagtttatgctgggttgccgccagtgccggttcaacgcgagacagttcatgcgcctgcagcaactcatagggcacgcccgcgtcgcgcagcaccgcaatatctttgctggcgctgtcgaaactgctgctgggtacggaacagttgcagcgtcccgccctgacggccctcataggcgatgccggtttcactgcgcagcgctttcagacagtcacggctatattcggcaatccgcaccatgcggcttttgttctgctgatagtgattgatgtcgcagttgcgcagcatgtgccacatccactccagctgaaaactactgccatccagccggatagccagcggcgcgtgacgctgaaacatccacttcaccgctttcaatggcacgccgggcgctgcccagggtgcggcataacccggagagatctgaccggcattccctgcactggtctccatcgctgcggcgggctgacgatcaatgaccgtcacctgatgtccggcacgtgccagataccaggcacttgccaccccgaccacaccacttccaagaattacaacgtgcatagctcccccacccgacctgtaaaagcataattcactgttcaactgatgatagtcagcggatttacacagcagacaccaccacagaatttcaccatccatttcacatcttttttacttttcaggtaactaaaatcttgtcgcacggccaatttcagcgctttatgcgtcttaatccttaaacacagaaataaatgacaacgaaggcagttaaatctgcctgttgcaggagattcattcaaccccatacattccgcttataaacaggattagattccgcaatttataataaggctagtattaaaggctgttaaattctctgccgcaccactcttaatgattttgtgccaaagaattcgtttgagttcgcatttcggataagcgacagtgggctatcattgttgtgttcgctcagtttttttcgggttccctttttcaggatgaagccttaaataaccagaacgggttgtctttcgggtcagccggtttgcaaaaaagaggtgcgctatgacgacaatctttgacgaagccatcagagacagcaaacgactcaatgacggaccagactggacattcgaactgcttgatgtctacttagccgagatcgaccgggtggctaaactctaccggcttgatacctacccgcaccaaatcgaagtgattacctctgaacagatgatggatgcctactccagcgtcggcatgccaatcaactattcacactggtcattcggcaaaaagtttatcgagaccgagcagcgctataagcatggtcagcagggtctggcctatgagattgtcatcaactctaatccctgcatcgcctacctgatggaagagaacaccatgaccatgcaggcgctggtgatggcgcatgcctgctatggccacaactctttctttaaaaataactatctgttccgcagctggacggatgccgggtcgattgtcgattacctgttgttcgccaaaaactatatcagtgactgcgaagagcgctatggcgtcgaagaggtagagcggctgctggactcctgccatgccttaatgaattatggcgtcgatcgctataagcgcccgcagaagatctctctgcaggaggagaaggcgcggcagaaaagccgtgaggagtatctgcaaagtcaggtgaacaccctgtggcgaacgctgccacggcgtgagaaagaggccgtcacctttgaagccgcgcgctacccctctgagccgcaggaaaacctgctctattttatggagaaaaacgccccgctgctggagtcatggcagcgtgagatcctgcgcattgtgcgcaaggtaagccagtatttctatccgcagaaacagacccaggtaatgaatgaaggctgggcgacattctggcactacaccatcctcaatcacctctatgatgaaggcaaagtgtcggaacgctttatgatggagttcctgcacagccacaccaacgtcgtgtttcagccgccctataacagtcagtggtataacggcatcaacccctatgctttagggttcgcgatgatgcaggatatcaagcgtatctgtcagtcgccgaccgaggaagatcgctactggttcccggatatcgccggttccgactggctggaaacgctgcattttgcgatgcgcgagttcaaggatgagagttttatcagccagttcctgtcgccgaaagtcatgcgtgatttccgtctgtttaccgtactggatgatgaccgcaacaattatctcgaaatcgccgcgatccacgatgaggcaggctaccgggcaattcgccagcagctctctgcgcagtacaacctgagtaatctcgaaccgaatattcaggtctataacgtcgatctgcgcggtgaccgttcgctgaccctgcgttatgtgccgcagagccgcacgccgctggataagagccgtcgcgaggtgctgaagcatgtacatcgtctgtggggatttgatgtgattctggaacagcagaaacgaggatggcagcgtagagctgctggatcgtaatccaccacgcggttcatcactctgatgggataaaaacaaaaaaccggacgcgatgtccggttttttttaacgcttactgcctagatcgtcgggcagattcttctgcatactgtgccagatttcaccgctgcggcggccgtagttgcgcaccacgtccacaatctcatcctgtccgggctctttgtcgcacagttccagcagtttcagatagaaatcgcgcgcgacctgacgggcttccggattagagaagtagtggcggccaacacgggtatagagccctttcaggccattcagaatcagaccgtaaatcgggttacctgacgcaaacgccagaccgcggaacacccggtagtcgagctcggtataggcatcagcctgatcggcagccgcgctgaccgtttccagcacttcgcgtgctttgtccggatgatggcgcagcgcccggctgataaagatcgatgaaatattgctgcgtaccgacagcaggttgtcgatcagcaccggaacgctgtcgtgatcgagacgggccagcgtttccagaatattcaggccggacgtctcccagaaatcgttcacccgcgtcggtttaccgtgctgaatagtcagccagccatcgcgcgccaggcgctgcagcacttcacgcaaggtggtgcgcgtcaccccaatcaattcagaaagctcacgctcagcaggaagaatcgaccctggcggaaagcgactgttccagatgctttcaataatatactcttcagcaaatcccgctggactctgagcctttataaccatagcaatgtgttctcgttgcttttctaatcatgatgggcactcatcataccagacgccctatagcggatatagcctgcgtaaccattaaaaccgggcgcaggcgcatatttcagcatggctgaccgcagtatcagcggcttcgggatcacgggcgggctgaatggctttctgcgctgaaatggcgcgtgccacagcaccgctgagtgtcagcgttcagccaccctgaaagcgcaggactttgacagcatataacccgcgcctgccgtttcgcctcctgccgcatgcgatcgcccctgtcgccactgcggctctccccgctcttcactgacggtcgttctgcagataaggtccggcttatcctcatttaacctgctctggatcagaatcaggtcatgtttgcacacgatttttccctgcccctggctggtttgcaaacgcttttggtttacactgcgtggcattaacgtttacagggaatgcaatatgttgcgatatctgaatcaatgctcacgtggtcgcggagcctggttactactggcactgactgcacttgcactggaattaacagcactcttttttcagcacgtaatgggcctgaagccctgcgtgatgtgtatttatgagcgcaatgcgctgtttggtgtgctgggcgcgggtctggttggtgcgattgcgccgaaatcgccgttgcgtctggcggcactggcgttgtggatctacagtgcctgggaaggtctgcgtctctcttatgaacataccatgattcagctgcaccctaaccccttcaccacctgtgattttgctgcccgcttccccagcggcttaccgctggataagtggctgccgtcggtgtttcttgccagcggtgactgtgcagaaacgcagctggactttcctgacgctcagcatgccgcagtggatgattgtggtgttcgccggttatctgctggtcgcggcgctggtgctgatagcccagccgctgaaacctaaacgccgcgatctctttggtcgctgagatcaaaaaaggctgccactggcataatgctggtcagttaagcgacaggtgataacgcagtctggtgccgggcaggggctggcggtcctcgcgccgctgcgcggttccttcacttcattcctctgcctgacggaccgccggggatggcacatcctgtgccgccccgcctttcgcccgcgtcctgcgggctctcctggcagactcattctgttcagcgctgcggattgcctgcccctgcccggcaccagcctgctctgaaacttcagtgtgtattgttaaaaagggcacgagagtggaggcctgagcgcctctgctgctgaaagggctatccgcagcgctgaggcgtgacggtgggccagaagtccacgccgggaagcgtggacaggtcggggccggccagggagggccgatccccgaacggttcgtcggcacgacgtcaaagccgaaggtaccgcgtgagcggcgcgaggacggcccggcagcagcagaggtgcgcaggcacgcgctgcggcttgctcgcccggaaaaaaagctgccacgtttgaccgtgacagcctttacaaatctaatcttaactgaccagcattatgccactggcagtcttttttctgttccgattgatagcgcggcactcagccgttgcgatcggggcgatcaataatgtgatcttcccagtcccgcacttcactctcacgcaccgcaatataccgcaccgaaatacgctgcgcatgcatcgctgttttcgaaccggcccgcagcggatgccatacgggtaaatctttgccctcacccagcagccggtaggcgcaggtgcgcggcagccagttgaaggtcgtcagattttcgcgcgttaacttgatgcaatcctcttcaagctcgaagcggcgctcatagttgcggcactggcaggttttaatattgagctgatcacaggcgacattggtgaagtagatctcatcggtgtcggcgtcctgcaatttgttcaggcaacactgcccacaaccatcacacaaggattcccattcctcatcgctcatttgtgccaggcgtttttgttgccagaaaggggtgtcagtcatgatgatttgtccggattgtgcctaaaccgcaccttataaagcctatgcggcggtgatgcaagtttttagagtacgcgcgtgctgatgccgtgacccgccagtgaaacttccagctgatcacccgagcgcatcgggcctaccccttctggcgtaccggtcagaatcacatcgcctgcacgcagcgtaaagtagtggctcatatgggcaatcagcggcaggattttatgaatcatgtcttcggtgttgccgtgctgacgcacttcaccgttcaccagcaatttaagctcgacgttctgcggatcgccactgaattccgtcaccgggataaaaccagagacaggacaggcgttatcaaagcctttggatttttcccacggctggcccgcttttttcagcccggcctgcaggtcacgcagtgtcagatccagcgccacgccataacctgcaatcgccttagccacatgcgcatcggtcgcctgcttcagtgtcgcgccgatcagcaccgccagttcaacttcatgatggacctcgccaaacgcgtcgggaatagagagcggctgacgcaaatcacacagcgccgtttccggcttgataaagatcaccggttcggttggggttgcgctgcccatctctttaatgtgctttgcataattactcccgacgcaaaccactttgctgaccggaaaatctaacagagcgccttgccagttacgatgctgatacatgctcatcccctgttcaggttaggtgtgatgccagcgctgctggcgggttgatgtttgctcatgcgttgatcgaaatgccaacctcatagcgtgataataagatccttttaacggtccggcgtgcgtaatttgtcagaaagcgtaaatgcaggggttgaagcgctgaataatcgtacaaatcgggagaaaaaattgagcagggaatttaaaaaggggtgaaacagataagctgcaccgttaattttgcgcagcatcagggcaatattatcctgccaggatcgcaccgacaggatttatatttacagaagaatccgagttaaagttttttatcggcctgtaaatgaatgttgaggagactttcaatcggcggagggagctgtaaataatagccctgctcgctcaatccctgcttaactttattgatatccgcattagccagcctgtcccgccccgccagcttaagcaccatcgccagctgcggcttgccaaagcctttcagcaattcttccggaacgcgcgagaaatcgtcctttttttcaacgtagagataagtctggtcacgtaacgggcttctgtagatcacacaaaacatattttttactcgaattaaccggcgttgaggcttgtctgaatatagctgtaactataacatgcttgcagaacttcgaatattcaccgttagcgcttcaacgatgattttatcatcgccaggctttcggtagtgaaaacaggactgagtcgggacagatgtcgcaaacgccaatcgaattcaaaggtagcagtttcaccctgtctgtcgtccatttgcatcaccatgaccctgcggtgattcgcaaggcactccaggtcaagattgaccaggctccagatttcctgaaaaacgcgccggtggtacttaacgtctcgacattaagtgccgatgttaactggaaactgttgcaacaggcggttctcgccaccggtttacgcattgtcggcgtaagcggctgcaaagatgaagcgctgaaacgtatgatcgcccgtgccggcctgcccgtgctggcagaaggtaaagaggccagaccgcaagccgccgcgccgcagccgatacctgaacctctgccggctgtaaccgaaacggtagcaacgaaaacccgcatcgtgaacaccccggtgcgctcgggccagcagatttatgcgcgtgacgccgatttgatcatcaccagcagcgtcagcgccggcgccgaaactggtcgccgatggcaatattcacatttacggcatgatgcgcggtcgcgccctggcgggtgccagcggtgaccgcaactgccagattttttgtaccaacctggctgccgagctggtctcgattgccggagagtactggatcatggatcagatcccgcaagaattttttggtaaagctgcgcgcctgtgcctgcaggatggcgcgctgactatccagacacttaattaggccccttttcttttgttaaggaaatcaacatttatggcacgcattattgtagttacatccggtaaagggggcgttggtaagaccacgtcaagcgcggccatcgccaccggtttagcgcagaaaggcaaaaagacagttgtgatcgactttgatatcggtctgcgtaacctggatttgatcatgggctgtgagcgccgtgtggtctacgactttgttaatgtaatccagggcgatgccacactgaaccaggcgctgattcgcgacaaacgcacggagcagctctacattctgcctgcgtcgcagacccgtgataaagatgcgctgacccgtgagggtgttgaaaaagttctgaacgatttggctaagatggagttcgatttcatcgtctgtgactcaccggcagggattgaaacgggcgcactgatggcgctctactttgccgatgaagccattattaccaccaacccggaagtctcttctgtccgcgactccgaccgcatcctcggcatcatctcatccaaatcccgtcgcgctgaaaacagtcaggacccggtgaaggagcatctgctgctgacccgctataaccctggccgggtgaaccgtggcgatatgctgagcatggaagatgtgctggagatcctgcgcattcctctggtcggcgtgatccctgaagatcaatcggtgttacgtgcctctaaccagggcgaaaccggtgattcttgacggcgaatctgatgctggcaaagcctatgccgataccgttgaacggttgctcggtgaagtacgccccttccgctttatcgaagaagagaagaagggtttcctgaaacgcctgttcgggggataaaccatggcattacttgatttctttttatcccggaagaagaacactgccaatatagccaaggaaaggctgcagattatcgtggcagaacggagaaggggcgacagtgagccccactatcttccgcaacttaagcgcgacattctggaagtgatttgcagatatgtgaagatcgatccagaaatggtaacggttcagctcgaccagaaaggtgatgatatctcgattctggagctgaacgtgacgctgccggaaacggatgaagtgactaaatgacgctgaccgtttgctgaatttcccctgcgctctggcaggggaaatttaaccggttaacaacccgccagaatctcctcaatgccgggtttcagcagttcgccccgccatccggtgagtaactccggctgacgtccctgtggcttcaggccccagtgctgacttaatacctgattaatctgacgtcgtgacgccagcagctcctgactgaatccactctgctcactcacctgctgcaccagcgctttcatcgctttaaacactggcttgtagtgcggatggtcaatcagattgcccagcggagccggcagtttcgctctcatccagcgcctcagcttctgccaccagcgccaccagcgctttgccgtggaaacgaatttcgtggcctgacagccccagatgatccagctcgcccagcgagccgggcataaagcgcgccactttccacaggtgctcttcgcgcaccacaaagttaacggccatatctttttcacgcgccagcttcagacgccaggacgccagccgctgtaacgccgccagctgacgcgggcgcaactgccaggcattggtaatatcccgccaggcttcatccggcgacaggctatccagacgacgctgacacaggttatcgcactcactgagtgccgccgacatattgccggcctcttccgtattgatcatcagctgacgcgcaattggcaacagatagtgaacgtccgccgccgcatactcgcactgacgctgggtcagagggcgcgccagccagtccgtgcgtgattcacttttatcgagttcgacctgagtgaaatgtgccaccattgaggcaaaaccccaggagagcggctggccagaaaaggcagccagaatctgggtatcgatcatgggcgtcggcagcacgccgaaacggtgcaggaagacttccagatcttcacccccggcatgcaggaatttggtgacgcgggtgtcggtcagcaaggcaataaagggtgaccagtcacggatattcagcgggtcaatcagcaccagttgctgatcgtcgaacagctggatcaggccaagctgagggtagtaagtgcgggtgcggacaaattcggtatccagggccaccgccgcgtgctggcgcgctttctgacacacgtctgccagttgatcatcctggtcgataagggaatagttcacgtctgatttccaccgcagccaacaacgcgcggcgctccatgttaaaaacaataaaaacgccggacatgccggcgttcaacctcaatttctgcccggattcagctcgcgccgggtttcgcctcgtcgcgcagctcacgccgcaggatcttgccgacgttggttttaggcaactcatcacgaaactcaatgattttcggcaccttgtaaccggtcagctgacggcgacagtgatcgagcacctcttctttggtgagcgatgcatcttttttcacgatgcagacttttaccgcttcgccagaaagatcgctgggcacaccgatagccgcggcttcacgcactttaggatgctgcatcagcacgtcttcgatttcattcggatagacattaaaacctgataccagaatcatatcttttttgcggtcaacgatgcgaataaagccttcctggtcaacggtaacaatatcaccgctgtggagccagccatttttcagcacttccgctgtcgcttccggatgctgccagtagcccagcatcacctgcgggccgctgatgcaaagttcgcccggttcacccggaggaacttcattgccgtcgtcatccagaatcagcacatcggtcgagggcaccggcagaccgatactgccggtatgacagctgatgtcatagggattgaccgacaccagcggagaacactctgtcaggccatagccttccagcagatagtgtccggtcagtttttcccagcgatcggccaccactttctgcaccgccattccgccaccggcggaaagacgcagcgttgaaaaatcgagtttattaaactgctcatcgttgagtagcgcgttaaacagcgtattcacgccagtaatggcggtaaacggaaatttccccagctctttaacaaagccgggaatatcgcgcggattggtgatcaacagattctgaccgcccagctccaggaaacagcaggccattcaccgttaaggcgaagatgtgataaagcggcagcgcggtgacgacacactctttaccgtcacgcagcaccttgccgtaggtcgcgcgggtctgctcaagattcgcctgcatgttgcgatgggtcagcatcgcccctttggccacgccagtggtgccaccggtgtattgcaggaaggcgagatcgtcattggaaaccgtcgggcgttgataattgagcgtttcgccgacttccagtacgtggcgaaatgagattgcccccggcagatggtatttgggcaccagcttcttcacatacttaacgacaaagttaaccagcgtcgcttttatcggcgccagctgatcgcccatccgggtcaggatgacgtgccgcacagcggttttcgccaccactttttccagcgtgtgcgcaaaattcgagacaataacaatcgcactggccccactgtcattgagctgatgctgcagttcgcgcggcgtatagagcggattcacattgaccacgaccatacctgcacgcagcacaccaaacagggccaccggatactgcagtaaattcggcatcatcagtgccacccggtcccccgctttcaggcccagctgttgctgaagataggcggcaaaagcgcggctcttctcttccagctgacgataactcatcttctgacccatgttcaggaacgcgggttgatcggcgtagcgttttgcggcctgctcaaacagatccaccagcgaggtgtaacgatctgcacttatttcggcaggcacatctgccgggtagcgtttcagccaaaccttattcaaggatccaccccgataattatgttgtatttccatcgctgcctcagccaatctggtttgttaacaatattttaactgattgtaccagtttgcctgttttggcatgttgaggttgcgaagtgcatcactaaatttcgtgctgataaaacaggcaaataaaaagcccggcagcgagcaccgcgaccgggctgatacttaaatgttttttgcacttactcggtcagaatggtctgcacctctgccggcccactgttcatcattccccagtagggattcggaccccagtatccgccgcgatggcgggtcggaccataccagatccagggatccatcggctggggtggtgctgtcacctgctgggtaagtcgccagcgctgataaccgcgcacatcgatgaccgcaaatttgtaatctgcttcgccaattttgccctgctccgtccccttcagggtacccagcaccgtcacatactgatttctgacatccaccggatcaacaaaacctcggatatcggcataaatccgaccgaccgaggccgcacccagacgtggtctggcgctatcatccagcggctgtgcagcaatctcaagccgggttttgccgtttcaggttagtgacattcactaccttgccgccaaagcgcgattcctgcccgacaaagagcgaaggattgctcatgacccgcaacagatcctgctgcggctgaggtgagctgccctgcagcgtgtcaggaattgagacacaaccggttaacgccagtacacaggtcagcagcagacctgaaagccctttaccacacattgacgacatagacgttctcccgttaggtaaagagttagactggacgcataacaataagttgcgtgcattttaccggccaggtaattttttccaggcgacttcattacgcagataagtgggctccgctgtttccggcagcagcgtcttcccctgcgccagcgcaagggtcgccagcggcagcatatcttctgcagcgggcagcgtaacgtcactggctttcagggtaagttcgtgtccctgctgcagggcaggataagcctgccagccggtgcctgcggtcatccattcgccagaaagcgcctgcatccaggccagtgccgcttcgggcgacagcacgctttcgctggcctcaccctgccaggcaccctgttcatcacgctgatattcggcccagtagacctcgcccatccgcgcatcaatagcggttaatacccgggtagcaccgtgcagacgccatgcgccttccgccagcgttgccagcgtggaaaccgcgatcattggcagagaagcgcccagtgccagtccctgcgcaataccaatgccaatccgcacgccggtaaaactgccagggccgcgaccaaaggcgagcgcgtccaggtcggtcagttccagctgctgtgccagcagtagctcttcgatcagcggtaaaatacgctgggtgtgatcgcgcggggcaatttcgaatcgggcatcaatctgttgctgattcagcaaggcggctgaacaggcttctgtcgccgtatccagcgctaaaattcgggctgacatgactacctcagaagaaagaaaacggcgcgcatcttagcataaaattacgcgtctggttcgggttgctggcggataaaggcgatggcgcgggcaatgtcccgggtgcgcggcgtcggtggcaggctattgagaaacagcgcgccataaggacgagaaaccagacgctgatcgcaaatgaccagtacgccacgatcgtcggtatcgcggattaaacgtcccacgccctgcttcagggtgatcaccgcatccggcagttgcacatccgtaaagggatcgccgccacgaatccggcaatcttccattctggctttcaacagcggatcttccggtgaggtgaacggcagtttatcgatgatcaccagcgacagcgcatcaccccgcacatccacgccttcccagaagctgctggtcgccaccagcagggcattgcccttatcgatgaactgtttcagcaactgacccttgctggtttcaccctgcaccagcacgggcagcgtcattgaggcgcgaaattctgcggccagctcacgcatcatcaggtgcgatgtgcacagaaagaaacagcggcctttattagcatcaatcagcggcttcatcattgcggccagctggcgtgcaccacccggacggttaggctcaggcagattgcgcggaacgcagagcagcgcctgcttcgcaaaatcgaacgggctgttcagaatcaggctttttgctgcattcacacccagccgttcggcgaagtgtgccattttctcatccaccgccagggtggctgaggtgaagatccatgcagccttacgattatccattacttcacggaagcgtttctgccaccgagagcggcgtcagcgccaggataaagtgacgtgaggtacattcataccagtagctgtagcccggctcgttaatcgcccgcagccgttttaaccggccacggtagagcgcggctcgctcgaaggcggcatccagcagggctgaacggcccagtgagagtttgataacgtcgtaacagagctcaagcgcatcatccagcagcgtaaacattcgcaggatgttgttatcgctcagcagttcacgcaggttaccgcgatagccgggatcgcctaatgacaggcgaaaatcctgcgcgcactgcgccaggcggtcagcggatttctgcagctgctgagcatcacgcacctcggtgcggtaggcggtaataatatctttggcgagatcgagtaactggcggctggagagctgctgaccaaaatactgactggcgatatcgggcagctgatgggcttcatcgaagatcatcacatcagcttcgggaataagttcgccaaagccgccctctttcaccaccagatcggcaagaaagagatggtggttcacgaccaccacatcggcgtccatcgcgcgtttacgcgctttgaccacaaagcactctttatagcgcgggcagtcagtgccgaggcagttatcgttggtgctggtgaccagcggccagaccgggctgtcttcggtcacgcccgcacagctgctgatgtcgccatcttccgtctgcgatgaccagctgcgcagcgtcaccagatcggtcagcccctgcgcggtgagatcgccgcccgccatcgattgctgttccatgcgttccaggcaaaggtagttggagcgtcctttcagcaaggccgttttacctttaaaatccagcgccttgatcatcgtaggcagatcgcggccatagagctgatcctgcagcgccttggatccggtggagacaattacttttttaccggcccgcagagcgggagccaggtaggcataggtttttccggtgccggtaccggcctcgaccaccagttcaccctgctgttttacggcttcagataccgcctgcgccatctcacgctgtgcttcacgcggcttaaagcctgcgatcgccagcgccagcgcgccatccactgcaaaatcgtctgccacataccctcactaagaacggcaaaaacactgtaattatgtcagtattggatcaacaaagcaaaattgataattatcaatagcttatctatttttagccgttgggagtgtggcaaccagtggctcaggatcgcgtctgaaagatgggaaaaaggcggcaggtggccgcctgaagagaagcgctcgcagcaccgggatgcctgatggaaaagttgcaccgcgaaaggcagcagaaatcgctgtgactactctacaatcatgcgcccattgagatgctgcaacggacgattattggtggttttcagcgcctgtttaaaggcgtcgagctgcgcctgagagagcgaaaccggctgtttcagcaccagccagcgaatcccttcgctgcagggtggcgtcgtcagggagccgctgaaacgataatagtgcagatcttccgggaagagatcgcgtaaatttacctggcgattaatggttacctgctggttttcctgtttcggcatagcgtcgatcaacggtgccagcgccggattctcttcaccgaccttaaacatcaccgcgaccacggccagatcgccatcctctttgctgtgtacaaagtgggcttcaaggggaaaggtgtgcccattgatctggttctcactcggcgtatggaagtgatactgacgcagcgtgaacttttcccgatccagtacaaaatcatcttcttcatcaacggtcacctgaatcgtgtggccattgttgatcaccttctcagccgacgtatggtaggccagatcgagtgcctgtaaatgcccctcaatcggatctttaatattgattggcgactgggacttaccttcgtgacagatgtggaagtcgctggtcagtttcgctccagtgttccgggccagctttgccttcgtacgtccagtgcggttccgccgcaccggctacgttgagggtagaaagcgccacaaccagacttaacatttttggtaatttcatttttatccctgctttataagcttatttgcggcagggatactattccgctgactactgaatcagcaaggtgacaaaatgcgttaaatcaaaatcagaacgaataaagagtttataattacaatcaatgttaatttaattaacaaacatcacgatgtgacgtttttaagcatttcaggaaagggttgatatcaatctctctgaataaaagagtttcattttcctgtatttatcattttgattgtcgaaacgagccgggagggaaattttgcactaaattcaggcgacgtaagaaaccgcaaaactgcacgcaggcggttttgcggtgcaacgcgataacgcgtcataaaagattatgcaggtgacgctagacatccttttctaatggttcctcttcttcatcttcttcctcatcttcaggataaatctcagcgtcatcgggcagcggctcatcgtaatcagggcgtttcagacataacttcctccggtgtcagatagcaattttgctatgccctttgagtgtagcttactcctgccatctgttttgcaaggctcgcaaaagatatcagaaatgcgggcgctgccgcagactctgcttcgccactgcgtgaaacagccttgcgtcacagccggtgctgatagcgtaccggttaatcggatgcccattcgcctcccccagccgcgttatcattgacgtcagtcggatagcgggtttaataattcgccgctgaaaaaactgtgttttcaaaaaaacctcttactcgtttaatgaataaaaggccggaacttaactgcctataatatagggatacgaaaagttaatgatgcgattcaaagcacaattatgcacaaagaaaggtaacattaaataaaaacccaacaggagtagcattaaacatcgttctgttgttataagaaaaaatccctgatataaaagagacagaatttaaacgtaacctgtgagcattagcggattgaatatttcctctgatgcagccacgctgacttaacagatggtagagaggtaattaaaaattcaggcgttctgttatctctcacaggcaataaaaaattgtcgccggatgagtcacatcacaatagaaaccatgccccacggcatccgtcctctttaaaaggccgtttaagactatctcgctaaagatatccgttaatgtaaatgaagtggggttttatattataagttaaatgggatgtaatctggctgttgctaccctgttgcatccatctgtcagtcaggacacaattacctcaacaaggagaaatatcattgttcccaaaattaccccggtatagcttagtgattctgacgctgagcggttgcgttaccaacgatgaggtcaaacttaacccagttggtcaacatagtgaacctgtcatgccgcatataaaccaggggatcagccctgcacagcggcgcgcgattatgtccggcgaaacaaccagactggtctgacgtttatcctcagcgaatcaataaaaactcgtcagctgtcaggaaatgatctgcacgtcgtagcagttaacgtcgttactccaccactcacatagcgtaaaaaacactgtggaaaataatcaacacgtcgatgatgtctccctatgggattggattgtcacattaattttaaccggcatacccgtattaaatcttttcatgctgctttactggtccttaaaccgaaggactaaacgttcaaagaaaaactacgccagagcgagtttattattgatattcatcgtacttatcttctatatcatcaccctggaagttacaacgggctattttctttttaaacattactgatccttaaactgacagcgtcacaccctcaaatggagtttttatggtgcgttatttcacttttctattattgggcgtcacttccgcttgctgcatagcaaaaacgtcagtggtgataaataacaccctgaaagcgcaagagataaaatcggcaaaaatcgtttacattggagaggttaatggcactaaagtggcagaattgatggcaggcatcgatgatattaatgcaagttaccccgctgtaaaagaaatatcgctttatataaacagctttggcggcgacatggaagctggctatatgggcggccaggccgtcagggggtcaaggattcctataaaaaccatcaatgccgcaatgacgggttcggcggctaccctgatttattgctcaggggcgcaaagggaaacattacccagcgcgacatttttaatccatcctgcagcgagtcaaaacattcagagcaactatctgaaaaaaaatgaagtcattttactcagcagagatatcgataatgtcagtaaaatattcagggacacctatgcatcctgtttcaaagatgacgggaaagagatagataaagccctattcagtgaagacaaccgtatttacctgcgttttccagaatctgtaaaacagggtattgcacaaaaacgtattgaaggaatcgtacccgctgatgtcgcttattacattttcacttcagaggccagcggctagcaaaaataacgttatttatgcctgctggacgaatactttttatcagatatgcgccgcctggacagatgggcgtgctggcggggagacatatcgagccgttagcgggtaatccagagaagaacataacgcagacgacgttcagatgggacgccgcaggaactcaccatcaatatcacggtggattttcgcagtaagcgctacccttgcatggtgagttttttgagcagcaatagcagggttgattcaacactggccgataaaaagcggcaaataaagcaggccgctcagccagatacggcttattctggtacagggcgtttatctgtttctggctggtgacctgatatcacgattattggcgacgctgctcttgcgacctgcttataagcggacgtacaacgcgcccgccagcataaagatgaacagaatagcgaaggtaataaagccctgcttactgccacgggacaatcccacaaatgccgaaaccacaataaacagcagcgtcagtgcgccgaccatcacccaaaaaagatactgcgtattcgccatgcctgaatcctcatccgtagcgcgatttatctgctgttttataacatttttatgccgcgcgtgccctcacttctcccgctctttcgacgctttatgctgctttagtgcagcagggctgcaacagtgacaacgtccgcggctcatgatcatgatcatgatcatgatgcagacagtgtgatgcagttagcaaatgcagaggaacgcagcgagtaaacaagcgcgcggattataatgattaaatcagcttaccgttgggatgtggcacccgtaggctgacgtgctgagactggtttaacattgccgtttcaggcggtgtaaaacagatggccttaacccgactgcctgactcaggcggaggaatgtatgaactgtttccgcatcggctctctggctggcgtgctgctgctctgcggctgccaggcacccacgcctgatcaggctcgtctgcagcagcctgtttttcagggtcaaagcacccgcaccgtccctcagctcagcgactgtatttatcgcggctggtccaccaccagcgtcattgccagagataacaccacccacacccagcccaacggcagcgagatcagcgtttttacctgggaagattcgatttttgcggatgtgtcgccccgccgaaaaggggctgaggtgaaatatttcacgactttccggatggcgcctcaggtgatggcggacagacaggcgattgttgagcgctgcctgtaaggcgtaaggggtgacagcgatgtcgggagtgtgccaggctaatgcgcaattaaccagggagaaaccgatgagtattacccgcattgacccggaacaccgtatgtccgaagccgtgatccacaacgacacgatctattacaccagcgtgcctgagaatctggatgccgacgcagaagcgcagacagccaatgcgctggcagtgattgatgcgattctgacacggctcggtagcgataaaagcaaaatccttgatgcgacgctgtttctggtggataaggccgatttccccgcgatgaaccgcgcatgggacgcatgggtctctccaggtaatgcgccggtgcgctgcacggtacaggccgggctgttgaatccgaagtacaaaatcgaaattaaaattatcgctgcacgttaaaacgccgggcgttattcctcttcgttttcttcatcttcgtcttcgaatagcgcccgaatccgttcgcccttgaaattttgtcggatctcctgcgccacctgggtgatcgcttcaccgctcgacaaacctcccgccatcaattcctgaatacgttcgacggcctgctgctgctgctcatgagagagagccggtattcctataaacatgtttcactcctgcgttggggcagacagtatcccacgcggaactaacaggtgccagtcaggaaaaaatatggcagtctgaccgcctctttgctctctgatttctctgcccgatgattgttgaaaccctcagtcttgattataccccggatgcgctgactcagcgttttgccccgattgcccatctgccctgggcgatgctgctttcctccgcgcaggcgaaccacagcgacaaccgctttgatattctgaccgccgatccccgcgccaccctggtgacccgcggtgcgatgactaccctcagcgacccgaccggcacgaccgaatcaaccgccgatcctctgctgctggtacagcagcagtgtgatgcgctgggcgtgacgccggctgccagcgatgccctgccgtttcagggcggtgcgctgggcctgtttggttatgatctgggccgccggtttgagtccctgcctcagcaggccgcagccgatctcaccacgcctgacatggcggtgggtatctatgactgggcattgattgccgatcatcatcagcagaccctgacgctggtggcgttaaagaacgcggaagaacgcgccgcctggctggcgcaatggccggcgcgcgaggccgtgcccttttcactgaccagccgctggcgctccaacctgagctatgcagattacgctgcgcgttttgcggcggttcaggcctatattcaggcgggtgacttttatcaggttaatctggcgcagcgctttcaggccggttaccagggtgatgagtggcaggcgttcagtatactcaatgcggctaaccgcgcgccgttcagcgcttttctgcgtctgccggagagcgcaatcctgagcctgtcgccggagcgctttctgtcactgaataataaacagatcgaaacccgaccgatcaaaggtacccggccacgctgtgacgatccgattgctgatgcgcaacaggctgagtcgctgcgccatgcggaaaaagatcgggccgaaaacctgatgattgtcgatttactgcgtaacgatattggccgcgtggcgctacccggctcggtcacggtgccggaactgtttgtggttgaacccttccccgccgtgcaccacctggtcagcacggtgcgggcgcagctgcctgacaccctgcaggccaccgatctgctgcgcgcctgttttccgggcggctcgattaccggtgcgcccaagattcgggcgatggagattattgatgaactggagccgcagcggcgcaatgcctggtgcggcagcatcggttatctcagcctgtgtggccggatggataccagcatcaccattcgcacgctgatcgctgaaggtcagcagctctactgtgcggcgggcggcgggcttgttgcagacagcgatcccgaagcggagtatcaggaaacactcgataaagtcagccggatcttaccggcactggaacaaaccggaggttcagttggccctgacgcttgatgattttcgcagccgttttctgttgcagcagccagcccgcagcacacaattgctatccgggcgccatgcggcggtgctggtgccgattgtggcacggcctgaacccggtctgttgctgacgcagcgctcacacgccctgcgcaaacatgccggacaggtcgcttttcccggcgggatgcaggatgacactgacgcatcgctcatcgccacagcactgcgtgaagcacaggaagaggttggcattgagccgcatcaggtcgaggtattaggcgcactgcccgccgtgaccagcagcaccggctttcaggtgacgccggtactggggatcattccggccgatctgcgattaacgattaatccggatgaggtgagcagcgcctttgagatgccgctggccgaggctttgcagctcagccgctacagcgcgctggaggtgcatcgggctggcgttcgccacccggtctggctgtcgcgctatcaggattatctggtgtggggcatgaccgcgggtattatccgatcactgagtgctcagatcgcattctgaaacctttctcgtttttctctctccggcccgtcaggttactggcgcgctgcactataattttttctataagttttgataagtttatttcatgcgaaaagctgctctttcctggtgcatgaccattactatgggcgccataaactgccccggcagactgagaataattgtgaggagtgtcacctgtgattagtgtttttgacatgttcaaagtgggcatcggcccctcaagttcgcatactgtcggcccgatgaaagcaggtaaacagtttgtggatttgctgtgcgaacaggaaaagctgcaggaggtcacccggatcgccgtggatgtttacggttctctctctctgaccggcaaaggccatcacactgatatcgccattattatgggtctggcgggtgaatcgccggatacggtggatatcgatgcgatccccgcctttattaaagatgttgagcagcgtgagcgactgctgctggcgaaaggcgcacacgaagtggatttcccgcgcgaaggcggcatggtatttcgcagtgagaacctttcgctgcatgaaaatggcctgcgcctgctcgcgtttgcgggtgacctgctgatcctgtcaaaaacctattactccgttggcggcggtttcattgttgatgaagagcatttcggacagtcggcactggatgaagtctctgtgccctggccgttccactccgccaaagatctgctggctcactgtcgtgaaaccggcctgtcactctcaggtctggtgatgaaaaatgagctggcgctgcacagccgcgatgagatccatgcctatttcactaacatctggcagacgatgcaggcctgtatcgatcgcggtctgaataccgaaggcgtgttgccagggccactgcgcgtgccgcgtcgcgccgcctccctgcgtcgtctgctgacctcctctgacaagcactccagcgatccgatgattgtaatcgactggatcaatatgtatgcgctggccgttaacgaagagaaacgccgcgggaggccgcgtggtgactgcgccaactaacggtgcctgcggtatcgtgcctgcggtgctggcttactacgatcacttcattgagccagtgacacccgacattttcctgcgctatttcctcgcctctggcgccatcggcgtgctgtacaaaatgaacgcctctatttcaggcgcggaagtgggctgtcagggtgaagtgggtgtcgcctgttctatggcggcggccggtctggctgaactgctgggcggcagtccggagcaggtctgcgtggcggctgaaatcggcatggaacataaccttggtctgacctgtgacccggtagccggtcaggttcaggtgccctgcattgagcgcaatgctatcgcctcggttaaagcgattaacgcggcgcgcatggcacttagacgcaccagcgaaccccgcgtctcgctggataaggttatcgagacaatgtatgaaaccggcaaagatatgaacgccaaataccgtgaaacttcgcgtggcggtctggcgattaaagttcagtgcgattaagcgaaacgattaactgactaaaaaacgtgcaaacgtaataaaatccgcatcctgcgctatctcagcgcaggtttaaccggtagagtgatttccgcgcagccgtccggcttacgcaactttccagacccgcttttctgcattccggcctcaatgttgatctgaccgtgccgatactcaccccgttgtgttttgctttttactggctttttgggaaggtgaatacagatgtttatggcccagcaatctgttggacaattcagacgcaagcgtgtgctgatagcgctgtcgatcgccaccgtggtgctgatattaaccctggcctttcgctatatcgaagagaagtcacgtatcgagcagcaggcgatggatttcgccgataaagcgattatgcggtttgaccggatgttttcaccgctggaggtttcagccaataatacgctgggtctggtcggcgttccctgtcaggatgttcgctttccactcatcgaaaaaatctcttccctgcagacggtccgggcgatcctgctggtggataacgacgtgctctactgctccagtatctacgggccgcgcaccattccctttagtcagacctaccctgatttagcctttaacagtcagcgtatgacgctggcaaccgatgaatatctgctgaaaggctcgcccattttactgctgtggacgccaaagagcctggataaccgctccgggattttgcaggtgatcaacatcgaaatgatgagcaattatctgctggagccgcagttgccctgggtggagcgcgctgtctttaacgtcaatggagagagcctggagtatggcaatccactgatcgagcccacggtgccgtcagaagacgaagtgagctatgagcagggctcgctgcgctatccgtttacgcttactctctatggcccctctccgacccgcctggcgctggcgacgcttccctcacagctcccgctggcgctgctgctgagtctgcttatgggttacatcgtctggctggcgaccgcaaatcgtatgagcctgagctggcaaatcagttatggcattacggcccgtgagtttatggtttattgccagccgctgatcaacaccaaaagtggtgagtgcgacggtattgagttactgctgcgctggcataatccccgtcagggctggattgccccggatgtctttattcccctggccgagcgacagaacctgatcaaaccgctgacgcgctttgtactgaatgaggtggtaagtcagttaccgcagctgcccgacgatcccgcgttccatatcgccattaacgttgccgccagccacttccgcgaccacgccattctggaagatctgcacaacctgtggtggcctgccaatccggtgccgaaactggtggtggagctcaccgagcgcgatgccctgccggtcgtggatcagtcggtgattgcgcaactgcacgacatcggtgtccggctggcgattgatgattttggcaccggtcacagctcgctctcctacctgaaagatctgcagccagatgtgctgaaaatcgacaagattttcaccgcagccatcggcactgacgcgattaatgccacggtgacggatatggtgatttcgctggcccagcgcctgaatatcagtctggtggccgaaggcgtggaaacagctgagcaggcggcctatctgcgcgaaacgcggcgtggatcatctgcagggctactatttttcccgcccgatgccgctgcaggacttcccggcgtggctggcgcagcatcaggctgatgcccgcaggtgacaatcgcctgagccccgtttcgccctgcctgatgaccttacgccacagacaaaaaaacagccgcggcaatgagccagcggctgtcggagaattcagcgcggccggtaaacccggcagcgccgctgcatcaacgagaacgattagccctcttcatcctcatcatgcggtttatctttagtgacacgcaccagatcgatacggtagtcggtcgcttcgataatctggaagtgcagcggagtaatatcaatcacatcgccaggaagcggtaactgccctttctgctcaatcagcaggcccgccagcgaggcgtggtcttctgtcggatcgaccagttcatggaagtcgagcaactgctgcagcgagtgcagatcggtcccccctttcactaaccagccatcaccatccgcaataatatcgggcgtttcatcttcatccgggaattcacccgcaatcgcttccagcacgtccagcggcgtaatcagaccctgaaccacaccaaactcattggtgacaatcacgaagctgcctttggcacgacgcagcacgccaagcaggttgatcggatccagcgtctccggcaccacgatagtcggtgtattggccgcaaaggtcgccacatccacaccgtgctccagcgccaccagcagctctttggctcgcactacgccgacaatttcatccagttcaccccgacagaccgggaacaggctgtgtggcgtatcaagcagctgaccgcgaatctcatctaccggacgattcgcatcgacccaggagatttcaccgcgcggcgtcatgatgctgcgaatcgagcgggaagccagcgtcagcacgccattaatcatatagcgctcttcatctttaaacgcttcctgcggcatcgcttccgccagcgcagcctcttcgctgctgctggtgttgccattgctggcggtctgggcacggttgcggccccccatcaggcgtaaaatcgcttcggcggtgcgttcacgcatcgggcgatttgactgatggcggataaagttacgacgtgcaacctggttgaacagctcaatcagaatcgagaagccaatcgccgcatagaggtagcctttaggaatatggaaaccaaagccttctgccaccagcgacagaccgatcatcagcaggaagctcagacagagcaccaccacagtcggatgcgcgttaacaaagttggttaacggcttagatgccagcagcatcacacccatcgcaatcaccacggcggtcatcatcaccggcagatggttcaccatacccacggcggtaatcacagcatccagcgagaagacggcgtccagtaccacaatctgcgtcacgacagcccagaaactggcatatccccgattaccggatccgtcgagctgccggtttctccagccgctcatgcagctccatggtcgccttaaacaacaggaacagaccacccgccagcagaattaaatcacgaccggcaaagctgaaaccgcctacgctaaagagaggcgtcgtcagcgtcaccatccaggagatcagcgacagcagacccagacgcatgaccagcgccagtgacaggccaatcaggcgtgctttatcacgctgcttcggcggcagtttgtcggccagaatggcaataaacaccaggttatcaatgccgagcacgatttccagcaccacgagcgtcagtaaacccgcccagattgaggggtcgaataaaaattccattatttatgactccagaacagggaacagatcgcggtgccgcttatcagcgcagcaatgcgtgacatgcaggtagtcgggaaagcggtgaaaacgccgtgaggcgaagggtgacgcgccagcaggcgcaaagaacagattaagcgacgtcggtgacgatccataaaggtgggctgaagcccgttactcctgagtaataaacagaacgttaatgtatcaggtcggcgaattgcgtcaaaaaattttcttatttttacaatctgcctgacggatgatcaggcgcataaaaagggttactggtcacttcacaggatgaatagctgacagacatcacataatttattttttcgatcactaaaataaatcgcgacttaatcgccttgacgtagttaacccatgttttttcgacgctataccgataattcgaatcatccggttaaacagatcatcaaagcacttcaatacagttcattgactcagatgagcatctctagcgaacggaggtagcacgtgaccattgcgatagtaattggtacacacggctgggcagcggaacaactgctgaaaacagcagaaatgctgttgggcgagcaggacaatgtcggctggatagattttgtccccggtgaaaatgcagaaacgctgattgaaaaatatcaggcacgactggcagaacttgatacgacgcagggagtcctgtttttagttgatacctggggtggcagtccgtttaatgcggccagtcgcatcgtggtcgacaaaccgcagtatgaggtcatcgccggggtcaatatcccgatgctggtcgaaacgctgatggcgcgcgatgacaatcccggttttgacgagctagtcgccgtggcggtggagaccggccgtgaaggggtcaaggccctgaaagccaaagaagaagcgccggcgccagccgcggcaaaaccggccgctgcggcgcaaccggctaagccgatggcgcccggtgaccacatgaaaatcgggctgacacgcattgatgaccgtctgattcatgggcaggtggcgacgcgctggacaaaagagaccaacgttcagcgcattatcgtcgtcagcgatgaagtggccaacgatcatgtgcgcaaaaccctgctgacacaggtcgctccgcccggcgtcacggctcatgtggtggatgtcgataagatggtgcgggtgtggaacaacccgaagtatggtcaggatcgcgtgatgctgctgtttaccaatcccaccgatgtactgcgcgtggtggaacagggtgtcgatattaaaaccgtcaacatcggcggtatggcgttccgccaggggaaaactcaggtcaataatgcggtctcggtcgatgaaaaagatattgccgcattccgcaaactcaatgaacgcaatattgaactggaagtgcgtaaagtttccagtgaccagaaactgaaaatgatggatctgatcgcgaaagttaacgcgtaacagaagcacttatgcgcctgcgtttccgggctcctggttatcctgctgaggacaagaagtatgatggaaataacctcgctacaaattgttttgatttttattgtcgcctgtattgccggtatggggtcgattctggatgagttccagtttcaccgtcccctggtggcctgtaccctgattggtatggtactgggtgatatgaaaaccggcattattatcggcggtacgctggagatgattgcgctgggctggatgaacatcggtgccgccgttgcgcctgatgccgccctcgcctccattatctcgaccatcctggttatcgctggcggtcaaagtgtcggtgccggtattgcgctggcgattccgctggccgccgccggacaggtactgaccattatcgtgcgtacgctgaccgtcgccttccagcatgcggctgacaaagccgcagagaaaggtaatctcacggccatctcctggatccacgtctctgccctgctgttacaggcgatgcgtatcgccatcccggcgctgattgtggcgatttcggtcggcaccagtgcggttcacgccttactcagctctattccggacgtggtgaccaacggcctgaatatcgccggtggcatgattgtggtggtcggttatgcgatggtcatcaacatgatgcgcgcaggctacctgatgccgttcttttacctgggcttcgtcaccgccgccttcaccaactttaacctggtggcgctgggcgtcattggcgtggttatggcggtgctttacattcagctcagcccgaaatacaaccgtgtggcgggagcaccaacaggtgctgcgaccgcaaacgatcttgataacgaactcgattaaggaacaggtgagcacatggttgatattacgaaagtcgaaaagaaactgactcccggtgatgttcgcgccgtctttctgcgctctaacctgttccagggttcatggaactttgaacgcatgcaggcgctgggcttctgcttctcaatggtgccggtgatccgccgtctctatcctgagaacaatgatgatcgtaagcaggcgatcaagcgtcatctggagttctttaatacccatccttatgtggccgcgccggtttctgggcgtgactatggcgatggaagagcagcgtgctaacggcgccccgatcgacgatggcgcgattaacggccttaaagtcggcctgatgggaccgctggccggtgttggcgacccgatcttctggggtacggtgcgcccggtgtttgccgcgctgggagccggtatcgccatgagtggcagtctgctgggtccgctgctcttctttgtgctgtttaacctggcacgtctgctgacccgctactacggcgtggcctatggctatcgcaaagggatagatatcgtcagtgatatgggcggcggtttcctgcagaaactcacggagggggcgtcgattctcggcctgtttgtcatgggggcgctggtcaacaagtggacacacgtaaacatcccgctggtggtgtcacgtattaccgactcgaccggtaaaaccaccgtcaccaccgtacagtcgatcctcgatcagctgatgccgggcgtggtgccgctgctgctgacctttggctgtatgtggctgttacgccgtaaagtgaacgcgctgtggattatcgtcggcttctttgctatcggtatctttggttactggatcggcctgctcggtctgtaatttcacccggccgggagcctgcgctcccggcttttaagcgtggtgagctgagccacaaccggctgagctcaccctgtttgaggtagatgtgatgtcattaaccgacgcgctgattgcgtgttgtattgccgccctgatggggtttgccatttatcacgaggcgattctgccgcgtcgccacggtccgacccgcttacgggttgcgctgcgcaggcagcataagctggatagcctgattttcatcggcctgctgctgatcctgctgtggaacaacgtcagccatcacggcccgcagctcaccacctcactgctgatggtgctgagttttctggcgttctggctattctggctgcgaaagccaacgctgctgatgaaaagtgaggggttgttttacgccggtgtctggatcgattaccggcgaattcagggcatgaatctctctgaggatggcattctggtgattcagctggaacagcgtcggctgctgatcgcggtgcagcaactcgacgatctggagcgcatctataacaccctggtcgaggcgcgctagtcgcgctgccacacagtcagggtaaagtctgcgtcgcagctgaactgctcgctctgctgcagggtctgccagacctcttcacgcgcccgccaggcgaacggcgtcatctgaagcagggtcgtcgcggctgtgccggttaatgccatcgggtaacgcagcgcatgctgcgccacctggcggaatccgggatacgctttctgctccggcacatgcaactgcacttcgcggtaaatcagcgccttgaactgctgcagatgatgcgggcccggagtcacggtcagcaccaggccacccggcttcagcacgcgggccagttccgcttcattgcagggcgcgtagattcggacaaccgcatccagggcgtgatcggcaaagggtaagcgctggctggaggcgacgcagaagcgcaccgccggatagcgctttgctgccagccggatcgccattctggcgacatccagcccatagacctgcccggcctcgcctgctccgtcagccagtgcggcggtgtagtaaccttcgccacagccgatatccaggattttgcactccggctggctcagcgcgggcgcaagcaggctgacgacccgatcacgcagcggctggtagtagcctgcctcaagaaattcgcgtcttgcctgcatcatctctgcactgtcacccggttcacgtgaccgtttatgttgaacgggcagcagattgacatacccttctttcgcctggtcaaactgatggcgattctcgcagcaccagctgcgcgcagtaaaggcgagaggagagtgacaaagagggcaaatcagggacatagggtgctccggcatcagataacgcggcgcagtgtaaccttaacgtttacgcatcggaagcataaagaaagccccggctgagaagccagggctttgagatttcatgtcagggtgcaatgcaccgaggcggagttgaatcagatagccgtaacgttaacggctgccgggcctttctggccgtcctgaatttcgaactcaacgctctggccttcagccagggttttgaaaccattgccctgaatagcggagaagtgaacgaacacatctttgctaccgtcagcaggggtgataaaaccaaaacctttagactcgttgaaccacttaacctgacctttaatctttgccattttgcaaattcctttagatgtttatttagcccgaaggctgtcgtacagaaaaaccagagacattactgcatgaggcactaattaaggttcggcaaggaagcggtattcaacgtcaacgtctttactcgttcttctttacagacttctttacagaagatgccatgcataaacagaactgtacctcgtttaactcaggatttgttatcacatatcctaaaaacaatggcaagccatttttaagggcctcagccagcctgcgcacataattgccagaaggctcacattgcctgttctgtggcgcttacaaatgccgatgcaaattaagcacgctctccggccagacccctctccggcctctgttgtcgggtctaacccaatggataccataagaaattaatatttcacaaatatggcaataacagaatgaataagcgaagcgcgaaaagttgaaaatatcaataatccggcttcaatcctgtacagcgccttttatttcgtacagataacactttttttgcaccaaaagcaggagccagacagtcgtcctgctccaaataaaagcattgagcccgattttacttattaagaatttaacttttgatttgaaaaattgatatcagataataaaaatcgggcctttgtttatctctgaggttttaggataattcctgggtatccttattcagcccgcggctttcgcctattcgccacggtgcgaaaccgcccttttgctcgtttgcccgcagcagcgcatccgccagttctttgggtggtgcatcaagcgactcatcggccagttcgaacacgccccagtggatgggcagcgtcagcggcctgcctgctgcctgccacagcgccaccgcctgatcgggattcatatgttggcccgccatgaaccattcaggtgcataagcgccaatcggcaaagccgccaggctgaacgggccgagtcgggcagcaatctccggcaggctatcgctgtagccgctgtcgcccgagaaccagaagcgcacggaggcagaacgcacgacccagccgcaccagagcgaaacggtttcgatcgcgcggcgttcgcatactccagtgacgtgccggcaccgcatcaaaacagaggtcgccgacagtaaactgttgccaccagtcgagctgatggacctgtttcacgccccgcgccctgcaccatttttccaagcccagcggcacaatgaaggtcgcctgcggaaaacgccggacgatcgctttaaccgtcggccgatcaagatgatcgtaatggttatgtgaaataagcacgacatccagacgcggcagatcagcgatgctaagcggtgctggcgtttttcgctgcggcccggcaaaagagagtggcgaggcgcgtgacgagagtgcgggatcgatcaggatatattgctggttcagtcgcagcagcacggcggcatgtcccagccaccagatgcgatcgtcactgccgctgatataagcggtctgccaccactgttcggtgaaagccctgtagccctgctgcggtggcagcggcagtccctgtgctttgcgctccctgcgccagcgctgcagatcgcccggcttgcgccgttccggttcaggattgcagaatccctcgggcgtgtgatgcgctttgctgctgtcataccacggatttttccagaccatcccgcctctctgctgtgattatcgttccggaatcaaccggataaagtcgcgtttctcgcgatcgtcatcggtttttttactctctgcccctggctgcatctcaatcagacggcgcagcagctgattctgtttcttctgctcttccagcaaagactccagtaaacggatttgctcaccggcgcgcacactggcgcggttgacaaagaaccaggcgataaacgccacaatcaaaataatgaccagcaagccatagctgaccagtgggcccgaatttgcggctaactcattcataactgcctcgtaaaactcagtggaaacgccagaacatggcaaccgcccattctacctgtcgccatcgcaaaagataatggggttaacatcaatgcagaatttgccgtttcagttatctctgatcgatcccaccagaaaagcgaggcatgctgatatcatcataaccggcggcaccaggtggagcgctgagttatctttcacaaggagacataatgaaactgtttattcgtacggtaggcttgctggcggtgatctggctggcgatgctgtttaccggctatggcgtattaaccggcagtactaaaaatgcagccggccttggcctgcagtgcagctatctgaccgctcgcggtgtgatcagtgcgcagtatctgcatactgacagtggcgtggtgggcgtgactgattgtccgttgctgaagaaaagcggagaagtgatcgataattaacaaaacagcgggccacatggcccgctgttttcagaacggatagtcgtgatagcccatctctgaggagagcgtgcgcgccgcccgatgcaacatggccacgtaatcctggcgggcatcttctgaaaagcgaatggtgggaaaagagatactcagtcccgcaatcaccacgccaaaacggtcaaataccggcacggcaaggcagcgtaaaccctcttcctgctcttcgttatcttcaccatagccctgcgtttcttacctgatccagcgccgtaatcaacgcctccgcgcttaacagcgtattggccgtgctccgtttgaattcgacatcccgcaggatctcttcaacttcgctgcgatcgcgccaggcgagcagaactttcccaatcgcggtggtatgcagcggattacgacggccaatgcgcgaatacatacgcaggttgtagagggagtctattttgtggatgtagacaatactgtcctcttccagcgcccccagatgaatggtctctttggtcagacgcgaaagctcacgcatctgcacatccgcactgcggattaaatcgacgttctgcagcgctttagcgcccagttcaaacagcttcagtgtcagtgagtacttctcgctctcaccttcctgcgtgacataacccagcgacttcatggtctgcaggaaacggtaaacggtgctttttgacatcatcacgcgctgcgcgagctcagtaataccgtgatcgcgctcttcacccagcgcctgcagaatgccgaacactttaagtaccgaagagacggaatcgggctgtttatcattttcagcagaggacatcgcgcaccttgttaaacctgtttcaaaaaaaatggaacggactgtcagtatagagtgaggcatacgaaggcagcaatgctttaaccattacgtcatatttaaagacagttttttatccatccgatcgctgtatttcagcgttaatttcattagcatgatgatattcaccctctttagtaattaacttatgacactctcccctcctcaggatggattacccgcgcgtcagcgctatatggcaatcgtcaccatcgcgctgggtctgaccatggcggtgctggatggcgcgatagccaatgtcgccctgcccactatctcgcgcgaactgaatgccagcccggcgcagtcgatctggatagtgaacgcctatcagattgcgattatcgtctcgctgctgtcgctctcctttctgggcgacatgctgggttatcgccgcgtctatcaggcgggcctggcgctgtttattgccacttcgctgtttctgcgccttctccaccaccctgaccatgctgactttcgcccgcgtgctgcaggggttagggggtgcagcgctgatgagtgtgaataccgcgctgatacgcattatctatccgcagcgtcatctgggacgcggcatggcgatcaactcgctggtcgtggcggtttcaaccgcggcaggcccgacggttgccgcagcgattctttcggtggcaagctggaagtggctgtttctgattaacgtcccgctgggtgccattgcgctctggctggcgctgcgcacgctgcctgataatccgcagaaagcgacggcgcagaaatttgatgttcccagcgcgatcatgaacgccctgttctttggtctgatcatctctgcgctaagcgggtttgcacagggacagagtcatctgctggtgctgtcggaggtcattgctctgctggttgtgggctggttctttattcgtcgtcagttaaacatggcggtgccgctgctgccggttgatctgctgcgtatcccgattttcagcctgtcgatgggaacgtctgtctgttcgttctgtgcgcagatgctggcgatggtgtcgctgcccttctttctgcaaaacgtcctgcagcgtgatgaggtggcaaccgggttactgctgacgccctggccgctggcaaccatggtgtttgcgccgattgccggccggctgattgaacgggtgcatgccgggctgctgggcggcatcgggctggctatgttcgccctggggttgtttctgctcgcctggcttccggctaacccgggtgatggcgatataatctggcgcatgatgctctgcggtgccggttttgggttgtttcagtcacccaacaaccacactattgtcacttccgctccgcgtcatcgcagcggcggcgccagcggcatgctgggcaccgcgcgcctgctgggccagagtatgggtgccgcgctggtcgcgctgatgtttaatctgtttgatgaacgcgggacgcacgcttcgctgctgctggcgggcagctttgccgccgtggccgcgctggtcagtgtgtcacggatgacgcagacccgcgcctgatggcagaaacagaaaaggcgaccacctgacagagtgtgacccgattcgctgtaaggccgagccttcacagggaacccggtcagatcggaaagacttctgtcatccatgacggtcggcccgcaccatccatggcgcgggacgctttcctcctttgcccgggtttccctgcatgttgagctaagatattgctgtcagattcagtctgattatggtttctaaacagaaaaggcgacccagggtcgccttttttgctctgcttaacgctacttcagatactgaccgctacgcagtgcttcaatacgcttatctaacggcggatgcgacataaacagctcgctgaacgatttgcctttaccgttgatacagaacgccatcatgctgctcggctcctgcggttcgtagctggttttcaggcgctgtaacgccgcaatcatcttctcacgacctaccagcttcgctgaaccggcatcggcatggaactcacggtgacgcgagaaccacatggtgatgatgctggcgagaataccaaacaccagttccagcaccatcgacaccgcaaagtagaccagcgggttgccgttgctgctctcctcaccatcgcggttgccggacataaagcccgccgcgatctgcgccagaatacgtgaaacgaaaatcacaaaggtgttcaccacaccctgaatcagcgtcatggtgatcatgtcgccgttggcgatgtgtgacacttcgtgtgccagcaccgcttccgcttcatcacggctcatgttctgcagcagaccggttgagacagcaaccagtgaggcgttacgccgtgcgccagtcgcaaaggcgttaatgtcaggtgcgtgatagatcgccacctgcggcatcgcaatacccgcctgttgtgcctgacggccaattgtatccaccagccagcgctcggtttcgttgcgtggctgttcaatcacttcaccgccaaccgatcgcagtgccatccacttcgacatcagcagtgaaacaaacgcaccgccgaagccaaacaggcctgccatgatcatcaggccctgaacactgcttgactggatccctgtcaggctgagaatcagcccgaataccaacatcacagccaggttggtcatcaggaaaagagcaatacgcatcatttttgttaatcttcctcagtagttcacgcgcctatacgcggatccatatcctatgggcattgggctgcttttcaagcaaccttaacgtttaagtgcctaaaaagacataactttacattctgacacgcctgatgaggagcccagtcttcaggcaccttcaccagcgctaatcattgcttactggaaacttttctgagtacaaaaaaaagcaccgctgagcggtgctttttctggcaacagcggattatttagccgctggcgcctctggctgggatttctccagctgcgcaagatcgttagcgatcttcaccgtctcatcaagatagggatccggctctttataatctttcggcaactcatccaggtttttcagcggttttttgccttcggcctgatagcgcgcgttgatccgctccagacgagacgcatcatcttcgtggttctctttctcgcgctgagcgagattaagcgacacgatgttgcgcttatctttcagggcattgtaacgggcaatgtccttcatgatgtactggaaactcgcgatcctgagcgatgcggtcagcatgctgcttagtcagctgcactaccagcggtttcacatcaccggttttgacataggtcgctgctttgatgctgtcccacggcagtgcattatcctcaaatttctcaccggtttcagccgcttcaacgccggttggcatcagcagatccggcgtgacgcctttacgctgtgtactgccgccgtttatgcgatagaacttctgaatggtgtaagaaacggagcctaacgcaggccactccggacgcagcatctgatcgtagatgcggttcagagagcgatactgctgaacggtgcctttaccaaaggttggctcgccgacaatcaccgcacgaccgtaatcctgcatcgcggcagcgaagatctcagaggctgaggcgctgaaacgatcgaccagcaccaccagcggtcctttgtagtagacaacgccgtcgttatcgctgtcttcacgaacccgaccattgttgtcgcgtacctgaactaccggaccactcggaataaacagaccagaaagcgagactgcttcggtcagcgcgccgccgccgttggtacgcagatcgatcaccacactgtcgacgttctgtttctgcagtttctgcagctgtactttcacgtcgtcggtgaggccgacatagaaaccaggaatatcgagcacgcccactttctgcttgccgacatttttgatggtcaatttaaccgcgcgatcttccagacggattttctcacgcgtcagcgtcacagtacgggttttagtacccttaccggctggcagaacttccaggcgcactttgctgcccttaggtcctttaatttttgccacgacatcatccagacgccagccgatcacatcttccatcggcttgcctggctgacccacaccgacgatgcgatcgccaacggtaatggctttgctcttcgcggccgggccgcctgcgaccatcgagttgatcaccgtatagtcgtcatccatctgcagaaccgcaccgatgccttccagtgacaggctcatttcggtgttgaactgctcggtgttacgcggcgacagatagctggtgtgaggatcgatttcgcgggcaaaagcgttcatcaccagctggaaaacatcttcaccgttgctctgggccagacgacggatagcgaagttgtaacgcttggtcagaacgtcgcggatctcgttatcatctttacccgccagcttcagactcagctgatcatatttgaccttggcatcccacagcgcattcagttcagactgatcttttggccagggtgctttcgcgcggtcaatgtcgatagtgccattgccgctgaaattcatcggacgagccagcaccgtcagcgcatattgatagcgctcaaaacggcgtttctgcgccagattataaatatcgtaaaagagatccagcttgccactgcgcagctcatcgccgacggtggtttttttgctggcaaactgcgccacatctgacgccagcagcacattgtggctgtagtcgagcatgttcagatagcgatcaaaaattttcgctgaaaagttctgatccaggtcgaactggcgatagtgggaacgggtaaagcgcgaggttacgcgctcactgaccgtcggatcctgcggatcttcgtgaagctggggaatctgatcggcgcgggtaatgttctccgcgccgaaggttgggcctgctaatagcaggcccgcaataagtccaactttaaaaagggtgttcatgccggggttagcctccgtttcagaactgcaagtgttctgcgcgcacaatcattgccatgccggaagcgagctggacccgaacgccgtcttttgatacttcaagaacggtagcgtccatcgcacttttgcctgctttaactttaatactctggccgggttgcaaagttgaggtatcagtgatgggtcgggcttcctgctccggacgtggggctggcttgcgatgctgtgaggcggtcgcacgcggtgcagtggtctgcggacgcggtttacgcgcggcttcgccttctgcaggcttacgtgccgcgggcttgcgtggacgacgcggtgccgcgccctcttcgctttcgcctgcttcacgacgcgcggcgcgctgctggtcacgctgcgcctggacgcgtgctttcgcttcttccagttgcttgcgtgcatgctcaacgtgttgctcatccagcacgccacaggcattaccgtcgagatcgacacggatagcaccggctttgatgccgtacagataacgccagcttgacgtatagagacgcagcgcggaacgcagctgtgttttgctcagacccatttcgccctgaacacgctcgaccagatcctgaaagataccgattttgagcggacgcgcttcaccttcagcgctaaagcagtgcggaaagcgctccgccagaaaagtgatgacttctttactgctattcaacttaggttgattttccatgaaatttcctgattacaacgggtttgccgaccagcgcaggcatgaacaggcgacattataatgacaacatcgctaaatgccatgtgatccagtcgattagctgcgcgtcagctgcagatatttttctaagtcgctgttcgcaagcacttcacaaagcccatcagtcagtgtgaccagccccgattcgtcgtcgctgtcaaagcgattgtacgccacgctgtcgatgtccagcaccccaaccacagtgccattcactttcagaggaatcacaatctcagcattgctggcagcgtcacaggcgatgtggcccgggaaggcatgcacatcatctacgcgttgcactttttcttctgccagcgccgtgccacacacacctttaccgaccggaatgcgcacacaggcgattttgccctggaacgggcccagcaccagcgtatccgcttccgtcagcaggtagaaaccagcccagttcacgccatcgagacgttcgtacagcagcgcgctaaagtttcccatcgcggcgaggaacgccgtttctcccgccagtaaggcgcgcatatcgcgattcaaatcggcgtaaaaggcagttttgttcattatttaaccgttaccaatgacatctgaacggggcattgaagaccgttcgttaaaaataagttttaaatatccagagccacaaggtgaatcatagcgttagttgctatacccttagcattctgtggatcgaagcgtgatgcccgagacaggcacacagacaatgtctttacgaccgatatctgttacttctgaagagcgaagattgcatcaccctatgaaaattcacgctatcagccagacattgcctcacgcacgttatcagcgttgcccgcaatgcgatacccttttttccttaccggatgtgaaatctcatcagtcggcacattgcccacgctgtaacgccgaaattctcagtggtcgcgactggccgatgacccgtcttatggcgatggccgccaccatgattgtgttaatgccttttgctttctccctgccgctggtagatatccggctgcttggcatgcgcatcgatgccagcgtactggaaggtatcatccagatgacccagcagggtgatgtactgacggcctcgatggtggcgttctgcaccatcggcgcgccggtgacactggtggcgggtatctgttatctcggtatcggccaccggctcggcatgaatctgcgccccgtttctgctgatgctggagaagttgaaagagtgggtgatgctcgatatctatctgatcggcatcgccgtggcgtcaattaaagtgcaggactatgcttcgctggagattggctacgggctggcagcttacatcgccctgacagtgctgagcgtgctgacactgatccatctgaatatggagcagctgtgggagcatttctacccacagacgcctggcaatatggcccgtgacgatatgcaggtctgcctgaactgtcacaacaccagcatacccgatgaacggggccgctgcccgcgctgccatacgccgctcgacttccgacgccgccatagcctgcagaaatcctgggccgcgctcatcgcatcgattgtgctgttgatccccgcaaatctgatgccgatctccgtggtctaccttaatggctcacggcgtgaggacaccatcttctccggcatcctggggctgggcgaaggcaatattccggtggcggcgattgtttttatcgccagtattctggtgccgtttatcaaggtgctggtgatgctgactctgctgctcagcattcattttcgctgtgaacaggggctgagaacccgcatccggttactgcggtttgtcacctgggttggccgctggtcaatgctcgatctgtttgtcatttcgttaaccatgtcgctggtcaaccgtgatcagctgctggcttttaccatgggaccggcggcgctgttttttggcgcggccgtcatcctgaccattatgtctgttgagtggctggacagccgcctgctctgggatgcacatgcaacaggaaacgccgactacaccgactaacgcaacgctgcgcaataagcgcaaaatttcgcccttctggctgctgccgattattgcgatgctgatcgcctgctggctgctctggaccaattatcaggagcgcggcaccaccatcaccatcaatttccagacggcggatggtatcgtgccgggtcgcaccccgatccgctatcagggcgtggaagtgggcaccgtgcagggcattaatctcagtgatgattatcgcagcattcagattaaagccagcatcaagagcgacatgcgcgatgcgcttcgtgaagatacgcagttctggctggtgacgcctaaagcctcgctggcgggtgtgtcggggctggatgcgctggtcggtggtaactacatcgggatgatgccaggtaaaggtaaacccagcgagtcatttaccgcgctggatacgcagcccaaatatcgggtgaataccggcgaattgatgatccatctgcatgcgcccgatctcggctcgctcaacaccggctcgctggtctattaccgcaaaattccggttggccgggtctatgactacagcattaacagcaaatccgatggcgtgtcgattgatgtgctgattgaccgtcgctttatcaatctggtgaaaaccaacagccgtttctggaatgtgtcaggcatgaatgctgacgtcagcctgagcggggctaaagtgcagctggagagtctggcggcgctggtcaatggcgcgatcgcgtttgactcgccacagggtgcggaaacggccaaagctgagcagaattaccggctctatcccgatctggcacatagtcagcgcggcgtgcagatcacactggatctgcctaacggcaacaatctcaaggcgggcagcactccgctgatgtatcagggactggaggtcggcacgctgaccaaactgaacctgcaggatggcggcaaggtcaccggcgagctgacgattgatccctctgttgtcggtctgatgcgcagcggcacccgcattgagatgcacagtccgaaaatcagcctgacggataccagcctcagcgcgctgctgaccggcaacacgctggaactggtgccgggtgaaggcgaaccgcagcagcactacaccgtgctggcgtccaatgagactctgctgcaaaagcccaatgtgctgacggtaaaactcagcgcgccagagagctatggtatcgatcagggccagccgctgatgctgcacggcatgcagattggtcaggtgatgtcgcgtacgctggatgaaaatggcgtgaatttcgtggtagcggtcaatcctgaaaatcgcaatctggtgcatggcgacagtaaatttatcgttaacagtcggctggatgtgaagttcggccttgatggcatgcaggtattaggtgccagcgcccgtgaatgggtggatggcggtatccggctggatccgggcaaaaagggtgagccaaaaagtgcctatccgctgtttgccgatgctgaaaaagcggaagaaggcattaccggcgatggcccttctaccacgctgatgctgaccgccaccagtctgcctgatgtgcaggccggctctgtcgtgctttaccgcaaatatcaggtgggtgagatcgtcaaagtcacgccgcgcgctgacgcctttgatattgcggtacatattcagccggaatatcgcaagctgctgaccagcgaaagcgtgttctgggctgagggtggcgcacgcgtcagccttaacggcagcggcctgacggtgcaggcatcgccgcttaaccgcgcgctgaaaggcgcgatcagtttcgacaatatgagtggtgcgcagtcggccaaaggggccaaacgcgtcctctatccgtctgaaaccgccgcccgcgcggtgggtagccagattacgctgcacacctatgacgccagcaagctctctgccggaatgccgattcgttacctgggtattaatgttggccaagtggaatcactgtcgttaagcaaagataacaatcaggtggtggcgaaagcggtactctatccggagtatgtcaacgatttcgcccgtctcggcagccgtttctcggtggtctcaccggagatttccgctaccggcgtgaatcatctggaaaccctgttgcagccttacgtcaacgtggatccaggtaaaggcggcgccgcgcgcacgtttgagctgcaggagagcaccattaccgattcccgctaccttaatggcctgaacatttatgttgatgccactgaggccggttcactgtcgctgggtacgccggtgctgttccgtggtgtggaagtgggtaccgtgaccggcacctcactgggtaatatggcggatcgtgtgcagatcgccctgcgcatcagtaagaagtaccagcatctggtgcgtaataactcggtgttctggctggcatctggctataacctggacttcggtctggtgggtggcgtagtgaaaaccgggaccttccagcagtttattcgcggtggcattcagtttgcgacgccgccgacggtgccgctggcgccgcaggccaacccggataaacacttcctgctgcaggatgaagcgccgaaagattggcgtaactggggaacggcgatcccgtctccgcgctaaaggctatctcaaacgggcagcctggctgcccgtttcctttcctcatggtacactgccgcctttgctttaactggaatgtgcccgtgtcagatgcttcttcgcttttccccgccgattttctctcgttaattcgccagagcctgcccgatgaggcgagcctcgcgcaatttattgcctacagtcagcaacccctgcgccgcagtattcgcgtcaataccctgaaaatcagcgtggctgactttctgagtcagaccgcgggttatgactggcagctgacgccggtgccgtggtgcgaagagggattctggatcagtcgggaagatgagagcctgccgctgggcagcgtggctgagcatctcagtggcctgttctacattcaggaggccagctccatgctgccggtcactgccctgtttgaagctcagccagaggtcagcgccgtgatggatatggcggcggcaccgggttctaaaacgacccagattgctgcgcggatgggcaatcagggcgttatcctggctaacgaattctcttccagccgggtaaaagtattgcacgccaatatcagccgctgcggcgtcagcaacagtgccttaacgcactttgacgcgagggtcttcgggccagccctgccggaacagttcgacgccatcctgctcgatgctccctgctccggcgaaggggtgattcgcaaagatgctgatgcgctgaaaaactggtcgctggcaagtacgcatgagatcgccgcgacccagcgcgatctgctcgacagtgccttccacgccctcaaacccggcggcacgctggtttactccacctgcaccctgaatcagattgagaatcagcaggtcattgcctggctgctggagcgctatccggacgctgttgaggttgtagcgctcgatgggctgtttgagggtgccggacaggccgcgacgcccgagggctatctgcatgtcttcccgcagatgttcgacagcgaaggctttttcgttgcccggctgcgtaaaaccgcgtcggtcgagcccttaccgctgccgggctacaaagtgggtaaactgcccttctcccacctcagccgcaagctggaaagtgagatagcccaggccgccgccgctgtctctcttaaatgggatgcgtcgctggagctgtggcagcgtgataaagagatctggctgttcccgaaggccgtcaccccgctgctgggtaaagtgcggttctcgcgcatcggcctgaagctggcagaaacctttgctaaaggctatcgctggcagcatgaagcggtaattgcgctggcaaaaccggatgcggcgcagacttttgagctcaccgcagcagaggcggaagagtggtatcgcggccgggatatctacccggaaacggaacccacccgtaatgagatgattgtcacttatcagcagcagccgctggggctggctaaaaaagtcggcagccgtatcaagaacagctatccgcgggagctggtgcgcgacggacgcctgttccgctgagtcactttatttgcagcatcgtcagatgattgccaaacactgcgccggtatcgatgtagtgcagattggcaatcgtcagcgactgtttcagcggcgtgtgtccgaagtaaaaggcgtctgcgccacggatgcccgcccgtttcgcctgactccatcgcctccagccgctgacggctccagaccacctgctgccagtcgagtggcttattcaacgcatattcccgggccggataatcagcatgagcaatcacaataattcgctcatcgagttgcagatggagaatcagcggcagctcacggcaacgctgcaacgcgtgacgcgccgcaatcaatgctgcaccacgcagccgaaagaaccagtcgccaccgttcatctgccagagcgccatttcctgcccctgtagtgctgaaagcgccatctcctcatgattcccccgcacgcagcgaaaccagggctcctccagcagcgccagacaactcaggctgtcgggaccgcgatcgatgatgtcacctaccgaaatcagtaagtcctgctgcgggtcaaactgatgctgctgcaacagcgaatccagttcgcggcggcagccatgcagatcgccgaccacccagatccgtcgccacgctgcgccattcagggattggtaatacatcgctgcacccggcctttgtctgctgaaaccatcttcagagtatagtcagggccgacactgtacttgcatgacgcactggaaagcagaatgcaaaggaggctggctgaaagggagcaagggagcaagggagcaaggaggccgggcgaagcgattaaagagagatgaaaggtacgtccctcccggcgcttatctccggcactcagtaaaggtggtagctctgtcagggacgaaatacatcataatgcgatcaggcgcgccaggctattctgcccccaccatatctgtagtcatttgggatcagctacgcattttagccggatatttctgcagtttctctgccggacgcaccgggcggcgcaccagctcaccgccgcagttagggcaaagatgagtgagatgctcagcacagtcagcgcagaacgtgcattcaaacgagcagatgcgtgccgccagagaagatggcggcagatcaacgtcgcagcgttcacaattggggcgaagttccagcatggtgtgactccttaaaaaagcggtatgcgccagcttcgcggttgctgacccgaatgtcgagccagcaaccggacaagagtgtgtcagatccggacatcctgctttaatggtgcagtcagcggtgctttgccgctgctatttgtgccgctgatcctcaggaaggtcatcgggcaaatcctcttcgtcagctgtgtcatcgaactcagcactctcctcttccggctcctgaccgcccatcgacgcatgaatcacctcctcttccagcgtcgggatcagcgcggcacccaatggcgaggtcgccagactgtcaggcatcaccacatgcggtaacggcacttcggtcgtcggaagcggacccggcgcacgcacataactcagtccgccaatcaccagcgcacagagcataaagaagagatagagcatattgctgcccagcggctgcatcagcgcaccgaccaccagcgggccgatactggcgccaataccaaacgccatcagcagacaggcggttaacgagacacggcgatcggcggcgacctgatcgttggccagcgccacctgcaacggatagagcgcaaactgcatcatgctggcggcaaaggcgataccaatcatccagtggaaggtcagatgcggcagtaccaccagcggcacgcaggccacggcaaagagcatggcaataatgaataacagccgctggcggtcgtagcgatcagagagccagcttagcggaaactgcgacaccagcccggcaaaaatcgtgagactcataaaataaccggtctggctggtggtgaagcctttgctgctgccataaaccggtgccaggccatagaaacgcgccaatcgccatgccggtcaccagggtggtgccgagcagtttgggaatagtgcggataaaatagcccagctccatcggcgccggtgtcataggcctgacgtgagtgcgggtggtcagtgcaatcggcaccagacagagcgcgaaacagagcgccacaatcagcagcgtgctcaccccaaaccccgattgcaggctcagtatcacctgtccgccactgagtccaaggtaggtggcgaccatatagaggccgaaaatcatgccgcgctgggaagattccgcctgatcgttgagccagctctccagcaccatgtactggcacatcatgcagagcccgataatcagacgcagaaagacccacagcggaataaagtccgtcagcccgtgacctacaaccgaggcggtaatgatcccggcacaggccacgtaggcacggatatggccgacgcgggcaatcaggttgtgccccaccttgccgccaatcaccagcccgatatagttggccgcaataatcgcgccgatcagcgcaccattaacctgctcactggccagtcgtaacgagacgtaggtagtcagtaaacctgaacccagcagcatcagaagcgtagtggtatagagcggcagaaacgtactgaatatttttcccatatgactccctgtctacgcttttcaggcatcaggccagcaaagccctaaagatagtcgatttcgtcaggtgaagcggtattgttcatagcgacggtagcgaaaaaaaagcccgccagcaattgctcactgacgggccctgatttaagcgcttgggaagctgatgttgctgcccggcgcttcacggttgagatggatgaagttcaggtgtcgctcatactgatccagtatgtcgatgatcacctgctctttgctgtaatccattaagtcgttaccctggctgccctccatcaggaaggtttccagccggtagtaggtcgacttaccgctgcgggcgcgataggtaaagcccggaatcgaatattgctgcggccagacctgatagataaagtcctgctcctcgcccagatggacgcgcagatccagatagccaatcggattgctttcatccgcctcaacgctctccagcgtgacccggccatcccgcagctccagctctttcgccacttcctgcatcgccggatagatggttttttccatcatctgctgggtataacgcgagcctgggtagttcatcaggcgcgacagacgcttcttccaggtcaggcgatcggtcgcatgagccagatagggcgcggtgtcgcgcgtggcgctggcccgacggtgatcttcaatcttcagggatttaaacagccccgccatgacaaagaagataacaaagctgaacggcagccccatgatcaccgtggtgttctgcaaggcagtgataccgttggtcatcagcatactcagtgtcagtaccccaatcgccacagaccagaagatacgcagccagttcggtgcatcactgttgatatctttcaggcgcgaggtgaagttacccagcaccagcgagccggaatccgccgaggtgacgtagaacagcataccggtgatcgtcgcgaccgaggcgctgagtttaaacgccggatactgcgccagcaggctgtagaagccgcgctccgcatggttcatcacttcctgcgcaaactccgtattgccgtgaatgatctgatacagcgcggcattaccgaacactgacagccacaacagcgtaaaggtaaacggaataatcagcgtgcccagcacgaactcgcggatggtacgaccgcgcgaaatacgcgccaggaaacaggccgacgaatggcgaccaggccacccaccatgcccagaagaagagcgtccagctgttcatccactgggtcggacgatcaaaggcaaaggtattgagcgtcatgcccatgaagcgattgatgtaatccccgacgttcagcaccagcgcattcagcaggaactcggtgttgccgaagaacagcacaaacagaatcagtcccagcgccatgatcacgttgagttcggagagaaaacgaatccctttatcgacgcccgacgtaacagaaatggtggcgatcaccacggaaaggacaatcagcgcagcctgcgcggtcaggccttccgggatatcaaacagcactttgaggccatagttaagctgcacgaccccgatgccgagcgtggtggcgataccaaagatggtgccgaccacggcggcgatatctacggtgtggccaatcgggccatagatgcgtttaccaaagatgggatagagcgcggaacggatggtcagcggcaggttatagcgatagctgaagtagcccagcgcgatgcccatcaacgcatacattgaccagccggtcagtccgtagtggaacagcgtccagaccatcgcctggcgagccgcttccatcgtctgccctgccccctccggcggctgcatatactgcgtcacgggttcggcgaccgagaagaacatcaggtcgatgccgatcccggcggcgaacagcatggcagaccagctaaggacgctgaactcgggtttggagtgctccggcccgagcttgatcgaaccaaagcgtgagcaggccatatagagcacaaaaacaatatagagcgtggcagccagcatgtagtaccagccgaaggtggcggaaacccagtttaccgccttgaggatccagctcgcggccagttcactgtagagaatcgtcacaagtgaaaacgtcagaatcaatccggcagaggtataaaatacaacgggattgagtctgtctttttcaccggcaggtggattattcatcggttacctctggttaatgtcctgaaaatacgcaatggataagtcttgccgtccacggttttccggccgtgcggccctgtttcgttctgtcacttcctgttaatcgctcagacaaaccagcctattttagcactcattgccgtttcgctttcgctacatttaaagaacagcatcctaacaaattttctttttatattgaacgtgcaatcaaaaaaagtttaaataggggctcgatttgagggtggagctggagctatgccaaaggtagggatgcagccgatacgtcgtcggcaactgattgatgcgaccctgagcacgattaatgaagtggggattaatgatgccactatcgcccagatcgctcgtcgggcgggggtatccaccggcatcatcagtcactatttcaaggacaagaatggcttactggaagccacgatgcgtgatgtgacgcgtcaactgcgggaggcggtactgtcgcggttagaaccgctggccggtgcctctgcagaacagcggttgtgtgccatcgttgagggtaattttgatgatacccaggtgcacacggcagtgatgaaagcctggctcgacttctggtcgagcagcatgcatcagccccagcttaatcgcctggagcgggtcagcagccggcggctctactcaacgctggtggtcgaattccggcgtgaactgccgctggagaaggcacgtctggccgcacacgggctggctgccctgatagatggtctgtggctgcgcgccgcgctgagcggtaagccatttaacccggtcatcgccctcacactgaccacccaattcatccgtcagcaactggctggcgagcacgaataacggaaggagaaaacatgtcccgattcaccgagcagaaactctacatcgatggcgcttatgttgccgcaacgtctggcgaaacgttccagacgattaacccggtcaacggcgaagtgctggcagaggttcatgccgccggccaggaagatgtcaatcgcgccgttgctgccgccagaaaaggccagaaagtctgggccgcgatgaccgccatggagcgctcgcgcatcctgcgtcgcgccgtcgatattctgcgtgagcgtaatgatgagctggcagagctggaaatgctcgataccggtaagccttacagcgaaacctcagcggtcgatattgtcaccggcgcagacgtgctggagtattacgccggcctggttccggcgctggaaggtcagcagatcccactgcgtgaaacctcctttgtttacacccgtcgcgaaccgctgggcgtggtagccggtatcggtgcctggaactacccgattcagatcgccctgtggaaatccgcgcccgcgctggcagcgggtaacgcgatgattttcaaaccgagtgagatgaccccgctcactgccctgaagctggcggaaatttacaccgaagcgggcctgccggatggcgtattcaacgtgctgccgggcatcggttcggtcaccggtcagttgctcactgagcatcctggcatcgacaaagtctccttcaccggtggcgtcgtcagcggcaaaaaagtgatggccaatgcagcaggttcaacgctgaaagaggtcaccatggaactgggcggtaaatcaccgctgatcatctttgacgatgccgatctcgatctggccgccgacatcgccatgatggcgaacttctacagctccggtcaggtctgcaccaacggcacccgcgtctttattcctgcaaaactgcaggccgcattcgaggcgaaaatcagcgaacgcgttgcccgcattcaggcaggcgatctgcgtgacccggcgaccaactttggtccgctggtcagcttcagccatcgcgacaatgtgatgcgttatatcgaatccggcatcgctgaaggcgcacgcgttctgtgtggcggcaaacgtctgaccggtggcgatttcgaccagggtgcctgggttgcaccaaccgtattcaccgactgccgtgatgagatgaagattgtgcgtgaagagatcttcggaccggtcatgtcgatcctgagctacgaaagtgaagaagaagtgatccgccgcgccaatgacaccgaatttggtctggccgccggactggtgacgcaggatctcaataaggcgcaccgtgtgattcatcagatcgaagcaggtatctgctggattaatacctggggcgaatcagccgcagagatgccagtggggggttacaagcactccggcattggccgtgagaatggcctgatgacgctgcagagctacacccaggtgaagtccgtgcaggttgagctgacgcgttttcagtcagtcttttaatcacttaacctgaggaacgatgaatggaatttgattacattattattggagccggatccgcaggaaacgttctggctacccgtctgaccgaagagagcaacgtgagcgtcctgttgctggaagcgggcggcccggattaccgctttgattttcgcactcagatgcctgcggccctcgccttcccgttacagggcaaacgctataactgggcttatgaaaccgagccagagccttacatgaacaatcgccgcatggagtgtggtcgcggcaaaggtctgggcggttcatcactgattaacggcatgtgttatatccgcggtaacgcgatggatctcgataactgggccagcgaacctggactggagaactggagctatctggactgcctgccctactaccgtaaagcggaaacccgcgatatcggcccgaacgatttccacggcggcgacggcccggtgtgcgttgcaacgcctaaagcgggcaataacgtgctgtttgaagcgatgattgaggcgggcgtgcaggcaggttatccgcgcactgacgaccttaatggctatcagcaggaaggtttcggtccgatggatcgtaccgtcacaccaaatggtcgtcgctccagcaccgcgcgtggctatctcgatatggccaaaggccgcgccaacctgaagatcatcacgcatgccaccaccgatcgcatcatcttcgatggcaagcgtgcggtcggcgtggagtatctgcagggcgacagcaacaccatcaacaaagtgaccgcgcgccgtgaagtgctgctgtgtgccggcgctatcgcctcgccgcagatcctgcagcgttctggcgtgggttctcctgagctgcttaagcagtttgatatcccgctggttcacgacctgccgggcgtgggtgaaaacctgcaggaccatctggagatgtatcttcagtatgagtgtaaagaaccggtctcaatctatccggctctgaagtggtggaatcagccgaaaattggtgcggagtggatgtttaacggcaccggtatcggcgccagcaaccagtttgaagcgggtggctttatccgcagccgcgaagagttcagctggccgaacattcagtatcacttcctgccggtggcgattaactacaacggtttccaacgcggttgatgcccacggcttccagtgtcacgtcggatcgatgcgttctccaagccgcggtcatgtacgcctgaagtcacgcgatccgcgtcgtcatccggccattctgtttaactacatgtcgcatgagcaggactggcatgagttccgcgatgcgattcgcatcacgcgccagatcattaatcagccggcgctggacaagtaccgtggccgtgaaatcagtccgggactggattgccagacagatgagcagctggatgagttcgtgcgtaaccacggcgaaaccgcttatcacccgtgcggcacctgtaagatgggtaacgacccgatgtccgtcgttgatggcggaggtcgtgtgcatggactggaaggcttacgcgtagtggatgcgtcgattatgccgctaatcatcaccggtaacctgaacgccaccactatcatgattggcgagaagattgccgataagattcgtggtcgcgatccgttgccgcgcagcaccgccgcttactatgtcgcgggtgatgcgctcgttcgcacggttccgcagcgcgctgaataattagtgacaccgtcacttaataatagccgggcacttctgttgcccggctatttttttcattacggtttaccacacatccttttccacacgtcacccttttcaaatcatcaaaccttaacagacatcaaacaaagcagcatctgctgttgatttggtgatgtgcagaatgctataaatccagcgtctatttaaccggaggcactatccgtccactgatgagaagcaacaatgtggatgtgttgtaaattttatgagcagaatgttcatgtcaaaccccctgcattccccctcttgcctttctggctggaacgccgccgatcagcactggcgtaacgccctgtagtcccctcaccacttcgaactgttctgagtctgcccgcacattgtgcgttgttgcaggtcgtcctttatcgttgctggagagcacccatgcgcgcctgggttttattatcactcgctattgttactgaaattattggtaccctttttatgaaatggtccagcctcaatggcagccattccggctacctgatgatgctgggcatgattgcctgttcttatattctgctgagtttcgccattaaacgtatcgccctgggcgtggcttatgcgctgtgggaaggtatcggcatcatgctgattacgttattcagcgtgcagctgtttggtgaaacgctgtcagcgctgaaaatctgtgggctggtgacgctgatcgtcggaattgtgttgatcaaaaccggcacccaatcatcagcggaggttaatcatgctcatcgctgatcttgttcatgcgtcctggctggcgctggctatcgtgctggagattgccgctaacatattccttaaatattctgatgggtttaagaaaccgctttacggtctgctttcactttgctgtgtcctgctcgcgttcagcgcactcgctcaggcggtcaaaggtatcgatctctcgatcgcctatgcggtctggggcggttttgggattatcgccactgtcgcggccggatgggtattgtttggccagcggctgaaccgcaaaggctgggccggcctgaccctgctgctggccggtatgatcctgttaaaactggcctgatcggccatctcaatcagtgatattgattaagggtgtgccactgcacgcccttaacttcctgtgctttcccgccctgtttcggttgatttttccctcttacctgtgctcggaatcttcttacttttgtaaaggcccgtttacatatctgttgccttagggcttagtgagcgccgaaggtcggataaaaacgaggaatagttatgtctgcaacacgaggttggtctacggagctggagggattacgcggcatcgcttctctctgggtattagttggccatatcagcttactggttcattgccacatcacgcttatttcatcccctggcattggggtcgatctgtttattctgttatcgggttatctgatggcgaaaaactacgtcgagcgtcagcagaaagagccgtggcagagtacagagaccattaagaagttctggatccggcgcttcttccgcatcgccccgctctactatctgctgttaatcatcgccctgatttatggcccgtggtttggcgagatgcgtgacaccattgctcatttctattccggcaccgccactgagtcgtcgcgttacaatgaccagtcgctggcaaacatcctgacccacttcagtttcctgttcggcctgctgcccgaatatggttttaatactgtgctgcctgactggagcatcgggctggagatgcagttctatctgctgttcccgttcatcatgctggtgacgctgcgctttggttatgccgcctcgctgattggcatcatggcgctctgctgcgctggccggtatgtgctggcagattattatgaggcgtttgagatgccttcaatgatcctgataaagctaaatatgttcctgtcggggatgctgctggccgaggcgattcgccgtaaatccctgctctacgtcgcctttgcgctgctcggcccggtcgccagcgtggcaatgggcctgggcgcgattaagctgcaggtgattatggaggcgctgatgatcgtcggtatgacggcaattctgtggcaatacccgcaaggcagcctgatggcaacgctgattgctctgccgcgtaagctgctgaacaaccgtctcagcacctggctgggcgacgtgtcgttttctgtctacctgctgcatctgctgattgtaatcccgctgatcgcactgctgctcaatcacaccgacattgagtttaagagcgacatgatgcgcttcctgattgtctgcgtctctgccatcccggtgacctatgcgctggcctctttactctataagtatgttgagaagcccggcattcagattggtaagcgcgtgctgaagccgaagctggccgatcagaccagctgagtttttaacgcaggccatccctttcttaaaagcccccgacttcggggcttttttttttgccaggaaaagcgcaattggctgtgataacgagcctgctaaggcattgattaagcccgtcgccagcacacccgctgaggtgaactacactttgccggttagcaatctgactcagaggagagaacatgagcattcagcatctgctgctatccaccgacggtggcgcagtgatcattgaagcagaacaactcgaaagtgagctggttatcccgccccacctgcagaccctgaccggcggtgaagctgacagcgataccggccatcgggtggcggtaacaaagcactactgcaagggacgctactatgcggttgcccttgatcgtcatgcggccagcaatgaaattgacgacgtgatcgacctgctgcatccggccccgctcgattagtctttgtcagaccgaacccgtacatgttccgctgaaactgctggcgggaaagctcagtattgccggtgtgcggcatttacctattcagaagaggataagcattatgcaaaagaagaagtggtttgtttcttacgtgattaagcccaaaggtgaaaatcatgtcacgactcacgcctttatcgagggcgacgatgtcgaggaggcgctggaagcctttatgttcgaaaccaaaaaaagcctgtcgctggaaaccgaagagctgactctgctttcggtgagcctggtgtagactctgattaacctcgcgattgcggggttttttatgtcctgtatcaggatcggttatctatttatattatttataatttccctggtgcggcactcaattacttactgggatacggccaggcgtgatcaacgccagttgatgacagcagaccggtaaccgccagatacgccagtatcaggacaaacagcacaatcgctgcaatttcaatggattttagtaagtgatgcttagccataaataaccctccttcagatgtgtgtaatcagacttcaccccataaactataatgttaccggtaaagttcaagtgaaaatcacatcatgaaacataaagccgcgcttattaatgctttaacggaatgtgctcttacgcattcagagggagggaactggccttacaggcataaaaaagcccgcacggcgcgggcttctgcgattatcagcacggattattcagcagactgaccgctaaagtcgattaccatcctgccgcggatcttgccctgaatcatctcatcgaagatggcattgacctcaccaatcttccttttggtcaccttcggcaccaccttcccttctgccgcaaactggaaagcttccgccagatcgttacgcgtcccgaccagcgatcctactacctgaatgccatcgagcaccagacgcggaatattcaggctcatcgcttccggcggcagtccgacagccaccacccgaccaccggccctgaccgcatcgacagcagagttaaacgctgctttggcaaccgccgttaccacagccgcatgcgccccaccggtttgctcctgaataaagcgagccgcatcttcgctggccgagtttacgaccaggtcggcacccatctctttcgccagtgccagttgcccatcgctcacatcaaccgcgatcactttggcgttaaagacatttttcgcatactgcagagcgaggtttcccagcccgccaagaccgtaaatcgccagccactgacccggttttacctcggacactttcaccgctttataggtggtgacaccggcgcaggtgacactactggcggcgtagggatcaagcccgtcggggactttgaccgaatagtctgcaacgacgatacactcttcagccataccgccatcgacggtataaccggcattgacgacctctctgcagagcgtttcgttaccggagttgcagtattggcagtgcccgcagcccttaaagaaccatgccacgctggcacgatcgcctggcttaagtgaggtcacatctggcgcgacttcctcaacaataccgataccttcatgacccagcgtcacgccggttttatcaccgaaatccccgttcttcacatgcagatcggtatggcatacgccacagcattccatcctgagccgtgcttcgcccgttttgagaggacgcagcgtcttctcaaccacttcaaccttgtgttcactgttagcaattgccgctttcataaacgatgctccttttgattgaagctttaaggataagccaaaccgcggtgatgacaagatgacaggtaagctttgggtgcgaggctggcagggttgtttctgcttttgcagagtggagtgggtttttaggatggagaccgggcaccttaagctaatagggttattttgcgttagcttttcaacccaaattttaagctcactaatatgtcaggattttatcaataccatcggttaaatttaatatacacataagaaactacgataacccaggcaaaactaagaagtgctgcatactgcggaacaaagcagatgaagatatacacgccagccacaataacttcagcaggtaataaatagaaaaaagactgaatcagccataaaatagcacgcttcatttatgcagattctcatatagagcatcagcaattttcccttcgctgttagacatagcctgcacccaatattttttgatgtttaccttcaatttcaagaacctatatgaattaaagatttcataagtaaacatcctgtaatgcagccatagagcaccccataacttatatttacttttttcacaaatcaacctattggtttcgcaataactaaatatctgttatgaggcgcgttgacctttatatattgacagactctttgctttttcttctcgctggcaaaacctgccatagtagcaatgatgagatgaacgttagtaaaactgcattcaaagcatgcatcaagtgatccgccattgcgatgctagctactgtgggctgaggaataagatgcatagatcatgctgcgtcaacgacccgagcgtgcgcatcgtgatcgtttgataccagcggagcgacaactatggctttgagagtcgcaaaatgcatcagatagcgccagccagcatctggcagtgaccggaattgatgtgatacagttttgaccattacagtacccatttaagggaatggtatggatacaacggagcagttaaacggaacttacttctatggcggacttactaacctttctgcaggagagctttatttctggataatgattgatgtgactgcagagcacttcagcggtaaaaaggatatcatcgctctggttgcgatttactcgggacaaaatacgattgacgtatccggtaagctaaacggagcatggaaaggcacctcttatggttcggtctattctcgaaagctgttacgggattaccgtcttccattcagattacctacgtggatacagaaccctaaaaaccctcttcaaattaaaatgttaatgactcacaagctggggacgtttcgtcggtcgtacaatcccggttttaggctgggtaattatggccgctgatgtggcagaaattggctggaaaactacggcaaaatataaccttcttgctcataaggaagacaagatatggtaaacgaggatatagagaaagctgtatttgcgctggttgaagattataacggcagaagtttgtttacgttcagacgctataagcttgaactggataccgatctgaacaatgactttcgcatggatcctcttgacgcgtatgaattgctagagcggtatgctgaaacatttggcattagtcccagtactatcacgtttgccgaatatttcccggaagatttcaatgcgccgcacgatccgctgactattcgtctgttaattgagtctgcacaggccggacgctggttgggtaaataattaacgcctgcaaacgcaggcgtctgtctgttcagtttgttgcggctacttttagaggacaagtgcggaaaacgtgccgtagatttgggttttaaatttaaggacgcgaccgcgtcctctcggagtttctgtcaataactctacggagccaacaggctctgaagcagctatcgatttcacaaagccccctactcgcgccgagcgtggaaggatttttaaacgattaagaggaatgtcaccgctacaacagttggtgccggaaaaatatcactctgaactaagtcattgcacggaacgggaggcgatgaaaaagagtttcttcgagatctctagattaacactgtccgacggtgaggttttgcgcatgatgaaaggccacacaattaaggttggggagctttactgaagcggaacaagcggctatgtgttccatagacagagcaacaatcatactcccttaaagcgcttcaatacgcttgcgaaaaaagaggcatacatgtgcctgattaataaaacggcagtcggactaatctgagccgcacgattgtttacaattttagctcaccacggcactgattatacatacagtatattttgactaaaatgagttaatcatatgatgaatatagataatctaagcgaaacggttgcacgcatccagttcattgctgacgtatcgctgatcgcacattgcaaagaagatgaattaaaaaatggcactgtcgatgatcagtgatatggcaggtacaatcgatacatcagttttcgaagcagccatataccgccaggcttaatgattaattgccccttccctatcaacctccactagccacctttgaggtggcttcttgcttctgcatcaaagtgcaaagcttgcatgaatccgcatgatccaaattggatcgctaatcctctgttaggtctgtactggcgcgttttgagatgttgtatgcacatgcatgaaaagtgatgcataaagcgggcaggcgtggcggggatagcattgcgcgcaagcggttaagatgagcagactaattgcttggatccaggctgagaaagttagtaatctcatagcggaggagtaacattttcataatgcccatgttagattttactttccgcaacgatcaatcaactagttcttaatctttatacttattaatgagggtaccgtgattaaaagaaacttgggccgaatgggagaaacatttttcaataatttatgtgctacggtgggtttaacatgcaatggaagcattgaggatagtacagggtgggattatattgtggagtacccacatgaatatgacgaagtagttttagctgacaaagcacccgcatcaaaagagttcaaaatacaaatcaaagctacagatcatagaaaaaggaaacttgcaataacactgtcaaatcttatgcggctgtgtaacacaccattaccaagctttattttatttttagagtataacaacaaattagaaccagatgatgttttccttgttcatattagcaaggacatcatatttgacgtccttaaaagtgcaagagaaaatagcttgaacaaggccagaaagaattttaacaagaaaaccttgacaataaaatatgatgaatcaaataaattaagtcatctggcaggtgatgcttttattaaagccattgatagctacatcccaaaaggaatgaatgaatatgttaaagaaaaacaacatcaattaaaaaccttaggttacgagaaaagctgggggcaaatgaaatttaaagctagcactcttagccctgaaaatgatgttgttagtgcatctctgggatggattgataaaattaaagttaccgatgtgatgacttatgatactcgctttgaaattttatcagaagacgcagaccttcgttcacctgaggcatttatttcctttgatgttaaacaaagtactgataagggaaacataactttcacacaccttaaaagtaaaaagcgcttaagatttgaatgcgagttatttttctcacaggtttcagccgtggctcctaagcagatggctaagttcagagttaaaactaagagtttcgatatgttagttgcgttaactggcaattcacattataagttcattgacgatggtgtgagacttagtctttttgagctgagagatgcaataatttttagaaaatggatcacctcacaagaaagccagatggaaataaagattttttccgaaaaattcagaaaatctcttgttatgattagcgataaggtcattgaggggagttcagaattaaagtacattaaacatttagagtcacttgagaaatcaattgtcattgcttcagaactagctgggaatttgaatattgaatcacaagtgcaaatgtcttttgatgaactaagaaatagccaagagtcgcttcaatctatcgagcctttgctgagttcaaataaacagccttatgacattatgagattccatatagatcaagaagaatctgccaaaaaaattgaaggcgaagtggtttgcataatggttttatcttcaaaaatgggcaaccttacaatctatatgattatatctgttaaggggcaggccaatttacttgatggttggcatgcaattggaaaacctaaggtgtctattgaagagttaattgactgcccttctggagaaaatgtcacagagcagataaaagactctattgattcaattgttgatagctatagtagtgaaggagtggtaactattaacttcttcaagggttagtaaaaaagcccaccacgggctttttttaaccatcactgcctaagttataaattttaaatcttataacttcttctccaatccaattatttatctctttcatacgttcctcaagcggagtcagctcgttacacacgaatacctgagacgctttcacagcatccccgaatccgccggagttgtccgagataatccccatcatctgcggcggcacgcggtgctcgctgggcaggtcgtcgtggctggccttcttgatgttaaagaagtcgtctttcgtcgccacttcactacacggcagaatcttgatgctgttcgtcgcgtacatgaacaggttacggaagttacctagccctttcgtgtcgcgcatcgcctgtcgcatccggtcaacgtcacagcgactctgcgccgcgtcggtcatatacaggatgtaaccggcgtgcgcgccgttctgataatacttacgacggaacagcgttgccgcctcattcaaccaagcggagttaagcgcgctgagctattccggcaggccgtacagcttctgattaatatccggctccagcagttgaaacacgctgccggccgaaaattcgtgcggctttttccagtcattcacaaaccagtaaatgcctttcttcaaacctctgcgggtaaatttggccggggtggtttcaaggccattgcggcgcagctcggcaaaggcgttaccgaaaaccagataatcaagcgcaaacttgctgaactcctgctgactcatcattgggtgcgggataaaggtcgaggccagaattttgcgctttacgtaaatcggcgagctgtgatgtacggccgagcgcaggcttttagccagcgcgttaaaactgcgggcggctcaaaccagcgcccgttactgatgcactcggcgtaatccagaatgtcgcgtttatccatgaccagcatcggatcgccaaaggtaaacgcctcggcgtgctgctgaggtgcgtttgccttatcagtattgagttgcagctgatcgagcgcgtgagcgcacaacaggcagacagcgcgctacatgtgacttacgttggcgagaaaacccgctgcctgagagtgacgcgcggccggtgcagctctatgtttacggtgagctggtcagcgagtggcagacatgagcgagctgtagctggtaaatgaccggctggaagcgcttatcagcagcctgtcagccccggcacgtaaaaagatggctcgcagcattggccgtaagctatgcgcgagtcagcagcaaaacatttagcgccagcagtttccagacggcacgccgtttaagccccccaaaacgcagctagtgagcagcaaaaagggccggataaagcgcgagatgttcgcaaagctgcgcacggcaaaatacatgaagacgcaggccaacccgaatgaaactgtgatcgagtttgcgggtaatgtgcatggcccgcatgcatcattacgggttgcgtgacaggccgtcaatcaatagtaaaacaatcaaatatgaatctcgtccacttatcggtttaaatgacaaagacagaattgaatttgatagcaatattttaaaaacgttaagtaaagggttctagctgaactctgatttttgttgcataacgcattaatgctatgtaattttatcgaaccaaacctagcattatgggcgaaattcccatcgggccatgagtcatggttccgcctcgtatttggactatgcccgtcgtttcagttcgctgagcggcgtctggtggccgccgatcagcgaactgaacgacgtgctcaagtaggtttggttcttcaactcaatcttaattttcggaataaaaaatgattgttccgttcaggaagtcaggcagtgagcttaacagggcattgtttatgctcaacttttttatagaaaaagatagagtgaaatgccctggtgacgttagaaagtttgttttcctctgcggagcgaacaactcaaaaggtgagccttcagcacgaaggcaagaactaattaaattcgcggaaaaggatcttaccaactgtcatttcttcttggctgaacttatatttaaggagctttctgaggatgatacatctcctttagaaaatctattggatattgaaagcgaactttctgcccttgctgattacatactaattatcctggagagttattcatcttttacagagttgggggcattttcatatagtagcgaattaagaagcaaacttattgtagtaaataatactaaatacattaaagagaagtcattcattaacatgggcccaattaaagccataatggaggtcaataaaaacgggcattttatgcattataaaatgaatgaatcaagcgaggcaattgagagggctgatggtattggggctattttccctgacctttacgagctgttagtgaaacctgaaagaaaacaatctagaacattaaagaaacatgagctgaatcctgcgacaaatttcaacaaagactcaattcgctttattcatgatatagttttcacctgtggctctataacattaaacgaattaatagatatattaatagagatatttgggaacaaccactcctttaaaaaacatgcgcaaaagcatttgggcgtcctaaaggcaataaatataattaatcgttataatggataccattactcccttcaaagacaatattatctaaagtatggcttcgatattgagagtatatcatcgacttttaaaaccttctttttaaaaaacaacccggaaaggatttataatagatgattctttataagataatagacaccgatataatgatgcgtgacggtttcactgagtcggttatcaaatcctctgagccgcctaagaaatggactattcccaaaaaaagtggaggtgtaaggtcgattcatcatccatcaactaaaaacaaactattacaatactggctcctgaccaaggtttttaataaccttccacaacatcctgcctcctatgcctttataaaaggacgttcaataaaagataacgctcttcgtcatgcggaaagcaaaaacaattattatgtaaagctagatatagaagatttttttccatcaattacctatgatgattttgagcgttgctttgttaaatatagggaccttataacaacacctacaaaatgggataaagacctattaccactcattcaagatgtttgctttcttaaacctcagaaaatattgcctataggattccccacctctccagctattgctaattttgttgcaagagaactcgatgatatcattaacgctgagatggcttcatttgaaaagcacaaccctgtttatacgcgctatgcagacgatttgatattttcagtagccgacaaaggattaagtaaaaaaataataaccgccgttagaaagtcacttagaaaatgcagctcgaatttcaaacttaatgcaaataaaataaaagtctgtagtgcttccggcggtagcgttgttgttactggtttaaaaatttgcaatgaccatcatttaacgctacataaaaaaatgaaagattcaattcgattgatgttgagtttgcattccagaggaaaacttaaagaagaagattttaacaaactatctggctatattgctttcgcaaaaagtattgatgaacatttttacactagattgagcagaaaacatttcaaagaattacgtactttagaaaacaggcatttactatgagttaagcgtctgatttcccttttttttagtcattgtttagcaaacacttttttattgaggatgccgcaactgatcggcattctcatcctatgaatgaacaaatctctaaaattcagcgcctgttacgcaacctgatccgcataggaaccgtgtcggccgtcaaccttgacgactgactatgccgtgtcgctacagtaaaaacataaccaactagctgcactggttgtactggttgtactggctgagcgcccgcgcgggtaaatccctgttctgtttgccttggccgatgcgctgtaatggtcgtttcctgacggcgcggtgatcgagtacgagccgtaaaccggcgcgctgaccgcaaccggaataaagacggtaaccatcaaagcggcggtaaaaatcctgtttgactcgccagaagtggaatgcacagtgctactcaaaactgcacagctgtaagtcacccaagaggcgcgatgaatggaggtgttacgcataccggcggcaatctttcctccaacggcaaggtacggcgtttcgcatttatatccgggcgacaaagatggaaaaacgggagcgccagtatgagaactgtataatatatcggcatgggccgagaaatcggcgacatgctgaccgacctcgattacatccggcaatccgtgcgtgacattctgctgacccctgtcggtaccagggtgatgcgtcgccagtatggttcgcttttatccacactgaatgaccaggcgcaaaacgaggagctgcgcctgcagattatgtcggcctgctatatggcacctctgaggcaaagctcgccgcctgagtaacggcgcagaagcgcctcggccgtgacattagcctttctgcgctgtatgccgccatgcatgttaagggcgtgcagcgcgtcaaacttatcaagatttgtgctgacatagtgctcgacaaacgcaggccgcttactgcacgggctatcccctgatagtggcggcatcgcttacggtatggatgaaatgcatgcaggcagtacaggtgctgatactgccgcatcgaaaattgcatggacgaaaaagactcaataaaatccattctacgcacaaagttttcagttaaaaaatttcaatggaaaaatatttaattctgccattgaatcatttcatccagcctcttcagaatgtcggggaaatagctttcattaaggccaaagctgcctttaacctgaacgctgtcggcatgaggctccggtcgaaggataaaatcaatagtaacgctatcaatagtattttcatttgtcagtatcatatcaagctgatgaatatcgctctgatatttaaacgactttaactttttctgagcaattatcgcctgatgaaaagctgaaaattctttcttcaacattttcaactctccaacagtgaacttagtcttaaacgccaccttcaggccgcttaccgagaattctatccaggactgtatccaatcccaattatgattaaccggatcgacttcgttatcgacaacccgttcaaaaggcgacaccgcaaaaacgaattcttcatctctgatatcaaacatatgtacgttcctgtcggttaatcaaaaatacctaaaatgagttatcgtccaatctgatacccttaccacaacctcaagagtgtacttcttatactcagtgatatttttcttacggtgtaatttatacatttccgtttcataacgatacataccctctccgttgcgaggatcggccatgcgtctgccatagcggatagctctttcctgaatatgtaacggaacatagcgacccggctcatacatgtgcctcgccgctgtttcggtcattgtcaggttacacgccgataaacccgtttttaacctggcacgcaggaacattattgttgcctggctgagtctggcacttatagcagctcgtgtaccagcctccaataatgcgcggccagcgcggaaaattcgaaatacaccaaacgcaagaagcgctatgtctgtaggatcaatcagtggcgtttcgagaggtgcctcttcaagtcgaacaaaatgcccctgcacatcgtatatctgccacagaccgggagcctgagccacagaataaccaatgcacatgccgctggactcatccagcaccggctgtgcgtttcgtggcagcacacgtggtctcaattcaaaaaatacgttgcccgatagtggtgactgaaatgtgtaatatctgccaggttctgtgattgcattccctgcattcattatcgttccctcattttcatgtgacttaatagagtgccacaggatagtagagcggtcattaccgagtactgcaacgccgtttcactcagcaaacttctctcgcacgggctgcacagcctatacctgatgctcctggcagggcttcaaccatgagtaaaacaggtggcagattatcgccacggtgtccctttcatagagaggtaataaagcagggttgtaacttatatgaataggaaaaatggcaatgacataatggaatggcgtcttgcagaagagtggagaagaacacaacggaaaaagactaagttattgattgaaaatcattaactgatgggcggcatctgacaaaaaaagaccgaatacgattcctatattcggtccagggaaatggctctcaaggagccgtgcgctaaaagttggcatttatgaaggcgatgtcgccttgccatttaacattagaacagcgcggtggaattgccagcaaacgggaggcgcaggaccataaaccggatcagtttgtgatcgcaacggcaaaaaagaggggttgggcgcagcgcgatgctacacccgacaggtttatttaccgcacagcgcctgggtgcgctcaacaatcggctgtagactcatcatctggcccggatgcgctttatcttcaacctgaatcacgctgatcggctgcgctttcacctgtttgtttttgaacagtgtgtcggcgatatcgttcagggggtatgtcatcagcgtgctcgggttgatggcaaacatcgcaccatctttctcacaggtcagcatcacctcttcacggttaaacggccacttctctttaccgatctcaaagcggctgacggtaatgatttgtgccgccagcgcctggccgcatacggataacaacaggattgcggggatcactttcttcagcaacataactacccttttctctcttaaaccacattcaggctggcgacagcgtggcaaatacgctgaccagcccaaccactccacacgccagcagcagttcaagctgcgtcatgcgaataaatttttgctgcgtcccgctgcccgccaggcggaatcgcggtaccagccagtatcggttaatcagcgctaccagcaccatcagggcaaccagcagcactttacacagtaacaatacaatgtagcgtgaatcgtgccacgtcagcggccagcccgcgatcatcacgctgtttatcaggccactcagcagcgttaacgccaccgccagatggccatagcgcgaaaagcgcatcatggtgcgaatagcgtcggtgcggcgatcgatctggcgcgcctcccgcatcaacagcaacagaggcactaatccgcccgtccagaaacgccgcggcaatcagatgcagtgcatgattgagctgctgaaacaatcccggccagccatcgcgcatcgcggcatgacctatcagagccatgcaggccagttgcagcacgcccgccagcagtaacacctgctgacgcagccgcccggtcagtagcaacccggcaacggccagcaggctaaacaggatttcccacagccacacgccaccgaagtgcgtgccaatcaccgccagccagatatggacatcggccagattggcgctgtcgccgctcatcaacacattctggcaggccagcatcgccagtgcactcagcagcgccagccaggcgctccctttcaccagcgggtttaatcgtcgcgccagtagtggtcgatagcgtccgggtgccagcagcgcactgtaacaggcgctgccggtcagcagcatcacggcggcaaaatgcagcgcgcgcaacaggatccagaaggtggtcaccggagttacttcacgctaaagcgatagcttcctgcggttttatgtccatccaccgacagcacatgccagttaacctgatagctgcccgcttgcagtggctgagacaggcccacaatcagccggtttttctggccagattcaacgcgggctttagcggtggcgacaggcttctgttcactatccagcagcgtgacaccgctgaatgccgcttcaatatcttcactgaagttcagcgtcagcgcatcggtggatgtcgttacctgcgctttggccgccgggatagaagactggagatgcgcatgcgccgctgccagcgaactgaatgtcatcagtcctgctgctgccagcgcaataaccatgcgggaaatcagttttttatgcataagatcatccttttaaccgccgccagggcgataaacgtggcaaaaggatacgctgctgtatttgcactgtcgaggccagcgatgcgatcctttatccttgattcagaccgccgaaaacattacttttgcccgctatcgtcaggagaatattatgagccataaccttgccctgctgtcccaggaagagaaagacaagattaatgtcgatttggcggcagcaggtgtggcgtttaaagagcgctataacatgccgatcgtcgccgaaatggtggcgcaggagcagcccgaagcgctgcgtgactggtttcgtcagcgtctgatgcactaccgccaggcgtcgctcagcctgtcgcgccttccttatgaaccgaagatgaagcaatgatatttcgcgttattgataccgaaacctgcggtctgcagggtggcgtggtcgaagtggcgtccgtggatgtggtcaacggccagattgtgaatccgatgagcgatctcaccctgcccgatcgccctatcagccgtcaggcgatggccgtgcatcgcatcaccgaagcgatggtcgccggtaagccgaccattgaagaggcgatccctcgctatcacggcagtgctttttacgtggcgcacaacgccagttttgatcgccggatgctgccggaaatgtacggagagtggatctgcaccatgcagctggcgcgtcagctctggccgggcattaaatatggcaaccaggcactgcgtcattcgctgaagctggatgttacaccgcccgccgacctgcatgctcaccgcgcgctctatgactgctatgttacggcagcgctgctaatccgtattatggagacctccggctggagtgcctccgagatgattgtgcgttcacaaccggcggcccagcgcgacgacgtttctgccgtttggcaaataccgcggccaggcgatcgcggtggttgcgcgcaaggatccgggctatctgaagtggatgctggataacgtcagcgatctgcgcccgccattgcggcaggcgctgcgtaagtacctgaccgaatctcagtaatcctgagctggcggtaaggtgccctgcgccagtcccagcaggaaggtgtattccatcgcgatcccttcataggctttgtagcgccccgacttgccgccgtgacccgcatccatgtcggtgcagagcagcagcaggttattgtcggttttcatcgatctcagcttcgccacccacttggctggttcccagtactgcacctgcgaatcatgcaggccggtggtgaccagcagatgaggataggctttcgcctcgatgttgtcataagggctgtactggcggatataacggtagtactcaggatcattagggttgccccactcgtcatactcgccagtggtcagcggaatcgactcatccagcatcgtggtcaccacatccacaaacggcacctgggcaaccacgccgtggaaccgctgcggtgccaggttaattactccgcccatgagcaagccacccgcgctgccacccatggcatagagtcgttccgggtgtccgatgccacgcgccaccagcgcgttagtgacatcgataaaatcggtgaagctgttcattttgttcagcaggcgaccgccgtcataccattgctgccccagctcaccgccgccgcgcacctgtatcagcgcatagacaaatccgcgatccagcaggctcaggcggctgacgctgaaatcggcatccatactgctgccgtaggcaccgtagccatacaccagcatcggattctgaccgggttgataatgtttgcggtgatagaccagcgataccggcacttcggtgccatcgctgactttgatccagtggtgctcgcttttgtaatcttccgcgttaaagcctttcaccgcgctctgcttcaggatgcggcgttcgccggtatccatatccagttcaaacagcgtggtcggcgtggtcatcgacgaatagccgtaacgcagtttgctggtgcgcggcgtcggattgtaggccagccaggtcacataggtcggatcgtcaaaggcgatgccgctggtttcaccgctggcccagttgatctgccgcaggctggttaagccgcgctggcgctcctcgaccaccagccagtcccgaaacagctgaaaatcttccatcactacctgttcacgtgccgggatcagggtttcccagcgtgactcgtccagatagcggctgcggtacagcccgaagttttcgccttcccggttggatcgaatgaagaactgatgatcgtagtggtcgatgctgtactcatgatcgcggcggcgcggcagaaacacatggggctgcgcgtcggggaagttcgcatcaatcagctgaatttcgctggtgttggtgctgtagagggcaatcatgatgaactgcttggaggtggtcttatgtacgctgagatgataagtgtcatcctgctcttcatagaccagctggtcgtcgaactgcggcgtacccagttcgtgtcgccacacctgataagaaagcagcgtctgcgggtgttttcgcacatagtagagggtgcgcgagtcgttaccccatgcgaagctggaagaggcattgctcagcacttcagggtaccagctgccactctccaggttacggaagcggatgccatattgccggcgagacaggaaatcttcagccagcgccatgacaaggttatccggactgatatgcagcgcgcccatggtgtagaaatcgctgtgcgaggcgcgctggttggcatccagcagcaggctccactcgccagactcatcgctcgcagcgggctggcggtaataggccggatattcgttaccgctctggtagcggctctgataacggtagccatttttcacatagggcactgagtgatcttcaggcggcagccgatcgataatctcttttaatacccggtcctgcagtggctgctgtgacgacatgatttttttgccgtagttgttttcggcacgcaggtaatcaaggacctcgctgttttcgcgcttgtcgtcgcgcagccagtagtagtcgtcaacgcgcgtctcgccgtgcagcgtcatctcatggggtattctttttgcgatgggtgctttcatccatccgtctccgtgaacgtaatgatctgtaagcgtaacacttcagcagcgggaagccaggtataggttgagaagcagccgctggcggatcacatcctgtgtcccgccagcggaatatcagagggattaactggcgggtaaacgggctttctcagcctcaagatcctgctggatgccgtctcggacatcctgggggattttcagcgcgtcgcccagcgcggagagatagctgcgctccatgaagtgatcaacgtcgatggcggcacagctcaggaagtagagctccagcgcctcctcctcgtttttcacatcggcggccagccactgcggatccagcgggcggttcatcgctttctggatcagttgttccgcttcctgaccgtagccggactgatgaatattctgctcaatcgctgcccgttcctgatcgtcaatgtgcccgtcgcttttggcggcaaacaccagcgccgtcaccagacgttcggcccgcaggttaactggcgtttgcgccacgccaaagtcaggttcattctggtgtgcttcgctgacccgctgcttgtatttgttccatagcaccgcgcccgcagccgcaccaccgccgataatcagcgccttgccgccatatttagtcagcagtttgcgcgacgatttactggcaatcagcataccggccaggccgcccagcgcacccggcgccagcatgtcgcttaagccgccgcccgatttgccctcaccgcccttcttcgtcagcaccgactgaatttgttgcaaccagttattcatcatccactccttttaagatgtcagtccgctatcctgacgaaaaggatgtcaggaaacgtcagagcgggaaaagtaaggcaaaaggtcgggtcagctggacgaaagatgagaacgcaaacgttttcgtttatacttgcgcgcgaattttgactgcttaggtgaatgtatgacgactctcggaacagcgctgcgtccggcagcaacgcgtgtgatgctattgggttcaggtgaactgggtaaagaggtggcgctggagtgtcagcgtctgggtgtggaagtgatcgcggttgatcgttacgccgatgccccggcgatgcacgtcgcccatcgcagccaagtgattaacatgctggatggcgcggcactggctgcgctgattgctgaagagaagcctgattttgtcgtaccggaaatcgaagctatcgccacggagacgctggttgagctggagcagcaaggccagcgcgtggtgccgactgcccgtgccgcccggctgaccatgaaccgcgaaggcattcgtcggctggcggctgaagagctctctctgccgacctcccgctatcgctttgccgatagcaaggcgcgctttgatgaagcggctaccgaaatcggctttccctgcattgtgaagccggtaatgagttcatccggcaaaggtcagagctttatccgcgatgccagccagctcgataacgcctgggactatgcgcaacagggtggccgcgcgggtgccggacgcgtcattgtcgaaggggttgtcgacttcgatttcgagatcaccctgctcaccatcagtgcagtcgatggcattcatttctgtgcgccaattggtcaccgtcaggaggatggcgattaccgtgaatcctggcagccgcagcagatgagtgatgtggcgcttcagcgggcgcaggatgttgccgcgcaggtggttaatgcgctgggtggctatggcttgtttggcgttgagctgtttgtatgcggtgatgaggtggtgttcagcgaagtttctccgcgtcctcacgacaccggcatggtgacgctgatttcgcaggatctgtcagagtttgcgctgcacgtgcgggcgtttctcggtctgccgattggcgcgattcgccagtatggtccgtcagcgtccgccgttattctgccgcaactgaccagccagaatgtgcagtttgtgaatgtcgaagcggcgctgggtgccggtctgcaactgcgcctgttcggcaagccggaaatcagcggccagcgtcggctgggcgtggcgctcgccagcggtgacagcaccgatcaggcgattgcgcgtgccgttgccagcgcagcagcggtcacggttcagggataaacgtgtgcggtgagcagacgctcaccgccataacttacttcgcgccttcaacagcttcgcgtgccaggcgggtgatgcgatcccagtcgcccgcttccagcgcgtcgttgggcaccagccaggaaccgccgatgcacagcacgcttttcagcgccagatagtcacggtagttcgccggagagatgccgccggtcgggcagaatcgcacctgcgggaagggtccgccaatcgcctgcagcgctttaacgccgccgtttgcttctgccgggaaaaacttgaactcgcgcagaccgtagtccataccggtcattaactcagaaacggtgctgatgccgggaatcaatggcaccggcccttcaacggccgctttcagcagcgactcggtgacgccagggctgatcacaaactgcgcacctgcatcggtcacttcctgtaactgctgcggattaatcaccgttcccgcaccgacgatcgcatccggcacttctttaatcatcgcacgtaaggcatccatcgccactggcgtgcgcagcgtcacttccagcactctgacaccgcctgccaccagcgcttttgccatcggcacggcgtgttccagtttgttcacaacgatgaccggcaccacaggtccggtggtcagaatctgttctgcactcgttttccagtttttcatcagttccccttgcttgataacaccgggattgcgacccggtcatggagcatcggctcctgccctgtaaattgcgtcactaccatacatgatcaacttcctgagcgtctatcatcctgcgaccattttgaaacggcagttcaattttattcgtgttgactggcccggtttaagggcgaaaaaaaagcccgcgttgcgggcttcatcatcacttccgttattcgaactcgttccacgaacggccatcgcgggtaatcatcgccactgaggccaccgggccccaggtgcccgcctgatacggcttggaagagtcaccatccgcagcccaggcgtcgataatggaatcgacataggtccatgcggcttccacttcatcgcgacgcacaaacagcgcctggataccgcgcatgctctccagcagcagacgctcgtaagcatcggcaaggtgcgactggttaaaggtctcggagtagctcagatccagcttggtggtctgcagtttgtgcttgtgatcgaggcctggcactttgttcaggatctcgatatccaccccttcgtccggctgcagacgaatcgtcagcttgttctgcggcagctcggagtaggagtctttaaacaggttcatttccgggtttttgaagtagaccacgacttctgaacacttggtcggcaaacgcttaccggtgcgcaggtagaacggcacacccgcccagcgccagttgtcgatatcgacacgaattgccacgaaggtctctgtggcgctcgacttattggcaccctcttcttccaggtagccaggcacttttttgccctgcacaaagccagcggtgtactggccgcgaacggttttctcacgcacgttggtctgatcgatgcggcgcagcgagcgcagcactttaactttttcgtcacggatgctgtcggcgctgagatcggacggcggcgacatggcgatcatggtcagaatctgcagcaggtggttctggatcatgtcgcgcatctggcccgctttatcgaagtaaccccagcggccttcgatacccacttcttcggccacggtaatctggacgtggtcgatggtgcggttatcccagttattcacgaagatagagttggcaaagcgcagcgccagcaggttaagcaccgtctctttgccgagatagtggtcaatacggaacacctggctctcatcaaagtactcaccaacgctgtcgttgatctcctgtgaggtttccagtgaggtgcccagcggcttttccatcactacgcgcgccggtttagcattcagcttcgcggtgcccagtccctgacagatggcgccaaaggtgctgggtggcatggcgaagtagttgatggtggtgcgatttttctggtccagcatcttgcccagtttcgggaagtgcgtggtgtcgttgacatcgaggttgcagaagtcgagacgattgctgagtttgtcccacagcgcttcgtcaatcttctccttcatgaaggtttccagcgcttcacgtaccactttggtgtattccgctttatcccactcggcacggccgacaccaataatgcgggtttcctcgtggatctgccccgctttctctaactggtacagtgaaggcaacagtttacggcgtgcaagatcgcctttggcaccgaaaatcaccagatcgcatgcctgggctgtttgtgttaccgccattttcctctcctcgttgcaggatagtccggtggtgatgcatcctctgccaccgggtccaggttattattttctttgagcacaatgtacttttttccccgcgccaggtaaaccgactcgccgggtcaaccgcattaactctgtaccggatgtgctaagcgcgtgtgatgacacgtgcggattgccggatttttctgtgtctgttggtgtcaggaaaatcaggcaccggtcaaagtatcccaaaaaaaagggcaatcgacttgtccgccgttgcgcctggcaggtgctgacacgatatagtctctgttaatcgactctgacgacagggataattgaaattggtaaaagtgattatggtcatcggcttatgaatatgctggaaaaaattgaggcgcagttcgccgcgctcagcaatgcggaacagaaagtcgcccggcagattctgactgcgcctcaggcggcgatgcactccagcattgcgaccctggcgcgcgaagcgtgcgtcagcgaaacccacggtgaatcgcttctgtcatcgactgggcgcacgcggctttcccgactttaagctgcaactggcgcagagcctggtgaaaagcagcaactgggtcagccggggcgtggaggacgatgacagtgtggagaactacagccacaaaatctttgactcggcgctggcagggctgcagcgggtgcgggatcaactggatagcgcccaactgcagcaggccgtcaccctgcttactcaggctgacaaacttgcctttttcgggctgggggcttccgctgtggtggcgcatgacgcctttaccaaatttcttcgctttaatctgccggtcatctggtcagacgatattgtgatccagcgcatgagttgcataaatagtcgagccggtgacgtttttgttctcatttcgcatactggacgcacaaaaaatatggtagaactggctcgcctggcccgtgtaaacggttccaccgttatagccatcacctctgccgattctccccttgcccatgaagcagcgatagctttagtgcttgatgtaccggaagatacggatatctatttgccgatggtatcgcgcctggcgcagttgaccgtgatcgatgtgttggcgaccggtttcaccctggaacggggtgcgcccttccgggaaaacctgaaacgcgtgaaagaggcgttgaaagcgtcgcgttacgaaaagcacaccattcgggaaaaggatgatcagtaaaaaaaattaacatcacatttacaatgtgagtcgtatcacaacccgtcgatcatatagaatagataaccatgctgtgtccacagaccagggcacgcttaaatgtttacggagtcctcgatgtcaagacgtctcagaagaaccaaaatcgttacaaccctcggcccggccaccgatcgtgataataatttagaaaaaatcatcgctgccggcgcgaacgttgtacgactcaacttctctcacggcacgccagaagatcaccagctacgtgccgataaagtgcgtgagattgccgcaaaactgggtcgccacgtggccatcctcggtgacctccagggtccaaaaattcgtgtttcaaccttcaaagaaggcaaagttttcctgaatatcggcgaccgtttcctgctggatgccaatctgggtaaaggcgaaggcgataaagagcgcgtcggtatcgactacaaaggcctgcctgcagatgtggtgccgggcgatatcctgctgctggatgatggtcgcgtgcagctgaaagtgctggaagttcaggatatgaaggtgttcaccgaagtcaccgtgggtggcccgctgtctaacaacaaaggcattaacaaactgggcggcggactctcagctgaagcgctgaccgaaaaagataaagcggatatcatcaccgccgccaaaatacgcgtcgactatctggccgtctctttcccacgctgtggtgaagatatgaatctggcacgtcgtctggcacgcgaagcgggttgtgacgccaaactggtcgcaaaagtggaacgtgctgaagcggtcgccagccaggaagcgatggatgacatcattctggcctctgatgtggtgatggtggcgcgtggcgatctgggcgttgagattggcgatccggaactggtcggcatccagaaagcattgattcgtcgtgctcgccagcttaaccgcaccatcattaccgcgacgcagatgatggagtcgatgatcactaacccgatgccgacccgcgcagaagtgatggacgtggcgaaacgccgtgctggatggcaccgatgccgtgatgctctctgcggaaaccgcagcgggtcagtatccggctgaaactgtctcagcgatggcgaaggtctgcctgggcgcagagaagatcccgagcgtcaacgtctccaagcatcgtctggacgtgcagttcgacaatgtcgaagaagcgattgctatgtcatccatgtacgccgcgaatcacctgcagggcgtcaccgcgatcatcaccatgaccgagtcgggccgtaccccgctgatgacctcacgtatcacctcaggcctgccgatttttgccatgtcacgccatgaacgcacactgaatctcaccgcgctctatcgcggcgtaacgccagtgttcttcgacagcaataacgacggtgtggctgccgcgcacgatgcggttaacctgctgcgcgacaaaggcttcctggtctctggcgatctggtcattgtgacgcagggcgatgtgatgggcgccaccggcaccaccaataccacacgtgtgctgcgcgtggattaattgagcccgggtttacattgtcggtgtagaataaacgacgcgactgccttgcagtcgcgttttcttttctgacaaggaggccagatggcccgtttccaccccatcagccagcttaccggccgaattttactctttcctctggcgttagtgctgttcgagtttgccacctatattgctcatgacatgatccagcctggcatgctgatcgtcaccagtgaattttccgtcggccctgaatgggtctccacctccctgaccgcttacctgattggcggcgtggtgctgcaatggctgctgggtcctctctctgataagtttggccggcgaccggtgatgctcttcggcatcctgttttttgccgtcgcctgcatgctgatgcactgggtcagctcgattgaagaatttgtcagcctgcgctttattcagggcatcagcctctgctttatcggcgcggtcggttatgccgcaattcaggaagccttcgatgaggcgctggcggtgcgcatgatggcgctgatggccaacgtggcgctgctggctccgctggcgggtccgcttgccggtgcagcctggctcaccattggcagctggcgcagcatgttctggctgtttgccgcctgcagcctggtcgcctttgtggtgctgtggcgtgtgatgcccgaaaccgcaggtgaccgcagtcactccatcgccctgcccaatctggcacgtaactatggccggctgatgaaagaccggctggtgatgtttggttccttcgctatcgggctggtgtttatcccgatcctcacctgggttgctctttcgccggtgatcctgatgcacgacgaaggtctgtcgcgtatgcagtacgccctgctgcagctgccggtgtttctggcgatgatcgccggtaacctgacgctgagtaagctggcgggacgcgtgccgattgaacagccggtgaagtttcgccgcctggccgattctgattggtctgagcctggcgctggtggcgagcctgatgaacagccacggctatctgctgataaccgctggcctgagtctctacgcctttggcgcgggcatggtcaatgccggactgtatcgcctgacgctctacgccagcaacgaaggcaaaggcagcgtggcagcgatgctgggaatgatcagtattatgacgctggcggtgggaattgagctggcgaaaagcggctacttcagcggcggcacgctgtggttctgcctggtcaactttatcagcggcgtgctctggtttggcctggtgatcctgtttatgcgcgagcgtaaacgtcgcagcaggctggaggcattataaacaggcagcgcagccacaggtttgccctgagcaggccgctcagaagctcaaagcgacgggagcatacgcctgtagccagcgattaagtgataagaaaaggccgctttcgcggcctttttgctatttgcgcggatagagatctttgcgcgaatagggctcgatgtcaccctctttacgggtcttcagcagcttgaggatccaggtgtactgctcgggatgcgggcggacaaacacttccacttcttcattcatctggcgagccagctgatgatcgtcggcttccagcagatcgtccatcggcggacgcacataaatctcaagcttatgcgatttgctgttataaaccgggaacagcggcaccacacgcgcgcggcacactttcatcagtcgccctactgcaggcagcgtcgctttataggtggcaaagaaatcgacgaactcactctgctccggaccatgatcctgatcgggcaggtagtagccccagtagccctggcggattgagctgataaagggcttgataccgtcgttgcgcgcatgcagccgtccgccataacccctgcgtgcggtattccaggcatagtccatcagcggatcgctctggttatggaacatcgccgccatcttttgaccttctgacgccagcagcatggcggggatatccaccgcccagccgtgcggcaccaggaaaatcacattctgctgctccgctttcatctggtcgataatttcacgaccatgccactctacacgttcacggatacgtgccggatcgcgcagcaccagctcggtcatcattgccatcgcctgcggtgccgtcgcaaacatctcatcgaccagcgttgcacgctgcgcctcgctgagtttccggcagacagtaatagaggttaatcagcgcacggcgccgtgcaccctttgccagcttaccggcgaatttgcctaaccgacccagcagcggatcgcgtactttcggcggtagcatcgccatcgcggccagaccaccaatcgccagccagctgccccagtatttaggtttgagaaaagaacgttcaaaaacgggaataaattcagtgttattttttttacgggtttccatgcactcgcctcaagcaatgaccggctaatgatagtgacgacctgaaaatttgcaatcatcctgcgccatatagcaaaaaaccgacgggaaacccgtcggtttttgcgcgatttgacgaaattcgcttacttcagacccagctgaggcagccaggatttaacctgtgccatgtaatcgctgcgatctttaccggtcaggccttccatgcgcggcagtttcgccgttaaggggttgaccgcctgattattgatccagatttcaaaatgcagatgcggcccggtggaacgtccggtgttgcctgacagtccaatacggtcgccacgcttcactttctgacctggcttcaccagcactttcttcatgtgcatatagcgcgtcatatactgacggccatgacgaatggcgacgtagttacccgcggcaccgccgttcttcgccaccactatttcaccatcacccactgccagcaccggcgtaccgatcggcagcgcaaagtcgacgcctttatgaggcgcaatgcggccagtaaccgggttaagacgacgcggattaaagttagaggagacacgatactgcttaaccgtcgggaagcgcataaagccgcgcgccagaccggagccgctgcgatcgtagaacttgccatcttcggcgcggaaagcgtaatagtctttacccccgctacgcaggcgcacacccagcaactggctttgcgcactcttgccatccagcatttcgcgtgacatcagtacgctgaactggtcacccgcacgcagtttacggaagtccatctgccactgcagcgctttgatcacggcgctggcttcggcactgctcagtccggcacgctgggcgctggcggcaaaactgccgcgcacttcgccctgcatcacgctgttgcgccattcacccttctgcatctccgcatccatcttaaagccacctttaggggtgcgctcataggtgcgggtttcacggcgggaaatttcccagctcagggttttcaggccaccatcatcatccagcgtccagctcagctgctgaccaacctgcagattacgcagatcgcggtcgctcatcaccagcgcattaatgtcactgatgtcgatgccatactgattcagggcactgctcagagtatcgccggatgaaacggtgtagtcgtgaacaccggccgtttcgggcacgtcggtgtccacatcgtccgcaggcaattcttcttccggttccggtgtgctctgatcgataggctcactggcttccggcaacagcgtgcggaacgtgttcttatccagttcgatgtttttgacgatgggcgtcacatcatccgaaggatgataaacgtaaggccgccagacagcgacggccagagtgactacagttaaagaacccagcattacgcggtgggggcgcggcaaattattaaatgcgagggcgacagagcgggctatctgctgcacttttacctattcctcatgctccattcaggcagctttcatactggctcgacagttgtgagaggaatttcacatagctgtctttggctaagctgatgtctgttcccaggggatcgagcgtgcctttacgcacctgcgtttccgcgggcgacagcatcgatgactgctggcctgaattgtggctcagcaaagacgcagaccgccttttgctcaaccaactgtgttcgtatctgatgtaaacgctgagcgcccggttgaatttcaggattgacggtaaagtgcccggtgggcgagagaccgtattgtttttcaaagtacgtgtaagcgtcgtgaaaaacgaaatatcctttatttctgaccggagcgagttgtgcgctaacgcgtttgtccgtgtccgccaaagctacctcaaactgctggaggttggcgtcaagtttggctttatcttgcggcataagttccaataattttccatggattgcaaccgcggtcttgcgcgcaatctctggcgacaaccacaggtgcatattaaactcgccgtgatgatggtgatgggcatcggcgtcctgttcttcggatttttccgctgtgtgttcatcttcatcttcactaccgctaatcaataacggttttaccccgtcgatgttcaccatcgcgaggtttttttgggccggaagttcagccgcagacttcgccataaaggcttccatttcaggcccgacccatacgactaagtccgcgttttttaagcgttttgcatctgagggccgcagggaataatcgtgttcagaggcaccgtccggtagcagaacgtcaaccggtgtgacaccatcggcaatggccgcagcgataaaccctaccggtttgagtgaagccacgacattcgcctgagctggaagggttaacgaagctgtaacggagaaagcagttaaggcgaaaattgcgccctttttattatgtaacatattgcgtcattccatcgtgaccatgaggtggaatgtgatattataacattcgaaattctgtgcaacctgtaaatactatgacctcacttgtcacactcgataatgtttcgataaagtttaaccagcgcaatgtgttatccggtgtcagcctggcactgcagcctggccgcatcctcaccctgctgggtcctaacggtgccggaaaatcaacgctggtgcgtgtggtgctgggactgctcgctcccaccaccggtagcgttcagcgtgatcccggcctgcgaattggctatgtgccacagaagctgcacatcgacccgaccctgccggtgaccgttgaacgctttatgcgtctgacccgtggcagcaaaaacgccgagatcctgccggcactgaaacgcgtgcaggcgggtcacctgctcaacgccccgctgcaaaagctttccggtggtgaaacccagcgtgtgctgctggcgcgcgccctgctgaatcagcctcagttgctggtactcgatgagcctactcagggtgtggatgtgaatggtcaggtgtcactctatgaccttatcaatcagttacgcgttgaactaaactgcggcgtactcatggtctcccacgatctgcatctggtgatggccaaaaccgacgaagtgctttgccttaaccatcacatctgttgttccggcaccccggaagcggtatcgcagcatccggaatttatcgccatgtttggtccgcgcggcgcggaggagctggcgatttatcgtcatcatcataatcaccgtcacgaccttcagggacgtatcgttttacgcaaaggacagggtcgatcatgattgagttgttattaccgggctggataggcggtgtgatgttagcgctggctgccggtccgctgggatcgtttgttgtctggcgcaagatgtcctatttcggcgataccctggcgcatgcctctctgcttggcgtggcatttggcctgctgtttaacgtgaatccttactacgcggtgattctggttacggtctgcctggcgctgggactggtctggctggagcgtcgtccacatctggctatcgataccctgctggggattatggcgcacagcgcgctgtcgctgggcctggtggtggtcagcctgatgaagaacgttcgcgtcgatctgatggcttatctgtttggcgatctgctggcggtgacgccagacgacctctggatgatgggtggcggcgtggtgatcgtgctgctggtgatggcgtggcagtggcggtcgctgctgtcgatgaccatcagcccggaactggcacaggtggacggcgtcaatatccagcgtacccgactgattctgatgctggtcacggcactgactatcggagtggcaatgaagttcgtgggtgcgctgatcatcacctcactgctgattatccccgctgcgactgctcgtcgctttgtgcgttcaccggaaggcatggcggccgtcgccgtggtcatcggggtgattgccgtcaccggcggcctgaccttctccgccttctacgacacgcctgccgggccgtcagtggtgctctgcgccgccatcctgtttattttcagtatggtccggaaaccagcagtctagttactcttcgcgcgtgatgccgaagtgacgataagcgtgctgcgtggccatccggccacgcggtgtgcgctgaatgaagccctgctgaatcaggaagggttcaatcacatcttcgatggtttcgcgctcttcaccaatggcagcagccaggttatccagccccaccggcccacccataaatttgtcgatgatcgccagcagcagtttacggtccatataatcgaacccttcgctatctacgttaagcatatccagcgcgctgcaggagacttcaccgctcaggtcaccatttgcccgcacttcggcgaagtcacgaacgcggcgcagcaagcgattggcaatacgcggcgtgccgcgggcgcgacgggcaatctctaacgccccttcgtcactcagcgccagacccagacaggcggcgctgcggcccacgatgtgctgcaaatctttaacctggtagaactcaagccgctgcacaatgccaaaacgatcgcgcagcggcgaggtcagcgagccagcacgcgtggtggcgccaatcagggtaaacggcggcagatcgagcttgattgagcgcgcagccgggccttcgccaatcatgatatccagctgataatcttccatcgccgggtagagtatctcttccaccaccggtgagaggcgatggatttcatcgataaacaggacgtcatgcggttcaaggttggtcagcatcgccgccaggtcgcccgccttttccagcaccggacctgaagtagtgcgaagattaacgcccatctcgttggccacgatgttcgccagggtggttttacccagtcccggcggaccgaagatcagcagatgatcgagcgcatcgccgcgcagttgcgctgccttgatgaaaatctccatctgctcacgcacctgcggctgaccgacatactcggtcagcatcttcgggcgaatagcgcggtcaataacctcttcttcgctgatactggcagcggagatcaggcggtcggcttctatcatgacttacctcaaatggcggcgcgtagcgcttcgcggatcagggtttcgcaatccgcatccggtcgaccgactttactgatcatacggctcgcttcctgcggtttataacccagtgataccagcgctgcaaccgcttcggattccgcatcattggtttccggctcggcgctcggcgtggtcagcgtaaacgcagaatcgccgccaaacaggtcgccgtgcattcctttgaagcggtccttcatttcgaccaccagacgctcagccgtctttttgcccacgcctggcagtttcaccagtgacgcgatctcctctttctcgacagcggtcacaaactgctgcgccgacatgccggagaggatcgccagcgccagcttaggtccgacgccattcactttaatcagttcgcgaaacagcgcgcgctcctgcttgctgttaaaaccaaacagcagctgagcatcttcacgcaccacaaagtgggtaaaaatcaccgcttcgtgctgaacttcaggcaactcataaaaacaggtcatgggcatataaatttcatagccgacgccgtgtgcctcaagcagcaccagtggcggctgcttttccagaatattgccccgtaaacgacctatcacctgaaacgcttccttaactaacgaatgtggcggattttataacataaaaaaggctggatgaatatccagcctgtgagtgcggcctgagcgatgacggctaacctgatcgtaaccgtccgcgcgtcagcaccagcttactgtcactcatgcgagccgcattctgagccacatgacagtgcgtaatggcaatcgccagcgcatcggcggcatccgcctgcgggttcgccggtagcttcagcagggttcgcaccatgtgctgcacctgacttttctcggcgctgccgatgccaaccacggtctgttttacctgacgggcggcatactcaaacaccggcagatcgtggtttaccgcggcaacaatcgcggcaccacgcgcctggccgagcttcagtgcggagtctgcattcttcgccataaacacctgttcaatggcgaagaagtcgggtgaaaactgcgtaatgatttcacagacgcccgcataaatcagcttcagacgggcgggcaactcggtggtattagtgcggatacagccgctgcccagataagtgagctggcggccagtctgacgaataacaccataaccggtgatgcgtgagccgggatcgatacccaggataatcgacattacgcctctttggttaaagtgattacggtagacgccattacagcgtttccgctacctcgtcggagatttcaccgttgtgatagacctcctgcacatcgtcgcaatcttccagcatgtcgatcagacgcagcagtttaggtgcggtttccgcatccatttcggctttggtggtcgggatcatcgccacttctgcagtgtccgctttcaggccgagcgcttccagtgcatcacgcaccgtgcccatctcttcccatgcggtgaagacatcaatcgcgccgtcgtcatagctgaccacatcttctgcgcctgcttccagagccgcttccatcaccgcatcttcatcctgacccggcgcataagagatcacgccttttttgttgaacaggtaagccacggagccgtcggtgccgagattcccgccagttttggtgaaggcgtgacgcacttcgcccacggtacggttacggttgtcactcaggcattcaatcatgatggccgagccgccaggaccgtagccttcatagatgatggtttccatgttggcattgtcatcgccgcccacaccgcgcgcgatagcgcgatccatggtgtcacgcgtcatgttgttcgccagcgctttatccattgctgcacgcagacgcgggtttgagcccggatcgccgccgcccagcttggccgccgtcaccagttcacgaatgattttggtgaagattttgccgcgcttggcatcctgcgccgccttacggtgtttggtgtttgcccacttactgtgtcctgccattttaaattttctccgatcttttacagggtgcaggctatcctgcttgcgagcctgtttaccgtccgtacgcatacaggtgactgacaacctgaatgccccgagggcgagcgtcgcgaagcatcctcacgtacaaccgtacgctgacgacgtcgcgcgggcggtgaacaacctcacggtgccgattacgcctgactgttcaatatgttggtgaagtcctgttaaaactcaccagattcataaaatttaatctttccgccgccggaataccgggcgatggcgagcattcagataaattcttcaattgcctggcggttactccatgatcgggttaatgctgcagcgtcagcgggtgccagccagcgaaacgccagatgctcggtgagcatcacatcgcgctccgtcggcagttgcaggcgaaaccagtgctcgtgattatgagtgacatcaggggcgtagcgatggcggaaatggggaaagatttcaaagtcgatctgacgctgacaatcctccacctccagccgctcggccagcacgtcgatgccgatttcctcattcacttcacgacacgcggtcgccagcggtgactctcccgcctccaggctgccggtgaccgactgccagaaacgtgggatcgtcacgccgctgcagcatcaacacccggccagtatcgcgcgccgaaatgacgaccagcactgaaaccgggtgtttatagcccattatttattctcaggcttttcttttttaacgacctgaatgccgagctccagcagggaagccggattagcttcgcttggcgcttcggtcatcatgcaggcggccgccgtggttttcgggaacgcaatgacgtcacgaatattatcggtgccggtcagcagcatggtcagacgatccagaccaaaggccaggcccgcatgcggtggcgtaccgaacttcagcgcatccagcaggaagccaaacttctcacgctgctcatgctcttcgatacccagaatgctgaacaccgtctgctgcattttgccgttgtggatacgcactgaaccgccgcccacttcataaccgttgatcaccatgtcgtaggcgttcgccacggcacgggttggatcggcggccagctcttctgcgctcatctcttttggcgccgtgaacggatggtgcatcgcagccagaccgccctcttcgtcctcttcgaacatcgggaagtcgatcacccatagcggtgcccaggctttctcatcagtgatgttcagctcgcggcccactttaagacgcagcgcacccagtgcatccgcgaccactttggcgcgatcggcaccaaagaagataatgtcgccatcctgagcaccggtgcggctcagaatgccttctacaatctccgcattcaggaatttggcaaccgggctctgcacgccttccaggccgtcagcacggacgttaaccttcatccacgccagacctttggcgccgtaaatctccacgaacttgccatattcatcaatctgcttacggctcagctgtgcgccggtcggtacgcgtagcgcggcaacacggcccttttcatcgttagccgggccagagaagacctggaactccacgtttttcagcaggtcgccgacgtccaccagctccatcgggttacgcagatccggtttatcagaaccgtagcgatgcatcgcctctgcaaaggtcatctgcgggaactcgccgagatcaacgccctgcacgtcctgccacagattgcggattaaacgctccatgatttcacgcacctgtggcgcggtcataaaggaggtttccacgtcgatctgggtaaattctggctgacgatcggcgcgtaaatcttcgtcgcggaagcatttaacgatctgatagtagcggtcaaaaccggacatcatcagcagctgtttaaacagctgaggtgactgcggcagcgcatagaatttgcctttatgtacccggcttggcaccagatagtcacgcgcgccttccggcgtcgctttggtcagcatcggggtttcgatatccaggaaaccttcgtcatccataaagcgacgaacgaagctggtgatttttgcgcgggttttcagacgcgtcaccatctcagggcggcgcagatccagatagcggtacttcaggcgcgcttcttcgctgttggtctgattcgagtccagcggcagtggctcagagcggttaataatagtcagtgcctgggcaaacacttccacttcaccggtcgccatgtcgctgtttttgttcttctcatcacgcgcacgcacggtaccggtgatctggatacagaattcgttacgcagttcagaagccagcttaaatgcgtcctggcgatcgggatcaaaaaacacctgcacgatgccttcacggtcgcgcatatcgataaaaatcaaactgcccagatcgcgacggcggtttacccagccgcaaagcgtgacttgctgacccacatgagacagattgagctgtccgcaatattctgtacgcataacactatccttttaacttcgccgctgcatctgacagcatccggccgcgttacctgttgcgatgctgtcgcaaaaatggcggtcattataatggaaaaagccagacaggataagcagatccgcgccaaagcgccgatttcctctgtgcatttgccccccagcctgaccatagcggataatggggtatcttaatctgcagccaggagcgcgcgtgacacttcgtattggcctgccccagtggcagcattcacactggaaacgctggggtatcgaaagcctggcggactatgcccgctatttccattgtgtagagggaaataccacgctctatgcgctgccgaatccggaaacggtgatgcgctggcgcgatatgacgcacgatgcgtttcgcttctgctttaagtttcccaataccatcagccatcaggcggcgctgcagcacagcgatgacctgctgaccgatttcctgcgcctgatggagccgctggccgatcgcatcggtcagtactggctgcaactgcctgccagcttctctccgacgcagctcgacgacttgtggcgctttctcgacagcctgccgcgccgttttcactatggcgtcgaagtccgccatcctgctttcttcgctaaaggggatgctgaacgggcgctgaatcgcggcctgctggcccgcggcatcaatcgcgtgatgctcgacagccgtccggttcacgcctctacctcgcaaagtccggccgcgctggtggcccgcgcgcagaagccccgggtgccgcctcatgcattgcgaaaccggctcacagccgatggtgcggtttatcggcagtgacagcgtggaagagagcgtgccgctgtttcagatctggcgtgacaagctgacagaatggcagcaacagggcgacgccatgctgtttctgcacacgcccgatatgggccaggtctttccgctggtgcaggcgctctggccgcagctgcagcagatcgaccccggcataggtagcggaccggactggccgcagcagacgtcactgttttgattcctgcccaggacagcgggctgcacgcccgttagaatagaagcattatggacagtcgcaggggtggctatggttagcgcgttatatgtggtgatgggtgcattactggtgatgaaattcacgctggacgtggtccgctatcgccgattctaccgtgtggcgtatggcgatggcggctaccacgacctgaaaatggcgattcgcattcacggcaacgccatcgaaaccattccgctggcgctgtttctgctggtaatgatggagatgaacggtgccgatatctggatggtgcatcttacgggtctgctgttctttatcagtcgcctgctgcacgcctggggtttgcgcagcagcgcaatggcaggccgcaaatatggcatgctgctgacgctgttttccctgtgcggcatggtgatttttaacctgatctatatgccgtgggaactggtgctgacgctgcattaagctggcctgggttaaggggtgcagcccgccccactttctgcgagaatagcgccctttccgtcgtctcttcggattttcgatatgtctgaccgcgatcaactcttctcagcgcccattgcaaaactgggcgactggacttttgacgagcgtgtagctgaagtctttcctgacatgattcagcgctcggtgccgggctactccaacatcatttcgatgattggcatgctggcagaacgttttgttaccccggacagcaaggtttatgacctgggctgctcgctgggcgcggccaccctgtcggtgcgccgcaatattcaggtgccgggttgccagatcatcgcagtggataactccccggcgatggtggagcgctgtcgtcgccatcttgatgcgtttcgcgcggacacaccggtaacggtgctggaagcggatatccgcgacattgagattgagaacgcctctctggtggtactcaactttacactgcagtttctggaaccgcctgcgcgtctggcgctgctggaaaagatctggcagggactgaaaccgggcggcgcgctggtgctgtcagaaaaattcagttttgaagatgccgaagtcggtgagctgctgtttaacatgcatcacgacttcaagcgcgccaacggctacagcgaactggaaatcagccagaaacgcagcatgctggaaaatgtgatgctgactgacagcgttgaagctcataaagcccgtctgaaacaggccggtttctcgcacgccgaactctggttccagtgctttaattttggatctctggtggcgttgaaatgatcgactttggccgtttttatcagcaaattgcggtgggaccgctggcgaagtggctggaagtgttaccggcgcaaatcagcgagtggcagcgtgaaaacctgcatgggcacttccgcgactggtacaagtcgctggagtatctgccgctgctggagcctcaaaaacttgacctgctacacagcgttactgccgaccgcgatgacatcagcgatcgccatcgtcagggtattgagaaattactgcgcaacctgatgccgtggcgtaaggggccctatttcctttatggcacccacatcaacaccgaatggcgatctgactggaagtgggagcgcgtgctaccgcacatctctccgctggccggccgcacagtgctcgatgtgggctgcggcagtggctatcacatgtggcggatgattggcgcgggtgcccatctggtggttggcatcgatccaatgcagctgttcctggtgcagtttcgaagcggtgcgtaagctgctgaacgacgatcgccgggcgcatatgctgccgctgggcattgagcagttaccggtattgcaggcgttcgataccgtgttctcgatgggcgtgctctatcaccgccgttcgccgcttgatcacctgttacagcttaagaatcagctggtcagcggtggcgaactggtgctggagacgctggtgattgagggcgatgtgaatcaggtgctggtgcccggtgagcgatatgcgcagatgcgcaatgtcttcttcattccgtcagctgaagcgctgaaaagctggctggaaaaaagcggctttgtagatgtccggattgtcgatttcgccctcactaccactgaagagcaacgccgtactgactggatgaccagcgagtctctggctgaattcctcgatcccgatgaccccagcaaaacagtcgagggctatccggcgcctctgcgcgccgtgctggtcgccaccaaaccgtaatgccctagcggcgagacaacgccagtttcgccgcaaatcctataaacacacagccggtcaggcgatccatcaccttcagcacccgcggtttgcgcaaatgaccggcgaaatagtggctgccgccaatcagtaccgcattccagatcagccccagcagcatgtgtgccagcgccatcagactacaccagagcgccaccgacgcccccgccgggataaactgtggcaaaaaactcacatagaagatccccactttggggtttagcagattgcccagcagcccgcggctgaagcaggcaagatagccctgctgcagcgacggttgttgcgtgtcgattgctgtttggcggggtttcagcaacaatttcagccccagataaagtaaccaggcggcacccagccacttaagcaggttataggccatttcggaggccagcagcagcgcgcctaatccgaatcccaccgcaacaccccagaccagacagccgagcgtgatacccagtgccgtcacgctggcgcgctttgcgccctgagcgactgcagagcgcagcaccagcgcggtatcaaagcccggcgtcagcgtcagtatggtgatggcaaacagaaatgaaaacagcgtggtggtcatggcgtttctccctggaggtaacagccggtcagcagcgtatgggtgtcctgccagcgtaacaggcccgtcgaattatctcacccttgtcactctccctgttcgtcagcgtgtgccaggctaagggcggtttaacttcatattaaggagctgtgattatgagtaaatttatcttctcttcaccccgtaaatatgtgcagggcgcgggcgtgctggacgagctgggcccctacgtggccgaactgggtgataacgctttcctggtcgcggatgatgtcgtctggaaattgattggcgaacgcgcccaacaggcgctgcaaaaggcgggcgttaccttcaactggcacccgttcaacggcgaggcgtcgagcaatgagatcacccgcctgagccagctggcaaaaagtcagggctgtaatgtggttgtcggactgggcggcggcaaaacgctggacaccgttaaggcggtggcggatgagctgaagcagccggtagccatcgtgcctactatcgcctccactgatgccccctgtagcgcgctgtcggtcatctattctgatagcggcgtatttgagagctatcgcttctacagtaaaaatcctgatttggtgctggtggacaccgcagtctgcgccagtgcaccagcacgactctttgcctccggcattgccgatggactggcgacctgggttgaagcgcaggcggtggcgcgttcgcattcaaaatcgatggtcaatggtgatccgacaattgccggactggcgattgcccgtgcctgtgaagaaacgctgcttacctggggttacagcgcctatgttgccgtcacccaaaaacgagtgacgcccgccgtggaagcggtggttgaggcgaatacgctgctatcagggctgggttttgaaaacggagggctggcagctgcgcacgctattcataatgggttcaccgcgattgatggtgatatccaccatctgacccatggcgagaaagtcgcctacggcacactgacgcagatggtgcttgagaagcgtccggatgaggacattgcgcgctatatccgcttctatcgctcgatcaacatgcctaccacgctccgggaactgcatctggaaaatgagagctgggagaatctggtcaaagtgggtgcactggcgaacagtgagggcgacacgctgaaaaaccttaatccaaacctttcaccggaagatattgcaaacgcactgctggcgctggatgcctttagtcagacggttaaataaccacccgaaaggcgatcatccgatcgccttttactccgccgccgctggctggtcccagtactcatatttataggcggaactgagatggcgctcaatagtgccgcgcgtgaagatttcggtctcgtgcagatagctcagggtacagttacccacctgatcccaggactgacactcatctactgaccggatggtgctcagcggtgtggtcgccgtgccgttgagccgcacttcacgccattggggatcgtaggtataactgtcggtgctgcgggccgatgtggtgcgggtcaccagaccttgcggattccagtggtaatgattttcaccgttggtcaggggatcgctgccgcgtgccacgctcttctccagccggaactgccgatcatagcgataagtcgtgtcggtaaagccgcttttacccatactggtaaacctgtcggaggcgctggtaatgttgccatgctgacctttctgccagttaatcgtcccctgtcggttatcgaccaccacctctttgccctctttcagcacttttaccagatacgcatattccgccacccagccgccctgcacccgggcaatgtgttgctccatgctgagaatcacgttgcgctcacttttgtcatagctgacgtcggcaaccgtcagatcgccacaggcgtcaaactgccccagtacccgcttttgcgaattcacatctttaccaaactcgcccgcaaccacctgcttgaccgcgcctttcgcattcccgcccagcaaaatcaggttattgctgttagccacagcagcgttgtttgggctgcatgcgctggccgcagcgctgccactgcagagagcagtcaggatcagagtcaggacagcaatcggattgggtttcataggatacttttccaggcgacgttgctttcagtgtaaacgctgcggtgatgaacagcggcaatctgtgaagatttcagcctgcatcgccttttaaggttttaaggaccggagaggcgacacggcatcagcataacgaataaagcaggtgattacgttgctgccgggcctgaaagtcctggatgacatgtaatgattaataaggggcaggtgatttttatcgagccaggcgaaagagtgataatttcgctgcagccagatttagatccctctgacatcaataacatgccagagaagcgcaaaacaatttaaccgggacggagtgtgttttacacaaaaagaaccccagcaaggatactggggtttggtacttgcaaacaccacgtcaatgatcggcgtgctgcgcggcaaaatctgttgtagttcaggcgacccgaacggtgctcatctgcatcacgcttttcatcgcctcaaccacatcgccgtctacacagtagcggctgaactcgtcagtctcggcttctgaacacatggagacccccgctttacggtagcgcatcggcgacgcgacaaggcggctggccgagctgtgaacttcatcaatccccatgtcgagaaacttttgcaggttgctgagacgtaccccagcacccgccataataataggaccggtgctggcctcatttagttccctgagtaatgcaattccgttttcagcgctctgctgctgaccggatgtcagaatacgcgccacacccaaatcggttagttcttccagcgcacgcttagggctgtgacagagatcgaaggcgcgatgaaaggtcacggccaggccgtcacacagcgccataatctgccgcatctgaccatgatgaatgtgagcatcttcatccagcatcccaatcaccagaccaggaaaaccgagttcacggattaacgccacatccgatttcattgcttcaaattcgcgtgcggtgtaacaaaaatcgccaccacgtggccggacaataggatgaaccggaatcgaaacttcttgcctggcggcattcagcatccccgctgatggggtcaggccgccttcacgcggtgcggcacagagttcaacccgatcggcgcccgcctgttgtgcggtcacagcgcaatccacgccatagcagcaaatttccagtgtggtcattctcttctcctttacatgactctggttcaaggcagattcatcagttagtctggctgctggaatgagtttaccgggaaagttaactatggcattcaatttcgaccaacggatagaccgtcgtcacagcgatagccttaaatggaacaaatatgcggaccaggacattctgccgttgtgggtggcagataccgatttccgatcgcctgactgcgtcatcgatgcgattaaaacccgtgccgaacatgggattttcggctatggcgacacgccagttgaatttatcgatagcgcgatagcctggctcgcctcgcgctatcagtggcacgttaatccggaatggattgtggttttgccgggtgtcgtaagcggtctgaatctggcagtgcgcgctttcaccgcgcctgatgagctgacgattgcgccaacacccatctatccgccgtttcgcggtgcagcaaaactggcagagcgcggtcagatcacgctgccgctgacgctgcaacagggacgctggcgactggatctggatgcgccggaaggtcagctggacgataaagcgcggctgttaatgctgtgcaacccgcagaatccgggcggcaccgtctatcgccgcgaggaactgcaggcgcagctggaatttgcgcagaagcacgatttgattgtctgttctgacgagatccacagcgatctgctgctggaacccggcgttaagcacataccctttgcttcactgagcgaagatgcagcccagcgtagcgtgacgctgatgtcgccctcaaagtcctttaatattgccggtcttggggcttccatcgccatcatccccaacgccgggctacgcgcgcaattcaaccgggtacgacgcggcattgtgccggatgttgatattctggcactcacggcagcagcagcggcatggcgcgagggtgagccctggctgaatgcgcagaatgcctatctgcgcagtaaccgtgactggctggtgtcgcaggttaataagatgaccggcctgtcactcgcctcgccggaagcgacctacctggcctggatcgacgccagcgcgctgggtgtggccagcccggcgctctattttgaaaagcacgggctgggcttaaccgccggacgtgagtttggcaatgaccagtttgtccggctcaatttcggctgtacccgcgcgctgctcgacgaagccgttgcgcgcctgaagcgtgcgttagccgcccgcctttagttctgttcgctggcgacaatctcctccagtcgccacggatggaacttgattgtcgtctgcccatccgtaaccgccagggtcggattgggcaggcgctcattctcgccctgtggtgaactggttttaaatgagatacccggctgcgtcagcgcctcatctgacagcaaggccatcgcgcgcacgcccagcgtctgatgatcgccgcgtaacaccacctcaatatgctcccagccttcatggcgataacgcttttcacccggccatggcagttcaaccacatcaatctgcctgcctgcgacaatcagcgggtcatggagtttaaacaggcaaatcttcctgccattgatcatcgccgccgaaaactgcgtgccaatctgctgcaaaccttgctgccagcgcatcgccgttgtgtcctgatggcaccgcacggcgatatggtccacctccagatcggtaaggtgcaaaccgagccgctgcgcaaaactttgcaacgattcttcaaaacgtcctaaatctgtctttaaatcatccaattctgccggaaaagatctcttcaccaccccacttcctctcaatttgtttagcatttataacccgcctgccttttggcgcgccgcgtgctgagcatcacataatgataagattcatcttatttggcccgaaatttaacgctaatcctcataataacatctttcatttcggatttatctcctgtttagggccatgagttccttgatgaaagcatgttaaatatatgatttatatcaacttctttaatacaataagataactctcatttacctggcaaacaattgcagcccaccccgccttcctataaatttgacctaacacaaccaaaaggaatggctctatgtctatgctcatcgttgtcgctgtcctgatcgcactgatgggatttgcaatctcccgccattggaaggtgcgtgaagataaaagcgtaaagaacccacgccgtcatctgcgacgtcgttaatgcttcagggaaacatctgttaagctctgtttccccgcttcatccaactgctgacgcccactgacatttcacgtatacttttcccctcatttttttccgttttgtctgccccatccgtttctgcctctccgtgacgcgatgcgctcaggcaagatgatgacagcccggctttctggtccgggcgttgctcagcacatgaaggtaactcggtgaatattcaggcacatctttccgcaaaagtcagtcaggcaatggttttagccggcgcacccgccgattgcgaaccccaggttcgtcaatccgcccgggttcagtttggagactatcaggccaacggcattatggccgtggcgaaaaagctgggacaggcaccgcgacaattagcggaaacggtgattcagcacctcgacctgaccggcatcgccagcaaagtcgaaattgccgggccgggcttcatcaatatcttccttgaccacaactggctggccagtcatgcccgggaagcgctgcgtctgccgcgccttggcgtgcagctggccgaaaccccagactatcgtcgtcgactactccgcgcctaacgttgcgaaagagatgcatgtgggccacgtccgctccaccatcattggtgatgcggcggtgcgtacgctggaatttctcggccataaagtgatccgagcgaaccacgttggcgactggggaacacagttcggtatgctgatcgcgttcctggaaaagcagcagaatgaagatcatgcagagatggcgctggccgatctcgaaggcttctaccgtgaagccaagcgcacttatgatgaagatcctgagtttgccgagcgcgcgcgcagttatgtggtgaaattacagggcggcgatgactattgccgccagatgtggaagaaactggtcgacatcaccatgagtcagaaccagaaaatctatgaccgcatgaacgtcacgctgacgcgcaacgatgttatgggtgaaagtctctataacgatatgcttcctggtatcgtctccgatctgaaacagaaaggcttagcggtagagagtgaaggtgcgaccgtggtgttcctggatgaattccagaacaaagagggtgaaccgatgggcgtcatcatccagaaaaaggatggcggctacctttacaccaccaccgatatcgcctgtgcgaaatatcgttacgaaacgctgaaagccgatcgtgtactctactacatcgactcacgtcagcatcagcatctggttcaggcctggactatcgtccgtaaagcgggttatgtgccggaatctgttccgctggagcaccatgcgttcggcatgatgctgggcaaagatggccgtccgttcaaaacccgcagcggcggcaccatcaagctctccgatctgctggatgaagcctatcagcgtgcctacacgctggtgcgtgagaagaacccggagatgagcgaagcggaagtgaaaacgctggcggaagtggttggcatcagcgcggtaaaatacgccgatctgtcaaaaagccgtaccaccgattacattttcgactgggacaacatgctggcgttcgaaggcaataccgcgccttacatgcagtatgcctatacccgcgtttctctccgtgttccgcaaggcgggcattgatgccgattcgctggatgcggagattgtgatcagcgaagagcgtgaagcgcagctggccacccgtctgctgcagttcgaagaggttattacgcaggtcgctcgtgacggcacgccacacgtgatgtgtgcctatctctacgatctggctggtctgttctccggattctacgagcactgcccgattctcaccgcagaatcagacacaacccgtctgagccgactgcagctggccgcactgaccgcgaagacgctgaagcagggtctggatacgctgggcatcgacaccgtcgagcgcatgtaatctctgaaacggagaggggtttccctctccgttgctgaattcgtatatccgctctgatcccccaaatcttcgcagcaggatggtgttatgtctgtagccgcgcacctcatcagcagccaccttcccacgataaaacagttgcagtgctttctggctgttgcgcacgagctgaattttcgccgggccgcagaacgtctcagcatgacgcaacctccgctgacccgtcagattcagagtctggaagatctgctgggccactcgctgttcagccgcacgacccatgaggtaacgctcaccgattctggccgtgcgctggtcgcgaaggcggaagcgatcctgactgcgctgaatgccctgaagcaggatgcgcagcccgccgcggcacggctacgcatcgggctgacccgcacgctgaactttgaactgattgcgccacttaaccggcagctcgccgcttttcatgccagcgaagagatggagatgccccgcctgacctcccctcagcttttgcaaagcctggccaaaaacactctggatttaatactcaccggagaaaaggggtcggatgcggaagacaccgttcagtacgcctgggtttaccgtgagccgctgctgattgccatgccgtcggcgcatcctgccagtgtggcggagcaggtctcgctggaagcgctggccgatctgccgctgttctggtttgcccgcagcgccaatccgctgtttttcgataaatgcgagcgctacttcgccacgctcagcgtcacgctgaaacgggtgagagagccggacgattccctgctgatgctgtcacacatcgccagaggaaaaggattcgccctgatgccgcagtcaaaatgcacctttaatcagacagggctctgttaccgcccgctgacagaggatgcggcgcagcagctggcgattgatgtttacgcggcgattcgcgccgatgaaaaaaatgaggcggttcttaatgcgctgagagaactctctcatcccgggtatgcgataaagtccgcatgatgccgtgccgctgaaacagagcgaagcaccaccacactcttcttccttgttaatccccgctcagcctgttgctgagagcttactgtgtcgacacgccggatggatgtctgaagccctttcattcgcctgataccttttttgcatgacggaaagagcaattcattgctttcacgcggagtgaaacaatcgcgtctcacatacgaggagcgacaatgaaaaagcgaacgttaactcagggtctggacgtcagcgcaatcggctatggcgcgatggggctcagcgaattttatggtcagaccgatgaccgtcattccctgcaactgctcaataagctgcgcgatctggatatcacctttatcgataccgccgatctttacgggcgcggtcacaacgagcagttgataggtcagtttcttgccgggctcaatcgggccgaacggctgaagttcaccgtggccaccaaatgtggtattgaacgccctgctgatgcggcctatgcccgcaccatcaacaatcagccggactacattacccgctgctgccatgcatcactgaaacggctaggcgtggagcgtatcgatctcttttatctgcaccggatcagtccggcgacaccgattgaggagagcatgcagtgtctcagccgtctggtgcaggagggaaagattgcccggattgggctgtgtgaagcatcggcttcaacgctgaatcgggcgcaggcgatccatccgctggccgcgctgcagacggagtattcactctggacgcgtgacatcgaacaagagattctccctatggtgaaaaagctcggtatcggactggtgccctattcgccgctgggcagaggattcctgacgggtaaataccgtaaaaacagcgattttgccgagggtgatttccgcaaaaataatgaccgtttccggcaggaaaatatcgatcacaatctccagcttcttaacgcggtgacgccactggctgagaaatatcacgccaccaccgggcagattgcgctggcctggctactggcccagtatgacaaaattgtgccgataccgggcaccaaacagatcgcttaccttactgaaaacgcgcaggccgcagatatcgagctggaagaggaagatatcgcgatgctgaacgctgttcatcagcagattgaggttaaaggcggtcgctactctgaggagggaatgaagggggtgaacgcctgaatacaaactacgcacttgcgcactgtgcctcggtgcgctagtcaattcagcaacgatacccttactcgtaattgaccatcacttcactgctcaccacccgtaatccgggtggcagcgccccgcttccggcgaaaccaaacaccatgtgcagggtctcactggcgctcagatgtgccagcccgcgcgtggtgccgcttgccccctccagggaagtgcagcgctgttcgccgcacaagcgcacctgcaggccggacggggccggtctgctcagctgataacgccagttaataacgctgacctccccgccaatgtcggcgggcggcgtcagcggctgcgcccgttgccagctgccgcggttcgccagcagcggcccattggccgtggcactccaggcaccaccggccgcctgcgccatcagtggcagcatcacgaatgccatcaccagccagcgcattatttacctccgatggtggcagtcatacggatctgacggttgtcgctcagctccagattagagagcaccaccagctgtggcagattgcggcgcaggaaacgcgccagcagcgcacgcagcggatgattgaccagcagcaccggcggcgcgcccagcatctcctgacgctgtaatgccgcctgtgcctgacttaacagccgatcggccagacccggctccagtccgccaccgccctgcaacgcctgtaacagcaggcgctccagcgtggaatcgagcccgataacctgcacttcgtcattacccgggaaccactgctgagtaatcgcacggcccagcgccacacgcaccacgctggtcagctcctgcggatcgctctgcaccggcgcatgttccgccagcgtttcgataatggtgcgcatatcgcgaatcgacacccgctccaccagcaggttctgcagcaccttgtgcagggtggtcagcgagatcactcccggcaccagatcttcggtcagcttcggcatctcctgagtcacacgatccagcaactgctgcgcttcctgacggccaaacagctcgctggcgaactggccaatcagatggttaaggtgggttgccaccacggtactggcttcaaccacggtaaagccctgaatctgtgcctgctctttcagcgcgctatcaatccagaccgccgccagtccaaaggcaggatcaacggtcgcttcgcctggcagacttccggcagccgtgcccgggttaatcgccatccagcggccaggataggcatcaccgctgccaatctccacccctttcatcaggatgcgatagcgtgccggtggcagctccatgttgtcgcggatatgcactaccggcggcaggaaaccgacatcctgagcgactttcttacggatactgcggatacgtcccagcagctcaccgttttgctgatgatcgaccatcggaatcaggcgatagcccacttccatgcccagcgtatcttccagctgcacatcggtccacgacgcttcggtggcggctggcgtatccgccgttttggcgatgccgcccgtgacttccactttcttcttcggctgtatttcgcggccgcgcagccaccaggccagacccagtaaggcggcggtgaacagcaggaagacgaagttcggcatgcccggcaccagaccgagcagaccaatcacgccggcgctcagcatcagcacgcgcggatctttgaacagctgggtgaccatctgttcgccgacatcctgatcggtggcaacgcgcgtcacgataacaccggctgcggtagagataaccagcgccgggatctgcgcgaccagaccatcaccgatggtcagcagcgtataggtctctgcggcatgacccacatccataccgtgctgcaccacgcccaccagcaggccgccgatgacgttgattaccatgatcataataccggcgacggcatcaccacgaacgaacttactggcaccgtccatcgaaccgtagaagtccgcttcctgggtcacttcggcacggcggcgtttggcgtcatcttcaccgatcagaccggcgttgaggtcggcatcgatcgccatctgcttaccgggcatcccgtccagcacaaagcgcgcgcccacttcggcgatacggccagcacctttggtgataaccataaagttgatgatgacgaggatgataaacaccacgataccgatggcgaagttaccgcccaccaggaagtgaccgaacgcttcaaccacctgtcctgccgcggcggcacccgtatgcccttccatcaggatgatacgggttgaagccacgttcagcgccagacgcagcaaggtagagaacagcagaatggtcgggaaacgccgcaaactccagggtccgctgggtgaacatcgccaccagcaggatcatgatcgacagcgcaatgttaaaggtgaacagcagatcgaggatgaacggcggtaatggcagaaccatcatcgacaggatcatcaggatcagtaccggcccggccagcacctgccactgcatatctttaaagttgcccggtaaacgtagttttgcggccaggttattagccatcgtttttgctctctcctgcaaagtccatctctgccggaaccggcaggttttttggtttggttggtatcaggccgccttcgcgcttccagcgacgcgactgccagacccacgccagcacctcggccacggcggcatagagcgcgccgggaatgtgctgaccaatttcagtatgtcggtataacgcacgcgccagcggcggtgcttccagaaccgggatgcggtgttcggcagccagttcacgaattctcagggcgatctcacctgcgcctttcgccaccactttcggcgcactcatcttcttctcgttgtactgcagtgccaccgagtagtgcgtcgggttggtgacgatgacatcggctttcggcacatccgccatcattcggcgtcgcgctgcggcgcgcatctgctgccggatgcgccctttaacgtgcgggtcaccttcctgctgcttatgctcgtcgcggatctcctgcatcgacattttcagctttttaaagtggctgtgcagctgccagaagacgtcatatccgaccatcgggatcagccccagcatcaccagcgaacagcagactgcgatcatctccatgccgtgaatcagcgcggtgacgggcgcttcgctaatcagccgcagcatctcgggccagtggctccagatgtaccaccagcccaccgagccgaccagaatagtcttaaggatgcctttaaacagttcggtccaggcctgcgccgcaaacattcgcttgaacccagccatcgggctcatcttcttcgggtcgaacttgatcgatttaccgctgaaaacgataccgcccagcagcatgggcgcggcgattgccaccagcaccagaccgcccatcaatggcagcagcgccatcagtgcctgcgtgatcaggctgccgatgtggctgacgataattttgtcatctctgaccatgccgtggtcaaaacggagtccggtggcgaccatcgccgccagccggtgcgccatcatgttgccgcccatccacaggatcatgatgccggccagcagcatcagtacggatgtgagttcgcgcgaaacgcggaatctggccctcttcacgcgctttctcaagtcggtgggccgtgggcgattctgttttgtcttcgtcgctatcttcagccacgacaaacctcggttggcaggaattctgagcataggatgccaaatctggcttaagttaaagcggagataagatggagaaaacaggcgttctttcggggatgggtctgacaatgcggaacggggccacccgaaggtgaccctgtttattataacctgcagctgtttcgcccgcccgcaggcggacgaaacctagaaccctaagctgtccagcaggtcatcaacctgatcctggttcgccaccacgcccggtgcatcggcgtgaatctgcggaccgttcagcaggctggtgccttcctgacgcttctcagcgctgacttctggcatattctccagcagcaccattaacagctggcgctcaatttcctggatcacatccatcatgcgcttgatcacctgaccggtcaggtcctggaaatcctgcgccatcatgatttcaagcagctgcttgttggtaaaggcggtatgctctggcacggcggtgaggaatgcgcgcgtatccgtcaccaactcccgcgcatcacccagttcaatcgggttctcaaaccactcatcccaacgccctttcagctgggttgccccggcttccatcttatcctgatggggttgtgctgcttcaacacagttcaacgcacggtcagcggcctgcgccgtcatctgcacaacataatccagacggtcgcgggcatcaggaatggcttcagccgcatcggctatggctttatccagccccagctcgcgcaggctgtcgcgcagcatgcgcgtcagagagccaatacgtgaaatgatgtcgtgtgccgcggcatcctcagttggtttcggaaagtcgctcatcacatccccttacatgcccagtttttcgaaaattttacccagcttttcttccagggttgccgcagtgaatggcttcacgacatatccgctggcaccggcctgggcggcggcgataatgttctctttcttcgcttccgcggtcaccatcaacaccggcagcgaactcattgccgcgtcggcacgaatggtctgcagcagctgcaggccatccatgtttggcatgttccagtcggaaatcacgaagtcgaaaccacccgctttcagtttgccgagggcatccacaccatcttccgcttcttctacgttattgaagcccagctctttcagcaggttacgcacaatacgacgcatcgtattgaagtcgtctactaccaaaaagcgcatgtttttatcagccatatctactcctgagttgtctcgcccggcgggacgggcctgttaaatacgcaatgcctgtccggcgctaattttcgccagcatgtgctggctgatgttgcttaaatccacgacttcgctcacgccgcctgtggcaatggcctcacgcggcatgccaaataccacacagctggcttcgtttctgggcgatagtccaggcgcctgcccgatgcatttccagcatcccggcggcaccgtcgttgcccatgccggtgaggatgacccccaccgcatttcgtccggcgtaagttgccaccgatttaaacagcacatccacagagggtttgtgccggttaaccggtggtccttcattcagtttcaccacatagttggcgccacttcgggccagctccatgtgcattgcgcctggcgcgatgtaggcatgacctggcagaatacgctcaccatcttcagcttctttcaccgtgatctgacacagcttgttcagacgctcggcaaaagagcgggtaaagcctggcggcatatgctgggtaatcagcagtgccgggctggtcgccggtaacggctgcagcacatggcgaatcgcctcggtccccccggtggaggagccaatcgcaatcagcttctcactactcagcagcgggcccgctttcagcgtcgccggcaccggcatcgctgcacggttgtgcagtcgggcacgggaggctgcacgaattttgtcgccaatcatctgactgtaagacagcattccttcgcgaataccgagctgtggcttggtgacaaaatccaccgctcccagctccagcgcgcgcagggtaatttcagagcctttcccggtcagcgatgaaaccatcaccaccggcattggccgtaaccgcatcagtttttccaggaaatcgaggccatccatgcgcggcatttccacatccagcgtcagcacctgcggattgaactgcttaatcaaatcgcgggcgaccagcggatcgggcgccgtagcgaccatctccatatccggatggctgttgatgatttcagtcatcaactgccgcatcagcgcagagtcatctacgcacatcacggtgattttgctcatcatctttccttcgtcagtccatagacggtttgcccgcgcagccagaactctttactgatctgactgaagttttctgagtgcccggcgaacagaatgccgcccggcttcaggagcgggacaaaccgacgcagaatcttctcctgcgtctctttatcgaaatagatcatcacgttgcgacagaaaatagcgtcgaactgacccggcagcgcccagtcattggccagcaggttaagctgcgcgtaagtgaccatattggtcagctcgggacgcgcccgcaccataccggcatgaggaccggtgccgcgcaggaagtagcgctgcatttgtgcgggtgacagcgtgcgcagctcctcctggcgataaacacccgccaccgctttttccagcacctgggtgtcgatatcgctggcatgaacctggaacttgcccggtccggtgcccagtgcttccgccagcgtcatggcgatggagtaaggctcttcgccggttgacgctgcggtactccagacgctgaagttgccctgtcgcttacgtgcatgctccgccagaatcgggaagtgatgcgcttcgcggaagaacgcggtcaggttagtggtcagggcattgataaacgcctgccactcggcactgttcggatcggactccagcagcgccaggtagcgaccgaaatcatcgatattcagcgtacgcaggcgacgaaccagacggttgtaaaccatctcacgcttgtgatcggccagtacgataccggcacgctgatagatcagctggctgatacgacgaaaatgcgtatcggagagcggtaaacgctgcaccatttgcgacagcagcgttgtcgtctcattttgatctaaaattgtcgattttttcatctctgcacctggcccgaactcaatacattatttgtctgctgcgatgcccggcggctcaatagcggccgggccacgggcgtttaaaaggtttcccagttgtcgtcgctgcgggtagcaggcgaacgaccaacggctaacggtgcatctgactggagagttttcatcgccgttgtcttgttaacggcctgagcgacaaattctttaccaatattgaacactgataccgcttgttttaagtgacttgcctgatcttcgagcgctgcagccgctgccgctgactcttcgaccagtgaggcgttctgctgggtgacgcgatccatctcggtcacggcaagccccacctggtcaatgccacggctctgctcgtctgacgctgaggcgatctcacccatgatgtcggtgacgcgggtgaccgcgctgacgatgttgctcatggtgtcaccggcgctctctaccagcaccgagccggtattaacgcggctaaccgaatcttcaatcagacctttaatctctttggcggcctgggcgctgcgctgcgccaggctgcgcacttcaccggcaacgaccgcaaaaccgcgaccctgttcaccggcacgcgccgcttcaacggccgcattcagcgccaggatgttggtctggaaggcgatgccatcaatcacactggtgatatcggcaatctttttggaactgccggcaatttctttcatggtggtgaccacgccatccaccactttgccgccctgctgcgcggtttcagaggcggtcagcgccagcttggacgcctgacgggcgttttcggcattctgcttcacggtcgcggtgagctgctccatgctggcagcggtctgctccagcgaagcggcctgctgttcggtacgcgaagagagatcgttattgccgatggagatttcgctcgcaccggtatagatggcatcagagccgtctcgaacggttcgcacggtacggaccagctcctgctgcatgtgctgcagcgaagtcagtaactccccgatttcgttacgcacgctaatctcaaccggctgggtcagatcgccccgtgcgatgtgctggatatgctcaatgctctgacgcagcggacggatcagcaccgagcgcatcacgttccacaccaggataatcatcagcaaggtcactgccagcgtggcgataacgatagtgatggagcgggtatacgcgtgctggttggcttccacaccctgctgagacagcgctttattgtgctcaagccactcgctgtaatctttctggaacttgtcctggtagctctgggtcggctgatccacaaaacctttgaaattgccggcagtgaagaagaccatcagctccgccagcgcatcgtgataggccttgtagttcgcctgtaacgcccggacgttttcggccgttttgccttcttctgacaggttatcgttgaatatctgatagctgacttcagcctgcttcagctcctcgcccgccagggcgaccagctctttcacgctggcacccgagcccgacatctgtgcatcctgcagaaaacggataccggcgcggttaagggtattgcgcgcctgaaccagcgaaacccatgaggtgcccatcgcctgttgcagagtattcaggcgttggttgtaggcaaaattctctttatctgaactgacagttttgaaaaacattccgccggaaaacagctgcagcagcgcaaacagcgccagcacacacagcaggccggagacgactcgtactcgactaaacataaacacctcattggttggcgattcgtgtgtatttatcggcggagacggggggaactttatgcatggcgacggctttacgccgccgccatgttgaaagaggaaaaaatcaggcgcgggaaattttgaaaacggagacggcctgggtcaggacgctggcctgctgctccagtgcggccgcagcggcggcagactcctcaaccagcgaggcgtttctgctgggtcacgcgatccatttcagtcacggccagaccgacctgctcgataccgcggctctgctcatcggaagccgaggcgatctcacccatgatgtcggtaacgcgggtcacggcacccacaatctcattcatggtgctgccggcgctttcaacctgcagtgaaccgctgttgacgcgtgacaccgagtcttcaatcaggcctttaatctctttcgcggcctgggcgctgcgctgggccagactgcgcacttctccggccactaccgcaaaaccgcgaccctgttcaccggcacgtgccgcttcaaccgccgcattcagcgccaggatattagtctggaaggcgatgccgtcgatcacgctgataatgtccgcgattttcttcgagctgccggcgatctctttcatggttgtgaccacgccattcacaactttaccgccctgctgcgcggtttcggaggcggtcagcgccagctgggatgcctgacgggcgttgtcagcattctgcttcaccgtggcggtaagctgctccatactggcggcggtctgctccagcgaagcggcctgctcttcggtgcgggccgacaggtcgttgttaccggcggcgatttcgctggcaccggtaaagatggcatcagagccgtcacgcacattccccaccgtcatcaccagcgactgctgcatctcatggatgcctgctgccagctggctcatctcattacgcccctcaaccacaatcggctgggtcaaatcgccggaggcaatagcgcgaatctgtgccagcagctgttgcagcggctgaatcagcacctgacgcaggccaaaccagcaggtaataatcaccgcaagcaccgcaacaccaatcgcggccagcagccacatcatctgtttaaaggctttctggttctgcgccattccctgatcggaaagctcagtctgacgcgcacgccatttgttgtaactctcctgcatcgcgacctgtttctgctcaatgttctgtttaaacatcccttccaggtcacgcgcctgcagactttttaccatcgccttcaggccgttttcgtagttagcgtaatccgcttcaagcgtgtcgcccatggtttcgtcaagacctgacgtggttggcagatggtaatagattttaaagtggcgatcggcttccgctaactgggtattggctttgttgatcagctcatcaagctgaccaccgttcatctgcgaggccatgctggtctgtaagcgcagcatgccgcggttcagcgtggtacggctgttgttcagtgaaatataggcgtcagtcatctcggtgacattgcgattggagacctgcgacagcgcaaaggactctttgtctttattgagggctgaccagaaaaggctgccagcgactaactggagcgcgccaaagatgaccaggactgcgattaaactggtcaccacttttattttttttaacatcttgttcccctgcaggttaatttaggtgcagcggctatatcggcgatgtaacaggattaattaacgctattcagcgctttcaggagagaagtggcttttgtaattatttttatcagcatgagctgctgagtttggctttacgcagaggaatcgcgaggggttgctgcgcatcccgcaggatgcgcagcgtgacatcagaaggtttcccagtgagtatcactgaccggtgccgtcagggctttgcgtggtgccagcgccgccgtagcgggtgcggcaatcggcaaatgctttgtcagcgtctgctgcaaggcgccgcgtttaattttgaagaccgacactgactgacttaaccggctggcctgatcttccagcgaagcggctgccgcagcggactcttccaccagcgaggcgtttctgctgggtaacgcgatccatctcagtgaccgcctgcccgacctgatcgataccgcgactctgctcgtccgacgccgaggcgatttcacccatgatgtcggtgacgcgcgtaaccgcactgacgatatcgctcatggtttccccggcggtgccgaccagttgcgaaccgacattgacccggttcactgagtcatcgatcaaccctttgatctcttttgccgcctgggcgctgcgctgggccagattacgcacctcgcccgcgaccacggcaaaaccgcgaccctgctctccggcacgcgccgcttcaacggcggcgttaagcgccagaatattggtctggaaagcaatgccatcaatcacgctggtgatatcggcaatcttcttcgaactgccagcgatttcgctcatggttttcacgacacccgccaccacgttgccgcctttttctgcggtttctgaggcgctgagtgccagctgtgacgcctggcgggcgttttcggcgttctgtttcaccgtggcagtgagctgctccatgctggccgccgtctgctccagtgacgcagcctgctgttctgtgcgggcagaaagatcattgtttccggcagagatctcgctggcaccggtgaaaatcgcatccgagccgtcacgcacattggtcaccgtgcgcaccagtgactgctgcatgtcatgcagactggccgcgagctgagtcatctcattgcgcccttccaccacaatcggctgggttaaatcgccctgggcgatatgctggatgtgattaatgctgctgttgaggggtgtcatcacgattttgcgcaatccaaaccagcagagcacgatcacggcgaccacgacggccatgatggtgcagaggatccacatcatacggctgtaagcagaactgttctcttcaacaccaagcgtagtcaggcgattctgatcggctcgccattcacggtaaaccgtcagaaacgtactctggcttggcgccaccggggctttaccggccgcaatcagatcgtttgcctgtagcgccgtctgcaactgatccagcgcagcgccatagtcgctgtagcgctgctccagctggttgtttaactcactattctgtcccggcgtatcgggtgtctctttaaagactttgaaaaaaccggcggccgcctgctgaaagtttttgctgtcgtcaaacagcgtggcgacatcggccgttttgccttccagcttactggtggcgaaacgcagctgaatacgggtcagcagcacccggctctggttaagactcatataggcgtcgttgagcgactgcgtattttgcatcgccagctgcgacacggcgaagctttgcttgtcgtggcttaatgcggagtagaaaacagaaccggagaaggcctgtaacagcccaaacaccagcaacaccagtaacaggctggtgacaacacggattttcgttaacatgagtaaccctgaagaaagtaggtaattaaagtgactgagggattatcggcaggtgacagcgggaaattagagtgcaatgcggctttattctatgaatagaaaggaattatcgctcagtgaaactatcacgggccagccataaccggcccgtaatgattcaattacgcgctacgcaggttatccaccagcgccatctcgtcgctgctcagcagcttctcaatgtcgaccagaatcagcatgcgatcgcccagcgcacccagaccggtcaggtactcggtggacatggtcacagcgaactctggtgaaggacggatctgatcctgggtcagcgacagcacatcagagacgccgtcaaccacgataccgaccacgcgattttccagattcagcacgataaccacggtgttttcattgtactcaacatcgggctgcgcaaacttcacgcgcagatcgataatcggcacgattacgccgcgcaggttagtgacgccgcggataaattcaggggtatttgcgatacgcgttacctgatcgtaaccgcgaatttcctgaactttgaggatatcgatgccgtactcttcgtcgcccagcgtgaagaccagaaactcctgacccacagtttcgccagcgatttttgtcacggttgccattccattcatgttatttaccctttcgttatcaatcaggcggcagcgccagccacacgtttttcacggttaagtgattgcagtgctgaaacatcaacaatcagcgccacgctaccatcgccaagaatggtggcggcggagatgcccggcactttgcgatagttactttccaggttcttcaccaccacctgatgctggccaatcagctgatcgaccagtagcgcgtaacgtttgcccgcgctttgcaggattaccacgatgccctgagtggcctcggttttggcatcctgcacatcaaagacgttccacagctcgaccagtggcagatattcgccacgcacttccagcacgcactcgccaccggccagcggtttcagctcttcggcgcgcggttgcagcgactccatcaccgcattcagcggcagaataaagacttcatcggccacacgaacggacatcccatcaaggatggccagggtcagcggcagcaggatacgaatggtggtgcctttgccctgcttcgaggcgatttcgacgtgaccgcccatctcctgaatatttcgtttcaccacgtccataccgacgccgcgtcctgaaacatccgtcacctgctctgcggtggagaagcccggtgcgaagatcagcatgccgacctcttcgtcgctcatgttctcgtgaaccggcaggcccgatgagagggctttagccagaatacgttcacggttcagaccggcaccatcatcagacacttcaatgcagatgttgccgccctgatgttccgctgaaagcgtcaggttaccggttgccactttaccggccaccagacgtttctctggcgtttcgataccgtggtcaagactgttacgcaccaggtgcgttaatggatcgatgatgcgttcaatcaggctcttatcgagttcggttgagctgcccagcagcgtcagttcgacctctttgccgagtttgctggccaggtcacgcaccagacgcgggaagcggctgaagacatattccattggcatcatacgaatcgacatcaccgattcctgcagatcgcgggcgttacgctccagctgacccatgctgttcagcaggtcgccgtgcgcgaccggatcgagttcgccggaacgctgagcgagcattgactgggtaatcaccagttcgcccaccaggttgatcagctgatcgactttctccaccgcaacacggatgctggtggattcgctcgatttggcaggggccgcgacgcgcttactttcacgcttcactgcggccaccggcagttcggtgacggtggcggtgtgaacgtcttccaccaccggttcggcctcggctgcaacagcagctggcgcgacaacggcttcgtctgctgccgggaagcggatctgtgcttcgtcgatgacgaagcagagcaccgccacgatgtcatctttaccgacgccatcaatgcagacatccagcgtagtgctgcctttctgtacgttggtcagggtgccgagattactcatctcttccagcatcagatcgacctctttctctttgagatcgatcagctgtacacgcaggccgctggtgctggccggtttctgcgctggcagtggcaacactggccggaacatcaaccggcagacctttggcctctagcgccagctggcgcagcgcttcacagatatatttgaagctctccgcgttaggctcctgcgcggttttataagcatcgagctgttcctgcataatatctttggtttccaaaaacaggttgatgatgtcggtgctgagctgcatctcgccgcgacgagcaccatccagaatgttttccaggatatgagtcgtttcctgtaataccgtaaaaccaaaggttccggccccacccttaatggagtgagcggcacggaagatggcgttaagctgttccgaatctggctcctgcgggtctaagcccaacaggtgttgttccatatccgctaatagctcatcggcttcatcaaaaaacgtctggtaaaaatcgctgatgtccatactcacgggaatcacctcggctgtgagggggctgctgtattcaccgcgccgcctggtgttgcaggtgcggtaatctgttcaatggccgccggatcgctgatctggacggcatcactttctgcgttctctttttctattgccgcttcggtgtcgtggttcaacaccagcaggctgatgcggcggttaacggcgtcattaccgccacgatttttcaggcgcatggtgtcggccatacccaacacccgtaaaatttttccgctgtctaagccgcccatcaccagttcacggcgtgaggcgttagcacggtctgtcgacagttcccagttgctgtagcctttgtcaccgctggcatactgaaaatcatcggtatgtccggccaggctgatgcggttcggaatgtcgttaaggactggcgctatcgcacgcagaatgtcgcgcatatagggctcaacctcggcccgaccggtcttaaacatcgggcgattctggctgtcgataatctgaatacgcagcccctcttcaaccatgttgatgatcagatgcgggcgcagcgctttcagacgcggatccgcttcaatcagctggtcgagcttttcacgcagccggttaagacgaatctcatccagcttgcgtttctgggcgtccatatcgacgactttgttcacttcgccaatctttttggtcggatcatcaccgccgccggggatcgggctctcgctgtcgctgctgcgcgccccgccggtaatcgctaccttcagcggtgttttgaagtagtctgctatctgcaccagctcctgcgggttggcgattgagagcagccacatcaccataaaaaaggccatcatcgccgtcataaagtcggcgtaggcaatcttccacgatccgtggctgccttcatggcctttatgtttgcgctttttgatcagcacaattgggcgattgccgtgtttcatgaagcctcgtctgaagtctgtttagccgggttcttggcgttacgtacgtgctcttccagtttcgctgaacgacgggcgctcggcggaatagagcgtcttacgaccaaattccaccgcaatctgcggcgcgtaaccattcaggctcgacagcaatgtcaccttaatgcactgcatcatcttggtggtttccgcacacttctgacgcagcactgacgagagtggagagacaaacccgtaggccagcaggatgcccaggaaggtgcccaccatcgcatgcgcgaccagcgcaccgagttcagcggctggacgatcggccgaagccagtgcatggaccacgcccattaccgcggcgacgataccgaatgccggaagaccatcacccactgcagcaatactttgcgctggtacgtcacactcgtgttcgtaggtctcaatctcttcatccatcaacgcttcgatttcaaaagcgttcatgttgccgctcaccatcaggcgtaaatagtcagtaataaaatccactaactgtttatcggcaagaatgcggggataattagcaaaaatttcactctggctgggatcttcaatatcacgttccagcgataacataccctgctgacgcgacttcgccatcaggcgataaagcagcgccatcaaatccatgtaaaccgctttgttgtacttggagccgcgaaataacttaggcagcgccttcagcgtttttttaatcgacttaccgttgttgccgactaaaaaagcaccggcaccggcaccgccgatcattaataattcggctggctgataaagcgcgcccagatggccacctaccagcgcatatccgcccaacacggagcctaaaacaatcaggtaacctataattatcagcacaaaaaaatccttacgtccgtaacgtgttggtggaagttaagccagagagccgcagatgttattcctgaaccgcaagcaaaaaaaaagcagcggtattaaccgctgctggatggcttccacagtgcgaacaaacttaaacggcgtgtttaacctgttcatccagcagttgtggaaacatatcggcaggttctgcagaaagtttacgtctttttactgcccgtgatggtggctggcacaggctgcaggtaaagctgccaaccggctgatgcgcatgattaataaagctgccgttgcagcttttacaatctgccagtttccagcataccgctatcaacgaatcggaccagggtccaggcacgagtcagcgccaacagcgggccctcgtccgattgaggacactgttcaagatacaggcggtaagctttaatcacggcatcgacgccgctgcacaacccggttttcagcaaaaacttccaggcgttacagaacatagaagcatgaatgttctgctcccacgtcataaaccagtccgtagagaacggcagcatacctttcggtggcggactgccacgtaattctttatagagcttgatgagacgaccgcggctcagttgggtttcgctctcaagcatctgtaagcgggcacctaatgtaatgagctccatcgcgagatgaatatcacgtgcttcctgaacaatacttttctcactcatgacattgctctctttttagcaggtgcatcatctttagacgcattacgcagtaaacggctcgataataaaatgccggtgtggatttgttgtaaatcatccacgcgtgattcctgcgtcaggcgattaatggtgctgctatcggtaaaacgaaactggcaaaccagttgattggtttccgccatttttaccatctcaggcaatgttaattcagataatgcattcgccattttctcgtcaattccgaggcgaaacattgcagaagctttatcctggttaattaaacgctgcgcaagcagtaaataagacaagttgagatcgtaaatatgtttcagtacttcagaggtgcccattatttttccatcctgagagatgcgacgtaactgtatcgcagaataaatctgcggttcgagctgctgtttgttaaatcaaaagatggcaaaaaaaacttcacgtaacgttaatgtcaccgttttcgccttccatttttgtgtgggtttcagacccaccgaaggtcgaaaatccatgccattttattttcgagttctggacatcttccgtgacgtcttcttacattttttaggactattccgaaaacaacgcaaatctatatcgtctgatttcgacatacaacgacagtgatgtgaaattttagataaagtgtgacgcagatcacacttttaacgcaaatttcttcagcaaccctttaccattacttaccggctggtcattttttgagcaaaaaagtccgattttaagtccaattggtcctgagaaaggtttaatagggggtaaaagcatcgctattcgacgctttgcgcagtccggaatgaatatcgggtgttaatcgttttaacaccctatttagaaccacccaaagaaaggttatcagcatattatgctgctgcgacgtgcggttatttgcttttaaattagttacttaaggggagtatcgcagagggtgagtaatgaaatcgttaaggtttatacggcagcaggtcagatttctggcaacctgacgttaacagtggtggtggggtgtacagactctgattcccactgtaacaaggggttatataagaaagtcgaatgaattaacgaagggttatgcgttggcactatcactatcggcagcctgaagagaaacttgagtaaagaaggtaaagaaagcggcaggggctgacaggacggggatttccgggcttacctgcatttatcgggccactccgggcagccactgacgttatcagcgtagaatcgtagcaaacggtcattaacagatagcaggcgagttttctgtgacctgggccgaaaaaaaagcagcgacgccgtagaggcgccgctgctttcataaccctgagtcagaacagatatcaggcgagttttgggaaggtcgcgactttattaaccgtgttgtggtcaacgctgcgcggttcaatgcgttccaggtctttcaggaagccttcacgccaggcggtaatatcatttttacgcaataccgccatcatgtcgttgtagcgtgaaatcctttcggtacgcggcatagtaatcgccttatccagcgcggcggccacttcatcacggtcatacggattcacaatcagcgcggaggtgagctcgttagccgcacccgcaaagcgcgacagcaccagtacaccgggatcatcagggtcctgcgcagccacgtactctttcgccaccaggttcataccgtcacgcagcggcgtaaccagaccgacatcggtcagacggaagattttcatcagcagtcgacggtcaaaatgctggttaaggtagtagagcggggtccagcccagcgtaccgtatttaccgttgatgcgccctgcttcggtttccagctgatgacggatatcctgatacgcctgcacatcgccgcgcgaggtcggtgcaatctgcgagtagcgaattttgccgcgatgctgcgggaagttttccagcagcgcttcataggcaagaaaacgctcaggcagacctttggaatagtcgagacgttcgcaggcaataatattgcgtgcatcgcccagctctttcttcatggcggccatttttggtggcagcggcccttcggccatctctttaatactgtctggctcaatcccgatgggataaacctcagtcataaaggtgttgccaaaggcgcgatgttttttgtcgcccttattctgcagctgagtgagctggctgacgctgtcgaggaaggccacccgatccgattcggtctggaaacccagcaggtcatattcgcacagcatttccagcaactctttgtgcggcggcagcgcattgaatatttcaggcgtcgggaacggaatatgcaggaagaagccgatgcggttattaatgcccgcccgacgcaacgcggctgcaaacggtaaaaagtgataatcgtggatccagacaatatcatccggcttgatcagcggttttaaacgctgtgccaccgcatcgttaacgtcgcaatacccttcccaggcttcccgctggaactgaaccaggtcaaggcgataatggaatgcgggccagatgacagtgtttgagaactggcaatagtagagatcgtaatcgttctggctcagcgggaacgaggcatactcaataccttcatgttcctgaaccgtgacttcttctacctcttcgcctgtgtactcgctgatttcaccgttccagccaaaccacagtccaccggtgcttttcagtgcatcgagaataccgacggccaaaccgccagcgctggtttttgacccatcgggcatggcgacacggttagaaacaaccactaaacgactcataacctaaactccttaccgacgttgtcttgatctgatagtaataatgttctttccagccagccgtaaaccgcatcgacatcatgaagccgataatgggcttgggtggaaccttctccgactttgatcgagacgccctgccgtgcgttcacggccagaaagcccttctcatccgtcagatcgtcgccaataaagaccggcgtacgtccggcaaaagggggctgctgcataaagtcgctgattgcggcgcctttatcgatacctgccggtttaatctctaccacacatttccccggctgaagcgccagtccgggaaaacgtttcactgactgttcagccagtcgcatcacatcctgctcatgctgcatcgcctggcggtagtgaagagcgaaagccatgccttttacctccagctgggtgccaggccaggatgccatagcattctgcaattccgccctgagcgattgctccacctcgaccggcaggctgatgcgttgcagattaccctctgcatcacggcgctctgcaccatgtacgcccgcagccgggccgtaccagggagcggccagcgcatcgagttgttctataggtctgccggagaccagcgccagcgcgccctgcgagagtgcagagagctgctgcagttgcgcgatgacctgctcaggaataaataccgcttcgggacgggactgaatcgctgccagcgtgccgtcgacatcaaaaaagaaggcgtactgcccgccgcttaatgtcgggtacctggcatgggtgtctgccgcttgggtcacgttacttctcctgaaaatcgaattttaataaaacattgagttaaaacaagaatgtcctgacgcagtcaggtcagcaagcgggaaattctgataaagcggtgattgagggataaaacgcggtaacgggataggtcactctcctcaaacttgcaagcgcattgctgacaatactggctaactgagaacatcttcacagtaagtgtagtcattaacaggggttatgccagaaagatgcaggtttcatgccagccgctgcggttaagtcagcataaaagcaccattcaattctgcttcgcttctgatgttcaggccggacacgatccgctgctgactggagtcacgcacgtatcgcacccggcagagtcggccccccccaaagcttaaggctcttaaggtattcctaatattgaaagcgcattctcgtgacacttttattactctggttcctgctcacatggcgtttaccctgaagaggccgctgattagccgccttacgttgctgattctggctgcggtttacatcgcggttttccttaacgttgcctattaccgtcaggtgctggcggtgatgccgctgaacgacctgcacaccacgctggtctttttatcgatgccgctggtcgcctttagcgtgatcaatatcgtgattacgctggcctcgtttatctggctggatcggctgctggccgcgctgtttattctgctctccgcctcggcacagttctttattcacacctataacatcgtggtcgatcgctcgatgatcaccaacatgatggataccacagcctcggaatcctttgcgctgattacgccacagctgcttgtaaccctgctcacctcgggcgtgctgatgacgttgctgctgttctggccgcgaatcaaaaatcagcagtggcgtggcgtgctggcgcgactgctcagcgtattgctgtcagcggcgctgattgtgctgatcgccctgctcttttataaagattacgcttcgctgttccgtaacaaccgcgaactggtaaaagcgctgagcccctctaacagcatcgcggcgacgctctcctggtataagcatgagcagttgcagaaacgcgccgctgatgcgtatcggtgaagatgcgcacctgcagcccagccgcagcagtggcaaaccgaatctgacgattctggtgctgggcgaaacctcgcgagcgcaaaatttctcgctgggcggttatggtcgtctgaccaatcccttgctggcgaaagatgatgtgatctatttcccgcacaccacctcgtgcggaacggcgacggcagtttccgtgccctgcatgttctccaacatgccgcgcgcccactatgatgatgtgctggccgcccatcaggaggggttgctggatattattcagcgcgccgggatcagcgtgttgtggaatgagaacgatgggggctgtaaaggggcctgcgaccgcgttccgcatcaggacatgaccagcctgaacctgcccggcatgtgtattgatggtgagtgctacgacgacgtgctgttccacggtctggatgattacatcagtcagttaaaaggcaacgcggtgattgtgctgcacaccattggcagtcatggcccgacttacagccatcgctatccgccacagtttcgtcagtttgaaccgacctgcgacaccaaccagattcaggactgttcgcaacaacagttgatcaacacctatgacaatacgctggtcaatgtggatcacatcgtcgataaagccattaacgtactgcgtgcacatcaggaccgcttcaccaccagcctggtctatctgtctgaccatggtgaatccctgggtgaaaatggtgcttacctgcatggcctgccctatgctatcgcgccggacacccagaaacatgtgccgttgctgatctggctctccgatgattatcagaaacgttatgcggttaatcgcggctgtctgaataaactggcggcgacagacgatttttcacaggataatctgttttcaaccatgctgggattaaccggcaccgcgacccacgaatatgtgcctgcggatgatattttgacgtcgtgtcggagccaaccttaatgaagatactgattgttgaagatgatgccctgctgctgcagggtctgatgctggcgctggaaggggaaggctatgtctgtgatggcgttacgcgggtgcgggatgctgaagcgcatttcgccagcggcctgtatagcctggtggtgctggatcttggcctgccggatgaagatggactgcattttctgatacgactgcggcggcagaagaagatgacgccggtgctgatcctgaccgcacgcgacaccatcagcgaacgcattgccggactcgacgcaggcgcggacgactatctgatcaaaccgttctcgcttgatgagttgctggcgcggatccgcgccctgattcgccgccacgtcaatcagggcgacagtcatgtcagagtgggtgcgctggcgctggatatgacccatcgccagattacgctcagcgacgtgctgctggatctgacacccaaagagtttgcgattctgtcacggctgatgctcaaggccgggaatccggttcaccgtgaaattctctaccaggatatctataactgggagaccgagccttctactaataccctggaagtgcatatccataatctgcgcgacaaaatcggcaaaagcgctatccgcaccgtgcgcggttttggctatgcgctggtgacgcaggatggcattcgtgaggcaacatgataagacgtttcgatcatcgcagtatgcgctttcgcctcatcctgaccatcggtctgatcctgctggttttccaggtgatcagcgtggtctggctgtggcatgagagcaaagagcagattcagtttctggtggaagcgcagctgcagaagcgcaacatggacagtcacgttaagcgtgaagtgcatgaagcggtagccagcctggcggtgccaagtctggtgatgattaccctgacgctgctgctctgctatcaggcggtgaagtggattacccggccgctttatcagctgcagcgtgaactggagagtcgcagcgaagagaatcttgatcccgtcgcctgccacagtcaggttcaggagatcgatgcggtgacgcaggcgataaaccagctggtcgcgcgtctgaacagcagtctggagcgcgaacggttattcactgccgacgtggcacatgagctgcgcacgccgctggcgggattgcggctgcatctggagttaatcgaacgtaacagcgatgtcaaagttcagccgctggtgcagcgcctggatcagatgacgcacagtgtgtcgcagctgctgaatctggcgcgcgccggacagtcctttacctctggcacctatcagaaacgtggggctgattgaagatgtgatcctgccaatggaggcagagctgagtattatgctggaggcgcatcaacagacgctggtgctcgatctgccgcaggagcagtttgtgcgtggtgatgccacgctgctgaagatgttgctgcgtaacctggtcgagaacgcctatcgctacagcccggataacagcaccatcagtgtgcagctggtgttagctcctcagccgatgctggtggtggaagatcagggcccgggaattgatgagagtaaaagtggcgagctgagtaaagcgtttatccggatggacagccgctacggcggtatcggactcgggctgagcatcgtcagccgcatcgtccagttacaccggtttcagtttttcttagagaaccgccgcgaccgaagcggttgtcgtgccgtggtgaagttttaagcgctgaaccaggcggagaggaacagaacgaccgtggctgcggcaatcagcagtgcagcatattcactcatcggacgcggagcagtcacagacagggcaacaggagcagttttcatagcatcatcctcagttaaagcaggcagtatcgcgattgcatattaaggaaaccttaagctcgcgacactgccgctaaaaatgtctgcgctgccagacgccgccatcaacctcgcatttctgcccgctgacacgcctgctgcatccgcccggtgctctacacttaatggctacgttccgtttcaggagttacgccatgagccaacgcatgcacaaatatgcttttccggtcagcaaagcccgcaaataccttgaacccggaccggtgctgctgctcagttcgcagtacggagatcaacatgacatcatgacgctcggctggcacacggtgctggagttttctccgtcactggtcggctgcatgattgccggtatgaaccacagccatgagctgatccgcaacagcggtcagtgcgtgctgaacattccttctgcctcgctgattgatgaagttgtggcaatcggcaacagccacggcgacagcattgataagtttgaggcctttggcctgacgccggaacccgctcaggtggttggcgcgccgatgattgccgaatgttttgccagctttgagtgtcagctttatgacgattcgatggtcgccaactacaacctgtttatttttgagattgttaaagcgcacgttgccgagcagccggaataccccactaccctgcactacactggcgaaggccggttcagcgtgatgagcgacaaaatactggataagagcggcgattttaaaccggagatgctgatctagttgaaagcgctctgccgcgcccccattcacctctttcgacctgacaggagtaaattattatggcaatcgaatacgcagttatcgctggcggctgtttctggtgtaccgaagcggtatttaaggatgtgatcggcgtagagtcggtggaaagcggttataccggtggtgcccgtcctaatccgacttatgagcaggtctgcagcggtgcgaccggtcatgcagaagcgatccgcattggcttcgacccggagaaagtcagctttggcgatctgctggatatcagctttgtgacgcatgatccgacccagcttaaccgtcagggtaatgatattggcacccagtatcgttccgccattttcccggccaatgcagagcaggaagcggaagcacgcgccgccattgcccgcgctcaggctgaccatgatgtgccggtggtgaccaccattgagccgctgaaagagtggtatcccgctgaagcttatcatcaggattactgggaaggcgcgggccagcgcaacggctactgcatggcggtcattccaccgaaattgcagaagctgcgtaaaagtttcgctaacagagtaaagagctgattccggcatcagtcggggcagcgtctgaccagtaacgagggtgagaacgccgccccggtttatttgctgccataaaactcacctgaccgggctcatcaggatgacgggatgtggccggtaaaacggcgggttttatgccgcagtaaatcgattcgttcagagcttaagcgaatagatcaaaagagaaaaatagtgcttgaccgttttcaaccgactccctatagtaccgccccgttgacccatcgcggtcagcgaagtaaatctggtgaggtgtccgagtggctgaaggagcacgcctggaaagtgtgtatacggcaacgtatcgagggttcgaacccctctctcaccgccatcttcaaagaagagcctgaaattttgttcaggctcttttttttgcatatttcactctgaaagagcgtgataactcccgccggggaacgaccacgttgcgcagtcgctgccccacaataagaaaacccggccggagccgggtttgggcgctacacttctactcaatcaaacgctagctatacgcgtgcagggtgcgctgacatagcgcagaacgcacacaatcttctttgccgaagcgtacaatgccaaccatctcgtcctcttcgaaacgcgccagcgcgtctgcgagaccggaaggcaccccagcgggcaagtcgcactgggtaatatcgccgttaacaatgaccgtgacgttttcgcccagtcgggtcaggaacattttcatctgcgcggcggtgacgttctgcgcctcgtccagaattaccacagcattttcgaaagtgcgaccacgcatataggcgaaacggtgcaatctctaccttggcaatttccggacgcagacaatattgcataaaggatgcgccaagacgtttaaccagaatgtcataaaccgggcggaaataaggcgcgaatttctcagaaatatcgccgggaaggaatcccagatcctcatctgcctgcagtaccgggcgcgtaacgataatcctgtcgatatccttattaatcagggcctcagccgcttttgcggcactgatccaggttttaccgcacccggcttcaccggttgcgaagatcagctgttttctctctatggcgttaagatagtgcgcctgagcttcattacgggcttcaatcggcaaccggtcacgcgtatcgcgcgccatgccaatggcatccagtccactcatatgcaccagcgaagtgaccgactcttcttcacgctgacgatgacttcttgagtcactacgaagcactcttcttgcttcacgacgcgctttgatcactgctttctgtcttcccatagtggcacctttcagttggtttcatttcctgcgtcaggccggtggcccgttgcgataacgtgaacgctttagaggtttcagttggcttccttttgagccatgacaggacaggatagtgggtatgcagcagcgcaatagcgtagctgaacaccggataaaacaggatgcgataaaacaaaagagatggttgaaggaaggaagaaataacgaggcagaattgccctcgcggtcaggcgcaatctatttactgacagtgactttccattaaagactcgacccatgcgcgaactccagtgtgatacatcaacacatccgattacgcctgtttaataaagtgcaccattttgttgggcctttgcaatagtaattttacctgctggcaaaagaattgctaatcacgtgtatgtatttcttttaaggcaaaatgtaaaatcttttaattacagtgtattagcttattttatatatgccagacaaccgctaaaactcagtttaacctcagccagcaaagcacgaaaaccgtaaaacgtgggcgaccagaacaggtacgcccacagtggttgaattttaatcaggcttccagcaacgactgcgctaaataatggctggcgtctggtacaccgggcaaaacaaaaaagtaaccgccgccaaaaggccggatatattcttccagcgcttcgccgtttcaggcgccgctgcaccgtgagaaagccgcgttccagatcgtgctgatagcagacgaacagcaaccccatctccagctgtcccgatgcagagatacccgcggagtaactgtagccgcgccgcagcatcaggctgcttgccgtctctggcgtgcgggggttggcaagacggatgtgcgcatccagcgcaatcacttcgccgtccggatcacgggcgtaatccggaacgtcgcgctcatgatgcatccccagcggcgcgccacttaatttctcgcgaccaaagatagtctgttgctcgcccagcggcgtgcgatcccacatttcgacgtgaaagcggattaaccgtacagcctgatagctgccattgcgcgcccagaccggttcgtcctgatcgtcggtcacccacagcagctgattcatcagagcagggttgtgggtatccggattggcggtgccatctttgaaacccagcagattgatcggggtctcctgcccctgactgcgcgcggcatgatcggagataaagccttcgcgccgccagcgtacgccaagcaggtcaggcgtatgcttgatgatatcccgcagggcatgaatcaccgtatcctgggtgttggcacagagctgcaacagcagatcgccatgacactgactggcatccagcgaatcattgggaaagcgtgtcatcggctgcaattttttcggtttgtgcggcgccagaccaaagcgttcatcaaacagtgaattgccgaccgacacggtaatcgtcagattatcaggcgcgatagtcgccccaagaataccggaatccattggcggcaaccgcggattggtgactaccggtgccggaccgcccgtggtcaggaaggcaatacgctgggtcagcaaccggaacagacgcaccagctccgctttatcgctgctgagcagatcaaacgccaccagcatcatcgatgcctgctgtggcgtcgtgatacccgcctgatgctgaccataaaacggctgcatctgctgtcgggcctgcggcgtaaccgtccccggcgaaaagctgtcggcggcggctgcatggaacggacagccgccgcccagcgctgccgcgccacccagcagccccagccctttaagtaaccgacgacgcgcaggctgcgcgtcatcttccttgcgactcatgattaatccagacccagggtgccacgaagtaatgaaagatcttccgccagtgcggtgatcggtcctttcagcgcgttacggtcggcgctggtcagtttctcataggattcaaaaccggtttgggtgcggtacttactcaggatcgcatcgacttttttgaagttggcgtcaaccttggccagcaactgcggattggctttgcttaccatgggtcgcagcagctcaacgattttctgcgcgccatcaatgttcgcctggaagtcccacaggtcagtccggctgtagcgatcttcttcaccggaaattttgctggaagcgacctcttcaatcaggccggctgcgccgccgaccactttggctggcgggaaggccagttcgctgatgcgcacctgcaaatctttcacatctttattcagctgctcagcgtagtccgccatgcctttcgtgctgttatcagcaaacagcgctttctccagacggtggaaaccggtgaactttggatcggccgctttcttctcatagtcatcttcacgggcgtcaatgctgccgtcgagatcggagaagagctcagcaatcggctcaatgcgctcataatactgacgggtcggagcaaacagcgctttggctttttcaacgtcacccgctttaacggcgtcagtaaaggcctgggtgttgctcaccaactgtttcacctggtcggtcacataggctttgtattcggtgatcgggccttccagctgcatacgtgctgaggtgccactttttgccgcaccctcacctgcctgcacaatcagcttgccttttggattgctcagcagcccacaggtcatctcatattcgcccgcctccagattggcggtcagtttctgactgaagcccggcgcgatattctcacgctcttcaaccaccatcacgcctttgaggatctcccactccagcgctttctggctgttgtttttaatcaggaactgggtcttaccggccttgaccgttaagctcatcggctcgcactgcttgtcggtgacgcttacggtaacctgaggaaccgccgcggccgccgttgcggagatcgccagcagaggaagcagcagtgccttgcggcggaaacgcattgtcatctctctttccctatcatgttgcaggcgtaagatgcgcccgttaaatgtcaaattacacagtggccgacgcagcagaaacgcgcaggcataaagaacagaatcagcgccgggatcaggtaggcaaagtaaacggtcacttcactgacgcttggggactcctgataacccagcaccccttccagcagggtgccgaacagcgaatgggtcgataaggtattgctgagatcgaaggcgacatcctgaaagcgattccataaacccgcttcgtggaaggcgcggatggcgcccgctgccagacccgcggcgacaaacaggatgaatacgctggtccagcggaagaaatgggccatgttaagacggataccgccccagtagagcagcatgcccagcacgaccgcggttgccagacccagcaccgcgccaatcggcggcgcataaccgacatcctgggtaaacgccgccagcaggaagaacactgactccagcccttcgcgcgccacggcaagaaacaccatcagcaccagcgccagaccgccacgacctgagcgttgcagcgcctgatcgaccgcctgttcaagctcgaccctgatgttgcgggcgactttgcgcatccagaaaaccattgaggtgaggatcaccaccgcaatcagcgccacgatgccctcaaacagctcctgctctttctgcgggaactcaccggtggtggcattgatgaacagacccaggcccagacagagcccggcggcaataaacacgccagcccacatcgcgggaaaccattgggtgcgctgggtgcgtttgagatagctggctatcaggctgactatcagcgcggcttcaagcccttcgcgcagcatgatgagaaaaggaacaaacatcgccaacctcttgaatgttaagcagcgtcaataaacagtaaaataaggtaaagtgtaaacgataccgattatcattatcgctgagaaaaaaacaagttgccggtggagataatttcatctttgagtggtttatctttgtaacaaaaaagcccgcccctttcgggacgggccaggcgattaacgcctcgcttattttgtctggaactccgcctctgcagcggcaaagcgctgctgcgcttctgctgatggctcacggcccatcagcgtgaacactacaatggcgatgctggcgaaaatgaagcccgggatgatttcatacagtcccagccagccatactgtttccacaccagcacggtcagcgcaccgacgatcatgcccgccagcgcgccgttgcggttcatccgcttccagcagacaccaaacagtaccaccggaccaaacgctgcaccgaagcccgcccaggcgtagctcaccaggcccagcacgcggttttccgggttagccgccagcgcgatcgcaatcagcgccaccagcagcaccatcagacgccctacccataccagctctttctggctggcatttttacgcagtaagcctttgtagagatcttcggtcagggcgctggagcagacaagcagctgacagctcagcgttgacatcacggctgccaggatcgctgacagcagaataccggcaatccatgggttgaacaggatacgcgccagctcgataaagacccgctccgcattggcgttaacgccaaccgccagcgtcgggttgttctggaagtaggcgataccgaagaagcccaccgccacggcaccggccagacagagcaccatccaggtcataccgatacggcgagcggtacggattgaacgatgcgaatctgccgccataaagcgcgccagaatatggggctgcccgaagtagcccaggccccagccgagcagggagatcaccgcgacaaagttcagtcccttcagcatgtcgaggttttccaggctcttcgcttcaatcaccgccagcgaatcagaccagccgccgaccgcgataatcacaaacaccggcgtcaggatcagcgcaaaaatcatcaggctcgcctgaacggtatcggtccagctcaccgccaggaaaccgcccaccagcgtatagagaatggtcgccgctgcacccgcccacagagcggtctggtaactcataccaaaggtgctttcaaacagacgcgcaccggctaccacgcctgaggcgcaatagatggtgaagaacaccaggatcacaatggcggagatcacgcgcaggattttactgtggtcctcaaagcggctggtaaagaagtccggcagcgtcagggcgttgttgtgatgttcagtctggacccgcaggcgaccggccacgattttccagttcagccaggcaccgatcgtcaggccaatcgcaatccagctttcagagataccggagatgaagatcgcacccggtaagcccatcagcagccagccgctcatatcggatgcaccggcagagagtgccgtgaccacgctacccagactgcggccaccgaggatgtaatcatcaaagtttttggttgagcgataagccacaaacccgattaataccatcccaagaatataaaccaaaaaggtcaccagcaaaggtgtacttacactcatctgtctctccacttattatttgatatcccagagaaatcgccagctacccgcctgccggaacggggcaaaacgggccgattttcttcgtcagggcgtaactcatttcccagcggcgcggtatcctgccggaaaggcgttgtgcgcacaatggatttaacacaggcgttacagtgatttcactaaccgtttgtgaaaacgtgctcataggttgcactcgctcacagttatccggttgcaccgtcgtattgcctatctgaaacccgcttttcatcgggtctgacagactggcgaggatcttgcagcaatatccgtgccgcattgcgggatttaacaatcgtcgacgttaaaagggtgttaactggctcacatttaacacggttgcacaaagttgcaacttaagtgatagtgcagccaacgccgtatcgaaccactatcaaggagctctggagtcatggctacaaccaccatgggtgtaaaactggatgacgcgacacgcgagcgcatcaaactggctgcgcagcgcattgatcgcacgccacactggctgattaaacaggcgatctttaactacctgggccagctggaaaccggcgataccgtgccggagatcccgctttctgctcaggcggccgcagagtccgacgacacccagccagaggagacgcaccagccgttccttgatttcgcagagcagattttacctcagtcagtgacccgttcagcggtgaccgccgcatggcgtcgtccggagactgatgcggtgccaatgatgctggaacaggcacgtttaccggcggcgctggcagagaaaacccatcagctggcttaccagcttgccgacaagctgcggcaccagaaaggggcaaccggacgcgcgggcatggtgcagagcctgctgcaggagttctcactctcctcccatgaaggtgtggcgctgatgtgtctggctgaagcgctactgcgtattcccgacaagccaacgcgcgatgcgctgatccgcgacaagatcagcaacggcaactggcagtcacatctgggacgcagcccgtcactgtttgtcaacgcggcgacctggggcctgctgtttaccggccggcttgtctcgacccacaacgagtcgaatctctcaagctcgcttaaccgcattattggtaagggtggcgaaccgctgatccgcaaaggcgtggatatggcgatgcgtctgatgggcgagcagttcgtcaccggtgaaaccattgccgaagcgctggctaacgcccgcaagctggaagagaaaggcttccgctactcctatgacatgctgggcgaagcggccctgacggcaggcgatgccaaagcctatctgctctcttatcagcaggcgatccatgccattggtaaagcgtcgaatggtcgtggcatctatgaaggtcccggcatctctatcaagctctcagcactgcatccccgctacagccgcgcgcagtatgagcgcgtgatggaagagctctaccctattctgaaatcgctgacgctgctggcccgctcctatgacatcggcatcaacatcgatgcagaagaggcggaccggctggaactgtcgctggatatgctggagaaactctgtttcgagccagagctggaaggctggaacggcatcggtttcgtgattcaggcctacatgaaacgctgtccgtttgtgattgatgagctgatcgatctggcgcagcgcagccgccgtcgcctgatgattcgtctggtgaaaggcgcgtactgggacagcgaaatcaagcgcgcccagatggaaggcctggaaggctatccggtctacacccgcaaggtttacaccgatatctcttacctggcctgcgcccgcaaactgctggccgtgccaagcctgatctatccgcagttcgctacccataatgcccacaccctggcggcgatttatcagctggcgggcaacaactactatcccggtcagtatgagttccagtgcctgcacggcatgggcgaaccgctctatgagcaggtggtcggcaaagtggcggacggcaaacttaaccgcccctgccgtatctatgcgccggtcggtacccatgaaaccctgctggcctatctggtgcgccgcctgttagaaaacggggccaacacctcctttgttaatcgcattgctgacacctcgctgccgattgatgaactggtggccgatccggtgagcgcggtggagaagctgggtgccagcgaaggtgccattggtctgccgcatccgaaaatccccctgccgcgcgatctgtatggcgataaccgcgtcaactctgcgggtctggatatggccaacgaacaccgtcttgcctcactctccagcgccctgctgagcagcgccgcacagccctgcctggccgagccgatgatcgacggtgaagcgggtgccggcgagttgcgcgacattctgaacccggcagcgcctggcgaccgtgtaggtcaggtccgtgaagccacagagcaggaagtttctgtggcgctggatgccgcggtgaacagcgggccaatctggtttgccacaccaccgcaggagcgtgccgccattctggaacgcgccgcacagatcatggaaggccagatgcagcagctgcttggcatcctggtgcgtgaagcgggcaaaacctacaacaacgccatcgcggaagtgcgcgaagcggttgatttcctctattactacgccggaatggtgcgtgacgatttcgacaacgaaacccatcgtccgctgggcccggtggtctgcatcagtccatggaacttcccgctggcgatctttaccggtcagattgcggctgcactggcagcgggcaacagcgtgctggccaaaccggccgagcagacaccgctgattgccgcccaggcggttcagatcctgctggatgcgggtgtgccgccaggcgtgctgcaactgctgccaggtcagggtgaaaccgtcggtgcacagctgaccggtgacgtttcgggtgcgtggcgtgatgtttaccggttcaactgcggtggcgacactgctgcagcgtaatctggcgggtcgccttgaccagcacggtcgtcctgtgccgttgattgctgagaccggcgggatgaatgcgatgatcgtcgactcttccgcgctgactgagcaggtggtgatcgatatcgtcgcctctgccttcgacagtgccggacagcgctgttctgccctgcgcctgctctgcattcaggaagatgtcgccgaccataccctgaagatgctgcgtggcgcgatggcggagtgccgcatgggcaatccggaacgcttctcgaccgacatcggtccggtcattgatgccgaagcgaaagccaatatcgatcgccatattcaggcgatgcgtaataaaggcttcacggtctatcaggcggtgcaggaaaacccgcaggacagcaaagagtggaatagcggtacctttgttaaaccgacactgattgagctgggtcaggtcagcgatctggataaagagatttttggcccggtgctgcacgtggtgcgtttcacccgcaataacctgccgcagctggttgagcagatcaatgcgtccggctatggcctgacgctgggcgtacatacccgcatcgacgaaacgattgcacaggtcacggcgaacgcccgagtcggcaatctctacgtcaaccgcaatatggtgggcgcggtggtcggcgtacagccgtttggtggcgagggcttatccggtaccggtccgaaagcgggcggtccgctctatctttaccgcttgctggcgcatcgtccggatagtgcgctgcgtctgacttttgatcgtcaggatgcagaacgcccggcggacagcacgctgcgtcagtcactgctggcaccgcatctggcactcagcaactgggctaaggataagcctgaactggctgaactctgccagcactatggcgatctggcccaggcgggcgtggtccgtctgctgcctggcccgacaggcgagcgcaataccttctcactgttgccgcgtgatcaggtgctctgtctggctgataacgagcaggatgcgttaatccagctggccgcggtgaccagcgtcggcagtaaagcattgtggcaggatgatgagctgcatcgcgccctgctggcctcgctgccggatgcagtgaaagcgcgcatcacgctggcgcgtgacccgttagcagcagagtttgatgcagtgatctatcacggcgatgccgatcagctgcgtaccctgtgtgaacagattgccgcacgtgaaggcgcgattgtgtcggtgcagggctttgcccgcggcgagaccaatctgctgctggagcgtctgctgattgagcgttcgctgagtgtgaataccgctgcggcaggcggtaatgcgagcctgatgaccatagggtaagggcgttcgcagggattgttcgctgcgcgaacgggctatgagaaggtttcgttcgcctggtaagccaggtagtttcagattcgcctctgcaggcgaccgacaagggggcgccagtcgccgcgcccccttgaccccgggctccggcctgcttcaccgccgcttcgcggttccttcgctacttcaggatttctcacggaccagcgggacgcgccatccctggcgcgaacccgcctcttcgcgacatccctgtcgctcgtcctgaaatccctcatccgctcagcggtttctgacggcctccccaccccctcgctgttatcttttctttttatgttgggttcgctgtcgctgtaactttgggaattgcctctgacttttggctcagcagaccgaatgttattcaacctacccgctgttatctcttcttgttatgtcgggaactttatcgctgtggtttttttgggattgcctctgaatttttgctcagcagaccgaatgttattcaacccacccgctgttatctcttcttgttatgtcgggtactttatcgctgtggttttttgggattgcctctgacttttggctcagcagaccgaatgttattcaacctacccgctgttatctcttcttgttatgtcgggtactttatcgctgtgggtttttgggattgtctttgctatcgggtcggcagacagagtggcattcgatcctaaccgctgttatctcgttttcaggtcactaagagtgttgcggtgagattccggaattgatactggctttcggatcaccagacaacgctgcactaaagaaaacacaaagaaatcaccggcaggggtttaccagaggcgtccggagcgctgaggaacaaccagaggcaaggatgagccgacaggacgtcggcgaaaggacggtacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgcacaggcaacctgaaactccccatcgcctggcgggcgtaaccctctcagcgctaacgcgcggctaagtgaactaagacgccccatcgccttgcaggcgaaaccgctcagtgcaagcccgctgcaaagcgaaaccttatgaatctttccacgctttcagcggcctgaacccagccagtccgggtgacaaacccaccggcaggggtttaccagaggcgtccgaagcgctaaggaacaaccggaggccaggatgagccgacaggacgtcggcgaaaggacggtacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgctcgggcaacctgaaactcctcatcgcctggcgggcgaaacccgctcagtgctaacgcgcggctaagtgacatgaaactccccatcgcctggcgggcgaaacccgctcagtgcaagctcgctgcaaagcgtaacttacccaccgctcgcgccgccaggcgcccttttcattaacgtcgggaacacaaacagcgactgcccgactccgcgattggtcagcgaccagatggccactgaacagagcgagcaaagccccacaatggccaccggatagaaacaggcccagagaaacgaaaaccacacctgctcgaacagatgatgccgctgcgcgaacagaatcgcagacataccaaagaactcgataaaaatacggtggatgacgtaaatctgcagcgtattgcggccaacccagttgagataacgcatgctgaagtgctgattcagccagcgacaggccgcgatactgaataacaccgccagtacacacaggaacagacttttatccagaccgaatagcacatgaatcccggcggcggctgccagaagcgcccaaggcatcagattctccctccgccattcactcaggcgcagcatcgtctggctccagaatgcccctagcaggaagaacacaaaatattgggccaggctctgtggtccccagaacgggatcactttttctgccgccagataattcagcagaatcgccaccgccaccagggccagcttatattgacggaaaactttggcacagaggaaatagagtcccagcccatacagataccacgaggtactcatggccataaaggtcagcttgagaaactcaaatagcgaacccgcataggcggcattaaggttctgcgaaatacgctggccggtaatttcagtggagataccgataattgaccaccactgaataaacccccacagaatatagagataaaaaagattggtgatgcgactggtaaatacctgcttccagggccggttcagaatgccattggtcgccagcaatcccgagacgaagaaaaaggcgggcatacgcagcggcgacagtaccgtattaaactgtatccatatttcggcggggatccatccggcagagagatatttcatcgtcccttcaaagccgggtaaaactgtgtggtacaggaccaccagtaatatgcaggcgcccttcagggtatcgacccacaatatctgatctgacttagtctggttcattcaatgactcctgctgtgtaggtcagaatgctggaaagtaaaagcgaggaaatcagtattgcttttatgattatccggcaattattcgccattgaaccggtgatgaatgtagcgaaactcttaaaagccgctgagtggccctgttaccacagttatttactcatcagaacgtttccttacacttattaatatcgacgcaacacactaattagcagtgccgcagcctgtttaaaggataatgttgcttcataattcagaaaatataattaagagaaagtggcaacgggaaaagccaatatatccccgatgaaaagaaaagatttgtcagatgtgccaaaaggtttaacagcagcagagttatttatgatactgcgcctgttaataacgtgaccatagccatttgcagcttaaaaaatgagggttttaaacaggttaaaactgccttcctgggaaggcagtgtggattactgattcagaaatttatcaaggaaactgacgggtgcgcggctgctgagggttactgaacaacgctttcgcttcgccctgctccacaatccgcccctgatccataaaaatggcgcggtcagccacatcgcgggcaaagctcatctcatgcgtgacgatgaccatggtgcgtttctcttcggccagcgcgcgaatggtgctgagcacctcgcccaccagctccggatccagcgccgaggtcggttcatcaaacaggatcacttccggccgcatcgccagcgcacgcgcaatcgccacgcgctgttgctgcccgcccgacagacggcgcggatagctctcttctttgccgtgcagcccgaccttctccagcagcgtgcgggcgcgggttaccgcatccgctttcgcttcgcctttgacgataaccggcccttcaataatgttctccatcactgaacgatgcggaaacagattgaagttctgaaagacaaacccgacctgctgacgcagacgacgcacctgctctttctgcttactctgtgccagcgccgcatcaacggtaatctctccaacgcggatggtgccgctatccggcacttccagcagattgatactgcgcagcagcgtggttttacctgatccgctggggccgataatggccaccacttcaccggcggccacatcaaggtcgatgtcgtgcagcaccgtctggccgttaaaagacttcaccagctttctgacttcgatggcgctcatttcgactccgaatcctgacgattaacatgctgttccagccggttctgcaacgcagataacaccgttgccatcacccagtagatcagcgaggctgccagatacatggtaaagacttccagcgtgcgtgaggtgatcaactgcgcctgacggaacagctccggcacctgaatggtcgccgccagcgaggtatctttcaccaggctgataaagctgttgcccagcgggggcagcgcggtgcgggctgcctgtggcaggatcacccggcgcagggtttgccagcgcgtcatgccgatacttgccgccgcttcccactgcccgcgctcaatcgatgaaatcgcgccacgcagtgactctgaggcataggctgcggtattcagggaaagaccaatcatcgcggaggggatcggatccagttcaatgccaaactgcggcaggccgtaatagatcataaacagctgggcgatcagcggcgtgccacgaaagatcgagacatagatccgcgccagccagcgaaccggccagaagcgcgaaagacgcatcagcgccagaataaagcccagcagcaggccaaagagcatgccgccgatgctgagctgcagcgtaaacagcgcgccttttaataaaaaaggtgctgaatccagcaccagttgaagactttcctgcattatttcgtcacgtccgcgccaaaccatttctgagacagcttgctcagcgagccatctttctgcatgtcagcaatggcctggtcgatcgctttcagcaggtcgtcgttgcctttacgtaccgccacgcccgattcctgacgggagaaacgcatcgcccgcgaccgccatggtatcgcccgttttcttcaccagatccagcgcggccagacggtcaaccagaatggcattcagacggccagagcgcagatcctgatatttcgtcgggtcatcatcataggtacggatgtccacgcccttcacattctcacgcagccactgctcgtagttggtgcccagaccgacgcccacttttttaccggccaggtccgcaggtttggtgatggtgttcgcattggctttcatggtcagcgcctgaatgccggagaccgtgtatggcgtggagaagtcatatttcttcttacgctcatcagagatggtgacctggttgatgaccacatcgatgcgcttcgcgtcgagagaggccagcatgccgtcccacttggtcggtttcaggctcgccttgacgcccatgtgctgtgccagctgttccgcgaattccacttcaaagccggtcagcttgcccttttcatcctggaagctgaatggcggataggtgccttccagacccaccagcagcgtgccgcgctctttaattttgttgagcagattttccgctgcaaaggttttaacgttgacgccagcaatcagcgccacggccatgacgcccatcatcatctgacgacctgcacgagaaaaggacatattcaccccattattgacagtattgtgtgtgtgttcttataagggcagcacggcttgtcgctgccagtccagaaggataaccaacggagtataaactgttttattcgcttgtctcagaccgaaggatgataagcaaataacgccggtgcgccgcccgtgtgaataaacagcaacggaccttcacggcggaaacgattctggctgacgccatccagcagtccggccattgccttgccggtgtagaccgggtccagcaggatcccttccagccgcgccagcagtttcaccgcagccatgccttcatcattgggttcaccgtagcgcggcgcaaagtagtcatcccacagggtaatcggtgccttagcctgcacttccagcgtctccgccagcgactgacgcagccgctccaccagcggcaactgcgcctcaacctggcgtgaaacggtgacgcccaccagctcggcctccggcagcagatgctccagacccaccgccagtccggcatgggtaccggcactgcccgaggccacgaccacggcggcgaaatcgaccacgccttcgctctgatgagcaatctcctgcgcgcactctacatagcctagtgcacccagcgcatttgagccgccgaccggcacgatgtaaggacgataaccctgggcttccagacgcgtggcctgttcagccagctgttccgcagggttattcagcgcatccaccataaccacttcagcgtccatcagatccagcaacagtcggttgccgttgctcaggtagttttctgcgtgggtgccaatcgggttttccagcaatgccacgcacttcaggccaagccgggccgcgactgccgccgtctgacgcacatgattggactggatagcgcccgcggtcagcagcacatcggcgccttcacgcagcgcgtccgccgccagaaattccagcttgcgcagcttattgccgcccatcgccaccggcgtgaaatcatcgcgtttgatgaaaatatcgcggcccagatagtcagagagccgaggcagatgttctaacggcgtgggtgcacccagcagttcaagacgtgggaattggtgtaacagatgtaaagacaatgctgcctccgttcgggcattcaatttatccttacagtgttgcagaagatgcgaaaaggatcaccctgattcaggtgtcagcagatgcggtgagacagatgcgtagtgaaagttgcaggagaaagaagcgccgtgctcccccttcccttttacccggatggcgggcaaaaggggaacgtgccgcaggcacgcgggggagcaatcggtgcagatcagggttaaccctgctgccagcctaagaactgatcgtacttgcgcagcgcgatgcggtaattgttattaccggcatcgggcagatcgctttccagacactgatgccagctatttccctgaagcctgtcggccgggaaatttctggctttcagcatctcatccagacgacgcagccgcaccacatattcacgaattgtgctggggctcatctctgtctgttcaaacagatactgtttaaacgccattatgtcgaagtaattaggatgggtattacaaaaaatatcactgcaaaaacgacaaagcgcggtcagttcgggctgaagtttcagccacagctgctcatcaatcatctggtccatccgagcgatggcctctttattgatgatctggccacgaaaaacgagcgccattcgatctaataccttgccacagtgtgaacagttgctctggctgtgtttatagtctttaagataacgacttaacggtctggccttggtcttggctcccattactgagtccccggttttttataattttgaatcgccaggaaaactgatactgctagcgcgctcccgcaagtcgggcacgcaggcgtttaatcgcctgactgtgcagctggctgacacgggattcacccacatcaagcaccgccccaatctctttcaggttcagttcttcctggtagtacagtgtcagcaccatcttttcacgatcgggtaacgcttcgatcgcttcaatgacgcgctcacgcagactcccttcaagcaactgatgaagcggattagcctcttcatggccttccgtcaccagctccgcgctgtcgccgtgctcttcccgatactcgtcgtaggagaaaagttgactgttgttggtgtccagcaggatctgccggtactcctccatggaaacattcagctgctgcgccacttcctgctcagaggcagaacgccccagcgactgttccactctgtgcattgctccggccacctcgcgtgcattacgacgcacactgcgcggtgcccagtcccgactacgaagctcgtcgagcatggcgccacgaatacgctgcacggcataggtggtaaaggctgtaccctggagcgcgtcataacgctctacggcatttaacagccctatcccacccgcctgcagcaagtcgtcaagctcaacactggccggcaggcgaacctgcagacgcaacgcttcatggcgcaccagcggcacgtagcgctgccagagcgaatgcttgtccatcacgccttcggcggtatagaaatcgttcacgttgactaccctgcgttaatgaagttatcggcatgattatccaattctgtagcgttttcgattggctgaataggcggggtaaaacgaggctatttcatttttgttacctcagagtgcagatccttctgcactcttcagtgaagattaacgacgggcgcgcagccgttgccgggtggcgggcggcactgccgcccacaggctgcagatgcgaccttccagttcctgataccagggcgccagatgctgctgcgcctcctcgccaggatgcaccagaatctcgcccgattcaccatcaatgctaatcagtcggttaataaacagccgctgcaaatcactgcgtaaaaacaggccgttatcgatgctgttatctgccagtacaccgtcatccccttcctgcgtgtcgatatggcaggcttccacccagggccagttatgccgttcggtcagctcggtaccggtcatcacacaggcgccgtagcgggctttgacaccggcgctgaattccgcctggctggcgcgctgcagcacccgggctttaacacgacgcccgacctcagtttcccggcatcaccgccgccggaactttgtgctgcggcgtactcagcaccacgatgaactgaatgcgctgcgactgcggaaaacagggatctgcctgtggattgaaaagctgccagtaagcgtcttcatcatcctgatgcatcagcaccagtttgtagccgcgactgttcagcagattctgtgccgtggcggattggggatcgatcatcgcgaagacctggctgctgcccatcaccttccacaggttgtcgcgcttttcgctatcgctgcgacggaaatagaggaaggaaagattctgcttaaggtagtgctcaaagcgacgcaggtaatttttacgttcgttgtcatgggagatgaacagcagatcctccagcgggctgttgctctcttcctgcgcgaacaccgcgcggattttcagcgtgcgcagcccggttgacggactcagcaaggctcgcgccgtcagctctttatcatcagggtattgcagagcataacgccgggcgatctcttcaaaggtcagccgctcacccggtaacaggtcataattgaagcgcatagacactccacaaagttaaaatcaaaaatgatgttgttctgtgaggagttatcggcagtctggaggggaactgtaacgggctggggggattgcctggcattgagagacaggcagcctgcaaggttgtggtcaggaaaccggtttgaaggaagcgggtgttaaattgcgttgcattgcctggcgctgctggcataaaaataagccagcactccagccgcaattctttcagcaattagctaattcccgcccgtagctatcagggacaaatgggcgatgccgatgatacgaaactgcatcgcctcagatcatttaagcagataaatcagcgacaaatcgtcattgaccttgaccttatcaatctcggccagaaacgccatcaccgattgtggcgtatgttttgttattgagtggtagctgtaaatgatattaataatatcctcttcactgacggttccgaccaactcaacattggccgcaatcagtgatttaagcaggaaccattctgccgtcagaagatataagctcagtaacgggctgcgattttcgttattagggaagaaatcatcataaatgcggtactgaatatagttattcattatccatggccgttcagcaagccagggcataacctgcttctgccagacgttgtccagccggatcattggctgactgacgtcatcggttttggccccttcggcctgaatgtaaatcagcttattaacgtagtgattcagggtaggaaaggcgcgcttatcggccatggtgctgaaccagctttgcaatctcaacagtaaagaccattgcaggttatagtcaggtttaacctgatcaagctgcagcctgatttcaccctgtgtcaggttgttgagtacatcagaaaaatgatgctccatctggaccagccagtcttcttcagggcttactctttccgcgcccagcagaaagctggccagcgcgtaaaacccttcatcaagatgaatgccgctgaatttaatgatgttaagacacatcagattcagcaatttcttttgctgatcgagatctttagctttattgccataaggttgttgcctgatgctctccgcgaacagcatcgcgtcaggtgaggctaataattgccgggtcgcctccggacaggagagcgccaacgttttttgctgttcatatttaaaggtgttcgccgctcggggataggtcgcacaggtgttgctcagtgcggcagcacccagccgggaatgcactttgcacaggcgattttcatccataaatgcacagttgccagaagcattaagcttcatagttccccaactggcaaagcttttgcgggtggttgtgatgttttcaactgccagcgttttgatttcaatcagcgaggattttaaatagcgattgaccgtgggcttatccaggtggatatcccagcccttacagcagtgatcgcgacactcactgccaatacatttgaaggcgctgacaaagagcggttccacgacagtaatatttttcattatttacctgctcaacaaaggcatttaaaaaagagtcttactgtgagaataaaggaacgcggggagattgattggcagagaaacagggcaaaaacaggctaatcgcaggcataaaaaaaccccgccgaagcggggtttgtcttttataagttgggtgattagccctgcagcagagacagaacctgctgtggaacctggttagctttagccaacactgagttaccagcctgctgtacgatctgcgctttagacatgtttgaaacttcagttgcgtagtcagcatcctgaatacgagactgtgctgcagacaggttagtcgtggtgttgttcaggttagtcacggctgagttcagacggttctgaatcgcacccagtgaagaacggaacttatcaacgctggcaatcgcttcgtccagctttttcagtggatcagaagttgaacctgaggtcacgttagacaggctcatgttagccgtatccagtgtgaacgcagcggtatcgccaccagcagttgttactgctgccttcgcatcaactgcaacgtagaagtcctggtttgcaccgttagcaatgtcaaaaccgttcgctttgaggctgttggtttctgcatcgctggctgatttcacgttaactttagcgaacaggttaccgttgtcatctttatacactttgtctgcagtaacagtgacgtttgcgttagcaacacccagacgagtcgccaggctgttagcagtaccttctgcaacggttgctttagatacgttactggtagaaaaccgtagacgctctggaagtcagcagccgctgcaacggtaggtgtaccctgtggaccattcacgttgaaagtgttcagtttcagcgtagaagagtcaattttcttcaggtcgatggtgatagtttcgccatcgttagcgccaacctgaattttcattgagccatctttagccagcacgttcacgccgttgaactgagtctgaccagatacgcggtcgatttcgctcagacgggatttaatttcgtcctggattgaagatttgtcagaagctgagttggtaccgcttgaagcctgtacagtcagttcacgaacacgctgtaagttgttgttgatttctgacagcgcgccttcagtagtctgcgcagcagagataccgtcgttggcgttacgagcagcctgagtcaggcccttgatgttagaggtgaaacggttggcaattgcctgaccagcagcgtcatctttcgcgctgttgatacgtaaaccagaagacagacgctccattgaagtagacagagctgactggttcttgttgatattgttctgagtgatcagcgagaggctgttggtattaatgacttgggccatgatgaattttcctgttaatcaagtctttcggttaaggtgtgggcttcaacccgccggcttcagcgccgtcaaagttgttatcgtccgccgtttaacaacctttagaatttttttagtaccaggcgaatttttctgcttcaacctgtcacgtttaaagttatcgccacccgcccgaacttctttaggcttaattcattaattttctagccgctgaattacccttctctatagtgcttatttacctcattaccctaaggcaaataaccttaaactttccttattcaaggccgataacccaggtatcaattttctgtcgaccttataaaggaattaatatggctagtataagcaacctcggtgtgggttccggcctgccactcagtaccatgcttgacagtttgaccaccgctgaaaaagcttcactcaaacctatttctactcagcagacagcttatacggccaagctcagtgcttacgcctccctgaaaagttcactgacaactttccaggctgctaataccaagctgaacagtgctgacctgtttaccgctacgactgcggccagtagctccacagcgttcagcgcgaccacttctggcagcaccgtagccggtaaatatgccattaacgtctcgcagctggcacaggcgcaggttctgacctcaggcgtacagagtagtaacaccgccgcgctgggcgacagctccgtggccagccgcagcatcgcgattaccttaaaagatggcaccagcaaaagcatcacgctctccagcgatcagacctcgctgaccggcatgcgtgacgccatcaacggcgccaatgccggcgtcaccgccagtattattaaggtgtcagacggcagtttccgactctctatgagcgccaataaaaccggcagtgataatgccgtggcgaccattgccgtcaccggtgacagcacgctgcaggggattgtgggctttgacgcatccgccagcagcaacgtgatgacccagagcgtcgctgcgcagaatgccaaactgacggtcaacaatgttgcgattgaaaacagcagcaatcagattagcgatgcgctggaagggattactttaaatctgaccgcgaagacagttggcgatgagacgctgacgattaccaaagacacctcaaaagcctccagcgccatcagtgcctgggtggatgcctacaatacgttgctggatcagttcaataccctgaccaaattcaccaaagtggataccaacagcgatgcacaggactccagtaatggtgccctgctgggtgacagtacgttacggacgattgagacgcagctgaaaagcatgctcactaattcgcagagcacatctacctttaaatcactgagtcagattggtgtcaccaccgatcccaccaccggttcattaaaactggattcgaccaagctgagcagcgcactggataaagatgctgcgggcgtgaaagcaatgatcgtaggtgacggtaaaaccggtatcgccgctaaaatcgacagcaagctgactgactggctggctactaaagggattattcagtccgccaccgatggcgtgagtaaaacactgaataggttaaccaccctctataacaccaccagcgatcgtattgatgccgatatcgcacgctataaaacgcaatttactcagctggatatggccatcagtaaactcaactcgaccagcacctatctgacgcagcagttcgacacgtccgattcgtctaaaaaataacaggagtgaccatgtacagcgctacaggcaccaaagcctatgcaaaaattggcgtagaaagcgccgtgatgagcgccagccagcagcagctggttgtgatgctgttcgacggtgcactgagcgcgttaatccgcgcccgcctgtttatgcaggatggcaatattgcaggcaaaggcaactctatctccaaagcgatcaatattatcgaagcgggcctgaaagagggcctgactgaaaaccgtggtgatgagctggcagacaatctgctggatctttacaactacatgacgcgtcgtctgttgcatgccaacctgaacaatgatgttgcagcagtcgaggaggtcgaaggcctgctgcgcaacattgctgacgcgtggaaagaagtagttcaacctaacctgattcaggacgccgtttaatgactactgcaccgcatctgattaccgtttaccaacagttactcgatctcagccagggaatgctgcgtcatgcagcacaaggcgaatgggatgaattgatcagcagggagatggagtatgtcagtgcggtgcagaacttagcccaatcgacagaagccgtgtcgccgtcggcacagactcaggagcagttacgtccggtgctgcgccgtattctcgataacgaatgtgaagtgaaacgtctgctgcaggcgcggatggatgagctggcctcactggtgggtcagaacagtcgccagaaatcggtgatgtccgcttatagcaatcaaggcggcgttgttatggtgccgcacgaaaccctctcctgatcccctgctctgtcacgccgccagatttatttttctgcgcggcgtctcttttttgccgcttactccatacttgattttcatcatcccctggagtgtggtacatgcaaaacccaacgttattacagtttttccattggtattacccggatggcagcaaactgtggccggaagtcgccgatcgtgcggcctggctcagcgaaataggtatcaccatggcgtggttgccaccgtgctacaaaggggattcggggggctattctgtcggttacgacagctacgatctgtttgacctgggtgaatttgatcagaaagggggtgttgccaccaaatatggcgacaaacagcagttactggcggcaacagaagccctgcgcagtcacaacgttggggtgctgctggatgtggtgctgaaccacaaaatgggtgccgacgaaaaagagacgatcagcgttaaccgcgttaatcccgataaccgcgatgaaatctacgacgaggtggtcgagtgcgaggcctggacgaaatttacgtttccggcacgcgccggggaatattcgaaatttgtctgggaccacaaatgctttagcggcgtagaccacatcgaaaatccggacgaaaacggcgtattcaaaatcatcaatgactacaccgccgaaggctggaacgaccaggttgataacgaactgggtaatttcgactatctgatgggtgccaacatcgatttccgcaacaatgcggtcagggaagagctcaaatactgggcgcgctgggtgatggaacaggtgccctgcaccggctttcgtctcgatgcggtaaaacatatcccggcctggttctacaaagagtggatcgatcatattcaggaggttgctgaagagccgatgtttatcgtcgcagaatactggtcgtttgaaacggagaagctgcaggagtatgtgcatcaggtggaaggcaaaaccatgctgtttgatgcgccactgcacatgaacttccaccaggcctcaaccgcgggcagcggctacgacatgagccagatctttgctaactcgctggtggtcgctgatccatggcatgccgtgacgatcgtggctaaccacgacacccagccgctgcagtcgctggaagcaccggtagaagcctggtttaaaccgctggcctatgcgctgatcctgttgcgtgagcagggtgtgcctaccatcttctatcccgacctgttcggcgcgacctatgaagatgaaggcggcgacggcgagaagcacaaaattgagatgccggtgatccctgaactggaaggattgatccgggcgcgccagcagtatggctggggcgtgcagaccgactattttgatcacccaaactgcgtggccttcagccgcagcggtaccgaaacacagccaggctgtgtggtgatcatgtcgaacggcgatgccggtgagaaaagcgtgccgatgggtgaaggttttgccggtaaggtctggcgcgatcatctggggaatcgggaagagaccattactgccgacgagcacggcacggcggtctttgtctgtaacggtggcagtgtcagcgtctgggtggttgctgaatagatcgctccctgaaaagctaaaccgccccggcagacagaagcgtgaagtgcgctctgcccgtcggggcggttttgttatgggtcggctgttacgacttcgcgttgttttctgtaatcggtgtgcgcagcagctgcggttcgatgttctgaattaccgcggctttcggctgcttcgccacttcttccagcgcctgctgacactcaacggtcggacgcgccactttacgcagggtcatcctgtcatagctcagttcgccattctctactaccagcggcatcacccgcatctgacgcgttacgttgacataatcgccgcttaaccgggtcagtttgcccggcttcgcaatcacccgcatccactgacggcagtccagcgtgctgccatccgcattgatgatcacactggctatcgccttgtcgctgatcaggctgctctgtgggccaacagtttgccaggttccctgcagatcagcgggcgccggcgtttgcaccgcattttcataatcgttgatttgtgcacagccactcagtgccagcgcggcaatcagcatccactttttcatgtttaatccctaagatcccatcaatggcggctacgttataatttttccaccgcgttgcgcaaggtatctgggtgttcaaacaccacgcagaccctgattgcgccagaatttaacccgcagcgagctccacggtcaggtttttgaccggcagatcagaggctgaactgatgcaaactccggcctttgtcacgcctgacaagcggaagacaacccgctacactgacgcgctgcaacagactttcaggaatatgaatatgaaaacgccagaagcctactatgcccaggcgcgcgagatgttttttaccgcgcatcccgactttcagtctgcacttgatgaattaacggagagcgatgcccgtgcggctaacctgtcactgcgacagctgcgcgaatggcatgccgaacgcatctatgcggcctttttgcggcagaagaatctggatggaatgatcttttctattcagctcgctgagccggataaagcggtggcggctgaagctatcgagacctatctcaaatctcatgctgagtcgctggggatgagctgggaagagttttgcattaaaaacgagctctaatcagggccgcgctgaagttgtatattgcaaacacctccaaccagttccggcactgcagataaaattgtactaactgggggaaagtgtataacttcggcgtgcgactcaggtcgtgattgacctttaacgaatagtgctgatgcactgcctctgcaggtattgtcccaattccacctccagaggcgaatttttttatccgcccctacccttcaccttccgtcgctttaccctttacttcaacataactcgctaccgccagcagacgattaatatgcgtcagtagcagatccacatcagactgcaaaaactcggtcgaagattgcgaagcggtaacaatggcatcctgcaccgtttctgaaatagtcagcgagttgtcctgtttcgcctgcaccagcagcgccgcaaccagcagcgactgcgcttcaagttgcgccgtcaactcttttgcatcgacgtccatctttgccagttttagcagaatatcaattaccagttgtcgcatcgcggacctcctaaaagtaagccgccattatgtcgcgatgcgtgcgcattttgctagtcgaagattgaggtttatgcgagataaaaatttacacgaaatcagacgtgctgccttgctactgtttttatttacagtattatatgtcagcgattttgccctgaatggattgccatcatgtttgttgagttgatttatgacaagcgcaacgttgccggtttaccgggtgcccgcgagatgattcgtgaggagctggaaaagcgggtgcatcgggtgtttcctgacattgaagttaaggtcaagccgatggaaacgtaacgcgattgatactgatttgagtaagaacgataaagcgacggttgcgcggattgttgaagagatgttcgacgaagcggaaatgtggctggtggccgattaatcccttaacggccaccacatcagttagcgggagatgacttagctctcctgctcgctgtgattaacttcaatctcgatgtcctgaatcgcggcatccagatcttccagcagtttaccctgcttattcagcaacgcatcgattcggtcggcgttggtcttgtctttatactcacccgcatcaaacgctaaccattggctggaaagggtttcggtgttggtctgagcatagtgacgcatctcttttagctgagaagtcacgtcacgcagatattcagttttggtcttggtttctgttgaatcgctcatgctaaatttccttctggtcatctatccaaagtgagtaggcttagcggttcatcaaccggccaatcagcgggcctgcattcaggtacaaaatgttgcccggatatttaaaactagtcgataatagcgaagccgcattaagaataatcggaagttatggtttatgaccggatttcacggctggcacctcactctcagtgacgacctctttgacttttatgaccgttttgtcggctatgcgatccggtattgcatccagcttatgctgtattgctgcaacctgatcggtcagcagctccactctgtcatcacgccgcgccgcaattaagcggtaatccgcccgaatctcctcgacccgcttgtttgcggtgttactgacgtagagaaaaatgatcgtcatcaggatgcaaatcatcgaacagctcagcaatacgcagccgaggataactttgcgccggtaagacataggtgccttagtgctattaatcgtggccatcactgcgatcctccagagttgagataagccgatcaatctcattacgaaatttatcgttctgatcggtttcggtcattgccagtaaaatccctaccgcattcttgattaaccgaagatcggtttcgagtgtggagatacgccgcagattcctgtcgtgccgtttcgcgtaattcatcgttctcctcccgtatcagcaggttgctctctttcagcaacaccacctgctctttgtagctggtaataatttcgccgccggctcgattactggttacgattgacgcgattcccgccaataacggtttccagaacagtgctgctgcccccccgcccagaactaacgcacccatactggtaatcagactactttccatgccacacccctttgtacggtaaggtctctggaacttactgcgtgctgcttagccacgtcccccgcatgaaatttaagattgcttaaataccaggcttaagtatacttaagtcactctcaaccaaaaagtcaagcttatgaaaaacgaaacgctgggtgaccgcatccgactccgacgtaaatcgctgcagttaacgcagaagcaattggcgcaacaggtaaaagtgtcccatgtggcgatttcgcaatgggaaaaagaggagacgctgccgcgcggtgagaacctgctgcggctcgccgaagcgctgggctgcgcaccggcttttctgatagatggggatggtcctgttttcagcgaaagcgcctggagtggtttgcaccagatcccactgcttgcacagcgcgacgtgccgcgatggctgagcgaggccggttccgtccggcatgaactgctgatgcacaacgacatggcgctttcacagcagagctttgccttccgggtagaagaacaggcgatgacgcccgcgattctgcggaatgatgtggtgatcatcgatcccacgcagtcacctcagcccggcgactgcgtgctggcattgcagcagcaggtcgtgctgctacgcacctggcgtcagcgcggcagtgaaaatggcgtcatgcagtttgaactggcaccggtcaatatcaacttccctgagctgcaatccagccgggacagcctgaagctgattggtacgctggtggaaactgcgacgctaccgccagccataaaaaaacccgccgtgcgcgggttcacttttcatcgtacaacggtgctgagtttatagccggccaactacagggcatcggtcaattgatctaccaccactttgccctgcagatcggtctgcataatgcggtaattgacgggccatgagcggcgggtactgagtttatcgaacagggttacgccgccttttttaacaccctggctatttacaataatccattcggtgacctcttcctgaccacgatttttcaggctcagcgagcgttgttcgattaactgatcttcagcttcaatctttaaatagtctcttaacataatttctatctcctggtaacgcaggacactatatgccttttgctaatcctttcaatcgaatttatttatcgatgtattcatcgacgggaatgtgacctgccgcaagcgacatgacagatttgtccattactgcatcagggattaccggttagcatgaacctgctgtacacacccaaacatcgaataatgacgtgttcagtatgagagaaactccgattagcccgcctctggcgggcttttttttcttctttaatccaccgcgcatgcgggatgttagtgctggtctaaacttaagagactggaataaaaggagagagttatgtttaaacacaatacgaatgaagaacgtaagaaagaaggtgatgtcagcaaaagcctgccggaagccgcgccaaacgctggtaatgcatacgaggaagatgatcatcccgctactgatgcgccgaaagatcatggcgaagtgccgcgcaaaaacgatgacagccaggatgacaaaaaagatccttacaaagcaagctgatgtgcgagaggcgcgcccgctgggcgcgctggtcagcgttaagatttaatgagatcggcaagctggtgctgattttcaaccagccaggctggaaaatgttcggatgtcaccggcactatctccatccttcgcggacggttccagatatcaatattgttctcaacgcagcgccgtatatgatccggattgttaaattcggggcagttacgttcggtatgagaaatcgaagacattttttcactgatgcgctcatcgctcattacccaggaaaaatgccaccctgcattcttaacggtttttgtccggaaatttagccacttccagcgccaccagttctcgcgtatcggtgtaccacgacgcttaacattgcgaagcaattccggttgccccataaaaaagtctcgcagcgttttacatgtcaccattttcgccagtgtggcacagcgcggtgtgccgtcgtcatttaaaacccggacattaaatttaaaattgaaatattgctgatgcagcgtcgtgcaaagatgttgatgactgaatgcttttatcgcttcaggtcggggaatttcatcgacgtctgacacaataacaatatcattatcctgcgcaccggccagcccttgcataatctgattacgtgcagtggcttcattttcccagggatctgtctcccccgcattaaccagagaactattcgatttaaaggcttcctgataaaatctgggcgcaatatcgttaacaatataaataattttatcgcggaaacgatcgaacttctcaatatcaaaatgaagtttttcccggcgttttccggtaaaggtatagcgcgattccacaatgacaaaccggtcaacaacatgctcaagcgtgttcagacgcatctcaagcaagatatcttcatcgtagtacaaaaaacagtcataaatcataatattcagaggcacttaagtagtaaggattttcatcaggacacctcaacatgcgtaacacaacagaggtataacgccttttactgggtcgttttttagtgaacctgatgtgtgtgtaatgtactgcgtaaaactatccatgtttataataaactggctaacaaaggctgcaggcaatgattttcggacatccacctcaaagcagactaacgatatgatgagcaaccattcagagtgatatttacctgacaacggttaacaccagcagacagcatgagtcacctgatgcgggctactgagttcctgtccgttgcttacatcataatgcgttgcgcagaatgttacatatagtccgtaacgccagcaatattaagcgcagatttttgattaaaatgagcgatacgatcaatatccggatattattggtcaacaaaataactatgatggtttagttaatgaagaagatcattattgccctgagcataagtctgatgggcggatgcgtagatatgggacgggttggattacacccgacaacaaaaaccgcttatttcgacgctcatccttttcaggttgaatcctgccttaacgtagcggcacaggatcaaagactctatctggagcaggatgaacctctgccggatggcacgaagcgatataaccttgagcaggataatgaaaccgtggcctgggttgaaattgcaaagttcagccatcatcagatcagtgcgacattttactatgatccaaaagcatcagatatcagcacagcagtttcagggatgatcgcgcggtgcaaaacatcgagttagaggcatcgtcgccatgtgcgtgatgcagaatggatgatcaggagttggcatacgttgtcaggccagccagagcacaagcgcttgcctgacaacctttcgcactcttctactcaaaggtttttatcacgctcgcttccgggctatgccatgttcaggagtgcgcagccgaagctcagcctatttagccggttcgcaatcgtaggcacctcgtatgcggatctgactctggctggtgcggacgatttcagctcttaacagccctttgccctgacggtttcgtcagctccatatccaccatccccggcgctttgctgtttttcaccagcagtttgaccgtcacgttgtcgtagtcgcccttctctttcgcaaaggtgactttctgcgtttttgcgcgttctccattcaccgagaaccagccgctcttgtcaggtttaagatagaacggcccgcactgcgtggcagcaaaggctggagccgataagctgattaacgatgcgataaggataagtttttttagcattgggctggcgtcctgctgatgggtgatgaggggtcgggtcgtctgcaccgaagagtgagttccctgctgcacggctcgtaataaagagcagtatagtcaatgacacctgcattatcgccaggaaagggtcatagactcagcaaagtgatcggccttgatgctggcaatccaccgccctaatcgctaccacgcaggcgtgccttgctcaatggaatcagctcactaaacctgcatattcataatttcactttgaatatttagcatatcaggttgctgtgcattgaagcgtggttttacagagacataccgcaagtcacaaactgccgtcatggtggttttgaggtgattggcggtatttttttgtgctacatgtgtgctacggttaaatcgtcggccgcagcggttcatagacggacacgacctcggccgtcactttcctcagcacgataattccttccatgccctctccgttccatgccctctccgtcgatcgtctcgccgtctcaggtgatgatgcctgtagtgaacaatctgcccagttgcgggaactcacctatatggaatgcgattttgtctcccggcgctggcttaagtgatttgtcagccagcgagaacccgtcaggtgtctcgattagcaacatgttgttccggtgaggcatcagcacgtcgttgaggtcgatgcgccgctctatttagtccaacgcaggtgatggaaatcccatatctacctcacatatcccatgttgcgtaacgaccaggttttattctcacttccctctgtgaccagtttcgaagaagaagttctagtagtaccttatccaccggttgcactcctgcagcgtccacacgtgattcacgtcatccagccgcttctggaatgccgctgttgtgacaatctgccgccccttgctgtccttcgttatcgctccaacgaaggtcgcatgtatgtcactctctctcgccataacaaatccttccttgacaaatactgtatgaataaacagtaacatcgatcggtatgtttgatcaagcagacgagttctcagatttgtaagcatttgaggaataagagttttacacaggtaggggcaacgaaaaggttctaatctcaaatcttgcaaacctatcctcgaagaaataagcgccatgcactcctctttcgagaatatttcaaagtaaacaatacattaacccaatttttattaaaaaaaattagtagggttgcacgacaaaattaatattttttagtaaaatttcttcaaaatcacattaaggaaagcatgaaatgcattatcgtgggttaaaaatagctttggtagtaccatgccataatgaagaaacaactatttttcaagtagttactgactttaaaaaacacatgcctgagattgagccttatgtttttgataactgctctactgataaaaccaaagaagaagccttaaaagccggggcaacgctaatctctgtgtatgaaaaaggtaaaggcaacgttgtaagaagaatgttcgctgacgttaacgcagatgtctatgtaatggtcgatggtgatgccacatacgatgcatcctcagtccataaattagtcgataagttaattgatgataaccttgacatggtagttggttgtcgaaaagttgtgtctgataaaaaagttaaagcataccggttaggccatgagtttggtaataagatgctaacaagcagtgttacatctattttcggcggtaagtttacagatatgctttcagggtatagagcatttactcgaagatatgcaaaatcttttccagcattatctcaaggctttgaaactgagactgaacttactgttcatgcccttgaattaagaatgccctatggtgaagtttcaactttatatggagaaaggccagagggttcagtaagtaaactttcaacttataaagacggattaagaattttaaaaactattataaagcttttcatgcgagaaaaacctttgtatttctttagcattttgaccgtattactttcaacaacatcaattattcttgctataccgattttctccgactattttcttaccggattagtacccagattaccaacagccgttctatctgcaatgctcatgcttgccgggctaatgacattatcctgcggtcttattttagataacattaacgttgctcgtcatgagagccggagactttcatatttactcattaccaactcattaagctaaaatatgagcaaggtcataactgaaataataaaatttggtgctgtaggggtatcaggctttttagtcgatactttttttgtactgctattgaaatcatatgctggcgcatatggtgcccgaattatttctttctcattcgcagtaattaccacttggttacttaatcgcaatatcacattcaaaaaagctaatagaagtgatgggctcatcactgagtttctccaaatatgcagtaagtatgtgtataggtgggtcagctaacttgatatgttacagcttaataatatcttcaagaccgcatactacagagaatattatattcgccaccgcaataggtagcattgccggattggtttttaactttacattatctaaaatatttatttttaaggaaaaatagcgtgcgagtaagaactggggtcataattttcctggcatctatgttacttttttcatgggttttaactgtgaagcccccttttagctcacctgatgaagggttccatctgagccgggcagacggtattctccaaggatattttatacttaagccaatatctccagatggttcatccggcgcaaaagttgatatatcattagataaaatggctaatctcttcaattcaacattgagtgcaacacaccttggagatctcaatgattcattagaagaaatgaaaaatcttaagtggagccatgcttatttagctaaagggatgccgaacgttagtttttatactcccagcgtttacctgccacaggctctcggcttttacattagcaaagccttagatctcaacctttactcatcatatttatttactaatgtagtaacttttgcagcatgtttaataatactaattcttgcctattatatttaccccataccattattaacccttgtttttttaacaatcccaatgtctgtctttcagttgatgtcaccaactattgatggccttagtatggcatttactgttctagccatgtcatgctttatgaggcttctttttgacaaagagataaaaaactacaacgggcttgctctcttaatgtcgatttgtatattttcagcagctggtagtcgcgcaaacttgttattaatgtcattaatgcctttgtggcttttttataaaaacaggaaactttcaaatcttttatttctggcactatgtttagttaccaccctctcatggaccacatataatcttttgaatgtacacgacgctggcatgggtcgacatcctggttatagcaatactgagttagtcattttttacctgaaaaatcctttaatcttctttaaaacattcttcaatactataactgacgtcaatacattaatattctatttaacatctatgataggtgtgctaggttggcttgatgcgccaatttctaaaacttctttttctttattttttgttataattttgactgcattagtaatctccgtaatgtcatttagaaagtcgaatgacaaagcaacatcgtattttattttcatcttatcagcactttcattattattgatttttcccgccttacttgctcaatggaactcattccctaccgagaagatagttggtgtccaaggaaggtattttatcatacctgcacttatatttggttattgctttcacacttatgaaaggatgaatctggaaaaattactagtattgtcatcaattttagttgcatcaacttacacagttcattcagcaatcagcaatcattatattcaccctaaatttacatttgaaacaatcaattctcctgacgaattgaaaaactcaagacccataaatattttggggagctcacagcccccttatgccctttcagtgcctaatgggaacattagcagtatgctcatctattttggaaattataataacaaagctaaaggcacggtaaatcttaaggtttgcagcgtagagaaatgccaagaaacttttgttaacacacacaaacagcaggataactctttttatgagtttaacctaccgcagggtttaaaggtagagaatagaaaaatcacattaaaatttaatttttttgaagatgacaattcatcccccctagctttgtgggaatatagcccaacaaacgaaaataactcattttctccacgaattaaaataaattatatcaactaaaagtccgggcggcatgtccgcccttatctccgtctaccctccctgttttaaagtctcatttttactttctcagaagactttcacattattagcttattaacaggcccttttggaagaacatctcgaccagatgcttcagcaatataggctctcagagctttgcgataagcagtcaattcagcttttgactttgccaccgccgcttccgttaactcgccgctatagtcctcatcttcaattcgctggttgagagcggtgatctgggctgacgcgtgattgtattccgactgcgcaatattgaggtttttctgtgcctgctcttccggggtgatttcaactaccggagcagtaaatacccagctaccttttttgtccttctctgcagtaaagcttgggccgacctgatcctcctcttttatctcgtaagtttcatactcagggaaaaggtcaccttctccgttccacaggactgcatttactacaacgccgtctttaatcaatgcgtaagatgaaactgacattatgcatactcccagataatgacaatgccatcagcacccgcgccacctttgtagccggttaatgcattgttaggtccgccaactgcgccgcctccaccagaacctaatccattggcatcgtttccgactgagttgttatttgcccgactgaaaccacctttaccgaaaaacgaatctccgcctttaccaacaaagtttgatccggtactaagagatacgccgtgttcagaactccctccgggggtgttaacgatgttcccgcccgttgcgttaccacccagaacacccgtacaggtgaacggcggtattgactgctcttggccgtaaccgccgctgccacccttacataaaataaggctgcctattgaggagtcgcctcctacgctacccgatgcgggtaatccactattcgatttgccctcgtacctactgtaataagttgtccgtcaatctgatctactgatagttttgattttgcataaccacctgcactaccgccggtagccagggaaacggttgatgaccctgaatacccagtgttgcctcccgaaccacctgcggcgtgaacctcggaaataacatttatcgtacctggcgtttttttataaatggcactggttttaaaaatctgtacattgatcagccgtccgggtccgaccaccgtgttcatggcggcgagcagctgcgccctgttagatttggtaagcgtcaggcccccgcctcaataaccgcagctatttattcctgaactgaatcaaaaaaatctgcattcagcgcagtaggcagttcaccggcctgaggattaccgccggtaaagccatttttacccgcgccaaatttatccacctgcgcggtagatgtgtcaatacgatgcatttttactccgggtaactgaaaataacgtaggtatgtgacagtgcctggttgttaagtatgcattcagcgatagtgtctccccacgttctaagactgtccgtgcagttactgatggccgtcattggggttatctgcgtggaagcaggcatgtttacctgccaatagtaccgccactcatcgctgtaaagtgagtcagtacaaacagacaggcaggtaaactggcttttgttgtagcgagtaatggtgacgccggtgtaacccaacgcctcaagctgggccaggtagaatgcctcattaataccgccagccagattaagctttgcatccagccgctgccgccgctgctgaagcgtccgaacacctgcaggtgcgcagctgtcaggcagtccactgatgttctcatagcgatcaatcaactccgtcactgagtgcgggtccgtttccagcatcagtgcatcaccgcgaccatgtacctctgccagtgacggtgccagcccggttagcagcaggtcttcactgtcccacgcagggccgcgtggcagcagtgcgcccagcatccggcgatactgcgccgttaattccatgagatagtccccaccacacccacctcgcctttaccgatggtgatatcagctgcaggactgaccagcgtgtggctgtactcgccggttgcgatgctgatggcctcactgatgcgtgacggcttcagcacgttctcaggaccgccatcgcgcagcatcattgagcggagctcagtctcaacggcatagcgcacagttgcggtgtccgggttgagtcgaatctggaagttaaccgtgtgctgcgtaggtgcgaaaacataaatgtctgcaccggctaccggggccagtggttcaatataggctttgacggcggccaccgtggcggcatccgggatcggattaatcaggtcgctgttcgccaccatgataccgactgttccccgcccgctccagtgacggtatgtccaggcgcgggtaatgcctgccacttctttagcccacacctcataatcgccgtctaccgcattaagacagggacgtttgattacaggagtgagttcccagactcaccactatttaagaaccaggctggatcgtcaaagtcggtagctatcagggagattgctgatttgtggctgaagctcaaaaagcctgactgggccaatagctcttatgtcacgacagaaacgtcgcgccagggtgacgctggatatcatcggcaacggaaaggacatccggtcgatcatgcagaaggacctactcaacctacgcattgaacttcttaatggcagctacttcacgggcaggaagatgaatatagaaaagaaagggaggacagcggccacggttaactccagcatggcagacctgaaagcgatcttcgcctttgctcatggcaacgggtatatagaagcgaacccgatgacgggcatcaagcctctgaagaagtcgaataagcggccggacccgataacacgcgaggagtaccctcgcctcatcgcagcctgctcaacgcgtcagacggcaaatatgtggtcactcgccatcctgacgggattacgtcacggagagatatgtgcgctggcctgggaagatatggaccttgaagcgaaaaagctgacagtcagccgcaaccttacaccacagggtctattcacgccgccgaagacagaagcgggaaaccgtgtcatatgtctgatagatgcagccgttgatattctgcgtgaccagcgagagttgacgcgaatgtatccacagacctctttcacttttcataccagggagtatggcgagcgaattgaggagcagaaaactttcgtgttcaatcccagcgtgaacgcagtcaatggcagatcgggagcatattactcaacagagtcaatcggacagatatggaccggcgcactgaggcgtgcaggcctgcgtcaccggaaagcatatcagtcccgtcatacgttcgcgtgctgggctctttcagcaggcgcaaacccgaactacgttgcatcgcaaatgggtcactccgatgcgcagatggtgtaccgggtttatggcgcctggatgtcagagaacaatactgaccagctatcactcatcaacacgaaaatgagcgatcttgtgctacatacgtgctccactaaagtgacagtgtgataaaccttaacagcttcagacagttacccgcctaaacctgcatattcataatttcactatacgccgacaccagcttgttcctgacctgaatacccatctgcattgagatggacgatttctgcagatcgaccatcacgtcattaagcgcgatacccggtttccccatctcaaaatcctgcgcctgggtgcgggcggtggtctgcgtctcgctgatcttatccagcgccgctttcatagtcgcaccaaaatcgatctgattaggggcttcactactgcggttgctggcctgcagtgaggtcgcctgtagctgctgcagtacgccatcaattgcctgaatggacatgaacgataccttattaaagaggatgacatttttgatgtgagcaaaagttagcacgttgtcaatgagacaaagccgctaaatgacatcaaaaaccctaccttatccaggcatcgaattttgcttatcacctaataatgcctggcattgaagtggaaattttatctacgcaggtcagggagtctgttttgccatctcaacttacccggtcaattacgtcaggcaggaaacggtcatgaatgcgagtacagccgccacaacagaacaagaaaagaaaggcttcggtgacctgctcgctcgcctgcgcgcaaatccgcgtattcctttaatcgtcgctgccgccgccgttgtagcgatagtgatcgcgatggtgctctgggcaaagcagcccagctatagcgtcctttataacaaccttacagatgaagatggcggtgccatcgtcacgcagctgacgcagatgaacatcccttatcgcttcgccgaaaatggcggcgcgctgatggtgccggaagcgaacgtgcatgagctgcgtctgcgtctggctcagcagggtctgccgaaaggcggctcggtgggttttgagctgctggataaagagaagttcggtatcagccagttcagcgagcaggttaactaccagcgcgcgctggaaggcgaactggctcgtaccatcgaatcactcggtccggttaaaagcgcccgtgttcatctggcgatgccaaaaccaaccttatttgtgcgtgagcagaaagcgccatccgcctctgttaccttaaccctgcagcctggccgtgcgctggatgaaggccagattcaggccatcgcccacatggtctcaagcagcgtcgccggtttaccgccgggcaacgtcaccgtggtcgatcagaccggtcgcctgctgacccgctctgactccgccggtcgcgacctgaatgatgcacagctcaagtatgcctctgaagttgaagctcgctaccagcaacgtatcgaagcgatcctgaatccgattctcggtcagggcaatgtgcatgcgcaggttaccgcgcagattaacttcgacaccgccgagcagaccgacgagaaatatcagcctaacgctaacccgtcgaactcagcgattcgttcgcgtcagaccagcaccagcgaccagtcaggcagcccttatccgggcggcgtgccgggcgcgctctctaaccagcctgcgccagcaaacactgcgccggtgacgacgccgaacaataatgccgccaatggccagaacgccaatggtcagaatgctaacggtcagaacaacgcggcgaataacgctaaccagaccaccagcaccgcagcggccagtgccggaccgaccaactcgcgtcgtgacgacacggtgaactacgagctggatcgcaccattcgtcataccaaggtcaacgttggtgacgtaaagcgcctgtcggtggcggtcgtggtgaacttccgtgcagatgataaaggcaaagcggttgcgctgaacgaacagcagctgaagcagattgaagatctgacccgcgaagcgatgggctactcccagaaccgtggcgacagcatcaacgtggtgaactcgcagttcaacaccactgaaccagtgaccaccgatctgcccttctggcaacagcagtcgttctttgatcagctgatgaacgccggtaagtggctgttgattgccctggtcgctttcatcctctaccgcaaactggttcgtccgcacctggttcgcaagcaggccgcagagaaagccgccgcggaagccgttgccgctcgtgcgactgagcaaccggaagaagaagcctttaatgtgcagctcagcaaagatgagctggatcaggaacgtaagtctaacaaccgcatgagcgcagaagtgatgagtcaacgcatccgcgacatgtcagaaaacgatccgcgcgttgtagcgctggtaattcgcgaatggatgagtaaagagctatgagtctgaccggaaccgaaaaaagcgccatcctgatgatgaccattggcgaagagcgcgccgcggaagttttcaaacacctgaaccagcgtgaggtccagcacctgagcggcgcgatggccaacatgcgtcaggtgtcgcataaacagctgactgaagtgttgcgtgagttcgaagcggatgctgagcagttcgcggcgctgagcctgaactccaacgaatacctgcgttcggtgctgacccgggcactgggcgaagagcgcgcctccagcctgctggaggacattctcgaaacgcgcgacaccaccagcggcatggaaacgctcaactttatggagccgcaggctgctgccgaccttattcgcgacgagcatccacagatcatcgccaccatcctggtccacctcaagcgtgcccaggccgccgatattgtggcgctgttcgacgaaacgtctgcgtcacgacgtgatgctgcgtatcgccactttcggtggtgtccagccagccgcgctggccgaactgacagaagtactgaacggcctgctggatggcaccaacctcaagcgtgcgaagatgggcggcgtgagaaccgcagccgagatcatcaacctgatgaaaacgcagcaggaagaggcggttatcgaagccgtacgcgacttcgatggcgaactggcgcagaaaattatcgacgagatgttcctgttcgaaaacctggtggcagtggacgaccgcagcatccagcgtcttttgcaggaagtggagtccgagcagttgctggttgcactgaaaggtgccgaacagccactgcgcgagaagttcctcaaaaacatgtcagcccgtgcggcggatatcctgcgcgacgatctggccaaccgtggcccggtgcgtatgtccgcagtggaaaacgaacagaaagcgatcctgctggtggtacgccgcctggccgagtcaggcgagatggtgattggtggtggcgaggaaacttatgtctgatgcattttctgcgcgcccctggcagctgtggcagcccacggatttaggccgtttcgatgagcctgctgaaccggagctgcagccagaaatttacgaagctgaagatggcgttgatgagcagcaacagcagctcgaacgcctgcagcagcagatgcgcaaagaggcacagggccagggttacaacgaaggctatcagcagggtgtgaccgaaggccagaaagccggctacgacgccggttttcagcagggtctggccgatgcccagcagcagcaggcgccccttcaggcgcgtatgcagcagctggtaaccgagttccagaacacgcttgaatcgctggacagcgtgattgcggcccgtctgatgcaactggcgctggaagcggcacgttcggtgattggtcaggcgaccacggtggatggcaccgccctgctgcgccagattcaggggttactgcagcaggaaccgatgttcagcggcaaaccgcaactgcgcgttcacccggatgacttacaacgtattgagcagaccctggggccgacgctggatctgcacggctggcggctgatcgctgacagcaccctgcatcctggcggctgcaaactcagcgccgaagatggcgacctggatgccagcgtcgcaacgcgctggcaggaactctgccgtcttgccgcaccgggagaactgtaatgaccactcgtctgaatcgctggctcggctcgctcgacgcctttgagaaacgcatcgcccaggtgcagccggtgcgccgttatggccgtctgacccgcgccaccggcctggtgctggaagcgaccggcttacagctgccgctgggtgcgacctgcgtaatcgaacgcaacgatggcaaaaccatcagtgaaatcgaaagcgaagtggtgggattcaacggtcagaagctgctgatgatgccactggaagaagtggacggcattttaccgggtgcgcgggtctatgcgcgccagaacggagagaacccgcaggcgggcaaacagatgatgctggggccggaactgctgggccgcgtactcgatggcagcgggcgaccgctggacggcctgccgtctccggataccggttatcgcgcgccgctgaacaccccgccgtttaacccgctacagcgtacgccgatcaccgacgtgctggataccggcgtgcgggcgatcaacgccctgctgacggtcggtcgcggacagcgtatgggcctgttcgccggttcgggcgtgggtaaaagcgtgctgcttggcatgatggcgcgttacaccaaagcggacgtcatcgtcgtcggtctgattggcgaacgtggccgcgaagtaaaagattttatcgagaacattctcggcgctgaaggccgcgcccgttcggtggtgatcgccgccccggccgatgtttcgccgctgctgcgtatgcagggtgccgcttacgccacgcgtatcgcagaagattttcgcgaccgcggccagcatgtgttgctgattatggactccctgacccgctacgccatggcgcagcgtgagatcgcgctggcgattggtgagccgccggccaccaaaggctatccgccttccgtattcgccaaactgccagcgctggttgagcgtgccggtaacggcatcgacggcggcggctcaatcaccgccttctataccgtcctgaccgaaggcgacgatcagcaggacccgatcgccgactccgcgcgcgccattctcgacggccacattgtgctgtcgcgtcggctgggcgaagcgggtcactatccggccattgatatagaagcctcgatcagccgtgcgatgacctcgctgatcgatgagaaccactatgcgcgagtgcgccagtttaagcagttgctctccagcttccagcgtaaccgcgatctggtcagcgtcggtgcttatgccgcgggcagtgatccgatgcttgataaagcgatcacgctctatccgcagatggaagccttcctgcaacagggcatctttgagcgcagtgattacgacgacgccagcctgcatctgcatgcgctgtttggctagtcacacgaattaacgcgaggtaacggcaatgaaaactgcaaatgccatcgatacgctgcgcgacttagcggagcaggatctcgaacgcgctgccatctatttaggcgatatgcgtcgcggccagcacgccgcgaacgagcagctgacgatgctgctcgactatcaggacgaatatcgcaacaagctcaacgatgacatgtcgtcgggcattgccagcacccgctggaccaactatcaccagtttattcagacgctggaaaaagcgattgagcagcaccgcaaccagcttaataactggaatcagcggctggaacaggcgctgatcaactggcgtgacaaacagcaacggctgaacgcctatcagacgctgattacgcgcgcagcggaaaatgcattacgacaggaaaaccgtctcgatcagaaacggatggacgaatttgcccaacgggccgcatcgaggagaggtgaatgattacgctgccaaacattgctatgaaagcgacggtaaaaaccgacgcagaaccctcagtctcaactgaccttgctgcgggtgccgatgccctgccgcaggactttctgaccgcactgggaaaccagttactcggcctggctaaacagcagggaaaagcggcgcaatccgctgacgtcaaagcagaaattgccgatgacgcccgcccgaaagccccgctgaatgccctgatggcagcactggaaaatcctgctgcgctgaccgctctgtttaagccggaaaatattaaaggtgggtcaaaatcagccgatgataaagacaagccggacgttgcacccttaagcgccagcgatatgcagaatatgcaggcgctgttcgccatgttaccgggtgtagcggctgttacagccaccacgtcgaccccggtcagcagtgaagcgggcgagatgatcgcccagaccgataccggccggaaaagccagagctcgctgatgcaactgctgaacagcgcgcagcagagccacgcaccgggcgaagatgaaaagtctgacgccagaagcgacgtacagagcaaacctgccgtcaccactgccgccagccagagtaacaacacggcgcagagtgcgaccagtagcggcctgacgctcgacagcagtttccagcaggcgctgagcaacatggttaagcaggatgatcaggctgcgattaaagccagcgccagcgataacgcggtcaacgctacgccaatcgccaccgccagcagcctgcccgcgccggtgaccgcctccgcgaccaccagcacaccgtcaacgccgatgctgaactcacagctgggcagcgacgagtggcagcaggcgctgagtcagcagattgtgatgttcagtcgcaacggccagcagaacgcggaattgcgtttacatccggaagaccttggcgctatccagatcagcctgaaactggataacgaccaggcacaaattaatctggtttccagccatagccacgtcagagcagcactggaagccgcgataccgcagctgcgcagcgcgctggcagagagcggtatcaacctgggcgagagtcaggtgagcagtgacagttccgcgcagggtcagcaattccagcagcagcaggaggcgcgccgcgatggacaacatggccgcttctccctcacccaggacagtgacaccgacattacgccgatcgccgttcccgccgcccttcaggctcgcgttagcggcaacagcgccgtcgacactttcgcctgacagcggcaaacgctgaaggtaagcgtaaaacccgcgtcttttctacccattggtttgacttaagacgcggataatctgtctcgtgagccgagaggcttgcccataattcacaggaagtaactgcaccatgtctgataacgcgaaagcaaaaaaaggcagcaaacgtaaactcttaataccagtgttgctcattttgacgctggccgcttgcagcgtggcaggctatgcagtctggcgaatgatgaataaacatgagggcgataagcctgaggtggcgaaagttgaaccgcctcccgctccggtcttttttgcacttgatacatttacggttaacctggtcaatcccgacaacgatcccgaccgcgtgctttacgtaggctttaccctgcgtctggccgatgaggatacccggcgtcggatgaacgactatctgcctgaggtgcgcagccgtttgctgctgctgctctcgcgtcagagcgctacggcgctggcgacagagcaaggaaagcaggcgcttgttgaacaagtcaaacaggcgctgacacccccgctggtaaaaggtcaacctccgcaggctgtaaacgatgtgctgtttactgccttcattttgaggtgaatcaatgggcgatagcattctctcccaggctgaaattgacgcccttttaaacggcgacagcggcagtgcggaagaagaaaagaaacaaaacggaccggaaggcgatattcgtccttacgatccgaacacccagcgccgtgtggttcgcgagcgtttgcaggcgctggagattattaatgagcgttttgcccgtagtttccgtatggcgctgtttaacctgctgcgccgtagcccggatatcagcgtcggggcgatcaagattcagccgtaccacgagtttgcacgcaatctgccggtgccaaccaacctgaacctgatccacctgaagccgctgcgcggcaccgcgctggtagtgttctcaccgagcctggtgtttatcgctgtcgacaacctgtttggtggcgacggacgttttccgactaaagtcgaaggccgtgagtttacccataccgagcagcgcgttattcgccgcatgctgaagctggcgctggatggttacagcgacgcatggaaggccatttatccactggacgtcgagtatgtacgttcagagatgcaggtaaagttcaccaacatcaccacttcaccgaacgacatcgtggttaacacgccgttccaggtggagattggtaacctggtgggtgagtttaatatctgtatcccgttttcaatgattgaaccgctgcgcgagctgctggtgaatccaccgctcgaaaactcacgtcaggaagataaccactggcgcgacaacctggtcaaacaggtgcagcactctgagctggaactgatcgcgcactttgccgaaacctcactgcgtctgtcacggattttgcagttgaaacccggtgatgtgctgccgattgagaagccggaacgcattatcgcccatgtcgatagcgtcccggtcttaaccagccaatatggcacgatgaatggtcaatacgcgctccgtgtcgaacacctgattaacccgattttgaattcgctgaacgaggaaacagccccatgactgacagtaataaaccgtctgacgatatctctgcggacgatctgtgggctgaagcgatgaatgagcaggtcggcagcggcagtgcgccgcagaccgacgaagtctttaaatcattcgacagcggcaacgtcgctggatcgctgcaggatatcgatctgattatggatatcccggtgaaactcaccgtggaactgggtcgcaccaaaatgaccatcaaagagctgctgcgtctggcgcagggttcagtggtggctctggatggcctggcgggtgagccgctggatatcctgatcaacggttatctgattgctcagggtgaagtggtagtggtgaacgacaaatatggcgtgcgcatcactgacatcatcaccccatctgaacgtatgcgtcgtctgagtcgctaaagagtcacattatgaatagccagaatcaaacgctgcaaccggctgcaccgcacgctcaggcgatctcgaccggctccatgctggcccaggtcagcagcgtgttagccgtgattatcttattgattctggcctgcgcctggctggcacgccgtgtcggcttcgcgccgaaaaaggtcagcagccaggagcttaaactcacagccagcgtctcagtgggccagcgcgagcgggtggtgattgtcgataccgccgatgcgcgtctggtgctgggcgtcaccgcgcagcagattacccatctgcatactttgccgccgggtgaaccggtctctgtgacgccggttaacagtgcgccacaggattttcgtcagctgttacagaacctggttaaacgtcccggaaaaccacaatgatgcgtcgactgcttcctttattgccactgttgttactggcaccggttgcccatgcccagctgccgggtctggtgagtcactcgctgccgaatggcggtcagagctggtcactgccggtacagacgctggtctttatcactgcgctgacctttattccggccgtgctgctgatgatgaccagcttcacccgtatcatcattgtgtttggtttactgcgtaacgccctgggcacgccctctgcgccgcctaaccaggtgctgctcggactgtcgctgtttctgaccttctttattatggcgccgaccttcgacaagatttatcaggatgcttatctgccgttcagccaggacaagatcagcatggaagtggcgattgataaaggtgcccagccgctgcgcgagtttatgctgcgtcagacccgtgaagcggatttagccctgtttgcccgtctggcgaatactgccccgattgccggtcctgaagcggtgccaatgcgtattctgctgcccgcctatgttaccagcgagctgaagacggctttccagattggctttaccgtctttatcccgttcctgatcatcgacctggtggttgccagcgtgctgatggcgctggggatgatgatggtcccgccagcgtccatcgcgctgccgtttaaactgatgctgtttgttctggtcgatggctggcaactgctggtcggttcactggcgcaaagcttctactcctgatcccccttttcttaccggagcaacacatgacacccgaatcagtaatggtaatgggacaggaagcgatgcgcgtcgccctgatgctggccgccccgctgctgctggccgcactggtcagcggtttgctgatcagcctgatccaggccgcgacccaggtcaacgaacagaccttatcctttattcctaagattctggcggttgccactaccggtatcattgccggcccgtggatgctgaatctgctgctggactatatccgcaccgtctttaccaacctgccttacatcatcggctgatgattactctcgacagcagccagctggttcaatgggtcagccagttcttctggcctctggtacgcatcatggcgctattcgccaccgcaccgatcctcaatgaacgatccgtcagcaaacgtgtcaaaatcggtctggcggtaatgatcacctggctgctgatgccgctgttacctgcggtcaatgtcaccctgttttcccctgaaggcttcctgctactgattcagcagatgctgattggtattgcactcggcttcaccatgcagttcgcttttgctgccgtgcgccttgccggggaagtgattggtttacagatgggcatctcattcgccacctttttcgatcctggcagccgtcttaacatgccggtgctggcccgttttctcgacatgctggcgatgttgctgtttcctgacctttaacggacacctgtggctgatctcgctgctggcggacagttttcatacgctgccgattggcggtcagccgctaaatgccaatgcatttatggcgctggtgaaatctggcggattaattttccttaatggcatgatgttagcgctgcccttaatcgtattgttactcatggtaaatctggtactgggtttgttaaaccgtgtttcaccacagttatcaatcttcgcaattggcttcccgattaccttatcagtcggaattttaaccatcagcttgctgatgcctctgctagccccgttctgtgagcatttgttcggtgaagtatttgatttactcgccgtgttcctgacagaactatcccgtccctgaacattaagtttctaactatctttgcataacgatacttaagtatcgcaaaaccatccgtgcattttcctaaccatgttttccagaatgcaactaaggaaattctgataaacgtgcggagagtctgaaaataattcttattaaaccgggcttcgcgtattttagtggggtggttcacaggagcggtcagactgtgaatgtgcaggcaaaatcgacaagacactgaatttacaagaaaaaaatctttaggtgatttttcttgttaaaaaatgttttttccggcattgtcatcgcacgctgagacatcacactttcgtaaaacaaatgtttttgagaattgtcctatcagaaaactccgcgttttcaaggatagtgacctggctcccaaaaaaatgagtcttacttaacctccgacatttcactggcaatccccgccatggccggagaatgtgtgacgtcatggcagcacaaattttttgcagaacgggtcagggatgaagacttttatgggcggttgcctgttgccaaactgcacgagcagaataaaaaagtacctaagaaatctctctcgtaccgcaacgcgtattcatcgttgatttaaacggataacaaattggtgagggtcgctattatgccaactattattatggattcctgcaactacacacgcctgggattatcagactacatgtcttcaaaaggagttaagaagaaaaatatctcttctgtctccgatattgagcaactacagcaaaaatgtgagcaattaaaccctggagtcgtctttattaacgaagattgcttcattcatgaatctgattccagtgaacgtatccgcaccattattacgcagcatcctgatacgctgttctttatattcatggcgattagcaatatccattttgaggaatatctctacgttcgtaagaacctgattattacatcaaaatcgatgaagacatcgaccctggattccttactcagcacctatttgcagaagaagcttaaccagtctgcgcgtatctcttcgggcatggatgtacatccattaacgctgagccagactgagtcaaacatgctgaagatgtggatgtcaggtcatgataccatccagatctcagataaaatgcaaattaaggccaaaacggtatcgtcacacaaaggtaatattaaacgcaaaatcaaaacccataataagcaggttatttatcatgtggtgcgtttaacggataatgtgacttcaggtatttacgttaatatccgctgatcataacatctgaagaaccggcctctctggccggtttttttttgcccggaattgcgatccaggtctcactcttactgctaagcctttacgctcttttgccgatgttatgccttataacaacagcctcaagagagcaaggatatgaacactgcacgagataataatggacagaaaagcgcaggcatctggcagaatctccgcctggtgccgctgtttagcctgatcttcggcggcattttgctgctgttcgcactctgtattggtgtcgccagttactttctgatttccggcaatcactccctcgatgatgccacggacgaaattcaggttcgtatgggcctctctaacagttcaaaccacctgcgtaccgcgcgcctgaccattattcaggccggtgccgccgcgcgtattggtgaaatggacgagtttcgcgccaatattgccgccgccgaaaaacggatccagcaggcaaaagatggcttcgcgatttatcaggcacgtgaagttaagacgcccgcggatatggaactggatgccacgctgcaggctcgcttcaacgattacattaccaaaggcctgataccgatgattgaatccggtaaacagggcagctttgagggcatcattgctcaggagaccgatgtaacccgcaagctggatgacgactataacgcggtgttgctgaaggcgatcaagatccgaactgatcgcgccaatgccattaccgcccaggccgatcaacagtcgcgcatcggctttatctccatggccgtggcattcagtgccgccctggtgctggtgctgttgacctttgtcttcctgcgccgcgtggtgattagtccgctgcgtcagtcggtgctgcgtatcgaaacgcattgcgcagggtgatctgacctccgctcccctgccccatggccgcagcgagattggtacgctcatccataacctgcaactgatgcagcaggcgctggtaaccaccgttggtacggtgcgtgaaggcgccgtcgcgatttatcagggctccagcgaaatttcagccggcaacaccgatctctcttcacgcaccgagcagcaggctgcggcactggagcagaccgcagccagcatggaacagcttaccgctacggtgaagcagaacgccgagaatgcgcatcacgccagccagctggccgcggatgcctcgggcaaagcgcgcagcggtggcgagctggtaaacagcgtcgtgaaaaccatgaccaatatttccggcagctcgaaaaaaatcgctgagatcaccaacgtcattaacagtattgcgtttcagaccaacatcctggcgctgaatgcggcagtagaagcggcgcgtgccggtgagcagggtcgtggctttgcggtggtggccagcgaagtgcgtaatctggcccagcgcagtgcgcaggcggcgaaagagattgaatcgctgattgctgagtccgtcacgctgatcaatgacggttcgcatcaggttggcgcagccggtagcaccatgggtgagattgtcgaagccgtacgacgcgttaccgatattatgtcggagattgcggcggcgtcagacgagcagagccgtggtattcagcaggtgagccaggcggtcaccgaaatggataacgtcacccagcagaacgcctcgctggtggaagaagcctccgctgcagcggcctcgctggaagatcaggcgggtaaactgacgcaggcggtcgcggcattccgcctgcaggatgcccctgcaaccacaggtgtggctgctcgcgtctcttcacccttaaagacaccggctctggccccccgtccggcgctggcaggcggcagcgataactgggaaaccttctgaagtcataccggtaaacgtcagcggctgatgtcagccgcgtaatctccgacagcaaaaagccgcctttccggcaaacggaaaggcggcttttttattgcgcgtcaggctcaggcttcgtggtaaggctcgacgaaaatgccatccggctggtgggtctcgttaaaaaaccagatgcccagcggataatcttccagcgccaccaggaacatggtgccttcattaaacggctccatagccagaatggtgccaacacgacgcgggccgccatcggttttgacgctgacgcggtcatttaccttcatttcggttctccagattattgactgagtacagtctaaacgaagaaccgtggtgatgcagcgcgttagcggcgggcaatgacccagacggcgtggatgataccggggatataaccacagagtgtcagcaggatgttcagccagaaggcgccgccaaaaccaacctgcataaacacgcccagtggtggcagcagaatagcgataataattcgtaagatgtccataaccattcctttaggtattgataaaaatcagctttatcgttaactatagctgaatctgctctgtttagtcgaaaagtcaggtaaatctgagtaaggagaaatttttgcaattccttaacatttcaccgcaagacttcttacgcgtcagacctttaaactcttctcactgcaccaccccataggtgcagccaacctgaaagtaacaaggattttgcccgcgcagcgcgggcttttttttgcctgcgatctcttcgctcccgcctttctgccctgcgttctatactgattactctgtttgctctcaggagtcagaaaatgacagacgaaaaacagcacggcgatgctcagccatccgatctgcagattgatgtcgaaggtttactggcggcgattcaggccagaaacgtcgggagaggtacgggagtatatggagcaggatcagacgccacggctggaattagaaggccgggttttacactcctatagcgaactggcggaggcgtttgaaattgatatttgtgattatcgcgcctatgaagcgaaccgctgaaatcgatttcaaaaaaaaacccggcgggaaggccgggtaaaaaatcaattcgttacaccagggaattcttaacacctctgtagattaccctttcccgactccgaaacaagcatcagatatgcacgtttctgcaaccgatcaggtaattatggagcgactgttaccaaaaacattgcgcccgccagtcacttagccctgcacacttcttgcatacccacttttactgcggtttcgttttaagaattatcctggatttccagccagcgtggcaggaaaaaaagtgtgagccatattcaactataatattgaaaaatcgccgctttagccgcgaatgtgatgaaaggagcccgtaaatgcccgatctccaccagccgttaatgataattaccgatctggatggttcgttactcgaccatcatacctatcgctgggatgcggccaccgaatggctcaccacgctaaagcagtacgctgttccgctggtgatctgttccagtaaaacggcagccgagattattccgctgcaaaaaaggcttggcatcagcggttcaccgtttattgctgaaaacggtgccgtggtgcaaacgcacgatcagcaccgtatccgcctgcccgataacaccctgacctatgatgctatctgccagcggctggctgccttgaaaacagcgtaccgttttaccggctttcatgacttctctgatccggaagtggccgcaatgaccggcctgagtgaggcggatgcagaactgtcgcgtcagcgcgatgcgtcagaagtgattgtctggcgcgacagtgacgaggcgtttgaccagttccatgacgcactgcgtgcagagggcctggcgctgacccagggcgggcgtttctggcatgtgatgcctgcgggcagcggcaagggcgaagccctgagctggctgctggcgcattcacccggtgaggcacgcgtgaccatcggactgggtgacggccctaacgatgcgccgatgctggatgcggttgattatgccgtcgtgattaagggctacagtaaaacaccggtgacactcagccgctccgatcagcagcagatctatcacacggctcaccatggcccagagggctggcgtgaaggacttgactattttttgactcaacctcaataagctgcccacgggcattaaaaggatgatgcgatgagtgacttttatcagaatggcgtaatcaccaactttcacaacctcacccaccgtagcgtggagtcgctggaaaaagagatggtacgctttgcccgcaaacgcaaaatggggctgatcctgccatcgctgttttccgaacttgaaggcccggcgctgacgaaaattgtcgatgagctggctaaagtgccctatctggatgaaattgtgattgggctggatcgtgccgaccgcgaccagttcctgtttgcccgcgagtttttctcccgtctgccgcaacggcatcgcattctgtggaacgatggcccgcgtctgaaggcgattgatgccgagctggataaagagggtctgtcacccaccaatcccggcaaaggtcgcaacgtctggttctgcaccggctatacgctggcgtcagaccgtaccagctgtgtggcactgcatgactgcgatatcgtcacctatgagcgcggaatgctggcacgcctgctctacccggtggcgaaacccggcgtttcagtatgagttctgtaaggggttctatgcgcgcgtcgcggacggcaagcttaatggccgcgtgggacgtctgctggtgggtccgctgctgcgatcgctgcagaaagtttatggccattcagaatacctggaatatctgtcgagcttccgctatccgctctccggggagttcgccatgcggacgcatgtgctgaacgggattaaaatccccggcgactgggggctggagattggcgtgctgtcagagatttaccgtaactacaccacccgccagtcgtgtcaggttgagattgccgataactacgatcacaagcatcagccgctggctgaagatgatggcaccggcggtctgaagcgcatgagcagcgatatcgtccagtcactgctgcgtaagctggccaccatgggtgtgccgctgaccagcgactcgttccgggtgctgaaagcaacctattatcgtaatgcgctggatatgatggagacctataaccacgaggcggcgatgaacgggctgaagtttgatcagcatgtggaagaggcagcggtagagatgtttacccagtcgattctggaagcgggtcaggcgtttattgagcgtcctaacgataagccgtttataccgagctggagtcgcgtccagtcagccttcccggatgtgctgcagcggatctatcaggcggttgaagaagataacgacggtaacgtctgaaaacagggcggcacagggagtgtgccgggccagaaaaagcagaaaccgggcctggcgggtcgcagaacccacaggcctgatgctgtcagcccgccagttgctgcgcgggattcaaagcgcagagttcatcgctgcgaaaggcttcgctgcgcacggcatagccatcataccagcggcactccaccatgccactcgcgtagccggtcaccaccatcgtctgcccctcttccttatgctgcacttcttcactgattgcgaaaaccatgatgcgctccttttattaacctgagtgttattaacctgagtgattattttctttatagcaggcgaataacgttcctgcctgttaaggcacgcaaaaaaagggcaaattcggaattaatcagctggatatgcggaaaataaaaaaagcggataaaaaaacttatccgctttgatgaagtattgacgctgacgtcagattttacagccttcgcaatcggcttcgtcgccgagatcatccggcacttcgctggcttttttctctgctttcgcttcagcctgctccagctgtgcgtcgatatcaaattcaaacatgtcgtcgttcatcgtcattctcctgaccgtaaatcacagtgcgctttataccgattttccgcgcactctggcaataaggttgaccactaacagcacgatcgacccaatgataaagccgagcaccagattggcaccgttgctgagcagcatggcgatccagccgctgaagccactgctcacttcctcgatcagatgatgcagcggtgcgatgccgtgtaccacaataccgccgccgaccaggaacatggcgatggtgccgaccaccgagaggatcttcatcagccagggcgcggcagccagcagcacgctacccaacccctgcgcaaggcgggacggtttttcacgcagccagaatccgaagtcatcaatttttacgatggccgccacgatgccgtaaacgcctaccgtaaccagaattgcgatgcccgccaggataatcacctggttgagcagcggcgattccgacacgatgcctaaggtaatcgcgacaatttcggctgacagaatgaaatcggtgcgcaccgcgcctttgatcttcttcttctcaaactctgccgcattctgattcgccagcgaatcgagtcgctgctgacgcgcttccggtgatttgctctgcttgtcatgctgcaggctgtgcatcaccttctcaacgccttcgtagcagagataggcaccgccaatcatcagcagcggcgtaatcagccagggcgcaaacgcggagataatcagcgccagtggcaccaggatcagtttattaagaaatgatcctttggcaacgccccatactacaggcagctcacggttggctttcacgccgctgacctgctgcgcattcagcgacagatcgtcgcccagtacgccagcggtctttttggccgccactttccccatgacggaaatatcgtccagaagtgttgcaatatcatcaagtaaagtcagtaaactggttcccgccaaaatcttatccttagtctggttcgttatgttgacaacatgggcagcgctcaatttccgtaacggtcatctcggcgatgccctcacaatcccactctacccgcaccgtctcgcctgctgctccttcagcatgcagatatttgctgaccgggctttcggtcatgccggtgatctcctccgtggcgacaagcctgtcgccgcagtaaacccgcgcggtcgctttggtattcaccatccgctcgtcacgaatctggtaaaggcgttttaccgtcagttttatgctgctcatttcaggctcctggccacggagaaagcgcagatctaaccaattatgtctgtgattagcaatcggcgttgtaatgatgaatgccctgatggtcgatttcggcactctccggcatcgccagcagccactcctccagccgctccagcagatcctgatccgtcaggcgcagtttgccacgtagcgcacactcccagatgatcagcactttccagccgctctcctgcagctgtcgcacataacgccggtcacgttcaacgttgctgttgatttttccggtccagaattctgtgcgcgtcgccggcagtttaaacagatagcagtgatgacgatgccagaagcagccatgaacaaaaataattgcctgatgttctgtcagaacgaaatccggccgacccggcaggtttttatcctgcacgcggaagctgaagccccgatctttcagcagcagcgcaatacgttgctcaatggccgtatcctgagcgcgaatggcacgcatatttttgctgcgtatttcgctggagtgaacatcagccataacctctccttttttgctggtccttcaactttagcctgcgccacgaaaagcgaaagccgccgcccgatgacttcacacagtgtgccgcaaaaacagaacattccggggggctgacacagggcacatccaggcaatttcctcacagcgtctggagtgatagcataggcaccttactgttaaggaaaaacgcatgcatcccgccgccctcgctgaaccactctctgctgcactttcatctgctgatgcgtctgaactctttcagcaggtgctggcaatctattcggttcgtgatctcacggcccgcctgcagcaggcaggattttcctgctggacgccggcactcctgaaccggattcgtcagggtaaaagtgccctgccaccgctgtgtgaggcggaactgtcgctgttacaggggctgctgccattccgtcccgcccattatgataatcctgaatttcgttttatcgatctctttgccggtattggcggcattcgtaaggggttcgaggcgatcggcggcaagtgcgtattcaccagtgaatggaataaagaggcggtccgcacttacaaagccaaccactacagcgatccgctggagcatcacttcaataccgatatccgtcaggtcacccagccggaaggtctgaccgacgatgaagcgatataccgcgcgattgatgcggcaatccccgatcatcaggtgctgctggccggttttccctgccagcccttttcgctggcgggcgtcagcaagaaaaatgcgctgggccgtgcacatggctttgagtgtcaggtgcagggcacgctgtttttcgatgtggcccgtatcctggctgccaagaagccgccgtttctttgtgctggagaatgtgaaaaacctcaagagtcatgacaagggccgcaccttcgccattatcatggagacgctggatgagctggggtatgacgttgcggatgcgggtgccagcagcccggatgccaaagtgatcgatgcgcgtcacttcctgccgcagcatcgcgaacgcattgtgctggtgggtattcgccgtgatctgaaaaagcaggattttacactgcgcgatatccgacgtttttacccggcgcaggtacccagcctgcagagcctgctggagagtgcgccggatgacaaatatatcctgtcaccggtactgtggcgctatctctaccagtacgcgaaaaaacataaagccaaaggcaatggctttggctttggcctcaacgatccgcgtaatcccgactgctgcgtgcgtacgctgtcagcacgttactacaaagatggctcagagattctgatcgatcgcggctgggacagtgcgctgggcgaagcggagtttcaggatgccgataacatggcacgtcggccacgccgcctttccccgcgcgagtgcgcccgtctgatgggctttgatgtgccaggacgcgagccgttccgcattccggtttcggacacccaggcttataagcagtttggtaactcggtggtggtgcctgtgtttgcagcggtggctcagctattactgccgcatattcgtcagttaaagtcgtaagcactgtgaaatgaaaaaacccgtctggcgacgggtttctgttttatttcttcttcttgctctgcttcttcagcagcagccgaatctgcttcagctctgttgcacttagtgcatcggtcttcacgtcagcggcactggatccctcagtcccctcttcagtgatgtcctgattatcaatcgccggatgtggatgcgtttccagactggcctgcagacgttgcacaatctcctggctcatcgaaatctgattttccagcgccacctgtttaatcgtttctttcagctcaggatcaattttaattgttaaattaacagtttcagtcatcgggcagctcctttttgttattgctacacgctaccggatgaccgtttcgattaacatactgtcataaaaatttaatattcgatttgcaaaggtgtgaagtcccgcagcacaccctcatccattcccaccagattgccctgcagctcggcataaagcttcgccatatagcgtaccaggaaatctgcgttatgctcagccagcatgcggccggtttcagtgtgcatggtttccggcagacgcagcagcttcttctggaaatgatccagcgtccacttaacatcattcagctcgcgatctttacccagcgggtcctggctgtcgaataatggccgattcagcgcaccagcggtgtagaagacccgcgccagcccgatcgcgcccagcgactccagccgatcagcatcctgtacaattttagcttccagcgtctgaggcggtatgccggcgctgaaactgtgggttttaacggcatgcatcacggcatcaatcttttcagccgggaaatcgagaaaatcctgctgcagaatgcgctgggtttccgtcgcggcataggttgaggcgagatggcgtttccggatggttcttcggcaggttcaccacatcgtgaaaatagcaggcggtcagcaccaccagcggatcagcggatgtaccgttcattattcgctgtgcgctcatccagacacgccgcagatgggcgatatcgtgcgcgccgtcgtcgtggatccagttcgcctgaaaccagctttcatagcgagattgccagagtgtgagtgacataatctatctccctgtagtgatcgacagcagtttttctgtcgcgatcagtgcgcaaacggcaagccatcatagcgactggctaatgacactttttttacagtgcagttgaaaagagcagcgctgccagcgattccgggcagaaaaatgagatctggatcatctgtatagcatctctgttacacaataaccgcaatttcggctgttttcagtctttcctcagtgaattgctgctaagaaaattagtttaacaggcgtaatgtttggttcgatcttaaccaacttcctgcctcatgctcagcgtttttttgtcacgcgattaagtgtaaaactgcacgttatgacaggtgaaaaagtctgaaaaggttcctatttttacggttataacgtactgtatccgggctattcgtcgctttttgccagttgcgtgataagctttggtgcgctttttgcattttgctggtttttaactactaaagtgacaattatacagtgacagtcagcctacaaattattaagcaaaatgatttaaagcttttatgataactctcagatgtgaagcaaatggacttttacagcagtaaccgggttctactaataaaaagaggtaatccatgaaagaacggccgattcttttttccgaacagcgtgttcgtgccctgttggttggccagcaaacgcaaacccggcgcattatgaaaactcaggctttcggtccgggacaggatcatcacgagggcgtacacgctttcgatgtgagtgctaatcatctgcatggttataaaatgatgtcgatgacggacatcagctatcagtgtccttacggtaaaccgggtgacgtgctctgggtgcgtgaaacctggcgtggcccgatggtacccgagcagtatctggccgattatgaacgcgacccgacgcccttccgccagccagaatattgccagtatcgtgcagacagcaacgagctgggccagcatgcactgagcacgccggaagcagaacagtttggctggcaaaccgccattcatatgccgcgctgggccagccgcatcaatctggagattaccggcgtgcgcgccgagaaaattcaggacatcagtgaagatgacattatggcggaaggcgtgcagaccgattcgcacttcctcaacaacttcttcaccatgaacgtcaattctgaatcgcccaaagaggcgtaccgtaaagcctgggaaaaacagtatggtgcgaccagctgggaagtgaatccctgggtgtgggtgattgaatttcatcgtattgagcgcaactgacgccccggccccacgctttgcgggctgaatcacagacaacgaccgtgctaacgggttgaatagacggcccttagccctgtcgccagatgaacagtgccagcatggtgttttcgatgctggcatttttatgtctggcgcgtcaggatagcgaaatagtccggtttctgtgcgggagttgcgatgtttaaatggccctggaaaacgcataacgacgccaccctggccgcgctgccatggcagcatgggctggcgcagccgatattcagccagctggatgaggctgaacagcaggcgctggttgagctggcgcagcgctttctgcagcagaaaaagctggtgccgctcgacggtgttcagctggatgaattgcgcagtgtgcggatcgccctgctgttctgcctgcccgtgctgaaactgggcctggagtggctggacggtttccacgatgtgttgatctatcccgagccgttcgaggtggacgatcagtggcaggatgacgatgggctggttcacagcgcgcctgcggttcacgccggacagagctggacgcaggggccggtcgtcctcaactggctcgatattcaggactcgttcgatctctccggctttaatctggtgatccacgaagttgcgcacaagctggatgcccgcggcagcggttacaccagcggtattccggtcatgtcgctgcgtgacgtcgccctttgggagaaggacttgcgtgccgcgatggcggagatagagagtgaagttgaactggtgggtgaacaggccgccacgatagatccctacgccgccagcgatcccgctgagtgcttcgccgtgctctctgaatatttctttacggctccggttctgctggccgaacgctttcccgccatgtaccagcatctgcgccagttttaccagcaggatcccctggccagaatcgccgctgacactgcgcaaactgcttaaatcacgatcgctttgcgttaaagctagccagttgaatgataatgtattttttgctgttgacaccttagagcgacgccgttaatattcgcctcgttcacacgattcctctgtagttcagtcggtagaacggcggactgttaatccgtatgtcactggttcgagtccagtcagaggagccagattagaaaaacccgctcagggaaacctgagcgggttttttgcttttcagcgatcccagtattctcttcctgtctgactgttcatctcagctcgtctgcggctgctattaccgagaccaccgttaagtctggatcaacgcatgctgtatggcgcaaccctgtcatggtgttatgacgagctggctttaaataaaaaaccagccgggcaatatttgcgccagctggctcatactaatgacgaattatcactcaggaatggtcagtacctgacccggtgcaattttatccgggctgctgagaaggtttttattcgcctcaaagattttcatgtattgggatgcatcattgtaaaactgcctggcgatggcgctgagcgtgtcgcctgatttaaccgtatatgtacgattacttcctgcggcggttacagacttatcatcaacatttttatccacagcatgtaacaactcatcgcctatatttttaatattatccagaatgctcatatttactcccctatcgtttctgatacgtttagtttaataaagaaaacaggattgccaggcaaatactgctcggcgtacgatacacctgcttctaattcatgggttaaaccactgctaaacgttgctgtaattaatataaaaacagaggatattaatgatgggtatattgtcatgggttgtattcggattacttgccggcattatcgccagatgtattatgccaggcaaagaacatatgggcattttcatgaccattattctgggtattatcggtgcactgattggcggtgtagtcagtaccgctctgggttttggcaaggtcgatggcttcaatatttacagcattgctattgccaccgtgggttcaattattgtgctgtttgtcattcataaaatcagagcgtgtaaacagtcttaatagattacgttaaaggggataacagaatgagtttactggaaacagtactggccatgtgcggcctgaataatcagaccagccaggaagtcaaaggtgtgctggagtgggttgagcagcaaggcggtttacatactatcgtgagtcatctgcagagcggcgagtacagtgaggtggttaactcctggctgggtgatgagcagaaacgttgcgctgagcagcgacctggtgcagaagatgattaactctgaggcgattgagcagttggctgcgcggatgggcatcaacaccagcgatgcactgaatcttctggcaaaatatctgccgcagctggtggataaagcgtcaacggcgggcgtcgtggataaaaaagccgatcttaccggactggttagtcagttaatgcactaagcatgacgtaattgaaagataaaagcctgctgcgaaagtatgaggcttttatcttttagatttttgaccagcattgtaaggaaataattagccaaatggtttgagctgttaatgttaagttggttaaggatgtgtaactaaataatttacaaatgaagcatcaccatgatggctgaaacttcatattagcaatatgcgccagagatatccggggtgtaatgacttgatgaccattttggtcatttattgtaggctttattagccagaaacgctaaatctattattaacttagccaattcagccaccaatatatttaggcgcagcatttaaccaggatatcaaagcctcatcaaaaaatttgaaattcactcgagagtaaattcaaattctttttcgctcccttttccctggtacctatctttagttttctcaaatagataaacaataacatcaaaagtggatcccaatttttttcgggaaatggaagatttcttccaatttatacacacaccgcaagcaataccggagcttaacatatcccaaagagcatcagtgttattaccataatactcaccaaaatctaaagccttagctattacacgatggaaatcgcgttctgaatccacttcatcaccttcaattatgacattacgatacatatagcacccttattacatccatttcccaattgatgtcgccgtttcataatggtctgtagtgatatacagtaacccatctttagaatataacaagcgtgtacctgcttgccttgctctgggataacagaggcaataagaatagcccgatcaccgaggcgggaagatgggctttaaaaacttacaagtagagaaacccgtcataagtcgggatcttacattgagttaataatgttacaagatggtaataatctttcgatttcacccttatctttttcatgaataaaaacctctagttgatgccactcatcatcaacccaatctaagaacgaattttttaatacctttaagtatatacacgcagatcagagtctggaatgtctgttattgactcgttaacgatccttactttattttcactaatccaatccagatctcgtaaacaatcagatagggtgttccagtttaaaccaaaatatcctggaaaccaaagtaattaataaagtgatcttagtaactcgtcagtatcagcgatggctagatccaccctagctcaaaacgccttaccatcttcataacatacagattcatcaaagaatttaaattcactcatcacatcatcacctgatttttatgaacgtcttataatgatcattcgtataataagcctcaccattttgcccaacgatgattcgctgaggtcctggccctggtatatccggagttggatgaacatattctttatagtatccattaggttgcttgggcaagccagatattcctgtcgtgcgattaggatagtttctgaatactgaaaaattatttttatgtggatactttccgccactagtaattcgattaggtgtagttttaaataaaaatcctaagtaaatatccccctaatacatctacattattattaatatttattaaaaatagcagactcttgatttgtattgaatgtttttgtcgatcctttactactgccagcaacaatgccgcttgctcccatcacattcctttcatcatccataacaccaggctttattgcatttaatgcaatgaattatgccgggcgattgccatgttaatagctgcaactcaacataatcacttcccagaatattatttcctattacattgtttaattgctaataaatacaattacccaagttatatacgccagtcttgatagccaaagaaaaatcgagccaaaggataggtctgactttgtcaaaaaaaccttaatgaaataaaatggtttttcatcatcagttaatccttggtgaaaatactttccatagagagcaaggagaagaaatgaaagacctccggacaaattagatatcaacaataagttatcggcctcccttctatattcagctatcgctgccgccatatatccaagaacaagaaaaaccaatgcgcaatttgataaaaaatctcgtttaaaaaacatataattgaaatagagcaaggaatccttacctaccttagcgccaccaagattcctataaacaaaaataaaaaaacacccaccccataaaaataaaaaaaacaataacataaatgatgacgtatttaaaacaatatcatttgaaatcatagtgatatatttccttagtagagtcaccgttcagatctattttttcgtcatgagaaccagtggcagaacctgtaaaaccaatacttggtccaatagaaaaggaaataccaattccatcttttccgccagacattcctacagaaccgggaccaaaacctatgctagttgaataatcacgatttaaggctccaaacaatcctgggaaatatgggccaaagtcaataccgatcgaagctccagccttaataccaaattctttagtgtatcctgaagaaatagataagtaatcattattaatctcagatcctcctttcaaagcaagtcccacaccacctgaaacctcaacttttccattaggtttaaccttatactcagtaccccaggaaggcccttcgccaacagcaatacgattcagccctgcctgtttctgctccggcgtcagaccattaacttccgcatactggttccaggattttactgccgcaccgtagctgttcatccccgtaccaaagctcagcgcattattctcaaccgcattcttaccggcaaccgccccctgaatcccaccttcaacagaaccagaagccactcccgccgacagctgcgcagccagctggccgagtgcgctgacaacctgtttttgttcctgcgtcagtttcgctggcctgcttgccgggatacattgagttgaggatagctctggccatcagttcgccacccgcagcaccggctgcacccgctgttgcgttgttgcccgccagctgcgccagtacggcacccgcaaccgcgtgcgccatggtgttagccaggacgttagcctgctcctgtccgtcgacaactttgctggtagcttgcttaattttattggcgatatatggcgccatcccaccggttgcggctgcaccgaggttacctgcgccaaggccacccagcacgcccgtcacggctgcgatagaaaagctgccgatcaggcctgatttttttcctcgcgctgatgcacttcaggaagaagggataagtgaaatactgctcggaaaaaataatccgttttacagaggtgcctcgcagtttattatccggcttgcagcgagtttatgcagcagaaggtgtatatttaaacaggttaaaacggaacaggaagagcgtaataagcgatttttagcgcgactgaagcgggcggcaacccgcagcagccgctgaccacaactaactatacgggagttaattatggctgacatgcatcataagtcaggaacccgcacggtcacaaccgccgcgcattattacaaagttggataccggcctaataggggccagccgaacccgctgccacagctgaccattaaaggccgctggctggagccgctgggctttaccactggccagcgaatcgaggtgatcaccgagccgggtcagttgattattcgcatcgctcccgccatggagggaaacgcatgaacattacctttacctctgagccgatcccggaattgatactggcaggcggcgcgttggttgtattaggatttaccagcagcaccccgttacaactgacgcttcagcagcacactctggatcactacacccaccgatgcggccacctgggtataactgtgtgagatcagccagaaccggcaagatataggagcggattggatatggcagaaacggtgaggtgattatttgcagcgactgacttacagagtccgacattgccagcgctgaatcactggtagtgaccgccgcacccggtgtactccggttgcagcagcgggaagtgatgattttagggcttagatgcagtaaccccggccattcgtcggggttactaattttagtaccttaggcctgatctaacagtcaccaccattttggataattattaaacgctgcatagattgcagactttgcatcgtccgttaacttttctctgctttttgatactgtagtatatccatgcagatcttctttagcgcatgaccattcaagccatcctaaaactggatttaaaatcaactcaaaacatccattcatatctttaagatgagctatatcaccattccgcacattgtcgataaattcatcaaagcattgacattcaatccatgcattagagctgacattcaagctataactaaatttatccacttgaatttccaggttaaattttaatgatggaatatgttcatcaagttctattacgtccaacatgatattgatcggacttgtaatctctatatccacttaatttgctcctagataacgagcgtgaatgactgttggcaactcaccagcagcgcggaggtttgatttccagttgccagccatcgactgttatacgcccatatgacataccgtccttagtcgcggtatctaacgcagcttgaaaaattctgagttctgtctgactggcaagtcttactgcttctggcgttatttgttaaggctttagatgcagcatattctgccatgtgttctgtagcattcccatgtacccacactttttgaccgttaggcagtgtcatttcaaaagatttcggtatgacagaaccaggataaacaggttgggttccttttatagaatcaaatacagcatcagttttacctatatcagcagcaatagactcagccttaccaacaaatccatcaggtaatttcttcccgggcaggaacagccccgccaacattccacctgttgcctccagtgcaagctggttaccttgagcagcttccttcacctgcccagcaacagctccccaggtttcactcttcatcagagctttcagcgtatctgccgcagcctgatttttactcgccagatcgctcaatgcctggatacagtagctatcacccattgcgcaggtggtaagcgccattgctgcatcagcaccgtaatctgccccatctaataccgcatcaccagtatccgccgccgcaccgataatgctgttaacgatagcagagagtttaccttcgccaagcttgtttcctgacctgatccttcatatttccagcagtctgcttaacagactcccgggctttgtcaccggacagcgagttattctccgcctctatctggcccgcagaagccccactacccaccccagcgctgccatcaaccgcaccgcccgctgctgcgcctgccagcgttacaatgttggcaatcagcatcttgtcatcggctgacagttccgataccactttaccgaacaacaggtgactgagcttgtcgttatagctgagcatcacggcagtcggttcgtacctatctaaaagtgatacctaaagtaaatcagatgaatattttttcaaactcgcaattatttcacttatctctttttttggaatggtaatatcctcaaggttcggtttttctatgtccacccaggttcttccgttgtctccgttaactaactccgttattttacccccaataaccctcactgaactttcatttgcaatagcaaaaaaatatgcccctgattcgttaatgattgtagtagacgcgcaaaaatcaaacacttgctcaggatattcatcatcatgtgtcgattctggatatgtcagtttaaataaggcattaaaagcttcagttgtagtggccttgaagatctcatcattgcatggaaaagaaagaagagcatttttttcatcaataacatcataaacatcaacagataatgttgatgttctgatatcttctggatacatatgtccatttataaaaaaataaaaaaaaccatttttataggattgactccattgaggaatacactctatccagatagcaaaccgataaggatcaccgaaaatcatatttatctccatttcccaggtaacccaaattcttttttaacagcgttgggtatatcgctttttttgattaggactgatgcatcccccgtgctccctgaccaatgccacgaaccatcatttgtattcgtaaactgatgtacattgccattctcgtccaatgcatacctttcttaccattctctactgaattactaaacaactgaatagagtttgtaggttcggttccagcgtttctattataaccggcttgcccaggcgtatgtttaccattcgattgataaactagcccattttcagctctggttgggataggaacaggcatcgcgcttcctttatttttcccgattcccgctgctatccctgccggctggtttccaactgcctgagccagagagtttatagcaagctgcttagcttctggcgagtcccccgacgttaatgcattgtgaatagcagccaaccgacccgcttccaactgaatcgaagcacccagaaggattgatatttcgtactattcaaacgtgtttaagttgccatgaaggcgggattgttcctttcgctcatttacgcaattgtcataatctgcaaggggcaacgatcagtgcgaggcgtcagcgggtttgaacgtcagcacgggtggcaaccaatgccagcacattgcggatcctgccatgatcatttactggtgacccacgtgtttgggtgtcggggtgtcgctctgatcaaggcgttttggagggccgccataaagcggtactgaaaaaaaatcttgtctgaaagtaataagcgcaggacatacaaccccggctcaaaagccggggggttaatcaatttaatactgaatatcagtttgattgaccattattttactcagggttaacatcataacgtgcatcctgaataatgtaaggttctgcgacatcttcccatacaaccttcgccatgttttgccattcagtcgggttttgctgctttgcaatataatccctgattagcttaacagcccggttaaagtcagccttatctaactcaacaaacgaataaaatttcagatactcgccttcttctgactttattatttcatgcagcttgggatggttgggtaaaaaaacaccatccagcaggtcgccaaaagcatcccaatagctactatgtataaacgcagaggtaagtctactctcaggtttttcgatagtttcatctctacgaaaaaaaatacttgctcccataccaattacctcatgatgataattttatcttgctgtgctttaggcaatgtttttatataattcataaaaacattttgattggcagacgttagcactctaaaatcgacaggaacaaagtcagctttttgcaagtgttcctgaatgactttttgcccatttcctgaaatcatgtttttttcataaaatttgtttaatccgtctatttctttctgtgacagcctgtctgtcgtatacatagcatcgacggatttacctttattgggacccgacgtaatcacaaagtcaggtgttttatcagtaatcatccctggtggtggcgtataacgctccattgtaccaagaacaggctctaattgtgccgcggatgcggcttctgccggttttagtttaccgttgccccccacatccggtgtgttaagtcggccatgcccttcaagtgatgtgacattaacatttacttcgtaaataccatctgtattcttaaccagcttttctgtttttcccagtacagcaccgaactccggcactttcttaccaggtgaaaatatgctcgccaatattccgccagtcgcttccagcgcggcctgattgccaccagacgcctgtttgagcgtgtcggctactgctgaccaggtttcactcttcatcagcgctttcactacatcggctgctgcctgatttttacctgccagatcgcttaaagccttattacaataaccatctccgacagcacatgacgccagtgccatcgctccatccgcaacataatctgttctacctaatgcagcatcaccagtatcagcgacagcattgataatactgttcgcgatagccgatgtagtgccgtcacccagcttatcgcgaacctgtttcttccaccattccgcactttcttttactgactgacgggctttatcaccgctcagcgagttattctcaaccgcatttttacccgcaattgcgccgctcgtcgccgcagcactgctgttgcccaccatgccgcccgccagtcctgccgccagcgtgccgagcaggctcagctgctcgcggtcttcctgccccagcgccgctatcttttccggggtatctgcaccccagtacttctctgcgatgtagcgggtggcaagctcgccgctgaaggcacctgccgcacccgctgccgcactcccgcccgacatctgcgcagaaactgcaccccacacggcatgggccatggcattggttgccacatcaacgttgccggaagcgtcagtcgtttccttcttaatcagctgagctgcccacggattaaggccacctgcgaccgcctgacctgcattgccggtcaccagccccgtcagaatactgccgaccgtctgtgcgaccttctgagatgtactgccaataccccactgcttcatctccgcctgatactctggcgaatcacgcattttctccagccactctccccgctttttttccgttgctccggcgggcagcgtctcggcgtttcttcgcactctgcgccttctcaagccctttgatatcgcccatggtcgtgacgatatttgtcatctggccgctgatttcaccggctaactgagccgtctgaagccgcttctgctctttctctttgtcaaagatcgcactgatgctgtcgttggcatgttctgtgtcacggctgaggtctgccacatcctgcttctggttgacccggtcgcgaatgatcacggtgccgtttgccaccgccgactgcgtggtgccttcggcatggccgttgttgttcaggcccgacagcagcgtgctggcggcattggacgccacgctggacagcatctgcgcacccatgccgccaccgctggacagcgcgatgctgccgccgctgtggctgaccctgtagtccgccgcattgccgatatcggtgaagccgagcgtaccggtatccagacggttgtctgccgcatcgccctggctggcaatcactgcaccgttcagctgggtatgattgccaacggtgatgtcaaagccgccgttaccggcatagataccgctctgctcctgcacgctgtcaaagttgctgtgcattttgtcctggttgacgctggcatagccggacaccgacattgagccaaaggtaaagctgccgcccgcgccgtagctggtctgttttgaatcgtaacgttcgctgtcctgctggctggtgatggtcagatcccggcccacatcggccgttacctgattaccgctgacctgcgcgccgttgagcgtggtatctcttccactgttcaggcttaccctgccgccgctgtccagggtggtctcagaccagcgcgtaccgttgccgctctccttacctttggcgccgttaacgctggcaaaaatgctgatacccgcgctgccctgtccggcaccaaaactgatgcccacgccgccgccgctgctgctgtttttaccgctgctttcctgagtgttggccgccccgctcagcacaatgtccctggcagcattgaggctgctgtcacctgcggctttcagctggctgccggcgataagaatgtcgccgctgtgctcgccacggcccttaccggcagaggtaatggagaggttcttaccggcattgagcgtggatccggtgacgctgtcggacgcctgatgctgctgcgattttgatttctgtgtggtcagggaaaggctgacgcccaggccgttgttgggatcggcgctcgcttccgccagttgcccgcccagcacggcctgcacgcctgaaagcgcggctttggtagcctgcagggcagcaaggcgaccgtcactctcttttttcgatgtctgcgccgccgcaaccgcgttattaatggcttcacccaccaccccggagagcgccagtgtcagcccgctcttcttctgctcaaacagttcatcatgagtccgtttatcatgacccggatcgatgatcacgctgtcgccggtaatggcgagatcgcgccccgccaccagatctgagccgctgacatgagcctgtccgcccgcaataatgctgacattaccgcccgtactgcccacggtgctggcactctggctctgggtggtgcccttgtcacgtaagtcatggaccgatttactgctgcctacagtgatgccgatgccaccggttcccatcaggccgcttttcttagtttccgtgaaacgccaggttgagtccgtgttggtcgcagcaacgatatccacgttgttaccggccctgagcgctaccgtgccatcgcctacgacctgagaaccctggacaagtaaattgttgcccgcattaagcgtgacattatcgccgctcagtaaggtgccattttcacgggtgtcactgtcttcgctgatggtatgcgtggtctttttactcaaaaatccttttttggttttggtctcttctttgtaggcataatcgctttcagtggcggtggtcaggttgatgtcgcgtccggcacccactgcgatattaccgctggccgtaacctgagccgcttcactgttaacatcctgacccgctttaaccgtcgtactcccgccactggcaatttcagtgccctgctggcgtaccgactcattaatctcaaccttcttgccggatttgtagctattgccagaaccggtttcagccgccagcagattgacgtcacgtcccgccagcaaggtcacgtctttgtctgcggcgatgcctgccgcctggctattgagatcgcgtccggcctgaagtgctaaatcgcctccactggtcagcgtcgtgcgatccagcccggttgaatgggtttcacgtttacccttcacatcattctggctggtcgtcgcgctgttgagattaagatcgttaccggctgccagcgccgcgtttttaccggcgctgatgttgctggcggtaacagtcagatcgtggcccgcctgcatcgccatattgccgcctgcggcgatctggctgccgactgtggtgacggtggttgtgctggttgggtcaactttttgccagcggtttccgaagccggattgcgcgctgccagtgacgttctggttcccggtgatagcaatatcattccaggcgttcagcagcagatcgccacccgctttgaggttagcaccggtgacggtaatatcgttgcccgccttaaggctcagagaatccagtgacgtgatgctcgccgttggcccgctcagagtttcggtataggatttcttcgcacccttaccgttgtctgcatccagatgccagagctgtgatgtggtcaggttgttgatgtcaccgttaacactctccagtgccacctttttaccgctgatagtcgcgctgacgttgttgatatcattcagtgcgctaagttgcagatcgccacctgcatggagcagaccggcgttgaggttactgagcgtgttctgactgtcgatagtcagatcgtttttagccatcacgctactaccggtattggtgatgttcccgcctttcagcgtcacgttgttaccggcaattacgctgccatcgcgcatctccacatcttttgtcgacagatagagcttcggcaccatcaccgtttcaccgttgatggtggtggcttcccaccagaccatactcttgtctaaagaggcgagttgcccggcagagagtgagacaccaaactccagtcccagcgactgctgcgcagccgcagcgttgtccatcagatagcgcatctgggcgagatcggatcccaggccattgatgtagcgattaccggtctgatttagtaccgcattactgacgtagcgggtatcaaacgccgcatcaccgagaaaacgataatcataatctggcttcaggttcaggcggctcagcatgtatgaggagccgaggaaggcgttctcgtctgtgtattgaggccgcgtttcctgtaaaggcgtggtggcaggctgtttgcccagttttgcgttcagctcgccgaacaggctctgatcaagctgacccaggccattaagtttggggttaacggtaatcagatagcggctattggtgttcgacgcaacaaagtagccattttcaccagaaggtaatggataggcgctgatatcaacctcagcgaccttatagttatgcagcgacgcaggatcctgagcagcattcgtcaggttaatggctttacccagcgctgcgttgtttttacccgcagttgcatattgcgtcagcggtgcgctgccctgtgatgcggtctccagcgcacctgcgctattgacctgctgcaaggcattctggagctgatcgcgccattgcggggtattgattgcggctttgtcggcggttgccagttgctgatgggactgcgcgcctgcggtgcctgcagcagttaagctgcgtaaagcgggggccgaaagggtattgccgctccagccggcattcgctgtggtgttggtgttactgatatcgccgctgaagttagctgagacattgcctccggcctgaataaccgaccggtatagctctcccggtgtgaaactcgtcccttgatcggaaagtttatatgtaactgctcttacttttggttcattaacgcctctgattgatgcattgacgataacagaggaggtaacagaattgtatgttgtgctcttataaggttttgaaaaatcgaacagacgcccttcatacttataagtcaaatatgaagtttgtgtcccagcctgccaggattgattgttaagttggtttccagagagagatatatctctctgcgccagaacattactggcctgattatcaaacgaacctgcccttatattgatatcacgtccagcggctatacgagctgcaccaccattacttatcacgtttatagtggtgcttgataataaaatattccttatagctgcttcttttgttggtgcatatgtatatgttgtttgtgctggagtacaacgctccccattacctttcccatatgaaatacaatctttgtcacggtgataaagaaacgccccatattcacctggttttaaatcagagattaaaacacttatttgaggtttggctgaacccgccgggcttgaagaattattagtttgagaaacactcaacccatcccttgtattcagcaaatgtcccgtattaatcgtgatatcgccgttctgcgtttcgatggtgccggagttattaatcacctcgccgttggcgtttccctgccgcgtctccctgaagccacatactgccgcctgccagcatatcggcacgctggttgcggatgctgttggcaaaaagagagagattgccggccgcatagagcagcgcgttattgacgatgctgcccggtgcgctgagggtcagattgcccaacgtacccgtaaaaccatcaacagtgatatcgctgcggctggctaagttaatattcccgccgccctgcagactgccattcccgttcatggtgatacggttgccgctgaacgcactgtcacccgaaccggtagtgagctgaccattattagtgagatcgccgcctgcgctcagcgtcagcacgccgccctgcatcgtgccctggttgtctatcgcaccattactgctgacggagagtcgcccgcccgcagccagcacatcgcgaccggtaaaaccattcgcgatctccagcgtggcatcacccagcgccacaacctgaccggtctgatcaaagccattgctgtgaaccagcaaattgccgccactgaacaggcgcccactgctttgctgattaacctgagcgcccatcacgctcagtcggttgttacccagcagcgtgccgctgttgtttacctgctgataattaacctcaaggttgccgccctgggctgtgccctggttgctgaagccattgccggtcagcgtgccctgaccgtcggccagcagcgtaccgttattgctggcattagtcgcattgaggatgagttgagacgcctgtaaccagccgttgttattcagctgcggcgtattcaatgtctgcgcgccacccgagagccaccggccatcgttttgcgttaaaccggttaatgtcgcgacaccgttgccattgccctgaatcaggccatagttgaacagttctggcccggtcagcgtcagggcgttttgcgtgatcatggcgccattgccgccgttggtgatgcgtccaccagcattgaccagcaggctgttgtcaccctgtaagcgcccgttgttatcaaccgcgcccgtggtgatctgcaggtcgccgccctgcacgcgtccggcattattgagcgaggaggactgaagcgtcagcctgcctgcgctgagcagcgttttatcctgctgctgggtcagtgcaccgttaaggccaaccgtcagcgcgtcgacaccggtgacggcgccgttattgtttaacgtgtcgccccgtagcgtcaggtttctggcaatccattcaccctgattggtcagcgtcagtgcctgcagtgccgcagtgccattcgctgagatcttactgccagcgcccgcatcaaggcgatccgccagaatcagttgtagcgcatccgcactctgaatcgcgccattattggtcagttgccgggcattcagcaggatctgctgtccctgccagttgccgttattcacaacgtccccgccgttgatgttcagcgtgccctgcgtcagcagcgatccgccctgattattgatcagctgacgtgatggcgcggccagcactctgagcagcattcgcccggccacctgtggcgcagcggcaaacgtcaatgcctgcagaccaatcaggctgccctgattaatgacgctggcgggtgaaatggtcagggttttgccctgcaccgatccgctgttattcagcgcggcaccgttcagcaccatcgccccttcactgagcagtgagccgctgttgttcagcgtgttcgccgtaacctgtgcagtgttctgactcatcaacgagccggtgttatgcagttcattgctgatgctggcgttcagatctttactgcccagcagcgatccctgatgcagccagttgtcagcgttaaccgttgcctgctcgccctgcagcgttccctgggtgttgagctgacctgcggtcagcgtcagtgttccgccgctcagcattttgccaccagcagattgcgtgacgttatcggcctgagcagtcagcgccgtgttgccctgtaacagaccgtcgttgttcaggctggtgccctgcaaccccaggcggtccgccattattttgccgctgttgcgcagcgtggtggcattcaggtcgctattgccctggctgatcagcgtgccgctgttgatcagatcgctggcgatgttaccgcgcaaagcgctgatgccattgaggctgccgcgattgtcgagagaatccagcgtgacgtcgagttgctggccctgccagctgccatcattgatcgcgctaccgcccttgatgatcagtcgatcgccgctcagcagttgcccattgttgtggttgagggtctgagcaaatccgagatccagtagcgtgtcgccctgaagcagcccgctgttttccagcgtattaccgctggcgctgagttgctgtgcagcaatctggccgctgttactgagcgtttgggcatgcatgtcggcctgctggccggtcacgatctgtcccgtgctgctgttattcagcgtatcggcaatctgaaggtcgaggtcatcgctcagcaggcgtccgctgttgttgagacggttgccgttgactgaaagcgcaccgttaacctgcagcagcccgtcgttatccagttggtctaacgtcagcgtcagcggtcctcctgcgattaactggccgccctggaggttgtggagttgctgatgctccagcgttaaggtgctattgccctgcagcagaccgccgttactgagcactggcgcatgcaggctgaggttatccgccgccagtgtgcctttgttatcgatctccccagcttgtaaattcatctgctgctggctgatcagacttccgctgttatccagcacacccccgacctgggctgtcagtgcttttccggcgcgaacagtgccactgtttctgcaacgccttcgcgtttaacgccatctgatcggcctgcattgcgccgcggttattcagtgaagtgatgttgccattcagggtgccgtcactcagcaactgcccgccctgctgattatccagctggtcgccttccagcgtaatctgctgattgccctgaatcaggccactgttaatcaggtcgccccgcagcgtcagcgcctgggcaatcagccagccgctgttgtcagtgtgattcgcttttagcgcgatgccctgttgtcccagaatcttgccgctattgaccagcgtgtcgctttgcaggtcggcgtcggcttcactgagggcattgccgctgttttgccagcggtcagcattcagtgtcagctgtttgccctgcatcagtccgctgttgtccagcgtctgctgttgcacattcagctggcctgcgctgagcagcgtgccgctgttggttaacccgctgccctgcaacgataatgccttgtcgccctggagtgttccgctgttattgatctggctgacatcgctattcagcgttgcggcggcgatgatgccctgattagtcagtacatcgccgtgcagctggagtgggtcactggccagcagtttgccacccagctgattatccagatgcccgtaccgggcgctgaggctggcagcgttgatttccccgctgttgttcagctggtcgccgctgacaaccaatgttttgccgctggtgatcaatccgctgttattaagctgtggcaaatcgagcgcaaaatcgttgtcggagctgatcgtccccgcagcaaggttatccagctgtccggcatgtaaagagagctgataagagccctgaagcaggccgccgttactgatttgcccggtggtcagcgtcagattcggtgcggttaatgagcccatgttacgcagttgtgcactgttcaggatgagtgcgttctgactgctgatggccccctgattttccagcctgccacgagcggtcagttgcgcgtcaccgcgtgcagtgatggagccgttttgttgcagcgtatcgctgttaatcacggcatcgccatgacttaccatctcgccactgttattcagggtcggggcatcgatttgcagacgctgactgaccagattgccgctgttgctgaaggtgtccgcaacactgaatagtgtgttgccctgtgcggagaagatcccgtcctgattcagacgattagccgtaatcgtggcatcacccatactgatcagtttgccgctgttatcaagagtgccgctttgaatgttcaggctgctgccgctgatttcatcgcggttagtcagctgtccgctaacagccaaagtgtttttaccctgagccagcagcttaccgtttctgttgcagagtgttagtgcgaacctgcacgtcaccattactggccaggctgccacggttagcgatctgtgcagcctgaatatcgagtgtttttgcggcggcgagctgaccggcattgtccagctgagaggtggcagagagttgcagcgcgtctaccgcactaccgctgctgctgttatcaacactcaggttagcaccgctgagacgcacattctggcctgctttaacgctgctgcctttaagcgtgatactgccctgactgttgagatccagcgaggcgtcgctgcccagcgaggccccatttaaggcaatatcctgctgcgctgtcagtgcgacgttaccacccgctttatgttcgccttgcagggtgatgctgctgccttttgcagtcagggtgccgctggtcaggctattgttgatgcttaaccgaccctgcgcatccagcaccatatcgccctgacgggcattaagattgccgagattgacgccaacgccgttttcgctggagaccagatggatgcggtttgcgtacatgccgcccagcgcgccggtatctacggcaaccgatggcgcagcaccttcgcccgtgatgggtgtcacgctgccatcagcaccgacccggtttgcgcccagcgtcacattaagatctttggcatggatgcccgcgttgatttcggttgcgcgcgcaatgatcgagacagcatcagcctggctgccatccagtcctttaccctcaatgctgattgcgcctttcgtcacttccagcgattgcagattgccctgcgcatcaagctgcggtttaccggtggtcagcgtaacgttgggcgtattgataaagccgcagccgttacaggtaatgccataagggttagcgaccatcacgttggccgctttgcccgctacttcggtatagccctgcagctgtgaacggttggcacccaccacctcattaataatggcccgggcttcctgcccagctttgaggttcgggttgttctggacaagtccacccagctgggtctgcgtcaaccggccggttgcgttgttcaggatcagcccttcctggcccacgttgtaattctgatactggttatgcgacaggcccgccgcattcggcgtcgcgatattaatgaccggcacgccattcccggcagcatcgacttttgttcctggtgtgacgggcgctatcgccgcagaaaaggcgggcagcagtggctgaaacgcgatcagcgagcagatcagatagctcagcagacgacgcggcagtgaaagctttaattgatcatccataatcggggcctttgtttaaaaaacgagtccaacacgcgcgtaaacgctgaggcgatcgggcgcaagataattggggtagctgacagggatacccagcgacagctgagtggagacatgcgcgttacgggtgccaagtcccagcgaactgccccacagcgtgcctgctgcgtagcggtcctgtttgtcgctctggagccacccgccgtccagcgccagggtggtgctgacctcgccgattacaggcagggtaaacagcgagtaattcagttcgttacgcagatagccgccaacatcgccggacaggtattgctccttgtagccgcgaaccgagttctcgccaccaatcgtcagacgttcgctgccatagaggcgatccggcgaccactgagcgtaaaagctgctgagccaccacattttctgagtgactggccgctgatagctgctgctgacgctccatttgcggaattcagctttcggaaaatcgtcgcttttacccttgtcgctttccgcatcaaaccacggcatcccgcggctcagcatcgggttcagggtggccaccccacctgcaattttttgcgtatggttaaaaccgatctgcagactggtcagtttgcgactactgctttgaagcagggtctcattcagccagttatggctgacataatggttcagcccaacctgaaggccggttttgatttgcccgttgcggaacagcacccacgagccgctgaggcggttagagatgttgtcgccgttgctataccagtcgaaactattggcgttaaagcggctgtgatagttgctccagctatagctgtaatccagcagcccatagccataaggcacgctgacgcccgcctggaaattttgcgcatcgcgccagtcgctgaaagcgctgctgcgaccaccgctgacaaaccagcgatcggcaacacccagcaggtcattacccaccagcgagccggaaagctgaccaatgccggtgcttcgctggccgctattgtccatattcagccccagcgtcagaggaaactcgggtgtgctggtcaggttgacaatggaatagcccggctgagtcgatgggatgatttcaatctgaaccggcgtagtacgaagccggtttatctgctccataccctgttcaatgtcacgtaaatttaaaatacgacctgcacgggtcgggaacgccatgttcagctgacgtgcactggcaccctgcaaatgaatcgcctcaagctttccttccagtacggtgatatttaacgtcccgtgggaaagattctgttctgtcaggaaggcccggctggtgatatagccgcgctggacataccactctgaaatggcgcgtaccagctgattaatacgatccagactcaggcactgattgatatagggagcgacaagtctcttctgtgtatcaggcgtgattaagctcgcctgttgcagtgaaatctggttgatttcaaaacaggggccgctggctggcgccgactcggttttttgcagctcaacctgatgcgcctgtgttaatgcgtcacgctgctgctgatcctgctgcaaccgctgctgctgctggttttgaataacgtcaagatcacccggcgtgaccggtgcagccatgacattgctgataaacaaactggctccgaaaaccagccacttccctgtttcaggcattttcatcgaaggattaacaacgcttattgtaagttttgtgtaagcacaggcgtgcagattaccaccttaacaatcggaagttccttattgacttaaaataatgatgtggttttacaaaaagtaaaattagcggtgataaaacgttttttaagccaaatttgtaatgacttagccactttctttgtgcagagctcatttacgagtgttaagggaatggatgttaagacgtgcactgatgaatatagatccgcgccggattactcattcatataacggcgctggggtattaagtgggataaaaaataatgatgttgctgcttttcgtggtgaagcctgctggctgaaatgactagtgcactacagatgcaaaaaggcccgcaacgtagcgggcctttaaccagacaacacacaacaaccattatttttcatggtagcgatgcactgccggataatattccagtccatacagctggctcagcggcagcagcagttccacgttaatatcatgcacacgttcactcgccacagggccgctcagcagctgttcaaaccaggctatcagtttctgtttcatctcaggctctccgcatcagttgatgccctgagtaaacccgcttacacgcccgatcagaaccaaaaatttctgcgctgcttatgccggaaatggcataagcagcccccatctgtttagccagtgccatacgccagcggctcaaaacggttactgcgttatcagcgtcacccagttcgcgcctttaccagccggggcttcagcaacccgtttgagttcgccgctggcgggctcgatagcgtaactgccaatcaccgcgctcttctccccgctgacgataagccatttaccctgcgcatcaatcgcaatactgcgcggctgtttttcaaccagccagctgccgataagtgttaactcacccgactgcttatcgacccggtagccgctgacggtgctggaggtgcgctcggtgacatagataaaatgtccgtcaggcgtgattttgatgtctgctgcccagatacgcggcgtgggatcgctgtagcccgccgggcgctgctcgccatgctgcaggttatatttcttcgcaaccgcattcggccaggttttcagctccgtcagcgacccatccgccgcgcgacggaaactgcgtaatggtgccgctcatctccgcgaggttatagaggaagcgattgtcgggcgaaatcaccgaatgtcgtgcgccgctgttcttctcgccctgaacaaaaccggttcccagcggcgttatcgcgccgttatcggcaaaggcatattgcagcacgcgatctgcgccaaggttgccgacgtagagggaatgattgctgacgtcggtgatcaccgaatgggcatgcggcccggttttcacctcgcctgtcacctgtggtgtcacaatccctttgtcatcaatccggttgctggtgacgatatcgctgtcataggaggccgccagcagatagcgcccacttctgtcggtggtgatccacggaaagctggctgcaaccggcgtcaccgccagtttctgcaagtcaccgtgcggacccgagacgcgccagctgatgatcgaataaggcggactccgcagcgcaccatagagccgtttaccatccgggctggccgccagcggcataatctttttaccggcaggcgtatcgccacgccattgcaggctgccattcgcctcgctgagctgatagcgggaaacggtgccggattcagcattggagacatagacaaaggttgtcgcccataacggggcgctacacagcagcggcaggagtgccagcgccgttttcagacggatcatagggtcaccttgataagtagtgtctgcatcattgcgcagcaggcattacgctaaccctgtccggggaggctggctttgtgcaactgtctgaaattcggttcgaaagtctggagatgtgacggagatgttatttttaatggtgctgaaagaggtaagacgcctttccccacggcgggtgaaaggcgttaacaacgcgctaaccggttttcgcgatcatttttcgatagcggttgagccacttgccgctgttaagtcgccaccagaagaagatgccacgcaccgtccagtcgaggaacatccccagccagacaccggtcacgcccatccccagttcaataccgagcaggtagccgaccaccacgcgggcgccccacatgctgaacatcgacacatacatggtgtaacgcgcatcgcgtgcgcccttgagtccggcaggtagcacccaggaagcggcccataacggcataaacagcgcgttaagccagatcagctgcttcgtcacgttaattacttccgggtcgctggtataaaaccgtgccagcaacccggccagcggcaccgtcagcagggccatcacggtcaggcagaccgtcgccagccagaagacgtgccgcacctggcgttccgcctggaacacctgattcctgcccagacgggtaccggtgataatcgttgaagccgaacccagcgcattgcctggcaggttgatcagtgaggcgatagaaaaagcgataaaattaccggcaatctcgctggtgcccattccggcaacaaacacctgtgtcagtagtttgccgccgttgaacagcaccgactcgatactggcaggcacgcctattcctaaaacttccatcagaatgctgctgttccagcgccggaaatagctcgacagcgtaattttcagtgaggcgttaaagccgatcatcagcacgtaaatcaccgcgatcgccccgatatagcgggtgatggtcagtccgagcccggcaccgataaaccctaaaccgtcccacgagaagcagccataaatcagcacgctactgatgatgatgttgaggatgttcatgccgccgttaatcagcatcggaattttggtattacctgcaccgcgcagcgccccgctgccaatcagggtgatggcggcggccggatagctccaggcggaagtctgcagatagctcagcgccagcgctttgacttttggatcggcggcaccggcaatcgcatcgacgatcagatggccccagaactcaatggcgatcaccagcacaaaggcgagtatcgtcatcatggccagcgactgacgcgtggcggcacgggcgcgcttgccgttgcgttttgccaggctgaacgccaccaccaccgtggtaccgagatcgatggcagcaaagaacgagatgatcaccatgttgaagctgtcggccaggccgacgcccgccattgcctctttacccagccagctgaccaggaaggtgctcagtacgcccatcaatagcacacaggcgttctcgaaaaagataggcactgctaatggcgatatctcacgccagtagagcgtgcgatacgaacggcgtttcgggtaccacgccgtgcgcttgatcgcctgcatcactgctacgccgggattttgcaaaggattaccaaatcagaagagactggacaggagttctaatgatgatagtgggtagagaaatatgcaaagtctttccggtgcaaattaatcatggttacaaactttttaatgccgccacggcacaatctgcctcactgccccgcccgctgtagcaaacctgattatttccctgacgttatgatcggttggccatgctttgctgctggcgctttttccgccctctcctcatcggtaacgcattcaaacgtggcggatcaccccttctgatcgtaaagattttcttactggatttcagtgcagcgaatcctcatttaaaacagcactgctcagaattcccgcttcgctggcgcaaaaaaacggcgatcacagattcttcaccaatctccgcaacaaacccgctaagcttggggcaaattgcggaaaaaaatggaaggagaaaccatgccgacactacggaaaaacctgaccagccagcaggcgctggatgaactcgaacgcctgtacgatggcgccgtcgatgcgctgcgcgaggcgattaaagcctttaccgaaaacggcacgctgcccgatgccaccgctcgggcgcagggactatttgtttacccggagctgcgcatcacctggcgcggcgacggtccgcagcagaaccgcacgcgtgcctggggacgcttcacccacaccggcagttacagcaccaccatcacccgcccggcattgctgcgccactatatttcggaacagcttcagatgctggagaaggagtatcagctggagatcgacgtggggccctccagccaggagatcccctatccttacgtgatcgacggttccgacctgtcactggatcgcaccatgagcgccggtattgcgcgccacttcccgaccactgagctgtcacagattggcgatgagaccgccgatggcctgttccatgccgatgcaaaatcccctctgtcgcacttcgacgcgctgcgaaccgacttctcgctggcccgcctgcgtcactacaccggcaccagcgtagagcacttccagccgtttgtgctgttcaccaactacacccgttatgttgatgagtttgtgcgctgggcgatcgagcaggtgcgcgatcccagtaccccttacgacagcctggcctgcgcgggcgatgtggtgctgaccgccgacaccgctgacagtgagtcgatgctctcggatctggcgtggaagaagcaccagatgcccgcctggcatctcacctccccaaatcgtcgcggtattacgctgattaacattggtgttggcccgtcgaatgccaaaaccatctgcgatcatctggcggtgatgcgtccacatgcgtggctgatgattggtcactgtggcggtctgcgcgagagccagcggatcggtgattatgtgctggcccatgcctatctgcgcgacgatcacgtgctggacagcgtgctgccgcctgatatcccggtacccagcattgccgaagtgcagcgcgcgctgtatgacgccaccaaatcggtgagcggcatgccaggcgaagaggtgaagcagcggttgcgtaccggcaccgtggtgaccacggacgatcgcaactgggaaactgcgctactccgcttcggcactgcgctttaacctgagccgtgcggtggcggtcgatatggaaagcgccactattgccgcacagggttatcgtttccgggtgccatacggcacgctgctgtgcgtttcagacaagccgttgcacggtgagattaagctgcccggtcaggcgaaccgtttctatgaaggggcgatttcggagcatctgcagattggtattcacgcggttgagttgctgcgcgccgagggcgataagctgcattcgcgtaagttgcgtacctttaatgagccgcctttcaggtaagcgtttaaccgcctgatgcggggaataaggccggtactgctgacaggcagtaccggcctcttgctttggaatttacccaacgcgcatgtcagtgccgggataatttatactttaaaggtctctacaatcagcctgagagactgcgcttgctcagagagagactgagaagcacttgatgattcttctaccagagcagagttattttgcgtcaccccatccatctggctgactgcaatactcacctgagaaatcccctgcatctgttcagccgacgacaacgcaatagcatccatggattcagccagttcatccactaaatgcacgactttgagaatactcaaacccgtatcactggcaacagtgacgccgcattcaacctgtccgacagcctgctctattaacgctttaatatcttttgcggcagtcgcactacgctgtgcaagcgttctgacttcagacgcgacgacagcaaagccccttcccgtctctcccgctcgtgccgcttcaacggctgcgttcagggcaagaatattagtctggaatgcgatgctttcgatgacggcagtgatatctctgactttagacgcgctttttgaaatatcactcatcgtatctgacattcgtttgacgtccgtttcccctcgttttgcaatcgaggcggtatctctcgctgagttggctgtgtccctggcagttttgctgttattttgtaccgtagcggtgagctgttccatactcgcagccgtttcctgcaaggcagcggcctgctgttcagtgcgggatgcaagctcattgtttccttcagaaatctcattcgcagaaagggcgactgaagaagagcctgatttaatctctgaaacgatatcccgtaaccgaaacctgcatgctgtttaaagaggccatgagactgagagtgtcatttttcttcaagctaaccggtgtggtcagatccccattagtgatcgcattagcaagtttccgcgctgtactcggttcatcgccaagctcgctcatgagtttacgaataagatagatgctggtgcccgtgccgaacaaaatagccgcaactaaaagcgtcaccaggatgatgtaggctctttcggtatttttcgcgttttgaataactgagtcatccgactgctttgccaggatttcactcatcagggtaagaccttcaagcagcggaacctgtgcgggcctgactttttccaacagatacttaacggtgatatcactgtttttagccagtgccagcggaacggtgttactgaaggcatccagagcatttttctcgctgtcactgatcttcgcaaaggctttatattcttccgtatcgccagactggctgatcatcgtattcagttgatccctgctggctgcaaatttagccttcagtttaaccagacgatcagactgctcctggataagagcctgatctgaaaagagtgataaattcctgacggttatcgccatatcgcgctgcgccagggtaagttcattgattaattttgtttttttcatatcaccctgaacaactgactcaagcgtgcttttagcctgatataaagagtgaatagcgacaacgatacatatggagaaaaagatgattaacgtgccaaatccggaaccgaggcgcgtagagattttcattaacattccttgaaggggggcggcgatatagatctatcggcatctctttttttaacttcaatgaatatttatcacataaataatattaaccataattaatggcaccgctgcaaagcattacaaaaactcataaatttgtcaggcttcgatgatttccagttcaaccagaaatcgttttttgtgcgttataaacaatcagaacccttatgcttaccgttgtcttaacttattactgcgttacgctacactggtttgcatgtcataaaaatttcatttaacccttgtaggcgcggcttttaaggctgctacaacctggatgcttttcgcatgcaaaaaataccgcaataaaaatcaggaatacataaattataattataaataacgtcaggaacttctgtagatcactttaaacgcgggccggtttctgtgacgtctcgcaggatatgaatgctttattagttcgatgaatatggcagaacagaccggcataaggatgcttcagcccggccgtagcaatccagccttcaggcagaaaacgcgctgagtgcgttgatgagcgtgcccgtctgcacgatagccctggtctgatatgcatcacgaataaaatctccatcatcagcccttgatacgaacggatagcccgggcaatcgcagagagaaataggtttgcctgactcgcgcatcagctgcagtaacagatgaaattaaaagccgtaacataactgaagtatattgcagacgaaatataaaaacatacacagcaacaaaaatcatcattattgagcttgtcactccataattgctgtgcaatataaataacagccaactggagagctatttcttaaaattagtgccacatactggcaatgtattcccgcctttcacataaaaatcaaataaaggacgcataaagaaaccccaaaatggaggaagagtgacaagaattatttgaggaaaattaacatacctttggcagcgcagataataaatttaattactcacttaaagaggattcattgtgaaagttaaaaatatgactgtgttagcgagtatggttttattctactccgctcagggtatggccaggcaatttgatatcagtgcagcaaacattgacgtcaatacctctaaatcttccttcattcttactggtgcgggaggtgccggcggcgcaggtggcgcggggggtgcaggaggagcgttaggcgggcaaggtggtgccggaggtgttggcggcgccggaggtgctggcggaagtgatggtaatggcgccgctaacgccagccagaatggtaataattccaataatgataacggcagtaaaaacggcaacggttctgatcagggtaataacagtaataacggcaccgggaatgctaacgggagtggtgacggtaacggaaatgatgcaggcaacggcggtggtaatggaggaggtgatggtggcggtgatggtggcggtgatggcggcggtgatggcggcggtgatggcggcggtgatggcggcggagactgatagtctggcgtccattaactaaaaagctcctgtttgtaaccgttatagcaggagcattatcactgttagcacaggaacagcacatgaaacttaccagaagttacccattatttttagccaccgtactgacagtggcatttccgttttactccctggctcagactgccagcgacatgaatacttcatcctcaaatacctccctccagccctcagcaggtaaagacggacaacaaggcaatggtgaaaacggaggcgcgggaggcaaaggaggcgttccgggagaaggtactaacggaggaaaaggaggtaatggcggcaatggcggcaatagtggcaatagtaggagtgccgataatcccgatacatcaagtaaaagcggtgcgggcggcgcaggcggtgcgggtggcgcaggcagtgcgggcggtgcaggcggtgcaggcggtgcaggcggtgcgggtggcgcaggcagtgcgggcggtgcgggcggtgcgggcggtgcgggtggtgcaggcggtgcgggcggtgcgggtggtaacggagggaccggtggagaaagttttctgaaaaggattttcaaatgaaaacaatcactttgttagcttcgctaatcatcattccgtatgcgcatgctgagtacaaaacggatatgttgagttcacaccataatgtcattctcattgatgccgctgcaggttctgatggcggaccgggtcagaacggcggtgccggggccaatggcggtccgggtgaaaatggaggacgagggggaaacgggggtatcggcggaaatggagggccaggaggaaatggtggtgccggagccaatggcggtgatggcggaaatggcggcctgggaggaagcggtggaaatggcgggaacggaggtgctggacagaatggccaggccggaggcaatggcgggaatggaggaaacggcagtatggggggagatggcggaaacggtggaaatggaggggatggcaacaatggtagtgctggtggcgcaggggggaacggagggaatggtggcagcacgggaggtgacggcggtgcgggaggtaacggtggtgacgggggagatggcggcgactaaattcaaccacgccttaatatctcttctctcctggcagccggcttataaaacaggcctgaacagcaattatcacgggttaattcacagctaaaacaggcattttaataactctgatttagcgtaagaaaactttccgttagctccgtcagctcaacattaaaatcagcttacctgaattaactaaaacgctcagagatcctgtcaacgctgagtatgtgtgaaactcctctttttttaccatcagggaaatgcaacctggagttggcgtacagtggagccccggatttttgatagccatgatgtgagaaataatggaattaaatacaccgctgaaatggagtaacgagtaacaacaaacgccacaagtgaaatgcttttataatttaaccgcacaaacgagaacagccgcgaataacaacagctccgccatattcgctctattgcaatgtttcgcagtgtatcagacaccgcctgccccatagcctggccgacgaaacccgctcagtgttaacgcgcggctaagtgatctgaaactcccatacgtctggcgggcgaaacccgctcagtgctaacgcgcggctaaatgacctgaaactctcctcgcctggcgggcgaaatccgctcagtgtcagcctgctaaaagcgaaaccttatgaatctttccccgctttcagcggcctgagcccagccagtccgggtgacacacccaccggcagggggtttgccagaggcgtccggagcgctgaggaacaaccggaagccgggagccgacaggacgtcggcgaaaggacggcacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgcacaggcaacctgaaactcctcatcgcctggtgggcgaaatccgctcagtgtcagcctgctacaaagcgaaaccttatgaatctttccccgctttcagcggcctgagcccagccagtccgggtgacaaacccaccggcaggggtttgccagaggcgtccgcagcgctgaggaacaaccagaggcaaggatgagccgacaggacgtcggcgaaaggacggcacgagccagggatggcgagtccggacggtccgtcggccgcagggcgtgacgaaggcaccccgctacgcggggcgcgcaggcagccggacgccgggattgttaaggggcgggcgtccgccccttaacgcgtccgcctgcacaggcaacctgaaactccccatcgcctggcgggcgtaaccctctcagcgctaacgcgcggctaagtgatctaaaacgctccatcgcctgggcaggcgtaacctgctcatagccagcccgctgctaagcgaccttccctgccgccaggcaacaactaagcactcaaccatcccagcttaatcacaaacaggatcgacaggataaccagcgccgcattcacctctttcgcacgtccgctcagcaacttcaccagcgtccaggtaataaaaccaaacgcgatgccgttggcgatcgaataggtcagcggcatggtcagcgcggtcacggtgaccggcgcggcggtggtgatatctttccagtcaatctctgccaggcccgatgccatcagcaccgctacaaacagcaacgctggcgcggtggcataaaccggaacactggaggccagcggcgagaaaaacagggccagcaggaacagcacggcgaccacaatcgcggtcaggccggtacggccaccggcactcacgcccgccgccgattccacataactggtagtggtcgaggtgccgagcagcgaaccaaacagcgcagccgcactgtcagcaatcagcgcacggcccatcttcggcacgttaccctgctcatccgccagaccggcgcgtttggtcacacccagcagcgtgcccgtgttatcaaacacgtcaacaaacaggaaggcaaaaatcacgctgatcaggccgacgttaaacgcgccggcaatatccagctgcataaaggtcggtgcaatcgacggcggtgcagagaagaccccggcaaagggcgacagaccaatgcccatggagataaaggtcaccagcagaataccgatcagcactgcgcccgtaacccgacgtgcttccagtaccacaataaccacaaagccgagcatcgccagcagcggacccggtttagtcagatcgccaatgcccaccagcgtcgccgggttatcgaccacaatgcccgccccttccagcgcaatcagcgccagaaaaagcccgataccggcaccaatcccggcgcgcagcggcagcggaatactggcaataatccattcacgaatcttaaatagcgacatcgcgaagaaaatcaccgccgagagaaacaccgcgcccagcgcaatctgccacgtatagcccatgtgcagcacaacggtgtaggtgaagaaggcgttcagtcccatacccggcgccagcgcaatcggatagttggcgatcagccccatcagcacgcagccaatcgccgcagccagacaggtggcaacaaataccgcgcccttgtccatgccggtcgcgcccagaatgcttgggttcacaaacagaatataagccatcgccaggaaggtggtgatcccggcgataatctcagtacgaaccgtcgtgttatgcgctttgagtttgaatagtttttctaacatcatcatctctcgatacaggagacatcagtctcacttgccaaaggggtttgcatgctgattattctgtttccgggacattgatgccggccgctgcatacttgcgtgccagaatcgcctgaaatccctgacttacccactgcccaaagcaattgccatgccatctcccgacgcaatcgattacctggcggagccgggtacgcctaagagaattccgaaccaaaacgaggcgcgattatggtgcaatgcaccgatgccgcgcaatcgttttcctgcggcaaacagcgagccccgaaaaactctgcgccagcgcacgcttccgcactctcacaggcgaagctggtcacgtttcagcacgctgcctcagcaagcttttctggcctgtgtagactcctgaattaactctttcgtaacattgaggccgcgcaatgaagccagcaattttggtggtggatgatgatcctgcagtctgcgacgtcttgcaggatgcgttaagtgaacatctgttaacggtctatcgttgccatcagggacgcgaggcgctatcgatgctcagcgagcaccctgagatctcgctggtgatgctggatatgatgctgcccgataccaacgggctactggtgttgcagcagcttcagcgtcagcgacccgaagtgctggtgattatgctgaccggtatgggttctgaagcggagatggtggtgggccttgagatgggcgcagatgactacatcgccaaaccctttaatccacgcgtggtagtagcgagaaacccgggcggccctgcgtcgcagcggacgcattgcccaggcagaccctgaacaggagggctggcgttttggcggctggcaactggatgatggccgctgccagctgtttaatccgcagcgcgagctggtgccgctgacccagggggaatatagcctgttacgcgcgctggttcgccacgcccgaaaagtgctaacccgcgatcagttgctggagctgacccacagcgaaagtctcgacgtgtttgatcgcaccatcgacgtgctgatcatgcggttgcgccgtaaaatcgaaaccaacccgcaccagcccgacctgatccgcaccattcgcggactcggttatgtcttttcggccgatgtggtgaaacccgattcgacaacgcgtgccagtcagattgcctgattacgcctgccgcgatcaggatagccagtgcgcgtaatcattacatagcagccagcgcggcgcttcatcctcctccagtgggttgaaacgagccagcggcgtcagaaacacattgtcgttttcatcatcgttggtcatcgacacctcgcccaccagcacgtcgccgaagccactttcaccccagaaactgtgccagatgcccgcctccagcgtcacgctttcacccggtgagagccgcagctgtgaaccggcggcatgggtctggcgcaggccatccagcgacaccgccaccagcgagtcagccagcccgtcaccgtcgcggttatgcagttcgacaatcagattcccgccgccgcgattaatgatgtcttccatcttgtgcggatggtagtgcatgggcgtctgctgcccttcccgcacgtgcattattttctcggcgtagggtttatgccacggctgcccgcctggtgaaccgttgcgcagagtaaacagcgtcagcccggtctgcagaaaatcagctgcgccaaaactggtgagatcccagcccagccgcaacgccagaatctcctgcgcgacctcacgatcctgagcccgccactggctcacatcgaaatcggcccacggcggcagatgcacatcctgctgtcggaaaaactcgcgcgtatgttgcaggtaataattaacctctgaacgttgcatggtggcctcctgagagcggcaccctaaaggtgccgcactaaagcttatttcaccgtccagccctggtagctgccgatattattacgatcgatcagtttcaccgggatcagcaccggtttgtccggtgccggtttgccctgcaggatgtcataaccaatctcgaccgctttggcggccatgacctgcgggtcctgcgcaggcgtcgcgacgaacagtgaattcttgcgcttcagcgcctcttcaccgtccggcgagccatcgacgccaacgataaagaactcactgcgctgcgcctgtttcgccgctaagtctgcgccaatcgctgtcgggtcattgatggcaaacaccgcatcaatttttggattggcagaaagcagaccggtcatgacttccagtccgccttcacgactgcctttggcgttctggttgtaagagagcagcttgatgtcaggatgggttttcagctcggtcatgcagccttcaacgcggttctgcaccgcagagacagggggtccgttgatgatcaccacgttgcctttgttcttcagccggtcagcaatatatttacaggccatcgcgcccgcctcggtgttatcggaggtgatggtcgcattcgcgccatcggccgccacgtcgaccgccaccacgacgataccggcatcacgcgcccgcttcaccgccggggcgatccctttggagtcggcggcgttgagaataatcatgtcgactttggccgcaataaagttatcaatctggcccacctgctgaccgagatcgtagccgctggagaccagcgtcacattcaccttatcgcccgccagctgacgtgccttcatctcagcgcctttggtgatctgcacgaagaaggggtttgccagatcgccgaccgttacgccgatagatttgagttcttttgcctgagccaggccggtactgaacagcgtcgccgccagcagcccggttacaatcggattaaaacgcatagaccttctcctgctgttttcaaggtgccaaccacttaatggcgttttttaggtggcggaggtgaaatggcacatccgcccttataagactcaactcacatgatgacgggtacggtatttatcgatcagaaaaccgcgatgatgatgaccgcgcccttgatcaccagctgccagaaataggagacccccatcagcgtcatgccgttattcagcgtggcgataatcagtgcgccaatcagggtgccggtgatggtgccgatgccgccgacaaagctggtgccgccgaggatcactgccgcaatcgcatccagctcatagccaaccccgaggttgccgttggcgctgtatagccgcgaggcactcatcagtccgcccagccccgacagcaggccgctcatgccgtagacaaacagcagcaccattccgaccttgatcccggtgagacgcgccgcctggatattgccgccgaccgcgtagatatggacgcccagcgtggtgcggcgcaggatgaaccagcagatggcgatcaccgcaaaggcaatcacaatcagccacggcaccggcccgagatagccgttgccgatccactcaaagttaatatcggagttgattactgtggtgccatccgccagcaggtaagcggctccgcgcagcgcggtgtaggtgccaagcgtgacgataaagggcggcaacccggcccaggcgaccaggatgccgttgaacagccccatcaccaggcctgcgcccagcgccatcggaatggtcatggaagccagcatcggatccagcgacgctaccagcgcaaccaccgcggtggtccccagcattgaccccaccgacaggtcgatgccgccggtaagaatcacaaaggtcatgcccgccgccagcacgatgttaatcgacgcctgacgagtgatgttgagcaggtttgcttcggtgaagaagttcggcgtgacgaaaccaaataccgccacgatcaggatcaaaatcggcaggatacccaccgtttgcagcagatcgcccatcagggcgcgtttcagcgtcggtgctttggtgcgagccagttgtgtcatggtggtctccttagatttcgcctgctgacgcgctatgcgcaccggttgccagcgtcataatattttcctgactgatgtggctgccctccagctcaccgacgatggtgccttcgtgcatcacgtaaacgcggtcgctcatcccgaccacttccggcagtttcgctggatatcatcagaatcgccacgccctgccgcgccatctcctgcatcatccggtagatctcgcttttcgccccgacatcgacgccgcgcgtcggttcatcgaggatcagaatgcgcgggccaatcgccacccagcgtgaaatcagcagcttctgctggttaccgcccgacagaccgcccgcccggacctgagcgtgaggaacacgaatattgagtgaagcgatcgcctcactggcgatggtttgccctttgcggcggttcagcatcccgtaactggcgtcacgttccagcgtcgccatcacgatgttctcctgcgccgccatctccagaaacagtccctgctctttgcggttttcggtgaggaaaccgatgccgcgtgcaattgcatcgcgcggtgaatggatggtgaccttttcaccatcgatccagatctcgccctctttcggcttgtgcacgccaaaaaccagctgtgccagctcgctgcggcctgcgcccaccagaccggccagcccgacaatctctccggcccgcacttcaagactgctgggatgcactttgccgccgtcggtaaggtgattgaccgccagccggatatcgcccagcgggatagcacggtctttgttaaacaggtcgctgagtggccgtccgaccatcatccgtaccagttcgcttgcgttaagctggtcacgggtcaggctgcccacatactccccgtcgcgcagcacgctgacgcgatcggacagctcatacacctccgccatgcggtggctgatatagatgatcgccatgccttcgctgcgcagccgtttgatcagcgcgaacagctgttcggtttcgcggttggagagcgcggcggtcggctcatccatcaccagaatgcggctgttgcgctgcagcgcgcgggcgatctccacctgctgctgctcggcgatgctcagacggctgaccagatcccaggcgctgaactgcgcgccgagccggtcaatgacccgctgcgcctcttcggccatctgccgccgcttcaccagcccgccgggcgcgatttcgctgccgagaaaaatgttctccgccaccgtcaggttaggtgccaggttgatctcctgataaatcagggtgatcccggcggccagtgcctctttcggccctttcagcgcccagggcttgccttcaattaaaatttccccgctgctggcggtataggcaccggccagaatcttcatcagtgtgcttttacctgcaccgttctcccccatcagcgcgtggacctcaccgggataaaccgtgagatcaacgcccttcagggcataaaagctgccgaagcgccgggtaattccccgcatttccagtatcggtgtggctgtcatcgcctcgctcctgcggactgtggatagccgtcagtaaagcaacgtcagataaacggaaaatgtcagcgcccgttcatatttgtcataaacgcccgcctgcacgctcctatactcggcccatcgttgcagtgaataagaggtcgtgggatgcagcgcacttatccgtggcaggccggggcacgtggacgcctgttgctgttcaatctgctggtggtgtcggtcacgctgatggtgagcgtggtggcgatcttcggctttcgtcatgccggggcgattcaggagcaggcacaggcgcagaccctggccgacatgaacggcagcctggcgctggcgcgggataccgccaacgtggcgacagcggcagtgcggctgtcacaggtggtgggcgcgctggagtatcagagcgaatcacagcggctgcagcagaatcagcaggcgttgcagcagtcgctgagcctgctggccagtgcgccgctggcggcgcgtcagccggagcgcattgcccggatccgtgcccgcagcctgatgctggaacagacgattaacagcctgctgctgaccggccaccagcgtcatctgcagcgcaacaacatgctgagcgacctgtggcagacgcagattctgctcagccatatcgaccagctggtgcagcgggaacagcggacgctgccggatgccgcactgcgggagcaaaccgaacggctgatcaccatcgcgatccgcacaccctcgcccatcgccgtcatcgaacagctccagcaggtgatggtacagtggcgcaacgtgccgctgaccggcgtgaccggcgaaaacgtgcagcgactgctggctacccagcagcgcctgctgccgctggcagaggcgctggagcagagcgacctggcgatcgcctatgccacctaccggattaaagcgctggtggcgatgctgaatgaagatatcagcgcctcggtgcagcaggtggcgttacagagtgaggcgcgcaccctggcgacccaccgtgagctggattccatcatcggctttatcgcgctgtttgcgctgctggcgctggcgatcaccggctatgccggtatctacatctaccgcaatctcgggtcgagcctgacggcgattgccggggccatgacgcggctggcgcagggcgagcagaacgtcagcgtgccagggctgcaacgccgcgacgagctgggcgagctggcgcgggcatttaacgtctttgcgcgtaataccgcctcgctggctcacacctcacggctgctgaaagagaagagtaatcagctggaatccacctttctggcgatgcgcgacggctttgcgctgtttgataacaacggtcagctggtggtgtggaacgcccagtatgcggagctgctcggcatcgcgccgcatgaactgcatcgcggcgttccctggcagcaactgctggcaccgctggcggtggatctgcacgatcccggtgaaccgcaggagatccggctggccgatggtcgtacgctggagctgcgcttcagtccaatcccgcggcgcggcatggtcaataccgtgctggaccggacctcgcgtaaaacgctggaggaggcgctgcagcacagccagaaaatgaaggcggtcggccagctgaccggcggactggcacacgactttaacaatctgctggcggtgattatcggcagtctggcactgaccgaaggccagctgacacccggcccgctggccagccggattgatcgggcgcggcaggcggccgaccgcgctgcccaactgacccagcggctgctggcgttctcacgcaagcaggctctctatccccgtgcggtgtcggtggtgacgctggtggataaccttcaggggctgctgcagcactcgctgctgcccggtcagcagctgattattgatgcgcagcgtcccggctggcccgcctggattgatgccagccagctggaaaatgcgctgatgaatctggtggtgaatgcccgcgatgcgatgcatcagcaaagcggtgaaatccggctgcgcatctggaatcagcgtcgtctggagggggatgaaaagcgtgacagggtcacaatcgaggtgatagaccacggctgcggcatgtcggccggggttcgtgagcaggtgtttgagccttttttcaccaccaaagctaccggcagcggcagcgggctgggcctgtcgatggtctatggttttgtacggcagtcaggcggccagatcgaactggaaaccgcgccaggccagggcaccacggtgcggctgctgttgccacgcgcgccggaagccgccgtcgccgcagtgatcgccccgccatcgcctgtgcacattgagacggacattgcggcggccagtaaccggctggtgctggtgctggatgatgaaccggcggtgcgccagacgctctgtgagcatctgcatcagctgggttatctgacgctggagtgtggtgacggtgaagaggcgctggcgctgctgcgccagacacctgatatcgacctgctgatcagcgacctgatgctgcccggcgagattaacggcgcggaggtgatccgccaggcgcagcagaactggccgcagctggcgacgctgctcatcagcggtcaggacctgcgccatcagccggtgacgctgccgctgtgcgaacggctggcgaagccctggcagcaggcacagctggtgcaggcgttacagcgggcctggcagcgcagcgaacggcttaatcgcgcgcagcaggctgccacaacggcaccggcttcccactgatgtagcgcttgcgcaggcggctggagatcatatccatcaccatcactaccaccagcagaatcagcgtcagaaacatcaccacatcccagttccacaggcgcatattctcagcgtaaaccagaccgacgcccccggcgccgacaaagcccaacaccgccgctgagcgggtattggactctatctggtaaaggctcagcgccaaaaactgcgggaatgactgggtgaagatgccgaagcggtgtttctgcaggctgttggcgccgacggcgcccagtccgcgacccggtgaacgctccaccgcttcgtgcccttcggcgtagagtttgccgagcagaccgacatcctgcaggataatcgccagcaccccggccagcggccccatgccgaccgcccggacgaagatcagcccccagatcgccatgtcgatgccgcgcaacacgtcaaacagacggcgcatcagaaacgccagcggtttcgcggtttcggctgtgcatcacgttgcgcgccgccagaaatgacagcggcagcgccagcagcgaggcagtcagcgtaccggcaaagacaatccctaaggtgatgccgacctgcgacagatagtagccaaacggccagttcaggaagtcgtgccagacaaacatccgcaggaaatagcgccccagctgctggcagcccatcagcaaacgcgaccactccagaccaaacaccgaaaagaaaaagaggtaatagagcagcaccgccagtgtcatcagcgccaggcgacgcagatagcgcggctgtgcggcgaagagttcacgatgctgctgcttcattagcgcgatatcgggaacggtgcttatcatgtcctgtctcctgtcacacggcgacgaagctggccggagagcgtatccagcagcgacaccacaatcaggatcagcagcagagtaatactgacctgatcgtagcggtccagtttgatgttggtcatcagctcctggccgatgccgcccgccccgaccagcccaaggatggttgaggagcggaagttaatctccagccgcataaagctataggagagaaagaccggcttgacctgtggccagaaggcgaagcgcatccgctgcagcttgctggctccgcaggccgccaggccgcgcaccggcttatccgacgccgactcaatcgcctcgtaaaacagcttggtcaggctgcccacggtgtgcagcgccagcgccagaaaaccggggatcgccccgatgccaaaggccatcacaaacatcaccgcccacgccagctctggcatggtgcgcaggaaggcgacaaaggcgcgaatcgtcatccgcacgctgaccggcgtctgagtgttgtcggcggcgaaaaaggccagcaccgcggccagtgccaccgccaccagcgtcgaagccagcgccagttgtagtgtttcccagatcagcggcagctggatcggcagacggtagccccagtaagccagcgagccttcggtcttgccgtctgcaaacagcagcggcagatgcagcaccggcaggatttcgtgcaggtagtcaaagaagtgcggcagcgactgccagacggtgagcagattaaattctgccaccctgcccgccgccaggtagagtgccaccagcagcagtgaccagagcagcgtgtctcgtttctgctggcggcggatgcgttggtagtagtgttcgaattcggtcaaaggggatctccggcgctaaagcagcgggacgcaggcgagtttgctgcgtcccgctttccccgcctgagcggagaagataagaagtagctggatttagccgcggctgcctttcatcaggtcgcgcttcatatcgatgatgttctgataatcggcaaccgtcgcctgaccgatatgctgctcgccgcccaccgctttcacgaagcaggcgtgatcttccttatccagctttttaatcgccgacaccactttcgctttaaagtcagcgggcagcttgttgctgaccagcaccggaccgttggggatcagcggtgactgccagataatgcggatctgcttcatcagatcaggatggtccatgcggatcagacggccaaacgcgccagaggtatagccgctgttgtagtcaccgaccagtgaggtccaggtcactgcgccatcaaactggttattcagcacgcccagaatgtcctgctcatggccgccggagaaggtgacgctggagaaggtgttgttatatttgtcatccactgagccgccgaacatcttcttaaatgcctggttcggcatcaggaagccggacgtcgagtcgggatcggccataccgaaagatttccctttcaggtcttccagttttttgtacgggctgtccgctttaacgatcaccaccgagtggtagccgcgtgactgatctttgtcatccaccacaatgccaaccacatccaccgctttcgggtcctgaatgtagaccgacgcaaacgaggctggcgacatgctcagcaccatatcaatcttgccacccagcagaccctgaatcacgccagagtagtcggaggcgttgcgcatctgggtatccacacccagctctttatcaaagaaggtcttcacacactgattatcgccaatctgctgggtggcgtttctgaccgcccagaatccccagattaagctgtttcggcgcatccgctgcgctgacaccaaacgccattacactggtcaggagtgctaaagaagtcagtttcattcggggttgttctcttgctgtggaagttaatggatttggttaagttcatcgccgtacagctggtgcagcaggctgtcggtcagtcctgaaggatggccgtcaaacagcaccacgccgcgctgaatgccaatcaccctggtgcagtagcttttcaccagctcaatcgagtgcaggttgaccatcacgctgatgccctgctcgctgacctgacgcagcacatccatgatgcgcttggtatttttgggatcgagtgacgccaccggctcatcggccagcaggattttggggttctgcatcagggcacggcagatcgccacacgctgcatctgaccgccagagaggttttccgcccgctgcagcgcctgcggcagcatgttcatccactgcagcagttcgatggcgtgcgcccggtcattgtcggagaagattttaaagaaggatttcaacgtaccggtctggctcagacggcccagcagcacgttggtcagcacgtcgaggcgtggcaccagacagaaatcctgaaagatcatgccgcactggctgcgccattcgcgcagctggcggctgttgagcgtaaccacgttacgatccgcttcgccatgatgcagactgataatcgcgccggaagtcgcttcaatcgtgccgttgagcatgtgcagcagggtcgatttacccgcgccagagcggccaatcaccgccaccagctcaccggcgtgcaggtcgaaactgacctgatccagcacctgagtgtcgccgtaggctttgctcaatttctgcaccgacaacactttttgtccgctgaggctggccggtggcaggtcgttgtcgaccaccgttttcagaagtgcctgtgccatggtgttctccgtcatcgctgattgcgttctgcgggttattaaggcgtgacgcgatgaacacgagatgacagtcagatgatcaaaccgtgacaggccagtgcgcgccgcacagcaatgtctggccatcacgggcaggctgcacaccgtccggcaacgggttctcagctaaccagttatccatctcatgactgagatgggtgagccaggtctgacgcggctggagcatctctgctatcgccagcgcctgggtcacatcattatggttacgcggttctgcttgcggcggatcgttgcagtcaatcaccagctgatccagcggctgaccgcgcaggaagtcggcggtgtcgggtggcaacccgcaggtatcacacagccaggcgagccgggtgccgtgccagtcgaacagatagccatgcgtcattttcgagtgttgcaacggcagcggcgtgacctgcagttctccaaaggcgtgcgctacaaacggcgttaaggcgggacggaaatcgagcaggccaggatgtttatagagatcgtcacagcctcgcggatcgggtggaccccagaccggaatcggcgcgcccactccccagcgcagtgcaaacagcccctgcacatgatccatgtggtagtgggtcagcagaatgcgtgtcagcgtgccgggcgggaagcgcgatgccagcagcggcagaccggcatccagcaggatgcgctcgcggccaaactcaatcagcgcgctgcagggcgcacgcgcgtagccactattgagctgcgcccgctgacaggcgcgacagtcgcagcccggcagcggtgcggcagtgaccccgccagtacccagaaaagtgagtttcattgatgcgcctccagtatctgacgcagcaggcacacggtatccgccagcgcgccgtcgttgttgaggataaggcagccatcgggctgtggctgtgcggcgcgcgccagccgccgggcgatctccgcctcatcttcccgtccgcgctggcgcagccgcgctgccagcacggcgggtgtgacctgcagacagaccggcagcagctgcgagccgaaacgggcctgcgcctgcgccagatgcagccgcgaaccattcaccaccacattctgcccgcgcagcagccactgctccgtctcacagccaatgccatagctgaaaccgtgcgcctgccagctcaccgcgaacagccccagcgcggcgcggcgggcaaactccgcctcggtcagcgccacatggttttcaccgcccgcgtcggcggcgcgggtaatgtagcgatgggcgatcagcagccgtggcggaggtgccgcccgcagcgcatccagcaagctgtctttacccgaacccgaaggaccggtgagccagatcagccgcgccatcagtacacctgccggcctttgctccagacgtgccgcacgtgcgggtagccgtgtgcggtatgcgccagcaccagatcggcgcggcagccttcggcgattaccccgcgatcttcgagccctaaggcgcgcgccgggttacaggtgaccagcgcgatcgcctgcgccatgccgaggctgttgcgctcatcatctgccagccggaacgctgcatccagcaggctcgccggatagtaatcggaggagagaatattcagcaggccgtgtgacgccagctcccaggcagcgacgttgccggagtgcgagccgccgcgcacgatgttaggcgcgcccatcagcacctgcatattgcgataacgcgaggcgcgtgccgcctccagcgtggtaggaaactccgcgatgcggctgcccgcggcatgagactcttcaacgtgcgccgcggtggcatcatcgtggctggcaatggcgatgccatgttcccggcagagtccggcaatcgcctgacgattgggctgtgaccatgctgctgccagggtgagctggtcatgctcgaactgatccatctccgcgtcgttgagctgatatttgccctgataatattcgcgatacttcgtcagggacgcgtactgacgctggcccggtgaatggtccatcagcgacaccagcgccagctccggcgtgcccatcagcgcttcaaacagcggcgcagtggtgggatgcggcagttcacagcgcagatgcaacagatgctcggcccggttcagtcctttgcggttgctgtcgcggatggcgtcgatcatcttgctgaggttatccagccggtgcccgccgtcgcgcacatccccgacgccaatcgcatccagcaccgtggtaatgccgctggagaccatcagcgcatcgtggctgctcatcgccgagtgtgccggccagtccactttcggacgcggcgtgaaaaacttatcgaggttatcggtgtgcagctccaccagacccggcatcagccaggcgccctcaccgtccagcgcgcccggctgctggctggtggtttcgctgaagctgctgatgcgctcgtcgcgaaactccagcgatccggtcaccacttcgttttccagcaccagtctgacgttattgatgatcatgcctgcgctcctgtctcgatcgggtgcatcaggtgcagccggtcagctacccgctcgcgcaccgcccgatcgtgaaaaataccgacgatggcggcaccacgggcgcgcgcctgttcaattaagctcactaccgcctcgctgtttacactgtcgagcgaggcggtgggttcatccagcagcagcaccggatagtcggcgataaagccgcgggcgatattcacgcgctgctgctctccgccagagaaagtggacggggccagcgaccagagacgctgcggcacgttgagccgggtcagcagttcggcggcacgtgcttcacagaaggcgcgctcgacgccgcgctccagcagcggctgcatcacaatctccagcgtcggcacgcgcgggatcacccgcagaaactggctgacccagcccagcgtgtcgcggcgcagggcgataatctggcgcgccgatgcctgcgccatgtcgatccactcgccctgatgcgcgacccgaatgtggccgctgtcgggctgatagttgccgtaaagcgcgcgcagcagtgtggatttaccgctgccggagtgaccgtgcagcaccacgcattcgccctcgcctgccgtcaggctggcgttgtgcagcaccggcagcgccgcgccgttctggttatgcagcacaaaggttttacacaaattctctacccgcaggcgcggagtgatagttgtcatttaattgagcaccgaagagaccagcagttgagtgtaaggatgatgaggatcgtccagcacgcggtcagtcagaccgctctccaccacccgcccctgcttcatcaccagcaggcgatgcgccagcagtcgcgccacgccgagatcgtgggtgacaatcaccaccgccagattcagttcgcgcaccagcgtccgcagcagatccagcagtcgcgcctgcaccgacacatccagcccgccggtcggctcatccataaacatcaactgcggctgcgtcaccaggttccgggcgatctgcagacgctgctgcatgccgccggaaaaggtggtgggcaaatcgtcgatgcgaccggcgtcaatctccaccgcctgcagccagcggctcgcctcggcgcggatatcgccatagtggcgctgtccggtcgccatcagccgtttcgccgatattgccgcccgcgctgacctgcgaacgcagcccgtccatcggatgctgatgcaccacgccccattcggtgcgcagcaggcgacggcgatcgctttcactcatctgatagaggtcgcgattctgatagaggatgctgccctgctgcggcgtcagacgcgccgacaggctctgcagcagcgtggttttaccggagccggactcgccgacaatgcccagcacttcgccgggaaagagatcaaaactgacctgctcaaaccctttgcccggcgcataaagatgggtgagctggttcaccgcaagcagcggctgttcactgtgcatgttgctgttcctgctgctgatggcaaaagtcggtgtcggagcagacaaacatccgcgttccctgatcgtccatcaccacctcatcgagatagctgtggcgcgatccgcacagcgcgcagggttcatcccactgctgcacggtgaacggatgatcgtcgaagtccaggctttccacacgggtgtaaggcggcaaggcgtagatgcgcttttcacgcccggcaccaaacagctgcagcgcgggcatcatgtgcatctttgggttgtcgaatttgggaatgggcgaaggatccatcacgtagcgatcgttgacccggaccggataggcgtaagtcgtcgcgatgtggccgtagcgggcaatatcttcatacagcttcacctgcatgatgccgtactcctccagcgcatgcatggtgcgggtttcggtttcgcgcggctcgataaagcgcagcggctccgggatcggaacctggaaaatgaggatctgatcctcttccagcggcgtttccgggatgcggtgccgggtctggatcagggtggcatcggcggtgcgctcggtggtggcagcattgctgactcgcttaaagaactggcggatcgacaccgcattggtggtgtcatctgcgccctgatcgatcaccttcagcacatcctgatcgccaatcacgctggcggtgatctggatgccgccggtgccccagccgtagggcatcggcatctcacgtccggcgaacggcacctgatagccggggatcgccaccgctttcaggatggcgcggcggatggtgcgtttggtctgctcatcgagatagccgttgttatagccggtgagttcagccatgggtgcgctcctgataatcgtgctgcagctgtttcagcagttccagttccgcctggaaatcgacgtagtgcggcagcttgagatgcgagacaaagcctgcggcttccacgttatcggcgtgcgacagcacaaactcttcgtcctgcgccgggctggtaacacgctcatgctgttcgcggctttgcagcgcccggtccaccagcgccatcgccatcgctttgcgttcggcgcggccaaacaccagcccataaccccgggtaaagtgcggcgccgtgtcgtcgctgtgggcaacgccgttgaccatttcacactccgtcagtagcagttcaccgatctccagctcaaaacccagctcttcgggacagatactgacgctgagagtgccagtgcggatctcgccggcaaacggatgggtgcggccatagccgcgctgggtcgagtagcccagcgccagcagaaagccttcgtcgccacgcaccagctgttgcagccgcgcggcgcgtgaggcgggaaagctcatcggctcgcgagtgatatcgacaggctcgctgccgtcatccatctcggcggcggccagcccttcatcgctcatcatgctgaacatgtgcgggcactggtcaggcaccgaacgatcgtcacgcggcgcggcgggcgtttcgccattggccagcagggtgaagtcgagcagacggtggctgtagtcgtaagttggtcccagcacctggccgcccggcagatctttatagaccgccgagatgcggcgttcgatgcgcatcgcaccggtcgccagtggcgtgctctccgccaggcgtggcagcgtggtgcgaaaggcgcgcaacagaaagatcgcctcgaccagatcgccgctggcctgtttaatcgccagcgccgccagttcgggatcgtaaatcccgccttcggtcatcacccgatccaccgccagtcccagctgctgcgccacctgatcgcagccgagttcggctaccgctctatcgccgcgccgcagatcggcctgcaactgatgggcgttcgcaatggctttttcgcccccttttaccgcgacatacatcagcacacctccacaacggtggtgcgcggcacggccatgatcgcttcgccacaggtgaagatcagatccacgccctgtggaaacggatgcagacgggtgcgcagatattccagcacgctttcgggcagctgtggcgcgatggcgcgggtttcgcgcaggccagggccggagaggcgcagcgtcaggccgccattcagtgacggcacttcgataatcagcgtggtgcttttttccggtgacatgttgtcacccgctgcgaactgcgtcggatcgggctgcgccgccgcatggctcagggcgaatggtgcatcctgctgcgtggtgatcggcgcaccggtatggaagcgcagattgttgcgcagctgttcgttgtcgatttccgcatccagccagaccgggctttcctgatcgaccagcgtcagcagcagcgccgtggccgccggtgacagtgcgccccagccctgttgcagcggcagcgagaccatcacgcccggttcgctcatcgctttcagaatgcggcgaaacgcgcgctgcgcatccgccaccggatggttaaaacttgccagtaaagtcatcagttatctccgcgaaccagcgtaaagaaatccactttgctgctggcgatctcgcgggcgcgcagctgtcgctgctcatcgcgccacgccgccagcggggtaataatcttctcttccagcagttgccgggtttccggctgctgtaaaagcgcatccagcagggcacagcgttcggcatgggctttgtcgcgccctaacaggtagctgtaacccagagtgccgtcgctgagctgcaccaccgcgcgcgtcaccgtggcatcgcccatcacaaagcgtttgccggtggcccccatccgcgcctgcaaccgtgtcagcccgatctctgccggacggatcagggtaaaggcgggctggaggttaagcgcctgccagtgcgtctcaagcaaggcggcgctgctgtgcgccagcaccgacagccagcgctggcgatccgtttgctgttccattagtgctccagagtcagttcaatcatgtcgccgcgcgtcaggctgacggagtattccgccaccgcgccatcactggttttgttcagggtccgcacgcagagcagcggcgaatgcagcgcgatgtcgagctgccggcactctttggcctgcgcccggcgggtgctgatgcgggtctgggtgcgtaccagctgcttgccggtgtgctcaaccaagaagtcgtgcagcgatccgctgttaaattgctgaagttgtggccaccagctgaggtcggcgaggaaatggttaatcaggcagagcggcacgccgttggcgcgacgcagggtacgcagatgaatgacgttgtcgccctctttcacgcccagcgcattggcaacgtcgttgctggccggacgcagcaccgccagcagccgttcgctggtgggatgactgccctgctccagcaggtttctggctgaatcgcgcctgagcatgcagcggatagtcataagggcgcatcaaaaccaggatgccgacgccgtgacggcgctgcagcagccctttgtgcaccagctcatccaccgcccgacgcagcgtgtggcgattcacctcatagtgatcggccagctgttgctcggaaggaagatagtcgccgcagcggtagcgctctttcagcgcctgctccagttgtgcggcaacagcctgatagacagtggtcggatgtctggataactccatcacgatgaaatcctcacgggttacagagtgggaacgcagtgaaaagacgctgcgggatggtgttagcttgaggggatcagatgacagaaccgtgacgcgggggtgaaggagaggtgaatgtggtggctggaaaatgaggagtgcttgtcagggtgagtgactggcaggaaaccgccgggcatggggtgatagcccccgcttcagcggtcattttctctgccgggccgggagtcaatcaatcaaaagaacgtcattccctgataaggctgagcaaggcaggctctgatacggctctcaagatcgccatcatggatctcaagcctgtggccatcggggtccagaaagtagaaggagttcccctcgcttttattgcgcttccactctgtcacacccgccgctctcaatcgctcaacgaacgcatcaaattcgtcaccagcaatagtgaatgcatagtgtgtgtaatcatttccagcagagacggtatccacagagagacagagccagagttcacccagcgaaagataagcgccgtgatcccatgccgctttgggggtgaatcccagggtctccgtataaaaattcaggctactggccaggttgctaactgcgagggtgaggtgattgagtccggtcagcatgtaaaactctttatcagaatgcagaaaaatttaatttacaggaatcagatttctttgcacacaaagagaattaacagccgtttgtatatcagccgaatctctgccggacccaccccggaaagaggaaactgaagccggcaatacagccgggaccggcgcgcgatgagcagataatgaagaccgggcttgcacgaaatgaacgacgggcttcatggtgtacactggaacgaactaacgttgcgcttaggagagaatatgtacggaccgaatcccgccaatccccatccaatggaaggcttcccacaggtttgttttatcaaaaatacggtgaaaaaccccaacatcataatcggggattttacttattatgatgatcctgaagactcagaaaacttcgagcgcaatgtcctttatcacttcccctttattggtgacaaactgatcatgggtaaattctgcgcgatagccagaggcgttcagttcatcatgaacggggcaaaccataacatggcgggtttctccacttttccgttttacattttcggaaacggatgggaaacagcccagcctcaggccggcgatctgccctataaaggcgatacggtgattggtaatgatgtatggatgggttatcaggcgctgattatgccaggcgttaaaattggcaacggcgcgatcatttcttcacgtttctgttgtgacgtcggatgtcccggcctattcgattgtgggtggcaacccggccagagttatcaggcagcgttttaccgatgaaaccatatcccgactagagaagctggcctggtgggactggccggtagaaaagattacccaaaacttaccggcaattatctccgcagaccttgaagcactgccagatgaatagccgggcagaagtggaataaacactgcccgctgctggcaaagggtggcggtcatccgatacgggttcgcataatttcgcgcagattgatgtatcaatgtgtctgctttaccactggagcgcgggttaaaacaggagtcgttatgctctacatcttaagtggccttccgggttgcggcaaaagcactatcgctaaaatgctatctgaaaaattgaaagcggtgtatttacgcgtagatacgatcgaacaggctctgcgtaatagttcagcaactttcagggatattggccctgaaggctatttcatcctttatgagcttgcgcgggacaatctcagactgggatcacctgttgtcactgactcggtgaatgatcttaacctggtgcgcgatagttttcgtgatatcgcactatcatcaggtgttccctttctggagatagaaatcctctgttctgatcccgaacagcatcgtgcccgtgtagagaacagaatctcagatattcctggcttaaaagtgcctgactggcaagccgttgtggatcgtgtttatgaaccgtggagcagagaacatctgaagctggatacggctgaattatcgcctgctgagtgtgttgaagaaatccttaaagctagaacttagtactgggtttgtttgagccggacaattgattgtaaggagtgctttaagctcacattaagtattggcccgctttcaggaatttaaagcaagcaaaaggtatcgtcacacttttctttcaagtcgctgattgtctgaaagaaagaagcaagtactaaggtttatagtttcttatcgctctattcgtcataatcaattgcactacagttagttctaaataagttgttattgttatatgattcaattgaaaaacttacgataaaattaaatggataaatatgaaagcgtggtcttttaaatcagtaggtctggatgatctccgttactttggcaataacggttactatgatgactcaactggcctttaccgatatgacaattttgttccaaatcataagcaagtaaaagaaggcgacattgtcattattacagacagaaaaactgttcttggtatatcgattatagataacttgtcatcagcaccatatattaaaatccgcaaccgttgcccacaagaaaattgtaatccacaaaagattaactttcggaaaaataaaaagccggaatggcgttgcagcaatggacatgtttttagcgagcctaaagaagaaggtatatcagcgaatgaatttaaagctgagtatcagaaaaattacagatcacttaactctatatccatgacggatttaatatctcatacaccccgctataacgttcaaagttcaattcaggagattgatttagagtgggcaacgcacctgtttggtagcatcatccaattagatcccactgaagcagatattgaagaaattccacttgatgcagatgaccagcggaaagctgttttacggcaaattaagcaaaggcgtgggcaaaaagcttttcgcgacactctgatatctcaattagccaaatgtgcagtaagtggctgtgaaatcattgatatacttgaagccgcacatatcaccgcatacaaaaatgatacacacaaccatgttagtaatggactattattacgttgtgacatgcatactctttacgacctggacctatttgcaatagatcctaaatcattcattatttactttgctccacaggtccaagataaagagtacacaaagcatcatggaaaaaagctaaatgtaacgtataagattaatcaaggagctcttgttgaaaggtggaaaagatttactgaaaagtataatttaactgaattaaatccgcttaataccaccgcttctgcatagaatccactcacctccttgactcttagaaaataactgggcggcggccatcaggatgctcacatgctctcaaaaccgctgcccccaacctctaaaaaaccctattctgccgtccctttccccaccttctcacccccactatccgtcagtgacgctctcacctgcggcaggctttccgggtaattctgctgaataaactcaatcatcttttcacgcacgtaacagcgtaaatcaaaggcgatcggggagttttctgcgcggtcatcagcatcctgatggtcatggttttctcggtggtgtcggtcacctgcagcacagaggtttcctgatcccaaagcttggtttcgctcagcaccttttcaaaatgcttgcgcagcggctccagcggcatggagtaatccacgtaaaggaacaccgagcctaagatctgggcgttattgcgcgtccagttctgaaacggattttcggtaaagtaggtgatcggcaacaccagccgacgcaaatcccagatgcgcaccaccacataggtcaggttgatctcctcaatccagccccactccttttctaccactaccgcatcatcaattttaataggctgggtaaaggcgatctgaataccggcgaacagattgaccagcgacttttgcagcgcaaaaccaataatgataccggcgacacccgcaccggccagaatggtggtgccgaatttccggacaccagggaagctgagcagaatcagcgaaacacagaacagaaccaggatgacaataaccacttttttgacatagataatctgcgtgcggattttacgcgcacgaaggttattggaaatattaatgtcatagcggatataaagcatatcctgcgccacgttggtcagccggattaagaccgagcaaaatgacataataataaagacattgatgatattggtaattaaagagagagattccggttgaaaatcgatgtaattaacgccgacattaatcattaataacggaataaaaaagaacatcgagccgctaagatgcttctcaagggatttgaacagctttctgtcacgaatctgccagtagcggatgaaccggagcaggataaggcgggccagaaatcccagcacaaaagagagcgagacgagtaatacaacaggcacccatgacgggaaaccagataactcaccgaataacaatggcattattttcccttatagtaagctgacaacctcaggctgtcagataagtgacaaactcagtaaccgttgtcttcacggctatccgtttcgtaacacaatcagcgcacatgagtatgaaccatcgcggcgaagttaacaggaaatgcacggtgatgcgtccagagaggctgtcgcgcgccagccttatggctactgctacagaggccgaatgttggccctcacgtcaccgtccagccagctaaccccattaaaatatctgatacaacacggccactttttcactccccattatttagcctgccctggccatccggcaacaaaaacgttgccagaatcactaagcgtaacgctttgcgtggacgttcttgtgcaatctgctaatttttaagctgttcccctgctgctgagaaaaacaacaatatgattaacacccttaaactttcctctgattttcgtcgcagtttcctgcgtgaagtcctggtgccgctggtcgctatcttattgctgacgtttgtaggtgcaggcgctgcgctctttgttggtacctcactcaccaatacggaggcccgccatcagcagcaacggatgattgaagcctctttttcacagagtctgaatgagcatctgcgccagctgcgtagcctgtcgcgctggggaccctttgagcagcatctggcagagggcaacagcagcaggtggctggatgagaacattgggctgtggctgtatgagatgttcggccatcaactgattctggtgctggaccagcaaaatcaaatcgtcagagtctggcgcgaaggccagccggtctccgcccctgaagatgacccgctgattggtgaggtgctgcaaagcacgctggtcaacgatccggcacgccaggataacgccgattatgcccgcgtgacaaaccgggccgccgcgctggcagtaggtaacatccagcgggagagcaatgccctgccgcgtttccggctggtaagcctgaaatttcttgatgacggctatctggcgggcctggcggaacgcaatcagctgcagggactgcacttctccgacggcacgccgcaggcggggaccggtgcacgctatctgttgatcgcgcaggcgggcgaggcggttggctatctgaactggatcccctcccgtcccggtgcgcagatgctgcgcaccatcgggccatctaccgggctggcggtactggcgatatccctgctgtgcctttatatggtgcggcgactctggaactcgtcggtgaacctctcgcaatccatgctcaggctcggcgcgtcagaggcccaggcacagcatctggcgtttcatgatgtgctgaccggcctgccgaaccgcgcactggtcgaagaccgcttaacccaggcgctggctctggcgacgcgccacgatcaacgcgtggcgctgctgctcatcgacctcgaccgctttaaaaccatcaacgatacccacggtcatcacgccggagatgaactgatcatcgcggtcgcacagcgcctgagccgtatcgtgcgggccagcgatacggtaggacgcatcggcggtgatgaatttatcgtggtaatgccggacgtcgataatatcggccaggtacatagcctggcgcagcgcattatcgatgaactgagtgagccttttacgctgtttggcagcgatatctggagtggcgccagtatcggactggcgctggcacccaaagatggggttgatcggctggagctgatgcgcaaagcggatattgcgctgtatgaggccaaaagcggcgggcgcggcacgtatcgacagtttgaacgggcgatggatgagtcggtacggacccgacagaccatcgctgccgacctgcgtacggcgctacataaccgtcaggggctggaggtgtggtatcagccgctgatggatattggcggccagcagatggtgggcatcgaagcgctgctgcgctggcaccatccgacgcgcggcctgattgcgcccggcgaatttatcgcgattgccgaagagaccggcctgattattccgctgggcgaatgggtgctggctgaagcctgcgtcactcagcagcgttttcccgagctgctggtggcggtcaacgtctcgccggtgcagttccgctctaccggctttgttgagcgggtgatggcgattgtcagccagaaacggcggcgatccgaagcgcctggaactggagatcaccgaaggggtgttaatcgaagatgaacgtgaagcacgcgccattattgtggagttgcgtgacgcaggcttccggattgcgctggatgactttggcaccggttactccagcctgaactatctcagcaactttccggtggataaaatcaaaatcgatcgctcattcacccagtcgctgggcgtggcggaaaattcagtggcgattgttgaatcggtggtgaagctgggtcacgccatgggtctgatggtgacagcagaaggcgtcgagacgccagggcagatgtctgcgctggcagatgcgggctgtaatcagctgcagggctatctgttcagtcaggcggtgcccgccgatcagctctcagcactgatgaaaacgattgcgccagacaacgcgcagcatgagtgatactgatgtggaaagcctgagcgcagctctgtgcccaggctttccggctgcgtgatgcatctgagatcagaagatcaacatcacccttcacccgttgttgcgggaaattaaacccccaggctatccagcagcgcggcagaatgggcgaccgcgccaaagatgccgccctgcatatggatcatgctcagcgccgcctcatgatgacgctgctcggtcgcagcacaacaatcagacagcaccaggcactcaaagccgcgatcgttagcttcgcgcagcgtggtgtggacgcagacgtcggtggtaataccggtgaggatcagatttcggatgccgcgactgcgcaatatcagctccagatcggtggcataaaacgatcccttacccggcttatcaatcaccacttcacccggcagcggtgccagctccgggataatctcccagcccggttcaccgcgcaccagaatacggccgcacggtccctcatccccgatcccggcgttcattcgccgcgagcgccagcgtttgttggcgggcaaatcactgagatcgggccggtgcccttcgcgggtatgaataaccggaaactgccgggcgcgcatcgccgccagcacctgctgcaacggtgcgatgggcgcgcgggtcagactcacgtcatagcccatgctgtcgacataaccgcccacgccacagaagtcggtctgcatatcaatcacgatcagcgcggtgtcagccggcgtaaaagtgccgtcaaacggccagccgtagggggttgaattaacgctgtagtcgggcattgctgttctccattaccgggcgcggcatgcgcattctgctgatcacgctgtagctgatggcggcggttaccagaccaataaccgcttcaccaaattgagggaaagcgacgtgggcaatcaccgcacacaggctgccaatcgcccaggcggcaaacgcagtaccccgaaaacgctgcgccggacgctgctcgctgatgcgcgccataaaaattaaatccacgatcatcaccgcaccaaacggcggcaccacaatgccgagcaggctgagccactccaggaagtaagaccagacgcccgccagcgccagcacgccgccaatggcacccaggatcagcgtccagagccgcattttgctgctgaacagatgactgaagcccaccgccccgttatagaggcagtgtgtgcaaaccgatccgagattgataaagacaaacaggcaggccactaccgacaaaaaggcgctgtgccccatcagcatcggcaggaagttgccgccattggtcagcggatcaaccgcggcgcccacggccacaatcactacaccaaacagataggagatgacgttagccaccggaaaggcagagaacgcggcgatcaccgccgaacggccattctttgaccagcgggtaaagtcagcggtcatggtgccggagtcagcaaaaccggctaccaccatggtgacggcggtgcccatactcattgcaccggctgcgctggcgctgcccttccactgcgtcaccacggagaagtcgtgctgcttgctaatcagccacagcgccaccattcccagcaccacaaacagcggcgcggcgatcatccccagcaccgacagcgcccgcacgcccaggaacgtgatgccggtatagaggatcatggcaaaggccgtcaccgccagcgcattccagccaaaggtctgattaatgaccgtgccggtaaggccggtctggaaggcataccagccgatcaccaccgtcgagagaaaacccgagaccaggatgtagcctttgctgccaaaggtgcgtctggcctgcagggcgaaattcattccgctgttaccggcgtaccagctcagcgcgccgacataggcgaacagcaccaggtttcccagcagaatggcgatcagcgcaggccagaaccccagatgccaggtgatgatgccgccaaacagcgcattggtgaggatcatcggaaatccaaaccagacggccgagacggagcgggtagaatgacggtgcgacagcggtaccggctgatgttcaaactcctgctccagcgcaggcgtagtagacgttttcattgggcgattccgggttgaaggtgattccacggctgaatgcgctcgaaagcggcactggcagccagcactaaggcatcatcaagatgacgtccgacaatctgcagaccgacgggcaagccgctggcagtaaaaccggcgggaacggacgcggcgggctgaccggtgaagttgaaggggtagcagaacgagagccagtgatcgctgcggaccatgcggccatcaatgatctccggtccctgcatccccagcggaaacggcggcaccgccagcgtcggggtaatcagcaggtcaaagcgctgcataaagcgccacaggctgttgctgaccgctttgcgggtggtgatggcatcggtgaagttttccgcccgccagtcgcgctgcagcatggcgaccaggtgcggcgacatctcgctgccctgctccgccagcatccggcgcataccggtgagatcgctctccatcgccaccagcgcgccaaaggccgccgacggatcagggaagcccggataggccagttccagttcagcaccgatttcagcggcaaaacgctgcaccgccgcgctgaccactgcccgcacttccgggtcaacggccacatagccaaaatccgcgctgaaggcgatgcgcagtttgcctggcagatggtgtggcgcacccagccagtcgacatcgctgcagggaatcgagtggcgatcgcgcatatccggtccggccatcagcgacatcatcagcgcggcatcgcgcacgctgcgcgtcatcggaccgatgtgctccagtgactcccagctcgacacgccggggtagcgttcatcacggcagccgggccagagcggcacccggcccatcgacgccttgaagccgaaaataccgcagtgcgccgccggaatgcgtaccgacccgccgccgtcgctgcccagtgcaatcgggcaaagccgcgccgctaccgccgcacccgaaccggcgctggaccctcctggcgtcatgctcaaatcccagggattgcgcggcgacggaaacagcggattgtgcccgaccccgctgtagccaaactccggtgcggtggttttgccaagcagaatggcgtcggcggccagcaaccgttccaccgtgatgtcatcatcttccggcacgaaatctttgtacgccgccgaaccggaggtggttctgacgtttgcggtgcagattaaatccttcaccgccagcggtacccccgccagcgcgcccagtgtttcaccgcgtgcccgtcgggcatccacggctctggcctgtgccattgccagttcaggcgtcggggtacaaaaagcctgtatcgccggtttcccgctgttccatccgtgccagcgccgccccggtcagctcataagccgacacgtccccgctgcgaatcagagcggccatcgtggtggcatcttcgtctaataaggagtcaaacatgggttacctcgccaaaagtgtacctgtcagctagtgcatgaagcgtgccagttagcggtgaatcatccggtctgaaacggggatgccagatggaatacgggctgggatacaagatcgaattcttatgatgccaggtgcaggcggctgtttatttttccagcacgatgatggcgcagggctgcgcgataagggggcgtaatagctgaatggtttgcgggctggtttacaaaacgatgtcggttatcagcaacagcggccgatatgctggaatgaataaccacatttttaccagggccgtttgaccggtctgagcaggcactaaaaaatcacggcttaaagattcacatgcagcctgcagggatgataagtgcgcattgaagaagatatttatctcgaaaactacgaaatcagacgaaaaagattcatttatgatcgtcaggtttatcacagctacgtgtttgttgtcggtaatgagacttacaccgtcatcgttggcgaccggatagatgaacagacctttaaccgcatcggataccggatgccacccggtatcgcctttccggttaacgggctggctgaagtctgttttgacgtgttcgatggtctggagtgcctgggcgatttccgccatatcagctttgcaggattaggcagtgctgtcgttttcaaaagcgtactcctggcgttaatggcacaccatgaaagcttctttataggcggttttgtttttcaggctgcatcaggagagatcgttgaccgcaatcgcccgacaccccttgaggagatctacgatgctttgcttgggttaaaaaatgaactacgctacaatcgccggacagggttgccaaagaaagcgccgcaacctttaatcccggactgtttccgggcttataaagtagtgactacagggagagcttgctatgtcgttttacaataaacacgatgaaacaacccctttggctccggtcgaaaccaggtataaggagttaagggcactattgattgctgaatggctggtcagacccgatctgcccgccattaaagcccagttagctcagaggaaaaaacgctcgtcgtctgccctgttacgccgcaagttgaaagagctgaatgcgcgcgaaatgcagaaagctaagatcagcgcttaacgcttaaaggcccgataacgggcctttcctatttttatcagcttctggctcactcgcagacggctttccgccacccgcaactcacctctactccggaaaatccgtctccaccgacgtctgtttccacgcttcgatctcagccagccgctctttgagcttgctggttacggcatcatggccccaggcgcccattaccagatggcgtggcgggttatcatgctcagtgatggcaatcatcgccgtggcggcccgcgccggatcgcccttctgcgtgccgctgtattcggcggtggctttcatccgtgcggctgcagtctctgcatagtctggcagcgtgctcggtgtctgatgcagggagcgtcccgcccagtcggtgcggaacggacctggctcgacacaggtaacgcgaatgcccagcggtcccgcttccagcgccagcgaatctgaccagccttccaccgcatgtttgctggcagagtagtagcctgagctggcaaaaccaattaagcctgccaccgaggtaatgttgatgacgtggccgctgcgcgcctttctcatcgcgggcagcacggcgcgggtcagggcaaacaggccaaagacgttggcatcaaactgcgcgcggatttcgctttccacaccctcttccaccgagctctgatagccgtaaccggcgttgttgaccagcacatcaatggtgccgaacgtgtcgagtgccgttttgacggcctggtcgatgctcgcctggtgggtcacatccagcgctactgccagcgcgttgtcgtgtccctcaaccagatcggcaatggaagaggtatcacgtgccgtcacgacgaccttaaaaccacgcgcgatgatctgctgcgccagttcacgaccaaatccggtcgaacatcccgatattaaccagacagggctggagtgagcagtcatggtaagactcccgttgatgatgatgaagtgactggagacccggacgcgagtgcatccgggatttaaggttagcgaggcgcgaccgccccacttagcccttaatgctttttattgaacagctggctggcggtgtcgctgatgatctgtgccgcaccgcgatcgcctttcaccatcgacgccataaaggctttcgcctgtttaaaggtgatgtgcggcggtaacggggcaacttccggatcggttttcacctccagcaataccgggcgatcggcgctgagcgcacgctgccatgccgccgccagatcgtcaggattatcgacaaaaataccgaccattcccagcgactgcgcaaactcagcatatttcacatccggcagttgctgcgaggcgtcaaagcggggattcccctccatgacccgctgctcccaggtgacctgattgagatcctggttgttgaacacgcagacgatcaggcgtggatcggcccactgctgccagtatttctggatggtgatcagctccgccatattgttcatctgcatcgcaccatcacccaccagcgccactaccggtttatcgggatgggcaaattttgcggcaatcgcataaggcaccgccgcgcccatacaggccaggccaccggagagcgaggcgcgttgaccctgcttaacccgatagtcgcgggcgaaccagttggcacaggaaccggagtccgaggtgacaatggcgttatccggcagttgtggcgacatctcccacaccacccgctgcgggttgaccggattagcgggtgccatggcgcgctcttccatcagcgtccaccagtcgcgtacctgaagcgcaatatcttcctgccagctgcgatcctctttgtgctccagcagcggcagcagggcgcgcagggtttcagccgcatcgccatgcagattcacttcgctgggatagcgcaggccgagcatggcgggatcgatgtctatctgcaccgcacgcgccttgccctcttcaggcaggaaactccgtccacgggaagccactgccgatcatcagcagggtgtcgcagttctgcattaaatcggatgagggcttcgtgcccagcaggccaatcgaaccggtcacaaacggcgcatcgtccggcagcacatctttgcccagcagcgcttttgccacgcccgcacccagcacattcgcgacctgtaccacctcgacggcggcgttacgtgcgcctgcgccaatcagaatcgccacttttttaccggcattaagtacctcagcggcgcgttgcagatccgcttcataagggatcactttaggacgctgatagccgctgccggaatgggtaaaaccgtgcagatgctgcggcggctgccactcttcatcctgaatatctttagggatgatgatcaccgccacgccgttttgcgctttggcgatgcgcacgccccggtcgagcagatggcgcacctgggtcgaagtcgaagcttcctgaacgaagttggcaacgtccgagaagatgcgatccaggttcatctcctgctgataactggagccgcgcgcggtcgcttccgcctgtccggcaatcgccagcaccggggcatgatccattttggcgtcatagagtcctgtcagcagatgggtcgcgcccggcccgccggtagagaggcagacgcccagctcaccggtgaatttggcgtgtccggccgccataaaggccgccatctcttcgtggcgtacctgaataaattcgatgccgtcgcctttggcgttagcacgctgaatggcgcccagcaccccgttgataccatctcccggatagccgtagatgcgtgtgacgccccactctttcaggcgctggacaaaaaaatcactggttttcatgctcatcgtcgcgtttccccttgtagtccatgcagacttaaagcgtagtagacgatgggcaatcgccgttaattgttcgccattgccgggtatcgttgacgcaaatcactgaatatttgtgccatatccgccgtttcgcctatctctgccaccacccggaatacctgggttttcaggaagtgacgccagctcaccggcgcgcttgccagaaaggcggtcagtaactgataacgctgtggcgtccagagcgtttcgaagcgactccgtgcttcgccgtgctcaaaatggtgcgcagcctgctgcggcatcgtggcgcgcaggcgctccgttgctgcccgatccacgtggtgatcaaccaccaccacgccatactgcgtccttgctgccgcgacgctgagataaccgcagcgcacatcctgcatcaccgcatcggcatcgcgctgtgtcggcaggccataaccgcccgcgccgggtccgcgcacttcgaccacgtcacccggcaggcagtggatcacatcagtgttaccgtgattgatgacctcaccgtcgcgccgggtacggaagtaagagagcgccccactctggccgccgacgacacccgccgaggcaaacaccgatcggttacggttgcgcgcggtaatggtggtattgggcgagaaaacctcaaatgccatttcggtggctaaaccgccgcgatagcgaccggctccggcgctgtcctgggccagtccgtagcgatgaaagcggattggcacttccgcttcgttgatctcaatcggggtgtttttcagaaaggctgaaagaccgccggagccgtcaggcccatcgtgacgcggcgtgccgcccgcgccgccgcccaccggacccagcgaggcgaccacactgcgattctgcgtctgggtacgaatgttcatgattgagttgccgcccggtgaattcgcgggcaaacgctccggcatcgccagcgagaagacgccgatagtggcaatctgcgacagtgcacaggtcagcgagcgcatccctaccgctgcgggcgcttcacagttcatgaccgtgccaggcggcaggattgccctagtgggtcgcagcgtaccggcgttaagcagcagtgaacggtccagcgtagagagcgcataggtaacacccaccagcgccagcggatgccgctcacgtccgccagtcggcatattcagcgacgaggccagctgcggatcgctgccggtgtagtccagctccagttgatcgccctgcacccgcagagtaatggcgatacggcagggataaccgccctcgccatcttcatcggcgtagtcggcatagaagtattccccgtcgggaatggttttgataatgctgcgcgcctgcgcttcggcgtaatcgagaatgccctcaatgccctgcaaaaaatcggcgatgccaaagcgggcaataatgtcgtggattttacgctcgccgacgttcaccgacgccagctgggctttgaaatcgccccagttctgatccggcacccgcacattgagccgcatgatgctggcgacctcttcgttgagctgaccctgccgcatgatcttcagcggcgggatgcgaatcccctcctgcacgatgtcggtcagcgagcgcgacagcgaggcaggcaccgcgccgccgacgtcggtgttatgaatgtggcccaccacgaagcagacaatttcaccctggtggaacaccggtttccagatgtggatatcgggcgagtgggtcgccacgttgccggcgtaagcgtcgttggtaatgcagatgtcgccgtcagcgtactcttcaatcagtgccagcaccggcgcatagtcgatgccgctgtaccagggggcgccgaagctgcgcggcgaggcaaacgccaggccgctgcggctgacaatctggcaggagaaatcttccgtctctttaacaaaggtggagtgcgctgtgcgcatcagcgtaaaggccatcgcatcggcagcggcggcgcagtagttcgccaggatctgtaagttacgtccatcaatcgccatgttatgcctcgttcgccgtgatcagcagattaccgaatgaatcgaccgtgacgcccatgccgggcggcacgcaggtggtgcagtcatcctgggcgatgatgaccgggccactgagctgatgtccggcacgcagcactgaacgcagcactaaatcaacctgatgccagccgccgtcgatccacgccctggtctgtttcagtaccggcaccggttccgtggccggagccagtgggttaatcaccggtttcggcgtcggtgaggcaatcaccagccgcaggttgatcaactgcaccggcgcctgcgggtcacagtgaccaaacagctgctggtgctggcgatcaaaggcgtcatgcagcgcagtgaaatccgcctgcgccagccagttcgcctccagcggtacgtcgatctcaaacgactgaccgcgatagcgcatatccgcgctgaactgcaggctgtaaggcatatcgctgccgtgctcctgggccagccagccacaggcgcgctgctgtaatgcttcggcttcactggccagggtgtcggccagggcgggcgtcagatcgccgtagagcgtgcggataaagtcgttacgaatgtccgccaccagcccgcccagcgcggacagcacgcccggcgtcggcggcacaatcacccctttcatattcagttcgcgggccagaaagcagcccatcatcggacccgctccgccaaaggcgaggaaccagaattcacgcggatcgagaccaaagcgcgacagcagcccgctggtgtcgctgtacatgctggagatcgccagctggatggcggtttctgccgtttcctgcaccgtgacgccaagcgcatccgccagcggctgccaggccgcacaggcggcgtccacatcaacagtgacggcgttataacccagcgcgccatggcccatcatgccgcaggcggcgaacgcatcggtggcggtgggttgcgtgccgccgcgctggaagcagaccgggccaggcagcgatccggcactgtccgggcccatctgcagcacgccctgaccatcgatccacgccagcgagccgccgccctgacccaccgaagtgacggcgacagaaggaataaagatcgggaaatccccgatgatttcgccgttgccctgtgccactttgccgtcgatgatcaccgccacgtcggcgctggtgccaccgatatccaggctgaggattttttcaaaaccacaggcgctggcgagatagctggcaccaatcaccccggatgcggtgccggagagcaccatctgcacgcattcgcgtttcgcctgatcgacgcccatcaccccgccgttggatttggtgatgcgcggcggcggcctgacgccgagccgttgcagcgcctgctcaaaggattccaggtagtggatcaccatcggctgcacgtaggcattaatggtggcggtaatggtgcgttcatattcacggatgatcggccagatgtcagcggaacaggaggtcagcagctcgggtgccacctcgtcgataatcgccttcaccgccgcttcattgtgccggttgcgatagctgtgcagcagcgacaccacaatgccctgacagcctgccgcgcgtgcctgagcgattgcgtcgagcacgctctggcgatcaggcgcgtgcagcacgttgccgtgcgcgtcactgcgttcacggatggcaaacacccgatcgcgggtgatcagcggagcaggacgccgggagaaaaggtcgtggatatgcgggattttaagccgggccagctccaggacatcgcagaagccctccgtggcgaacagcgccagccgcacgccgcgccgctggatcaccgcgttaatgcctaccgtggtgccgtgggtgaagtaaccaatctcagcgggatcaatgccctgatgctgctgaaactgcgccagtccggtaacgatttcgctgcctggctgatccggtcgcgacaggactttcagggtgtgaatctggttcgtttgctgatcgagcacggcgaaatcggtaaaggatccaccaatatccacgccaacgcggtatcgcatatcggggtaactccagtgtcaggaagggggaaattccatcagcgcctcgggatgttgcaccacacgccagccgagccgctgatagacctgatgggcatcctgggttgagagcatccagcgatgcaccgtttgcagctccgggtgttcacggacgcaggttgccagccagctgcccagcccgtgaccgcgccagttttcatcaatcattacgtcacacagccagccaaaccgggtgtagtcagtaatcagtcgggcaaagccaatctggctctgctggtgatagaggccaaacggcagcgaaccggcaatcgcccgcacggttttggccagcggctggcctttggcccagtaggatttctccgccagctggatgtggatccacgccaggtcgagccgctggcggctggtggagacagtgaacgcctcgcgctgccactgctggtcagcaatctgcaatgagtccatgacaactccttgtatcggttgaaaacagtgtaaaagggttcgcccgacggttgaggctgtagcgcgctacagaaccggctgttgcgactgaattttgcgtcatgaagaaattttatgctgagggggcatctggcacattaacgggagaagtgaagcggatgggcgaacaaaagtgcggctggggtgaatcaggaaagagtaagcagaaacaaggcaggtgacggccctctctccaccggtaaacatggcgagggcgacgcctggccgcccgctacacgccgaactccaccgaattgtgcttgccgatcagcgatcgcaacggcacgctgcttttcatgatcggggatttgatcacgatatagctgaagtacttatcgatgccgatctgagcgtcgagcatcttctcaatcacttcctggtaatgttcaatgctgcgggtaataaagcgcagcaaatagtcatagccgccggtaatcagatggcactccatcagctcatcgacgtcgcgcatcgcactttcaaatttcataaagtcttcgcggcgatggcctgacagggtgacttcggtaaagaccgtcaccgaatcggtaatgcgggtgagattaatgtgcgcttcataaccggtgataaaaccggcctgttccagacgtttgacccgttgcagacagggactgggcgaaaggcctacggcgtcggcgaggttaacgttgctgatacggccatctttctggagttgcaccaggatgttgatgtcgatgcggtcgagtttcattaagccgttcatagcacccccctcattgtcagagcctgtcccgccaggcgtcattgttgcaggcagtctggagacggacagcgcggaacaaccggcgcgtacatggcgtacgtgaggattgtaagcactgaccaggttcagactgacaaatgaaatagcctgatgggatagacgcttaattaaatgtgcagaacctcccgaaggtatatcacgctttaccgtaaacgcgccagcgcttcgcagtggttataccagcgggagattttcaaattactttaacaatatcaatgaggaatcgcactttaccccaaccggcctgtggcgcgggccagcgcaatatcgaagatatgcagcgcctcttccagctgtgagtcggtagtgaccagcggcgccaggaaacggatggtgttgcgatgcaggccgcatttgatcagcagcaatccctcctggcaggcgctgtcgaggatcttctgggttaaggccgcatccgggcgaccggtttcgaaatcgaggatctccaccgcctgcataaagcctacgccgcggacgtcaccgatgcaggcatatttatccgccagctgccgcagtcgtgcattgagttgctcaccaagctggcaggagcgctgcaacaggttttcctgctcaaacagatccagtaccgccagcgccgccgcacaggccagtgcgttgccgccataagtaccgcctaacccgccaggcgtcggtgcatccatgatctccgcacgccccaccacaccggaaatcggcagaccgccgcccaggcttttcgccagcgtgactaaatcgggtttgatacccagttgctggaaggcgaacatcgtgccggtacgcccgaagccggactggatttcatcacaaatcagcagaataccgtgctggctggtgatgcgacgcagcgcctgcataaatgccgggccagcgggcaggaagccgccgtcaccctgaaccggctcaatgataatcgccgcgacccgctccggcaggatctgcaccgcaaacagctgatccagcgctttcaggcagtccgcttcagtaataccgtgcagcgggttcgggaagggcagacggtaaatatcgccggggaacgggccaaaattctgtttgtaaggcgcggacatgccggtcagagtgatacccagcagggtgcggccatgaaacgcaccatcaaaagcgataatgccagagcgctgggtgtgtgagcgggcaatcttcaccgcattttccaccgcttcggcgccgctggtaaagaagacgcttttgtacgcctcatcgccgcccaccagtttgttcagccgctgcgccagctcgatgtagcccggataggccaccacctgaaagcaggcatgagacaccagaccgagctggcgggtcaccgcattgaccaccgccgggtgattgtggccgacattcagcaccccgatgccgccgacaaagtcgagatagcgattgccctccacgtcccacacttcactgcctctggcgcgttcgatcaccagcggatgggcggtaactacgccgcgcggcacgttctgctcgcgtgcatccagtaacaggctgttatcggagtatgcttgctgctctgccatgacattctgcattttaaaccctcatccacgtaacgtttcggttggctcaagtatcgcaacccgctggtttgtcacgctgccgtaattcctcagacagcggcatttcctgtcaaaatcctgcggcattcagcagggaaatttctctgccagcgcctgacgaatcagcgtgacaaaaacgttaacgccatgcgggatcagcgcatcgttgaagtcgtatgcagcatgatgcagcggcttgcagggtgccgaccccagccacagataggcaccgggccgcgcctgcagcataaaagcaaaatcttctgaggtaagtgcgggctggggcgcggcctcagccgtaatgcccgcctgcgtcagcgcctgcaggcaaaactgcgcttcagcattactgttcagggtcgccgggtagtagcgcagatagctgacctctgcgtgcaaaccgtgggcggcggtgatgtgctccgccatctgacgcagtcgtgcttcaatcgtcgcctgcgctgccgggctgaaagtgcgcaccgtgccggtgatgttcgcctccgccgggatcatgttgtgcgaaaagccgccctgcatccgggtgacggtgagcagcgccgtttcgcacggatccagggcgcgcgagaccagagtattcagctgcaccaccagctcgctggtcgccagcagagtatcgcgcgtcagatgcggctgcgcggcatgaccgcctccgcccagtacccggatatcaaaacggtcagccgctgccatgatcgcgccagggcgggtctgtacctggccgagcggcagttcaggccagttgtggatggcgtagaccgcctcacagggaaaacggctgaagaggccatcgtcaatcatcgcctttgcgcccgccagcccctcttcggcgggctggaagataaagcagacgctgccatcaaagctgacgtcgcgcgccagtttttctgcggctcccagcagcatcacggtgtgaccatcgtggccgcaggcgtggctcacctgctccgcgcggctttgccagtcggtgccgctctgatcctgcatcggcagcgcatccatatcagcccgcaggccaatcatgcattcactgctgccctttttcagtatcccgaccacgccggttttaccgatgccgcgatgcacctcaatgcccagctgttgcagaaagttcgccacgatgtcgctggtgcgctgctcctgaaagcccagttccgggtgcgcatgcaggtcgcggcgcaatgccaccagatgttccatcttaatatcctcgcgaacgatcaatctcaccgtacagcggctcgccacgctgatggcgccgcaggttttccagcagtgccgcaatggcgctctcattctgcgtctggctggcgatgtggggtgtgagccagatggcgggatggtgccagaagggatgacccgccggtaacggctccgggtcggtcacatctatcacggcggcacggagctgaccgctctccagcgcctgcagcagatcgtcctgattcagctgggggccgcgcccggcctgcaccagcgccgcaccctgtggtagctgattaaacagggttcggttaagcaaaccctgtgtggtgtcagtcagcggcagcaggcagaccagaatctcgctgtgcgccagaaacgccccgagctgatcgtcaccgtgccagcagcggacgccgggaatctggcgcggtgtgcggctccagccagcgcagtcaaagcccagcgccaccagctgttgcagtgcggcctggcccagttcgcccagccccatgacgcctacccgacgctgcgcggcaggtaataccgcgtgtgccagccactgctgctggcgttgctgatgaaaatagcgcggcatgtcgcgatgcaggccgagtaccgcgaaggtgacatactccaccatgccctgggtcaggcctggctcgatcatcctgatcaccggcaggtcgggcggcagcgcgccaaggtcaaactgatcggccccggcacccacggagaacaacagtttcagccgggggaaaagcactgtgatgtcagccggtggctgccaggcgaccagcgcctcaacctgctctggatcgccggtctcaggccagatatgcagctgaatgtcaggcgcatgcgctgccagccagcgctgccagatccggccacgttccggctccgatttatagacgatatgcatcaggccatcgcctgcgtcatcagtccaaacgcctgcatgccctgcggtgtccagggcgtgccgcgcaccatagtcgcaggcgcatcgacctgagggatgcccaggctctgtagccaggcggccatcggcagcgcggcatcggtgtcgatgcgcaggaattccccctgcagcgactgcatcagcgaggcgaccagcgcctgggctaccgcgaagtctcccgcgatgatcgggcctatcgcccagccgtgaccaaagcggcgcaggctggcgaagccctgaatttgctgatggtcatcctgcaacagcaccgtctggcagtcgcgcagcaggtggtcgaacagtgccggacgatgcataccgtgcgcctgctgatccagcgtcaccagtgtggcgtgatcggccagtgttgccggacgcagctgcagtcccgccgggatcacgacgtcaggaagggtggtcactgcgcgggtctggtgctggcgaatttcaccgcaactgacaaacccgagtttttcatacaaacctttgcccatttcggtggcgtgcagacgcacattacagtcgggtaatttttccagttgcgccagcatcagctgtttgcccaggccacgcccctgctgctggttatcgacgatcaccagccccagcgtggcggcgcgctcgccccagcgccagagcaccgcgctcgcaatcagcttgccctgctcttcaatcaccgtgccctcgcccagctgcagcgccagctgccagtcttcacgtcgatggggccatttcagtgcctgcgttaaggtgaaacaggggtcgagatcgtccggcgtcattgcgcgtattttcaggctcattgcaggtctccttacatcatgcctggtgtttcaagtccgctgccgtcaaccagacggctgtagcgataaggggtgggatcaacgactggcgtggcttcggtcgccagatcggctgccagtcgtccggcacccggtccgataccgaagccgtgggcgctgtagcccgccgagagcaccagccccggcaatttcgccacggtggagatcaccggaatcgcgtccggggtgctgtcaatcatgccgccccacgactgtgccagtcgcaggttcgccagcgccggatattcacgccgcatcgccgccagcccctcttccacgatcgttgcatcggctgccggatcgagaatgcgcatgcgctcaaacggcgactcgcggtcaaatgcccagccacccatcgcttccgggccattgaagaacggcgacaggccaagattcagggtgagattcttgcggcgacttttaaaggtcggatagaactggcgggcatagcgcagcccctgcgcgccaggttccagacgcccgcgaccagagactgagacggtgtaactgccgtccatttgtggccgacaggcaaagccaggtgtgtagagtggcatggcaatcgcctgctcaatgggctgcgtgcggaaggcggtgccaatcacgttgcccagcggcagatcgataccgtgacgacggcaaaacatggaggtccaggccccggcggcacagatcacccggctggttttgatcaggccgcgctcggtccagacgccgctgacccgtccggcggcgatatccagcccgcgcaccgcgcattgctgaaacagcagcgccccttttttcagcgcgcccgccaccagcccgggcgcggccagccgaggttcggcgtgaccgtcggtaggcgctgagagaccgccccgccagcttgtggtgctgccgggcgtcatcgctttggcctgctccgccgtgaggatcgaactgcgcacgccatagccttttgccatctggatccacttatcccaggccgcgatgtccgactcttcctgcgtggcgtaaaccagcccgctgcggcggaaacccagctcttcgccggtttcatcgttaagctcaccccagcgttgcagcgcataaataatcagcggcaattcacgttcatcacggttctgctggcgacaccagccccagttacggctcgactgctccgctcctaccaggcctttttcgattagcacgaccttcagtccctgcttcgccagctcccaggtggcggcggctccggcgataccagcgccaatcaccactacatcggcggaatcgggaaaattcgcactgtcctgtacataacgaatcggtgcaggcataacaagactacctctgttgtcagtatctgatcagcgcagagcgatatcaccgctgtgtgctgacccgcgccgcccgcgcattacatcagtgctgtgcaggcggattaatcagggtgcccgttgcttcaggcaactcactctgcttttaaaatctcttcatgctcatccagccagccctgacgcagctccggcaccgcgcgtttcagccgctcgaaatacaactcgctggtcggcttgtcgtagtcgctgcgcgccagctgggtgacgatacgaccgctcttcatcactacgatttcatcacataccgcgcgtaccgcatgcatgtcgtggctgatgaagatcaccgagagtcccagttcgcggcgcagtttcgctgattaagtcgaggacggcagcggcaaccaccgtatccagcgccgaggtcacttcatcacacagaatcagatccggctcagccgccagcgcgcgcgccagattgacgcgctgcttctgcccgccggagagcgcccagggacgccgccacagcacactgcgcggaagctgcaccagatccagcagctgataaagccgctgctgtcgggccgcaccgctcagaccgtgaaacagcgtcagcggacgcgacagtatgcgttcaacgctgtgggccgggttcagcgcggtgtctgccatctggaatacatattgaatgcggcgcagctcgttgtcaggccgtttttgcatatcgcccgagatgtagtgaccgttgaacagaatatgaccgtggcttggagcgttgagtccggcaatagcgtgcgccagggtggttttgcctgagcctgactcaccaatgatgccaatcgcctgccctttccacagcctgagattgatatcttccagaatgcgtattttcgggtagccatcgctgccacgcggaccataacctgcgctgaggtcgcgcacctcaagcagcggctgaatatcggcggcaaccgggcaccagttgctgggccgctctttctgccgcgccgcctccatcagtaagcgggtgtactccgcctgcggtgcgccgatcagatgcgcggtgctgccatactccgccattttgccgcgcagtagcaccagtatccggtctgccatctgcgccaccacggctaaatcgtgactgacgtaaatcgccgtgacgccgcgctgcaccaccacgcggcgaaacgccttcagcacttccacctgcgtggtcacatccagcgcggtagtaggttcatcaaggattaccacgtcaggatcgccaatcagcgccatcgccgtcatcagacgctgtaactgaccgcccgacacctggtgcgggaagcggtcgccaatggtctcggggttgggcagcgccagttcgcggaacagctcaatcgctttggcttttgccgctttgcgggtcagggtgccgtggataaccaccggctcaatcacctggtcgaggatcttcatgcccggattaaacgacgctgccgcgctctgggcgatataggcgactttgttgccacgaaaggcgcgcagctgccccggcgtcaggctgttaacgtcggtgccggcaacgtgaatgttgccgtcggcgatgcggcagccgctgcgggcgtaacccatcagcgccatcgcgatagtggttttacctgagccggattcgccaatcagcgccagcacttcgcccttctgcacggtaaagtgaatgtcggaaaccaggtcgatctcttcgccgcgatcggtctgcgcagtgacgcgcagtttatccaccgaaatcaccggcatggcggtatgtggtgtcacgttcatgctccctccttcgccagcgtcatcggacgcatcgcctgcaggctgtcaataaacaggttggcgccaatggtcaggctggcaatcgccagcgcgggcatcagcaccgcaggcgagccgtcaaacagcccctgcatattttcacgcaccagcgtgccccagtcggcgtagggcggctgaacacccagaccgaggaagctcaggccgcttagcagcagcacgatgtagacaaagcgcagaccaaagtcagtcagcatcgggtgcaccatattgggcaggatatcgtgaatggcgatataccagcggctttcgccccgcagccgtgacgcccggacgtagtccatgctgcgcagcgagctggccatggcaaacgcgatacgaaatgcgcccggccagtaggtgaagaccgccgtgaggatcagcatcggcagtgaggagccaaataccgcgactatcatcagcgacagcactttgcccggcagtaccagcagcgcgtcgttgacgcggcccagtacctcctccagccagcgccccgccaccgctgccagcagcgccagcagcgtgccgatcaggctggccagcagcgccgcactcagcgccagaccaatggagaacttcgcgccatagagaatgcggctcagcatgtcgcgcccaaggtagtcggtgcccagcaggttatcggacgtcaggccgcccatcagcgggccgccgccgatgtcatcaatgctgtgcggggccagcggggtgccgaataccgccatcagcagccagaacagcgatattatcagacccagccgtcccgaccaggagagcgactgtaagaaacgccagggcaacgagagaatattcatgcgcttctccatttcgggttaaaggcgatagtcagaatgtctgccgccagcagcaggaccagatagcaggcggcgaaacagcatcacgcagagctgcaccaccggcaggtcgcggttactgaccgcatccaccagttggctggcgagaccgggatagctgaagatggtttcgatgatgattaccccgccaaacagataggagaggctgagtgaaatggcattggcgatggggccgaccgcgttaggcagtgcgtgacgcagcaccgctctcagcggtgaaacccctttcagcagcgccatctccagataagggctgtcgagctggttgataatggctgcccgcgtcatacgtgccatctgcgccaccagcacgcagcagagggtcagcaccggcagcgcgtaggctttgaggtaactcagcaggtcgctatccgggctgccgaacgacatcgctgacacccagtgcagcttgacggcaaaaatcagtaccgccaccgtcgccaccagaaactccggcacggcaaccgtcgccatggtgccgatgaccagcgcccgatcgagccgggaaccgcgattcatcgccgcaataatgccgataatcagtgccagcggcacgcagatcagcgtggtgatacccgccagttcaaaggtggcgggaatgcgctgcgccaccagctgcgagaccggcaaatggctggcaaacgaggtgccaaagtcgccctgcaccatgcctgtcagccagtggaagtagcgcatcagcaaaggctgatcgagacccagctgctgccgtaacgccgccaccgtttccggcgtggcgttctggccgaggatcatctgcgctgcgtcgcccggcagcaggctggtgatgaaaaacaccaccgccgagacgataagcaaagtcaggatgccggcaccaattcgccgggcaatcaggaacagcatgtatcggttcatcggcgtactccttcctcaaataacgtatcaggcgctcagccacgcaaattcatggaagcgatagcccatcatcatgcctgacggccaggcctccacccctttgacctttttgttgtagccatctgtggagctgataaaggtcgggataagggtgccgcagtggtcataaatcaacttctgcatgtcgccatacatctgcttgcgtttcgcctgatcgcgctcaccgcgtgccgcgaccaccagttgatcaaactgaggatttttccagcccgattcgttattcggtgcggtagagagataaaactgtgagaagagcatgtcgagcgtcggacgcgggtttatcgagccatatcccaccggatctttcatccagtgcgaagaccagtaaccgtcatacggcacacgtcgcactttgatgttcagccctgccccgcgcgccatctgctggatcatctgaccgccttcatttgccccttcgatattcggcgtggtgatgatctccaccgtggagcccgccatgcccgcttttttgatgtggaacttcgctttttcaatgtccagcgcacgcggtttgagatcggcgttatagagcggatgccacggcggcaccggggtgtcattactgacgtcgccgtaaccctgcagcaccgttttcaccagcatttcacgtggctgcagatatttcatcgccagcacgaaatcttcgttgttacccggcttcacatcggtgcggataatcaggttggtgtacatgcccgatttactctccagcacgccaaattcgctgctggctttgatgcgcttgcagtcggcagcggtcagcgtggagaccatctgcagatcgcccgacatcagggcattaacgcgcgctgcgccgtcggtgacgccaatcagctctacctcatccagatgtggcagaccaggtttgtagtagttggggtttttggtgccgatggtgcgcgtacccggcataaatgttttgcagacaaacggaccggtgccgatgcctttgctgaaatctttggtgccgtccggcacgatcagaaacggcggtgtcgccagcatataagggacgtcgaagttagcgctgctcagctccagctgcacctcgttatcattgaccgcgctgaaggttttaaactgatcggccagcttaaaggcgatagaggcgatggccggatctttgtgacggctgagcgagtagatgacatctttggcggtcagcggtttgccatcatggaaagtgacccccttacgcagtttgatatgccaggtaatgccgtcgctggattccagcgattcggccagcgccggttgcgccatcaggtttttatccagctcggtcaggccgctgtagaacatgaactggcgggtgtaatccgcactgttgttacttttggccggatccagtgtatcggtggccgaggcattcgacatcgccgcccgcagtttaccgcccctgaccggcttgtcatccgccagtgccgctcctgaaaaagtgatcaggccgctgctcatcaccgcaccggctgagagcattttcatcagactgcgacgtgaaagtgagccttctgtgatcatgcgcgtcagtgccggatttaccgcatcagcgtcgttattatcaaatttactcatctctgtaccctcaatagtcaggcgaaccggggatcatgttctggcggtgctgataacctggcggtcagcacccgacgggacgttatgaaaggcgatcctttgctttgtaatagagtcctgcgagcggtaaaaaccatggcttgccgtgatagccgggcagcgcgggccatgtgtcgcgctgccagggattttcagtgcgcttttcagccagcagactggccatgacgcgtcccatccacaccgacatctgggtaccgtgaccgctgtagcccagcgaatagaagaggccatcctgttcacccgcgtgcggcagacggtcggcggtcatatcaaccataccgccccagcagtaatccacctgcgactggccaagctgtggcagcatctgcgtcatcgcccggcgcaggatctcgccgctacgcgaatctgacgtcgggttgctgacggcaaaccgcgcccgcccgccaaacaccaaacggcgatcggccgtggtacggaagtagttgccgatattcagtgaggtgacgtaggtgcgatcgtttggcagcacctggcgcagcagcgccgggtcgagcgcctccgtcaccacgataaagctgccaaccggcacaatgcggcgctgaaaccagggaaaagggccgacgttggagcagccggtcgccatcagcactttgtccgccagaatggtgccctgcgcggtctctacccgatgctgataacccttcaggcgtgctaacttcgtcacggcgtggtgcgggaaaatcttcgcgccgctgcgggcggcggcctcagccagcccgacgccgaacttgcccatgtgcatctgaccgccccgtttctgcagcaggccgccgtggaagttatcgctggcgatctcgtcgcgtaccgccgttttgtcgagcagttcgatctccgggtcaacggtgcggcgcatcagttcatacgcttcctgcagcccggccacatgcgacgctttgctggcgagcttgagtttgccgcacagccggaagtcgcagtcgatcgcttcatcctggatcagttgctggacatagctcaccgcctcatcaaacgcccggtagaagcggctggcctgctccagaccctggctcgccaccagcgaggcgaagttctgcgccacaccggtgttgcagtggccgccgttgcgcgccgaggcctgactcatcacgtcgccactctccagcagcacaacgctgatgccgctgcgcgccagattcagggccgctgagatgccggtgaagccaccgccaatcaccaccacgtccgcctgtgcgggcagcggttcgcgtgcggcaccggtaaaggccggagcggtggcctgccagaacgattccagtttcatggggtgttcctcagagtccgacgacgccaggcaggccgccgatatcgttgatttcggtgtactggtaatacggattcgccggttcatgaccgcgattgacccagactttgtttttgatgccgagatcgtgggcagtcatcaggtcatagcggaagctggaggagacgtgcaggatctcctccgggccgcagccgagcttatccagcatgtactcgaagcccttcatctgtggtttgtaggcccccgtctcttctgccgtgatagccatatagattggcgcgcccagacgcggttcgtgatgcgggatcaggtctttcatcgagttggtcagcagcaccagcggaaactccttagccacctttgccagcccggcgggcacgtcgggatgcggaccccagctggcgcagtcggtgtagataaagtcgctgtcggctttgtcccaacggacgccccactttttgcaggtgcgctgcagggcattactcaccacgtcgtaatagggtttccacgcgccgagtacctcatccagccggtaactggaaaagtcggtagtaaaggcgtgcattgcgtccgggtcgacgcggtcgctgaaacagcgctgcgcggcacccgccatatcgaagcgaatcagcgtgccgtaacagtcaaacgtgatgaatttcggtttaaacagtgccatgtaacaccctcgtcattgtcagttgcgcttagaaatcgatgagtacactcttctggcgctggcaggcctgaaacgcctggcggcctaaatctttaccaatgccggagccgagaaagccaccggtcggaatgatgaagtcgccggaacgcccatagcggttgatccagacggtgcccgcgtcgatggcgcgcattgcccgcagcgcgcgcggcagactcagggtgtgaacaccggcgcagaggccataagtgtcatgggcggccatcgccagtccctgctcttcatcatcaaacgtctgcaccgtcagcaccggaccaaaaatctcctgctggactgccgggttatcctgcgccacttgactcagcagcgtgggctgccagaaccagccgtcgtcggtgtcggcaaaacgctcaccgcccaccagtacttctgcgccctgcgcttttgccgcttcaataaccgagcagactttgttgccctgtcgttcgtcgatcagcggcgcgtagcggctgccctcctgccaggtgacgcccggtttaacctcccggcaaagttgagccagccgctcaaccagcggatcggcaatgttgcgctgcacaataagacgggtgcccgccacgcaggcctgaccgccgttggcggtgaagccgcgcagaatccgctgggccagcacctcaaggtcacccgcgtcatcaaacaccagttgcggacttttgccgcccagctccagcgtcaccggcttcatgccgttttgcgcggcatcgctcatgatgcgcgcgccggtcagggtcgagccggtaaacgagactttgcgcaccagcggatgttttaccagcgcgctgccggtcaccgcgccactgccttgtacaatgttcagcacgcccgccggtaagcccgcctgaatggccagttcggccatgcgcacggtagaaaacggggtcagttcagagggtttaagcaccaccgcattgcccgccgccagcgccggtccgcatttccacgacgccatcgacagcgggaaattccacggggtaatcgcggcgataacgccataaggttcggcaattagcatgcccaggctgctgtcgcgggtgggaaagagatccccgctgtatttgtcagcgcattcggcatagaagcgaatcgcttcggcggtaaaaggaatttcgtgcagcaccacgtcattgatcggccgggtggagcccagcgcctccagctgtgccagcagcgcgtcctgctcaatcagatcggcccagcggcgcagtacccgtccgcgttcgcgcggcggacaaccggaccagccgctgcttttcagcgcctgatgcgccacagtcacggcacgatcgacatcctgcggcgtggcgtcctgcagcgtggcataaaccctgccatccgagggacgtttaacctcaaaggatgcgccctggctctggcagtgctggccgccaatataatggccagtcgggagagaaactttttctgggtcgaaacttaacatggaagaattccttatttgttacacccatcagttgctggtttattagcgtttaaaactgccggtttctgcgctgttaataagctaatgcagaaagtatgccagccgggcaaaaaataaaaatgcgtttaaaacagtgcaaaaaaattttctgccgtattggcgggggattttttgcggaattgccgaacaattaaacagatgatttacttcacaaaatttatgcgccctgctggtgcaacctgcacggaaattgcaccaaagcggatattgctgataaggctgctcattccggtacgcatgacccgccgatttaacgacccgcttcacatccctgataaattctttaatttttcagaacaattatttgacgccggtaagtttttacggagcctcaggcaaaaaaaggccagccggattatccggctggccttttttcatttttagttacagactgccaatgtgaaatgttttctgttccagatattcatcaattccatagcgggaaccttcccggccaataccggagagtttcacgccgccaaacggcgcgacctccagggaaatagcgccggtattaaagccgaccatgccaaactccagcgcctccgctacccgccatgcgcgccggatgttctcggtaaagaaataggcacccaggccgtagggcgtgtcatttgccatcgcgatcgcctcctcttcatcgtcgaagataaacagcggcgcgaccggaccaaacgtctcttcatgggcgatgcgcatggcggcggtgacctcaccgagcaccgtcggctgcacaaaggtcccgttgccctggctgatgccgccggtcagcagcgttgcaccctgactgagggcatcgtcgatatgaccgttcactttctctaccgcgcggctattgatcaaagggccaatagtgctgtcgggcgcaaaaccatcgcccactttcagagtggcgaccgcctccagcaatcgggcggtgaaacgcggatagatacttcgctgcaccaggatgcggttagcgcagacgcaggtctgcccggcgttgcggaacttgctgagcatgacccccgcgacggcaatctcaatatcggcatcatcaaacacgatcaggggcgcgttgccacccagctccagactcaggcgcttgatgctgtcggcgctctgttgcatcagcaactgtccgatgcgggttgaaccggtaaaggagattttacgtaccgtgcggctttcagtcagcgtcgcgccaatctccttgggcaggccggtcagcacctgcagcacgccggacgggaagcccgcgcgctctgccagtaccgccagtgccagcgccgacagcggtgttaactcggaaggtttaacaataatcgggcatccggcggccagcgcgggcgccaccttgcgggtgatcatcgcaatcgggaagttccacggcgtgattgcggcggcaacgcctaccggctgtttcagcaccaggatgcgccggtcctcgctgggcgcgggaatggtgtcgccatagattcggcgtgcctcttccgcgaaccatttcacgaagctggctccatagagcacttcgcctctggcttccgccagcggtttgccctgctcggcggtcatgataatcgccaggtcgtcagcgtgttcaataatcagttgatgccacttttccagcagcgcggcacggctggcattggtggttttgccccagctgatgcgcaccgtttccgcataagctatcgcctgcccggtttctgcccgacccagtgccggaatcgtcgccagggtttcgcccgtggcgggatcggtaaccggcagcgtggcgccctgatgcgcatcctgccagcgtccattaaacagcgcctgctggcgcagcagatcgctatcgttaagttgtagtcgcgacatatcatccccttgtggtcagctgattccactttatcgcgccgggtcagcgcaggatgttgttgtgcggggtgagaaaggtcgataggggagattttcgcaatgatttgaaattttatgccgtgcggaaacaggcgcgcatccgggtggatgcgccgtgtgcttaaatctggaagtcgataaccggttcgtcgtcattgctgtaggagagcgcctgacgcttgatctcttccagcgacaggttggcgttgcagagttccaggaactgccagacgtagttgcgttgcagctggccgcgcttgaggccgagccatacggtgctggcatcgaacagatgcgtggcatcgaggcgtaccagctcttcactctcttcagtttcacacgcctgatcggccagtatccccacgcctaaaccgagtttgacgtaggttttcaccacatcggagtcctgagcgctgagcacgatatctggttttaaaccggccgtctggaacgcacggtcaacccgcgaacgtccggtgataccctgccggtaggtgatcagcggatagcggctgagcgtgctcagtgaaaccggctgattctgcaccagttcatgccctttcggcaccagtaaggcgtgatgccagctgaaccaggggaacgccgccaggctgctgttgttgaccagtaattcactggcgatgccaatgtccgcctcacccgccagcagcatggtgacaatttcctgcggcgaaccctgattaagttcaagccggacgttgggatagagctgacgaaatgctttgatgactttcggcaggctgtagcgcgcctgagtatgggtagtggctatggtcaggatgccactggtttcattggtaaagacatcggccagacgtcgcactttgcccgcttcatccaggatacgctcagcgatggtcagcagcgctttgcccggttcggtcatccccaacaggcgcttgccgcgacggataaagatctcaaccccgagttcatcttccaggtcacgaatgtgccgacttactcccgactgggaggtaaacagcgtattagcgacttccgttaagttaaactcacagcgggccgcctcgcggatgattttaagctgctggaaattcacggtatttacctccctttacataatctgattatctgatggtaagaactattattgataaccggaaatactaaaaaattcggatttatgactttagggaataacggggtgggtttgggggggcagagaggtttgagatgggcggccggacttcagaatttgactgaaacccggcctgggggagaggctattttacagaaggcgatagattacgcattctggcgctctctgctttcatctcttcatagcttgcttccaggatccacagacaggtcgcaccctggtcagttgccagtagcgccagacgggtttgttgataaaaatcctctataaaggctgtaggttgctcagccggaacgctgcagacaatgtctgtacctgccatatggggccaggatctggcgtcaataacccggagcgtctccagcacgcccggggtattctttgctaacgccgaggcaagggcatcttccatccgggttgcctgctgaacatcagccgtagctgccagttggggcacttttgcaagccaggcttgctctcctgacgctatgcccttcagcgaattttcccagtcggatgtattcgctccagcccagaccgcgaagggcagaaggccaatcaatatcagatatttcatcggaccacctccagcgtcccgccttcacgcagcacgcgtcgccgggttgcaagtgacataatgatgcagccttctgaggcgaagcccgctggcttattgaccctttcgccatgaatgcgaaatgccgaacggccaaaagactctccggaagtctgcaccagaataatggtcaggggtccttttgatgtggagtgccctgcaattctgtacgtttccctgaggaaggggccccatccctcttacatgctggcgatcgggattatttttgttagtcagactacctgagtagccggcctcaataaattcactgttgtggtataagtgacccgtgctttgctcatatgtccatgtcatcgttatattcctttatgctgtcactcgatcattccagctgtccgagtggacgatatttccgtctgcatatcgccaggtaattttttcgtaaatcagctctacagtttccagatgatcccgcgcctcaccatagcgggatttaacgtcatacatcatcgggcccacacagataacggttacgccttccatcaaagtattgaaatattccacctcctgccccgcgtcatttatccggtaaaatcttatttccgctgagcaaagcttttgacctgaggtcacagccctgtaaaggcagggactggacttatcgatctctttatcaaaactgtaagaagcgtgttcgcggacagcggttgttttacccgtcacgttgtctgtggagagcatgacgccgtgattcaggccgaggacttcaatagcgccttcacgacctgccacgtcgactgatccgacaataatgttgttaccgtcatctttaagccagagataagctggaatagccatcgttttaaactccattttaaaaagagaaagccagcctgttttctgctgacaggcccactgctttcacagcctgattaaactatcttccggcaaacatcagatcaattttcatacagcgtgaaatcaacctgattgaagttttattgtttcagatatagagatcgcggaataacccggtatcagagaaaaaaaacgtgcccaaaagctattcagaataatttaaaagtcgcatcagcaattcttcacgccaacatggatttatcattcgtgctatgaagttcacattgtgtcgaaatggaaagatagaacctcttcctgtccagccagtaaacagctctgtgcagcaaataaatacagaaattacagacgaaggtttaccagaggcgtccgcagcgctgaggaacaaccggaggcaaggatgagccgacaggacgtcggcgaaagggcggtacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgctcaggcaacctgaaactcccgaacgcctggcgggcgtaacccgctcagtgctaacgcggggctaagtgatctaaaactcccatatgtttggcgggcgtaaactgctcagcgctaacgcgcggctaagtgacctgaaactcccatacgcctggcgggcgtaacccgctcagtgcaacccgctgcaaagcgaaaccggctggttgccagcccgctgcaagcgccctcttaactcactaacatcaactcccgctcctcactcagcggcttattcagcagcgacagcagaatgttcttcactgcctgcgctgaaggtgacagcggcaaccgggcggagacgttcagtgacagcggcagactcaatgacgggctgttaatgcgtgacatccaggcatcggtggatcccaccagcgaaacgggcggcggactcaggtaatacggtcacgcccatgccgctggaaatggctgcggtcagggttgaaatcgattcgatctcaccgatgatgcgtgcactcagacgacgcagcgaaaaggcctcatcgacccgcttgcgcactgcgctgtaatcgcgcggtaagaacagactcatctgcgccacatcggccagatcgacgctggctcccgggtaatcggtggcgcctaccagaaacagatcctctttcatcagcggcatgctggtgatcccggcagtgggtgcacgatcgtacagcaccgccatatccagctgaccgttcatcactttctcattcagcacgctgccgctattttcgtgcagataaaccagcacttccggaaattgatcgcgaacggtctgtaacagcggcatggtcagcgatgaagcagccgtacccggggccagcccaatcgatacctgtccactcagtacctgaccagcgttaattaccgcagtctgggcctgctcacactggcgcagaatggtgcgcgcatgaccatagagaatcttacccgcctcagttggcgtaacgccgcgcttggtacgaatcaacaactgctgatccagttcattttccagcgtcgcgacctgctgactgagtgcaggctgggcgatgtgcaacacttctgctgcctgcgtcagactgccgatatcgacgattttcacaaagtacttcagtcgtcttaaattcatcttgcctccgtcactcaccccgaatagcgaaatgggtctgatcccatcgccctgataacagagattttgcaagatgcaggccaggtttaaaaaactcaggccatcaagcagccagatttttcctaacggcccggaaaataagcgtttctgattacctcttatgggttaataaggatcaggaatggctgagaagagagagtaaagccgtcaggcgcactgtgacagtgcagacgctgcgagtcagacgtgcagaaaagtgatgacaggctgtacagtttgagtgcagtggaaacgcattgcacctgatgaagtcttgcagcgcctgaacagaggcgtgaaaaacagggagtgaatgtaaccgctatcagcgggatttcttatcgctggcgaatgccggatgataaaaagcaaccgttgccctctcccgcatccggaagaaggcaacgcctgctgattaacgttttttgcggttacggtgcatgtcgatagagacggcggccacaataatcatccctttgatgatgtcctgaatgtacgcatcaacaccgacgaaggtgaatccgcttttaatcaggccaaggatcactgcgccaattaatgttccggtgatacggcccacgccacccatcaggctgctgccaccgataacggctgcagcaatggcatccagctcgtacgacatccccatgctcgactgaccgctgctgacgcgcgccgccagtactacacccgccaggccagagagcgcgcctgcaatggtgtagacgataatcagatacttattaacgttgataccggagactttcgccgaggtcatgttgccgccgatggcgtaaacatatttaccgtagcgggtatgcttcagggcgatatggaacagcagcgccaccaccaggaaaatcactaccggcatggcaccctgtccgattgaggtgaagccatcggaaaggaagctgatcggattgccctgggtgtaatactgcgccagaccacgcgccgacaccatcatgcccagcgtggcaatgaagggcggaataccggtgcgggtaatcagcacaccattgaccacgcccgccagcaaaccgacgccgataccggccgcgatagggatcaccgcaggcatattcaccagcgacggatacattggcgacaggctgtcagaggtctgcgccaggctcgcggccaccactgccgccagggcgataacggatccggaggagagatcgataccggtggtgatgatgacctgggtcacgccgacggcgataatcccgataatcgccacctgcaatacaatcaggatcagacggttggtgttgagcaggaaagactggtcacgcacgtaccagccgaacatttcaaaaattaacgcaatccccaccatcaccacgaaaatgccggtatctttcggcaatttatgacgcaggctggcaaaaaaagagggttgctgcggggctgccggggtggcagtagctttcatattgctcatagtggtctcgcgcctcactcggatgccaacgacagaatggtttcctgatcggcttcttctttatcgaggatgccggttatacgcccgccgtgcatgaccattacccggtcgctcatgccaagaatttccggcagttcagaggagaccatgatgatagccacgccacggttggcaagttcactgattaagcggtaaatctccgctttcgcgccgacgtcaatgccgcgcgtcggtttcgtccagaatcagaatcttcggttgcgccagcagccagcgggcaatcaggactttctgctgattaccgccgctgaggttattgatgatttgatccatggtcggcgttttgatgttgagacgacggatttgatccatgcagtcctgcgccatcttcacatggctgacaaacccgcttttgccgctgtactccggcatgttaacgatgctcatgttctccattaccgatagcaccagaaacaggccggactttttacggtcttcggtgaggaacgccatgcccttttcaatcgcggttgagggtgagtcgatcgtcaccggcacgccatcaatcaggatctcgccgctgtcgaagttctccatgccgaacaagctctccatcacctcgctgcgacccgcacccaccagtccggcgacgccgaggatctccccccggcgcacactgaaactgacgtcggtgaaacgatctttgcaggtgagattgcgcaccgtcagcacctcttcaccaattgcgctgttgaatttcgggaacagctgggtcagttcgcgtcccaccatctgggtaatcagcgactgacgggtatatttcgacgtctgatcgctggcgatccagttgccgtcacggaagatactgacttcgtcggtgatggtgaaaatttcatccatcttatggctgatgtagatgatcgctttgccctgctcccgcaggtcacgaatgatggtaaacagatgcgccacttcggtttctgtcagcgcggaggtgggctcatccatgatcacgatgtctgaatcccatgaaactgctttggcaatctcaaccatctgctgcgacgcgatgctaagctcgcccaccatccgatcggctttcagacggatattgaggcggttgagcagttcctgcgtcatctgattaagccgggcgtgatcgacaaagccaaatctcatcggctcgcgacccagccagatattctcggcgacggtcatgtaaggcaccaggttgagttcctggtggatcattgaaatgccggaacgcaacgcgtccatggtgtcctgaaactgcaccggctcccctttaattttgatggtcccctgatcgggacgatacatcccgatcaggcacttcattaaagtggatttgcccgcgccattttcgcccatcaaggcatgtaccgttcccggacgcacccgcaacgacacgttgtcgagggctttaacgccggggaagaacttgctgatgccttcggcttcaagcgcaaaagcgttcatacatcacctccgtacagctgggtcaggaacgactatttcaggttacgcttggtaaactgttccatgttttctttagtaatcaactggtaggggatattgatgactttctgaactttctcgccattcaccagtttgattgccgtctgcaccgcaccttcaccctggccctgcgcatcctggaataccgtggcgaccatcttgccctgcttcagcatctgcagcgcatcgggtgtgccatcgacgccagcgatcaggattttgtccgggtttttacccagtgcctgcagcgcaccgatcgccatttcatcgttgttagaagcgatggcattgatctcatcaccggcagtcatccagttactgactacgtctaccgcatcgttacgggtaaatttggcggtctgtttctgaacaattttgatgccagggaatttagccgcaacctcttccacacctttggtacggtcacgggtcgcttcattcgccaggtcacccatcaggatggcaacattgcctttgccgttcatcgctttagccagcgcttccatctgtaagcgtccggccagttccgaatctgacccgacataggccattttgccggtcagctcagcctgtggacggcggttgacaaagatcagtgggatacccgctttgctcgcctggtccataatcggttttaccgcattggtatcgaccgggttgacgatcagcgcatcaaccccctgaccgataaagttctgaacctgctgcagctgctgtgaaacgtcgccttttgcatcctcaacctgccctttaacgccatctttctgcatctctttctgcattgaggtacgcagaatggtgaggaagttgtcatcaaacagcgccatggagacgccaactgagatatcttttgccataaccgcggcaggtaacatgcaggctaacagtgaggcgacaatcgtttttttaatgttcatagggacccttcttatttgttaacttgctcagcggctgtgaccgcgaatgaaaaatatcttttacattcacccagcctgtctggcgtttgtttcgggaaatttgaggtaagacttcaggttctgactatttttgtgatcgaccactccttttcacaatcacttgatctgcaaacagttaacttcaaaatagcgtttcactttcagacgataatgacgaccgtgatgataagcagtttatttattccatataatcacgttttgaaatttttatcataaaagcactgaaacggttgttttaacatcggcaaacaacaaaactttgacatgcctctaacatctgcggagaaatgcccgcaaagtgagatcctgttggcagtttgaaaatccagcagaatcgggtaaaaatcgccaatccgctgcttttacgagcatctgaacgcaattcggtaaacagggctttgacaagcgggatctgcgccgctaatattcgccccgttcaagcgattcctctgtagttcagtcggtagaacggcggactgttaatccgtatgtcactggttcgagtccagtcagaggagccagaattagaaaagcccgctcagggaaacctgagcgggctttttgcatttatgttttcggtcacggcggcatgacatccccgcctgaatggcttacacctcaaacccgtagtgcgagccgtccggcagttccaccaccagccgcagcttaccccctgccgcatcgatatagcgcttgagcgtggagagcttcaggtcgcggcccggcttctccatgcccgccacggtaggctgtgtaatgcccagcgcctttgccatttcgacctgtgttttctgcactttctcgcgcagctcggcaaggtgaatgttgagcaggatatccgtcgccatcgcttgtgcgtcggcaacgacttccggtttttcatccgcaataagctgttcaagcgttctgcccatatggttactcctcatctttaaaactattcagccagtgtgtaaattcccgatcggcaaccggaagcatctcctgataaaaacgcttttcattgcccaccttatttccggcacaaagcacaatcgccgtttcggtttgggtcaaaagcaaagaaagcccttatcggatcgccgcgactctgaatacgcagctctttcatgttgatataaacagagccttttagcgtatccgcgtatggcctggacaaccccggccctttttcgcgcaacaccattaatgctgccagtacgcaggcgcgatcgctctcattaagcaaggtaaaccagcgatcaaacctctccgtcgttttaatcatccacacgggatctccttattaatataggtcaaatactatataggtgtaaagcgataatcgagtgtgatgcagggggatttcagatgcctgtgcttttagtgcaaagtgagagaagcgttcagccgggtcagtgatgaatccacacaaccttcatcgttttgcgagctgtaccggattggttatggggtgagatgatgtgaggcgttgttatcaataagaaagcccgctcaggcttccctgagcgggctttcactttgttcgcatcgcttccctgccaatgcagagtgacgcttttagcgcgtgattacggcagcgcgatacgggcaatctcgtcagtgcctttggtggaggaatctttgttgaattccgccttaagcgtgacatagagcgtgttgttgtccgggccaatcagcaggctgtttgggttcttgtcaaacgaccagctgtttttcaccgcgtaggtggtggcatccagttgcagcactttcttcgattcgcgctggctgatgtaaagctcattgcgtttagcgttgaacttgatgcccatcgcatcgccttcgatgcgcttgatcactttgccggtgcgctcatcaaagatcagcgtggctttgcctttggagtcgtcagtaacaaacaggcgaccggtagcaggatcttccgccatgttcaggaacagatactctttgccatcgcctgcggtccagcgcttctcgattttatggctgcgtggattgatcaccagaatttcacccgagccgttagccgcataaatgcgctcagtcagcggggaatagatgataccggtgacccatttcccggcgtttttaatctcggttttcagcttaaaggttcgggtatctacgacggagatatagcccggtttcggctacgcgaccgacataaagctcgttgccgtgccacaggacttcacgcgcacccgccggatagccctctttactgatcttgcccgggaacaccagacgctgcagcactttgccactctgggcatccactttggagatcgcgccatccagtgagttggtggtgtagaacacctgaccgttttcatcgatagcggtaccgaagtttttcatgtcggtatgcgtttcgcctttggtcgtcagcgtggccggatcgagacgatagatcatgccgccgttcacatccttaaacgcctgcgcgctggcgacaaacaacgcttttgacgcaggggagtaagccatttcgtacagaccatcacccagagcgcgttgtgtcactgcggtattaaccggttttggggcttcagcggcaggcgcatcggcttttttagctggtgcctgacacgctgtcaggctaaaggcagcggcaactgccatggcaacagcggctttgcgcgggcttaacgatttcatgctgaactccgtcaggaaataaagaatgagaatcatacgcattaacagccagtaatcaaatgacgatgctgctatccagacctgtccggtcattttacccgcgttaaaccgcttaactgccccgtgaaattccacctgaatgccctttttctgctttcaaatctgataaacaccagcaactaaaaggctttaaattttcctatcacattgaattataaataattaacataaagttacactttcgattgaatcctttgaagaatatataaagcaaatgattatcattggcgttctcataaatggctgagcgtctttctccagaagatgagtggataaaaaataacaaccaaagacacaacggtttaactcaataccaatttttaatggaaaattttatggctcgtagtggcagggaatcaggtttcagaaacagctttagcgtctcattactgacactggcgatacacgccctcttccaccccgcccaggcggcggaggagacatcgcaggatatggtggtcagcgccacgcctgacgaaaccagtgacagcggtaagcagaattacgcggtgcagaccacccgcgcgggcaccaaattaatgctgacaccgcgagatgtgcctcagtcactcagcgtggtgacgcagcagcgaatgcaggatcaggatctgcaatcggttaatgatgtgctgaccaacgccaccggtatctccaccaatcttatcgacagtgaacgctccgagtactattcacgcggcttcaaagtcagcaacttcactttcgatggcattccgacctcggttaacgatacatggaattacggcgacgcggcgtccgacacggcaatctatgaccgtattgaaatcgtgcgcggtgcgaccggcctgatgaccggagcgggcagcccttcggcctcgatcaatatggtgcgtaaacatgctgacagcaaaaccgcgaccggcacgctgagtgccagctatggcagctggaacaagcagcgctacgtggcggatctctctgccccgcttaacagcgatggcagcctgcgcggccgtgtggtgaccggttataccgatcaggagagctggctggatcgctatcaaaaaaccaaaaaattcatctatggcgtgattgatgcggaccttaccgagaagacgacgctgtcactgggctacgactatgaagatgacaacaccggcaatccaacctggggtggcctgccgatgttttacagtaacaacgccacgacacattacgaccgcagcctgaattcatcagctaactgggcgcgttacaacactaattcgcgcaaagtctttgcggatatcgaccataacttcgataacggctggaatattcatattaatggcacgcacgccgagaataccttcagcgataagctgctctatgtgatgggcaatcccgatcaggagagcggtgaaggcactaccggttacggcagtatggatcgcggcaagcgtaaaatggattcaatcgatggctttgccagcggcccgtttgaactgctgggtcgtcagcacctgttgatggccggagcaagctacagccgccagcataatgccgcctacagtcaggatggattcagcgatgcggaggcgggtgaaatcactgccgccgatatggggattttcaataatagctggaccggtaacgtagcggagccggagtggcagggctggtatctcaacgctgatgacactgttcgtcagaaatcggtctatagcgctgcacgtctgtcgctggccgatccgctgtcgctgattattggcgctcgctatacccagtggagcacccatggcagcagcgaagagatgactaaaaataacaccacgccttatgcagggctggtgtatgacattaatgacacctggtccgcctatggcagctacaccgccattttcctgccgcagacttatcgcgatactcacggcagttacctctcaccggtgacaggtaaaagttacgagaccggtctgaaatccgcctggaaacgatggcctgctgaccgccagcgtagcaattttccgcatcgagcaggataacgttggacaggcaattgatggtgtttatctgagcggcaatgagcaggcctatgacgccgccaaaggtgcagtgagtaaaggtgccgagttcgagctgaatggcgcactgaccgataatctgcagctgacctttggcgcaacccgctatgtggcacgcgatacaagtggccggttcaacagctatcagccgcaaacctcattcaagcttttcacccgttatcagttagccgcgatccccgagctcaccgttggtggcggaattaactggcagaaccgggtgtttaaagatgtgaccaatgccagcggcgacagcgtacgggtatatcagggcagctacccgctggcctcgttgtttgcccgctatcaggtgaataagcaggttgccgtacaggccaacgtcgataatctctttgaccgtgaatattacagctatatgaacagctacgtttacggtgagccacgtaacgtgaatgtcagcgtttcttatcagttctgataatggtgagctgagaggccagacagcccgcgattgcgggctgtatagtgtgctgatttaacaggcaggatgcgtgtcagggctgtccttccatattccagcgcgctgatcccatcacatcgaaaacatgctggtcggtgaaagccggaaatctggcgcgttttgccgccactttgagcgcgttgcaataatctttatcgccccctttgataataaaattatccagggtgccatcaattttgaaatccagatgggcattacagcgtttccccttccaggcgtgcggctctgatagtgcagcatccagcgctttttttatgccagatgcctgctgaccatagatatcgttgtccccgacttttcctgaacggttatagctgcaggtttcgagtgcgctttttttaatgcattcgtgtggagtgagaggcgcgcaaccggctaacagggcacagcagaaaatgggaatgatctttttcatggataagtccttttaggtgaaaagggaacggcgtcctgctccctggttattctgatatcaggctaagctaaacccctgcaaagtgaatcaacacagggttattttcccgttttttttcgccagaagagagagaaagcaatcgctgttaatacgccaatcaggggcatcgtggccgcgcccgccagaaagttgtgctggtcgatgcgtttgtccctgcggatatccgcgaagcgtgcgagtgcctgtttttcatctgaggcacgaacttcctcaaactgttttttataaccctgctctgtcagatcgaaagctcgtgttacgtccgatctttcaagtgcaacagtgtatttgcctttggtatagaacctgtattctgacattcagcgatctcacatcccagaggatagatttgcactatatcgggtatgaatgggtttgcagaacgcttttggaaaatagtgcggcacaatacaggctccagcctccctgctgagttaaccgcatctccttttccagcaaactgcatgcagtattgcggtaatatttcccgtgatgaccgtggctgttaactctcttcggttatcactttaagccccagattctcccgcagcgtggcaaactcatactcatcgcgaaacagtccgcgacggcgcagttccgggatcaccagctccacaaacagatccagctgttccggcataatggctggcatgatgttaaagccgtccgcgccgccctgctccagccactgctggaagtcgtcggcgatatcttcagcggtaccgacaatcacgcggtgtccgcgtgaaccggcggcgacggcggccagctcacgcagcgtcagattctcgcgctttgccatatcggtcatcagcttaacgcggctctgattaccttcgcccagcggaacctccggtaccgggccatccagtggatattggctgagatccatactgaaccgcagtgagagctgacgaagcccgttctcaatatccaccagcgtattcagctttttccacagcgccttcgcctcctcacgcgtgcggccaataatcggcatgacaccgggcatgatcacgacatgatccgggttacgcccggcggcaatgacctgctccttttgagtgcgatagaacgcttgcgcttcctccagactggcggaggcggtaaagatcacttccgctgtctcagccgccagcttctgaccatcagcagaagaacctgcttcgataatcaccggacgtccctgtggcgaacgcgtgatgttcagggggccttgtacctgaaaatgctcgccctgatggttgatcggtttgatcttctcatcaacaaaatagtccccggtcgctttgtcgggctgtactgcccccgcttcccagccccgccacaatttgtctgccacctcaaggaactcccgcgcacgggcatagcgggaagcgtggtcgggcatatcgctgcggctgaagttacgtgcaacgtcagtggaaaacgaggtcacgacgttccacgcggcccggccacggctgatgtgatccagtgacgagaaactgcgcgccagcgtaaagggatcgctgaaggtggtagaggcggttgcagccaggccaatacgtctggtgttgaccgccagcgccgccagcatcgtcagcggttcaaggcgtgccatggtcgacggcagacgatacatgctggttgccagtgcatcacccacaaaaaacaggtcgaacttacccgcttcggcttttttagccagcgtgatcagccagtcgatatcagtgggatcgcccagctgttccgtcagacgccagccgctcacgtgctgacccaccggttgaacaaacaggccgagccgcaggcgacgtgatggagtgaaatgattcatgaacgattcctggtctgtaaggtgtaaaggcgcgccgcagcgcgcgcttaaaaaagggtgtccgtcgccagcagcgcctgctccagcgcgcgggcggagacgctaaacggcagccgtttctgcgcaagcctgggggaatttaatctgctgcgcgaggttgcgcagcgcgctatggcgatcgccgcgtaacaccggcagcttcagcggcatatcgtagtgacgcagcagcgcaaggagttctgcatccgcgacaccgtcatgttccatcagcgactgcaccagcaggctgaagccgactttctcaccgtgcagccagtgatgcagctccggcaggtgcgtcagtcgattgtgaatggcgtgcgcaaagcccggcgtcggcagcaggtcgcgcacactgttcgccagcccggcgagcacgatagtggcatcaatgactctgaccagttcaggcgtgacccgctgctgctggcaggccaggatcgcggcgtctccctgctgccgaaaagtgtccagcgcctgccgcgcggtcatcaccttaagatccaaagccagatcatcagggttgtgctgctgataaggccggaattcataatatttggccagcgcatccacaatacccgctttcaggtagcgcacgtcgctccgggcgattacttcactgtccaccagcaccagctccggcattttccccagcggctggctgcgcagatggccgccttgctcgttatagatgatggcaatcggtgaccaggccgcgcaggttgccgcctgggtcgcaaagttaaccagcgtgaccgtcggcaactggctggcagcggctttagccgcatccagcacgcgtccacccccaatcgccagcagcagttctgcgccctgctgttcggtatggtgttttaagctggcgatggcctgttcggtacattcgccctctaaatagtcgagctgccagcggatgccattttcttcaagactctggcttaattccggattaaccgcctgccacgcctgaggagaggtaaaaatacgaatatgggtggcatagggtttaataaactgaccggcgcggatgcgcaggcccgcctcatgcgcataggctcgcggagatgtaatggctaacacagcagcatcctgattatataaaatagaaaaagacttttattacaatgagttaatagtgtctcatggaatttaatttcttttctgaatactacgacaaataacaatttaagcaatcaaaaaccggccatttcatattcacaaatccgcattaggttagttatttttcacacatagcgacccggcttttactgttaatctctcattctggctgaatgaattaactgcctgcctggcagttttccgggaaatattatgcaactcgattttcgtcaggtcagagaagatgaggtagatgtttatctggcactgatgcatgccgcctatgcacccgttaaagcactgggcattaaatttgatgccgccacggctgaccgcgctacagcattacgccatctgcagaatcatggtgtgtatgcgctctacatgcgtaaccagatggtttcatcagtgaccgttcgctatccctgggggccgctgcccggcccgtttgggctgccgcatatcggctggtttggcgcgcatcccgactatcccggccaccattttggtcgccaggttcaggatcggttagagcaggaaatcctgatcgatcagttgcatgcccctgcggtctcgctgggcaccgccacccatcacccctggctgaaagagatgtatctgaaacgtggcttccagccgatgcatacccgcgatctcggtaaaggtcacatcaccctctatatgaaaaaagtactggacccggcggcacatgatgcctggctgagccgccagacagcagcagaaggaaacccgctatgagcagcgataatcccgcatcactgggcgaacagccgatcgcgtttcgccacgaactacaccgttttccggagcgaccgcaatgaacctgagcgtaatgctggctgaacatatcctttatggtcagccggatgagtcagcgcaccagcacgcgcgtgaaggtgtgcgggacttcctggcggtgagctggccggtgttacagggcgaggtgccggatagcggcttaccggcactgcgcacaatctaccgcgacggcagcgtgcgctcgcaggcgctgctgctgggctatgccggacatgcgctggactacgatgattttcatgccgattttcgcggtcaccccagcgtagtgatcctgcccgccctgctcgcctggcagcaatatcagccaaagcgcctgaaccgttttctggatgcttacgtcacaggtgtggaaatggctggtcgtctgggactggctgtcagccagcaacattacgcgctgggctatcacaacacggcaacgctgggcaccctggcagcggcggcggcactggcgcgtttgctggcgctggagagtgatgcaaccgcgaccctgctggggatcgctgccacccaggccagcgggctacgcgcgcagtttggttcggcggtgaaaccactgcacgctggttttgccgcagaaacgtgcggtgtcagcggctctgctgacactggccggaatagatggccgtcaggcgggtgtgattgaggcttttctggcagccagcagttcgggtcaggcgcagccggagaaattgctggaaaactggggccgcccctggcggattagcgcgcccggactggagttcaaacctttcccaacctgcgcaggcacccacagcgcagcggaagcggcacaaatgctgcgccagcagtggctggcagccggcaaacctcttgatgcgctgctgagccagattgtcgatatcaccgtcgccttcccgccaggcggtgacatcgccgcttccatatccgttccgacgcacggcattgaagcgcgtttcagcctggaatatgtgattgctgcgatgctgatctacggcgatctgcgtttgcaggatttcgccgaaggcgatctcaatcatcagattatgccgctggccgcccgcgtccgtcgtactcccgataacagcgcgccgcccgatgcgattaatcccgccctgcgcttccatgacgtcacgctgacgctgagtgatagcacaaagctgcatcagcgccgcacgcgccagcagtcactggcagagagtgtggatgtaaacaggaaactgcagctggcgctgaaggcgtcatcgcccgatctgctggcagccagtgagctgcgttcaacggcagatttgcaggcgctgggccgcgcagtgctgagcgccctgtaaccgactcataacgggggaataaaggcctgcaccggcgtaacttccccggcaaatttacgcacctgcaccaccgtaatctgcccgctacatccctgcgccagagatgacgtcccgatatccagcgtcagcacattgggattaccgtgacgacaaagcggacgggcggcagtggcgtcgaccggatcgtaccaggcaccggttggcagctgtaccacgccaggcataaccgtgtcggtgagacgtgcgctggcgagcacatggccccgatcgttataaagctcaatgatgtcgccatccgcgatagcccgggctgcggcatcctcgctgttgaggctacagacttcgcgcccgccacgcttgccactctgactgaaatcaccaaaatcgagctgactgtgcaggcgcgtcgcgggctgattggcaatcagccagaatgggtagtcggcgctgggtttttgctggggttcacgccataccggatggccgggacagttgtcataaccaaagctggcgatagtggcggagaagatctcaattttgccgcctgctgtgggcagcggtgcagcatcagggtcagcgcgaaacgcattgatcatccgtccaccatccttcacctgcggcaacgccaggatgccctgctgccagaactgattgaaatccggtgtctgcacctgatgcgccgccagtttttcctgtagctgatggtaaagatgctgcaaccagcctcgcgcatcgcgcccttcgctaaacgcttcctcccggccaagttgccgggccagatcacggaaaatcgtgtaatcgtccctggcttcggcgtaaggctgtgccactggctgcatggcgattaaatggcgatcggtcggcgcaccgccgatatcctctcgctccagggtcatggtggcgggcaggacgatatcagcatgacgcgcactggcggtccagacgctctcatgcacgatgaacgtatccagctggcaaaacgcctgacgcagccgggccagatcctgatggtggtgaaacggattgccgcccgcccagtaagccagccggatatgaggataagtaagctgacggccattgtagtcaaacctggtgccgggattgagcagcatatcggcaatacgggctaccggaataaagcggtcgataccatttttaccctgcgacagggacggaaaactgaccagattgtgatgtttgccataatggcccagcgcacccagtgcataggtatagccgccgccgggcagcccgggctgtccgagtgccgccgccagcaccaggccaagccacaccggttgttcgccatgctcggcgcgttgtaaggcatgggcgaccgtaaccagtacgcgcttgccgtgcagctgtcgggcgaactgcctgatcaggtcgctgctgacgccacagatcgcggccgcccacggcgcgtcacgcaccacgccatcctcttcaccccggatgtaggccaccatctgaggccagccgacacagtagcgcgccagaaatgcctcatcggttaacccttcggtgattaataccgccagcaggccgagtataaacgccgcatccgttccgggtcgcagcgccagccactcaccctgtgcttcctctggcaaatcgcttttcagtgggcttaccgagataaaacgggtgccgcgctgtgccgcacgctgcataaaaccgcgctcggtatgctcactcaggccgccgctggccacctgggcatttttcagcgccagcccgccaaacgccagcaccacctcgctgtgaccggcaatctcttcccagctcacgccacgccgggcgacttcattcatgtcgcccacaatatgcggcagcaaaaccgatgccgcgccggagctatagctgttaactgagcgaacatagccgcccagcgtggtgttcaggaaacggtgcacctgactttgggcgtgatggaaacggcctgcgcttgaccagccgtaagatccgccaaaaatccccgccgggccgtaagcttcaccgacccgcttaagctcctgtgcaacccgatgactggcttcctcccagctaaccgcgacatattcatctgccccgcgacgccgatccgggccaggcccgttttccagccagccacgccgtatcatcggccgtgcgacgcgtgccgggtgattaagtgaatgacggaagttttgcaacagcggactggggtcgggatcgcccccgaacggctcaataagcagttgatcgccgctgcgctcagcgtgaaaagcgccccagtgggcgctgtgcattaccggtttttgcgtcatcctgcttcctggttatcacaaaagaaacggtgctcagagcaccgttgcgataaagtttctgacgcgtccgttgtccggatcgtcgagtacctgctgcgtcgggccagccgctacaattttgccgctctccataaagacgatgttatcggcgacctcgcgggcaaatccgatttcatgggtgacaaccaccatggtgataccggaatgcgccagctgtttaatgacctgcagcacttcccccaccagttcagggtcaagcgccgaggtcggttcatcaaacagcataacgccaggatccatcgccagtgcgcgggcaatcgcaacgcgctgctgctgaccaccggaaaggttttgcggccactcatcttcgcgaccagacagccccacctgtttcagcagcgccagtgctttgctggtcgcctgatggcgactctgctttttcacccgcatcggcgcatccgtgatgttctgcaacacggtacggtgcgggaacaggttaaattgctgaaacaccatgccgatttccgcccgctggcgtgcaatggcactgctgttgagttcgtgcagcgcctggcctttttgtcggtatcccaccatctggccgccgatacggatggtgccaccatccagcttctcaaggtgattaatgcagcgcagcagcgtggatttaccggagccggatggccccagaatcaccgtgaccgacccggcaggtatatccaggttaacgtcgtcgaggatggttacgccagagaagcgcttggtgaccctgcgcagtgcaattgcttcagccattgctcacactcctttgcgttttcggcagcgaaaagcgcggcaacgacggccagaggctgcgcttttcacgccgcgtgacaccgcggccaaaataacgctccacgtaatactggcccaccgacagcactgaggtcatcagcagataccacagggtggcgaccagcagcagcgggatcacttcataggtgcgctgatagataatctgcgccgaaaacagcacatcctgcagagaaatcactgacaccactgccgtggttttcaactggccaatgatctcgttacccgctggcggcataatggcgcgcatcgcctgcggtaaaacggtatgacggaaaatctgagccgggcgatatccaagcgcgcgtgccgcttcaatctgcccattacccacgctctggatacccgcgcgcacaatttctgcggcataggcggactgatgcatgaccagcgcgatcactgccgcactaaacgggctaaccagcgcgttggactgagcactccagatctcacctaaaccgggaatcgacagcgctattctgggatagagcgccgcgatgttgtaccagagaaacagctgcaccagcatcggcacgccacggaaaaaccaggtgtaggcccagctcaccgcaaccagaaccggatttgatgagagacgcatcagcgccagcaccgtgccgaaggcaaagcccagcaccactgaaatggcggtgagctgcagcgtcattaacaccccctgcagaatggagggcgcagtgaagttttctgcgatgatcccccactcaaagcgcggattgttaatcatcgaatgtgccatcgccaccacgcacaacagcaccaccagcgcactcagccagcgtccgtagtagcgtttactgacgattttcagatcgtcagtgtggttctgaatctcactcatttaaaaatctcttcgttgcgtcgggcttcggtcacagcaccaaatccgattccccagttatcgaggattttccggtagctgccatctttgattaaggagttcagcgcggcctgcacggcaggttcaagcggagaagcttttgggaaagcgacagagaccggtgcatcgttaacggtgatttcgccgctcatggtcagcggtttgattaccttaacctgccacagcagcccctcatagggacccaggaaacagcggtacgcgaccgctgaccaccgcctgcacgccagccggacgatccgggaatatcgctaccttgatgggctgcttacctgcagcctcacaggctttactggcttcttccagccgcgtaacctgggtggtaccggaaccggcgccgacctctttgccgcagacgtcactgagtgatttaaacggggcgatactggcgtcttttcgggaaataattcccagcaggctggcgttgtagtagccgacaaagtcgatctgtttcaggcgggtcggtgtggcgttgatgttcgacagcgccacatcgtaacgtccggttttcagaccgggaatgatgttgtcgaagccgcccgtgtcgcgccactctaccgcgatacccagacgttcacccaccgcattcatgatgtcgatttcgcgaccggccagcgtcttattatcttctttataaaaggtagttggcggcgtattcgggtttgttcctgccacaatgtagccacgcttgaggatatccgcaggaatcagcgttttcagcgccggatcggctttaacatgtatgctgctgtcagcaggcactgagggttctgccgcaaagctgacggatgcgttgagcacgagtgtgaaaagggtcattctttttatcaatttcaccggaacctttctcctgatatttaaaatgttcccccagagggaaaagcgatcgtgacctgttgtcagcgctgaaagaaagccagataagcggcgggctccagagcttttatcatcctcgtaacgttctgttgtcattctcagtgaagaccggcggcgatcacaaatgctaaaaccgggaatattttgctggaatatggcaatggcgcgcgttgcgaggctgttgaacaggcgctggcatcctgtgaccgaagagatgagcagtttggtaaggattggcgaggcgagaaaacgtcatactgcggttaattaattggcacagccaggctctgatgattaataaaaatataatttcattgataagtatttattgaaaaatcatccctctgcgcctgaccgattcttttatccgggacttatttgatcaaaatcaataactatttattcaggtaatgtaaagactgcagcaggcacgggaatcataattttaatcaaaattatcaatacattacacgaagtaaatcaaagattagcaggcagatagtttcccttgagaataatgaaagcctcattaatcagatcattgagtaagcataaataatattaaagattagtctggcgctgacgataagaagattatctttgaattatttaacagcctcttctctgcttctgatatctcactaaaggtgaaccttatgggccttgctcaacgcatctccgatattaaaattgggaaaaaactgggcgtcggttttatcgtcgtcattgctgcctccctcgccattacttttatcgctttcgattgttttcgcagtattaaagacaactccgcccggcgcacgattaccgtggagatggtaaacacgttaagcaaggcacgccttaaccgcaccctctaccagtacaccaaagatcccaaatttgccacgcagaaacgttcaggccctgaaggagttagatgccctttataaacggctggatggattcaaatgggatgagatgggccagcagaaagtcgcgctgatggggcagttacttaacgattatcagaatcagcgccagacattcgtgacggctgcgcaggcgacaagcagcgcctttgatgccattaaaccgggtgccctgattgcgcttgcgcatcagtttgaatcactcgatatggctctgacacccgatgcggcgctgccggtcatgcacctggccgcagcgctgtttgatgcggccaatgttgaaaaagcgtttctcgataagccgtctgaggccagcagagaggcgattcttgaagaatacaccgctatcaacaccctgagcgagcaactggatattttcgcccagccgaatattaatgacgtaacgcgaaatgtgctcagcactctgacgcagcaacgccaggctttaacgcgctatgtcgatgcgacagagaaagaaaagagcgaatcggcgggcctgaccaccaccgcagagcggctcaatgcggtggtctccgatacctttgcctatcagtcccagctatcctctgaatttatcaaacaggcggagtggcgcattgcttttgccgcgctgatttgtgtggtgctgagtctgctgattgcctggcggatcacccgcaacattacgctgccattgaaagagacgctgaacgcagcgcaacgtattgccagcggtgatttaacaacctcactgaaaaccacacgtggtgatgagttaggtcagctgatgcaggcggtagatgcaatgaacatcagcctgcagaatatcatcaccaacgtgcgtgatggcgtcagcagcgtggcgcgtgcctcggcggaaatcgcggcaggtaataccgatctttcatcccgcacagaacagcagtctgccgcagtggttcagaccgcggccagcatggaagagctctcttcaacggtgaaacagaatgcggagaacgctcaccatgcgagtcagctagcgacagacgcgtcagtgaatgccggacgtggtggcgagattatccgtgacgttatcgaaaccatgaacaacatcagccagagttcgggcaaaatcggcgagatcattcacgtcatcaacagcatctctttccagaccaatattctggcccttaacgccgccgtcgaagcggcacgagccggagagcagggtcgcggatttgcggtggttgccggtgaagtcagaaatctggcccagcgcagttcactggccgccaaagagattgaaacgctgatacgcgagtcacttgatcgggttcatgatggttctgagtttgtggaacgcgccggtaccaccatggatgacatcgtccgctctgtcagtcaggttaaagacattatgggtgaaattgctgccgcctctgacgagcaaaaccgcggcatttctcagatcgccacggcaatggccgagatggataccacgacgcaacagaaacgccgcgctggttgaagagtcctccgccgcagccagctcactggaatctcaggcagatgaactggaaaaaacagtggccgtattccgtctctctcccggacagagcagtgtcagccggggcgcacctgccctgtcgccgcgtttagtgcccgctgtgcccgttaatgcatcagcagactcaagctgggaaagcttttaacggttagcgaagcgttaattctgtctgaccgtaaatagagccagccttaattgattgaggctggctgaaataacagccctcttcagacaaataagtgatttgattaatcagaagataataagccgcaacggttaacgcgggaatgacagggtcaggcgagcatccggaaactgagggaaggtcatattatcggccatgacagttgaaacaagctggctcgtgcctgatgattccggtttatattccggctggctttgaaatgagggtagataagaatcgcgatcggtctgtacagaaagtgatggagagagagttgtcgtccctgacagcttctccggccggtctacgctttcgcgcaaccgatgaggtcatccgcttcgtcgttttccggccggagccggactacgtccattggcatcagttccgttactgctagttcagctcttcgttcaggcttgcaagcgtctgcaggtacggcacctgctgttgagcaatcgccggtgactcaaaactactcagccagcttctggcttcggcgattttcgtcagccgatccgcgttgctttcagatttcgccatataacccagttgggtaaagagtgttgcgatactgatttctttttcacccagggcaaggcttagtgccgcttcgccaataatgacgtggcctttctcgtcgttttgaaataacacagaaaatcctccattagatacgaattgatgacaacctcaccagagactgtagtcgtaaaagagagaactgcccgaatttatcactaaaaatcgcgcaacttgctgaacaaatgttcttaatgttttttttccggattgttctgtttgtctctgccgcccttcctgtcagacttgcttttaaattcacgatgggatgtcaccatgaaactttccattctccttacgctgctggctgcgacggtctgctccgtttttgctgcccatggcaaatttgaaacgcagcaggctggccagtcactcttcacgcaaagcggggaaacgatcagcgaagaataatggctgcgcgcagcatcgtcagtgaccggccaatcggttatgatccgttgccatttacctgccggttgcccgatgtctgccattatcgatacgtttatcgccccgccctgctttgatgagataaccctcctctttcaggacgaccatctgctggtgatcaataaacccagcggcttgctgagcctgtcaggcaaaaatccgcaaaacctcgattcggtgcatcatcggctggtgaagctttttcctggctgcacgctggttcatcggctcgattttggcacctccgggctgatggtcgtcgcacgcagcaaaacgattaacgcggcactctgccagcaattcagccagcgcagcgtgcgtaaaacttatcaggcgctgctgtgcgggcaccttgccgatgacgaaggcgttattgatgccgcgatagcgaaagatccggcgcagtttccccggatggtgatttgcccgatccaggggaaacctgcgcgctcacgctaccgggtcatagaaacgcggttattatcaggaaaaaaagggaaagggattgccggtcacgcgggttgaactgatgccggaaaccgggcgcacccatcagctgcgcattcactgtcagcagctggggcacccgattctgggctgtgatctctacggcgggcttttgctgcctggcgcagatcaggcagagagactgatgctgcacgccagcggattgacgtttgttcatcctgtcagcggcagcacgctgcaactctctgccgacagcccgttctgaatgcgtcagcgcgctgttaccacatcaaatcatcgggcactttgaaatcagcataaggatcatcttcgtcctgtgcttcttcgcttaatgcactgtttaatacgatggcactggcatcacgctgcgcaattttatccgctacgctggcggggatgatagcgtactggctctcgccattattgtcagccgccaggcgggcaatggcgagacgcccattgatcagctgagtctgcgtcagcttatccaccataatctttttgatcaggttattgtcggtgaaattgaagctgatgttgcctcttgccacgtcaattttgttcatttcgatcagctgtttgacctgcgctttgtactctttagacagcacagccagcttctgctgctcgttcagctgcttatcccgctcaagctgcgcttttttgttatcttccaccgccgctctggcttcgcgtgcctgaaccctggatttcttcgctgtccgctgaaccttgtccatttttttgctggatactaatcccgctttcagcatctgctcttgcaaggtgagttttgtcattgtcgtctctgaacctgtgaaataatgtccgggattatacctgtaatcatccgggctgtaccaggttgccgcacctgccacgcccgcgattgcgggcagcctctcaacactgtgctaacattccccggtcaaaatcaccttattgagcaccatgtcagagctaacaaaacgtaaaaatgaccctgaagggctgaaaaaacgcatcatcgcaggcgcactgaaaaccttcgcggagtttggtatgcagggtgccaggctggagcagattgctgagcatgcgcaaaccactaaacgcatggtggtctatcactttggcagtaaagagcagctttatatccacgtgctggagcaggtttatcagcagatacgtcagcatgaaaccggcctgaacctggcggcgatggagccggaaactggccatgacccgcctggtggaagccagttttgattaccatgtcgagcatcccgattttatccggctggtctgcagtgagaacctgttgcgcgggcgctacatcacccagtcgccgcagattaaagcccttaatcgcagcgcgctggatttgctggatgacattctggcacgcggtcagcaacagggcgtgttcactgccgatgtgcagaccatcgatgtccatcgcctgatcagcagtatctgcgttcatcacgtctcaaaccgctacaccttcaacgcccttttcagcccggacaacagcgaagcagagagtatccgccgcaatcgtcagctggctgtaaccgcaacgttacgctatatccgcaaataattgcccgcaggccgggctgcgcttagccatagtctacgcttactgatacttgtcactaaaatgcaataataaggaatgctgttgtgagcagagatgcacgcctctatccgcttcgtcagacccatgttgaacccgatgatgatgcgctgtggaactgggcgcagaacgcgcaaatcggcagccgtcaccaggttcagcgtcccgccagtgaagcggaattacagagacttatccgggagtcacacggccagattcgggtgatcggcagcaagctgtcgcctggtcgtatgctgcatgtcagtgatgacgatgtgctgctcgatctcagcgccctgagcggccagcttgccagtgatgaacagagcgtgacctttggtggcgcgaccccgcttgagcaggtctatcgcagcctgaccgaaatgaaccgcatgctggcttcatcgccaggcgtgattgcgattcagacactggcgggcgcgatggcgaccggaacgcacggccagggattgcagcagagttcgattgccgacgaagcgctggcaatcagaatggtgctggccgatggcagcgtgcgcgaatttgttcgtggcgacgctgacttcccggcagcgcaggtctcactgggcgcactaggcattgttaccgcggtaaccctgcgtacccagccgtttagcatcttcacctgccacaaatatgccgtctctgccgatacccttgaagaggatctgctgcgctggaacaacgactatccgctgagcaaagcctggtggtttgtcgatgacaacctgatgcacgtctggaacgcccatgaggcgagtgacgaagagcgtcagcgctacgaagcgcagggtcgtcaggtggtggaacatgagggcgatgttgacgaaagcctcaacgacaccatcgaccagacgctggcgcatatgcaccgcgatacgcagattgagggcaaagggggaaaacagtttcgcaccgtcacccgttttcgtgatttcaccgatgttaccggtgacatttaccagctcttctgccgcggcattgcggtgccgcagatcaatgtggaaatcggcgtgccgctggcaaaaaccccggccatcattcgccgcatcaagcagtggtatgccgagaaccgtccgcatatgcactacccgattatcctgcgctgcaccggtgcatcatcggcctggctcagtccggccgctgaccagccaacctgctttttcggcttcgtggtctattacgccgacgatggttcgctgtcacaggaaggcctgcacttcctgactgaagtggaaaaactgctggccgaagagggcggacgcccgcactggggcaaatattacgatgaagaaacgctacaactggcgtgagatctatccgcagtgggacgccttccgcgccctgcgcagccagctcgacccacagggccgactgggtaacgactacatcacgccactttttgactgattgaggaaagttatgtttgcctgggtaacgctgttaactcaacccgattatctggtgggcgtgaaagcgctgcaccgttcgctgcaacagagccacagccagtggccgctggtggtgatgaccacgccggcgatttcagcgtctgactgtcagattttgcaggatgagggctgtgtgattaaaccggtcgaccccctctatccgcgcgatgatctggatcagcactatgcatcggcgcagttcggcgaagtctggaccaagctgcgcgcctggcagctcaccgattatgagcgcgtcgtgtttctggatgccgatatgctggtccttcaaaacatggatgagctttttaccctggatctgggcgataacccgctcgccgcctgtcacgcctgccgctgtaatcccaaccagattgcctcttatccggcagagtggcagcctgagcagtgccactatacctggcaggcgcgcggtgaaaaggcgccagagagtgtggatctttacctgaacggcggttttctggtgctgaagcccgataatgcgatgttcgacgcactggaaaagcgtattgtcgccattgatgatctcagtaactatcccttctccgagcaggatctgctgaacgaagtgtttgccgatcgctggaagccgctctcttacatctacaatgccttgaaaacgctgccgtttcagcacagcggtctctggcacgatgaagaggtgaagaacctgcactatattctggcaaaaccgtggaaacgcgatctcggccagcccgagagtcagcgcgatcgcttttatgcgctggataagttgtggtgggaaaaaagcggtctgatctgatcggctatgggcgggaagccaacgtttcccgccctgcccgccagtgttaatcaacacatcggcaataccctctatccctctgattctgcctatacctcaatccagcggcgttgcactgctgagtcagcaatcgcttccagcaccttctgaacctgcaatccctctgcaaaatcgggccacatgcggtcgcccgctgcgatgccgttgatcaggtcgcgaatctccaccgttttctgatcgttaaagccgatgccgtgtccggcagaaacacagaaatttgcgtagtcagggtgcgctggtccggtcagaatagttttaaatccctgacgcccggccggtttcgtcatgcagataaagctccagctccgccatgcgctcctgggtgtagcgcagtgtgcctttggtgccggtgacaacgtaagtcagtcccatctttgcgccacaggcgatgcgtgaggtttcaatcacgccgtgcgcaccgttatggaagcgaagcagcgcgctggcctgatcttcgttttcgaccggtaactgccgcgaaggctctttcgggtcaggccttgaggcgatcaccgtcatcatgtcgccgctgacctcagcaatgtcaccaaccaggtagtgcgccatattaacgatatgcgccgccagatcgcccagcgcaccgagacctgccagcgctttctgacagtgccagtcgagcggcgtttccggtctggcgagataatcctcgttatgggtgccgtagaaatgcaccacgtcgcctatctcaccattggcaatgatctctttcgccagctggctggtagggtttttcatatagttgaagcctaccagcgttttaacccctgccgcatcggctgccgccaccatctcctgcgcatccgccacgcttaatgacagcggcttttctgaataaacgtgtttgccatggcgtatcgcctccagcgccatctctttatgcaggaagttgggggcgcagatatccacgacatcaatcgccgggtcgctgaccagcgcgcgccagtcacccgtcgagcgcgcgaaaccaaaggtcgccgcctgacgggcggccagctcggggttcacttcagccagcatctcccgcacgatttcgcctttcagcgcaaatacggtgggagcctgcgcatatgcaatcgcgtggcagcgtccgatatagccgctgccaatcatgccgattctgactttgttcatttcaactccagagattcagttcagggttgaaatggaatctacgtttcgtttttattgctgacaaagccagaatccacactttgtgatgcccgtaaaaaactatccggttaaatcacgcgcctggccgcctgacaagggctatacagcgccataacacctcataaatacctcagttttacacgtgccgttttgccggatgagtcagccgcacaggccgctctttcagtgcttaaaacgccatagtggcgactatttcagcagtcgcgctgatttatgaaaaagagctttgacatggcccggcgtggccgttactatgcgccccgttcaaacgattcctctgtagttcagtcggtagaacggcggactgttaatccgtatgtcactggttcgagtccagtcagaggagccaaattagaaaagcctgcttaggaaactaagcgggctttttgcttttcatacttctgataaaattttgcgtcttactcagtctgtttcctcttcaaattccccgttcttttcgttagtgcctgatacttagacattcggtgccgccctcacttaaaggttcatttctgacccctacatctcatactctttttaacaaatgcattaatagtgacttaaagtgtcataaatgacctttcatccgcatatttcacagtctggctgtaagctgagaagatgatgccggtaaatagttcaaaaatgacccttttagtactatagtcggaccatatcgtttcaaaaacgtactgaaattgcagaaaaggtcaaaaatgaaccttgatgagattaaatcttcgctactaagcctttctgagtcagatcggcaaaaggtattggcggggttagctttgagtagagaaaccacaacagaagcaataaatgcggacaaaccggacacccgatcggagctgagtgatctgacgtttccgacactgccacaactactggccaatgaactcaaacgacaaaacatcacctatgaagagatggcgattcagattggtgtatcactctcaacatttaaacgactgattgctaaaccatcttctgcaaaggcaataaatcttcacgccttgcttaaagaactgggtataaaagtatggctcgaaaaatagaggtgtggctttacaacacgctggcaggaacgctgagtgaagggcaaagcggttatactttctgctacctgcccacttatgtcggctgtgcgatatctctcagcatgccggtaagacctgagccctatttaagtgaagagctacatcccttctttaaaggtttagcgccggaaggctggttgcgaaaacgctattctgaaattcaaaaaattgatgataaagatctgttcggcttactgatggaaaatggcaacgatttgcttggggcagtcgtctttaaagagataacatcatgaattcagaacgctgcctgatcacattaaaacggcttaaagaatctgagctaaaaaccggctactcaacaaaaggcatccggcatctgctgggtagtctgaatgtggctcttagcctgccgtttacgcgcagtcagtttattcaggaactccctgaacgtcagaaaggcatgagcatttcaggctatcaacccaaactgtcgcttcgcctggaaaagggagaactggtggtcgtcagcaatgatggcacctatatcctgaaaccctctccggaagaatatccacacctggcagaaaacgagcatgccactatgtgcgttatgcagcgtctgaaatttgacgtacccccgttcgggctgatgccattcagacacgatgaaaatcggccagaagaactggcgtttgtcattaaaaggtatgaccggacagcgtcagataacacgagattacatcaggaacagctggatggcgcgatgggtctcggcgataaatatggcaggattgataatcataaagccatcagttatgagaaagccgctaaattcctgaataccagagtgaacagcagcttaaagagtaaacgtgacctctttttgcgcatcgtgtatgcctatgtgctgggaaacaatgattttcatctgcgcaatatcgggattatcctgcctccgcagggttcaccctggctggccccggtttatgactttatcagcgttgtgccctaccctgcagcgtttggagagtatttagctttgcccctgctggaaacgtgaagaaaatgatgcaggaaacgcaccggggatgaattcagagtacggagaatatctgggtgcagactttatcctgcttgcccagggtatggatattaatccgacactggcacgaaaatggctttccgaggtggtgagtcatcatcagcttattatcgatacttataatgaaagtcatatgcctgaatcgcagcgggaagccgtacttgactacgtggccagaagaatcacgttactggcagtgaccaaaatttaaatgatgccattaacctgttgtacctgggttgtaaaaggatagttaagcggtcgaataactcacctgctctcataaaaaaacccgctaatatcagcgggtttcaggttttacaacgtcaacagcaatcagagttcaaaccgatccagattcatcactttggtccaggcggcaacaaagtctttgacgaatttttcacgggcgtcgctgctggcgtagacttccgccgaggcgcgtaacaccgcattggagccaaacaccagatcggcgcgcgtggcggtgaaacgggtttcgccagtgacgcgatcccgtccaataaatttctcattggtcgaatcggcggctttccactcggtgcgcatatccagcagattcacgaagaagtctgtgttcagcgtccctgtgtggtgcgtgaagatgccgtgctggctgccatcaaagttagcacccagcgcacgcattccgccaaccagcaccgttaactccggcacggtcagagtcagctgctgcgctttatcgatcagcagattttcggtggtggttttgccgaagccagtaccgtagttacggaaaccatctgcacgcggtttcagcagatcgaatgactcgatatcagtctgatcctgacgcgcatcaacacggcccggagtaaatggcacctcaatttcaacgccagctgctttcgccgcctgctcaacgccgaccacacccgccagcacgatcacatctgccagtgaagccttgtgcgcttcacgctgcaccgcttccagcgttggcagcacgcgtgctgcgacggcattgacatcccactcacgctgcggcagcaacgccaggcgggcaccgttggcaccaccacgtttgtcgccgccacggaaggttgatgccgaagcccaggcaaccgaaaccagctcgctgacgctgaggccggttgcagcgattttctctttcagctgcgcgatatccgccacggttggatgataaaccggtgcaggcagcggatcctgccagatcagatcttcctgcgggacttcaggtccgatgtagcgcgcttttggccccatatcacggtgagtcagtttaaaccaggcacgggcaaaggcttcgttgaacgcctgcggatcgttgtggaaacgacgcgaaatcttttcaaactccgggtcaaatcgcagcgtcagatcggtcaccagcatggtcggcttgtgtttcttcgcggcgtcaaacgcatccgggataatatccggggcatcagctgccacgaaactggatggcaccggccgggctgcgcgtctgaacccactcatatttgaacaggttctcgaagaagtagttactccactgggttggcgtctgagaccagattacttccagaccggaggtaatcgcatctgcgccaacgcccgtgccgtggctgttgacccagcccaggccctgcgcctcaatcggtgcagtttccggatcgacaccgacgtggctggccggtgcggcaccgtgggttttacccagcgtatgtccaccagcaatcaatgccacgatctcttcgtcgttcatgcccatgttgccgaaagtggcgcgaatagccggggccgcagaggcaggatcgccgctgtgttccggaccttccgggttcacgtagatcagacccatttcggtagcgcccagtggcgactgcgccagggattccgggtgacggtgttccagccaggcggcttcttcgccccagttcacatccatatccggttcccagacatcttcacgtccggcaccaaagccaaaggtacggaatccggagttttccagcgcgacgttgcccgccagaatgtagaggtcggcccaggagatcttctgaccatacttctgtttaaccggccacagtaagcggcgcgctttatccagactgacgttgtctggccaggagtttaggggtgcgaagcgttgctgaccacgacctgaaccaccgcgtccgtccacggagcgataggttccggcgctgtgccaggccatacgaataaacaggccgatgtagctgccccagtcagcgggccaccaggcttgtgactcggtgagcaaccctttgatgtcagctttcagcgccgagtaatctaatttggcaaattctttacggtaatcgaaggattcatcaagcgggttcgaacgggatgagtgctgattcagcaggtcaacccggagttgattaggccaccagtcgcggttggttgttccgccgcccggcgcctgattttcctgagaaggcttaccagcatgaaaaggacatttgccctcgggcgcttcgcgatcggcttcgacaataggctttgcatcttttgcatcttcatcaatggaattgctcatggtcacacctcttttttgtattttcatcgctactctatagaggattttcaggatcgcacacctgtctcatcctatctgtttgatagcttttacctttttatacaccttcttcaaaagcttaaaacaatgaattgacggttgctgccaggctgcagagagcagcgaagcggcaaccgtcaccctgagactattccgacagcgccggtttcacaactgccgttttgctgcccggcaggcggatgcggaaccagatagcgtacattgcgggcaggaaaaccagcgtgatcagggtgccgcccagcgtgccaccaatcagggtataggccagcgttccccagaacaccgagtgggtcagtggaataaacgccagaatcgccgccattgccgtcagcagcaccggacgggcacgctgcactgtcgcttcgaccactgcatcaaagggtgccagaccctcctgttcattgtggtggatctgccctatcagaatcagcgtgttacgcatcaggatgcccgacagggcaatcagcccgaccagtgcattaataccaaaaggctgactgaacagcagcagcgtcggcacgacgccaatcagcccgaggggcgcagtcagaaagaccatgatcatcgccgacagagaacgcacctgcagaatgatgatcagcagagtgatcgcaatcatgatcgggaacagcggggccatcgcctgggtcgctttaccggactcctctattgaaccggccagttcaatgcggtagcccgcgggcagcgtcgcgatgatcggttgcagggctttgttcagcgccgtcgagacgtcaggcggctccagggaatcggcgatatcaccccgaacggtgatggtcggcgtgcggtcgcgccgccgcagcacgggatcttccattttcacctgcacatcaccaatctgcgataaggggatacgctgaccggcggcgcccaccagcgtgaagtcggcgattttagccggatcgagccgggtttctccggccgcacgccctatcacctggaccgcgcggatatcttcccgcacggtagtgacaggcacgcccgacagcagaaactgtaattgccgggcgacgtcactggatgtcagccccacagcctgcagccggttctgatccagtgaaaaatgcagcgtcggcacgggggcgccccagtcggtgttcaccgtcctcatcatcgggctggcccgcaggaccgcttccacccgatcggcaatcgcgcgcaggcgggccggatcgggccccatcacccgccacgccaccggataaggggagtatgggccaaacaccagctgcgtcacacgaacctgcgcttcaggcaccagaccgctggcaatggcggcgcgcagctgcgttttcagtgcctcacgcgcgtcctgactgtcggtcagtactaccagcttagcaaaggccggatcgggcagttccggtgccatcgccagataaaaacgcggtggcccctgaccaatataggtggtgacgatttttgcctgctgctgctgtttaagccaggtctcaaccttttcagccgctgcgcgggtctgttctatggcgctgccgtaggggagctgaacttcaaccagcacttcaggccggtctgaggtcgggaaaaactgttttttcaccagcgccataccgagcacagcggcgataaacagggcaatcaccacgcctgccacccagcctttacgggcaatcacgcgggtcagcaggcggcgaaagcggttgtagtggcgggtgttgtagatcgctgcgtggccgccttctaccgttttgatggctggcagcagctttacgccaagataaggggtgaacaccaccgcgacgatccaggaggcgatcaacgcgatgccgactatccagaacatattgctggtgtactcgcccgccgtggactgcgcaaacccattgggcataaacccgacggccgtaaccagggtgccggccagcatgggtgccgccgtatgactccaggcataggcagaggccttgatgcggtcgtagccctcctccattttcactaccatcatctcaatggcgataatggcgtcgtccaccagcaggcccagcgccagaatcagcgaacccagcgtgatgcggtcaaagtttttgccggaagcctccatcaccacaaacaccaccgccagggtgagcggcaccgcagccgcgaccactaccccgacacgccagcccatgctgacaaagcagaccaccatcaccaccagcaacgccacgacgaacttaaccataaattcatcaaccgccgagcggatattgacggactgatcggtgacctgagtcagtgagagccccagcggcatcgcctggttgatgcgggcggtttcagccgccagtgccttgccgagttccagaccgttccagccttcacgcattacgatacccagcagcagcgccggttcgccctgattgcgcaccataaaggtggcgggatcttcgtaaccccgggtcaccgtagccacgtccgccagcttcaggcttctcccctgcgccacaatcggcgtctcacggattttttccagtttatcgaacgcgccatccagccgtataaagacctgcggcccctgcgtatcaatcgatcccgctggcgtcaggacattctgatcgttcagcgcagcaaaaattgcctgcggggtgatgccgagtgtcgccagtcgatcgtgtgaaaacgacacatagatgcattcactctgctcaccgatgatattgacctttttcacgccaggcagatgcagcagtcgctgacgcagtgattccgcttcacgaaccagcaggcgctgcggctccccttttgccttcagcgccagcagtgcaaaggtcacgtcggagaactcgtcgttgatcatcggcccgatgaccccggcaggcagatttctgctctcatcacccagcttcttacgcgcctggtaaaactcctcctgaacctgggaaggcggcgttttgtcctgcagggataacatagtgaaagccagaccggggcgcgtgtacgtctcgctacggtcataccacctcagctcctgcagacgcttttccagcggctcggccacctgatcctgcatctcctgagccgtcgcacccggccaggcggagataatcgtcatctgttttacggtgaacggtggatcttctgcccgtcccagttcgaaaaaggacaagacgcccgccacggtaatcaggatgatcagaaacagcgtaatagcgcgctcgcgcacggccagcgctgacagattaaagcgtccctggctcatggctggctcccggcaacggcagcgtcatcggggcgcacgcgctccccctgctgcaacagatgcgcgcccagcaccactatctgatcgccagcattaagctgacccgtgacggtggccgcctcgtcacttatcgacaccaccgtcaccggccgccaggcaacggtagcgggctggccggtaatatcccagacgcctggccctttaccggcatcgtagatcgccgccagcggaacctgcagcagcggttgcgacggtttattcggcagcgtgattgtgacggtggctcccagcggtgcgctggccagtgcgccctccagcacatatctcgcctcaaaggtgcgcgtcatcggatcggccacatcagccagttgacgcagccgggcagaaaccggcgcactgtccgcaccatacagcgttgcctttgcctcacttcccactgccgggcgcagggtctctggcaactgaacacttgcctcgcgctgtccggctctggccagtctgatgacggcctcaccggcactcacaacctgacccggctccgccagcgttgccatcaccacgccatcgtcatcagccaggagcagcgcatatccgctggcgttacctgcaacgctggcctgcgcctgggcggctttcagctcagcctgagcggtggccgcagcggcccgaatctggtcgtatgccgacgcagaaactgccccggttgccaccagagtgcggtaacgcgcctgatcggcgctggcctgtctgacgcgtgcctgcgcggcggcaacggcctgctgctgagcctgggcctgcagccggagatctgccgggtcgagccgcatcagcggctgaccgcgcttcacccgctggccgctatccaccagccgttcgaggatttttcctgagacccgaaagccgaggtcgctctgaacccgggcaaccacgacgccactaaacgcacggctgccatcggtggcgctgatgacctttgtgaccctgaccagcggcggctgcgtgcgcggatcgtctttgggtgaattatcccggcaacccgccagcgccagtggcagcagacaaacaaccagaatggcaggattgaacctgagcatagattaccttcaacagtaagcaggagagtgccgccattctcttatcatgtgaccaatactgtcaatagtcacaaattgcgtaaaggcattgtccgttcatacaggttatgaaaacacgttaaaccaggaaaatgcgttgatgaagggttcagacccaccctgagcagaggaaacaccccattctgcaacaagtgacgaaataaatcatgagtcacaaaatctgcatattccgtacactggaaacagagtgacgaaaaggctctgtcagggcctggaatggctcgtcagagagaagttcagagaggataaagcagaaaaagcgcggagtgatgacgcgcgtttacagcagaatcaccgcaggcgctttgtcatctgcgcctgcggtggatctcacagcgccctgctcttcagggcgctctgtcacttaacgccagccgagtttccggggcgacatacttcaggattgcctcaatcacatgggcgttgtaggcgacaccaagctggttaggcacggtgagcagcagggtgtcggcttcggcaatcgcctcatcctgcgcaagctgcttaattaacgcctctggctctgcggcatagctgcggccaaagatagcgcgggttttctcatcgagaaagcccacggaatcctggtcgttaccgctgcggccaaagtacgcgcggtccatatcattcaccagcgcaaagatgctgcgactgaccgagacgcgtggcgcatgctgatgccccgctgctttccaggcctcacggtaggcgcggatctgttttgcctgctgaatgtggaacggctcgccggtctcatcatctttcagggttgaactttgcaggttcatgcccatttttgccgcccattctgcggtggcgttggagccggatccccaccagatgcggtcgcgcaggccttcagagagcggctcaggacgcagcaggcctggcggattggggaacatgggctgtggatttggcttagcaaaaccttcgccgcgcagcacctccagaaactcttcggtgtgacgacggcccatatccgcatcgctttctcccgctttcggttcaaagccgaagtaacgccagccatcgattacctgctcaggtgaaccgcggctcagacccagttgcagacgaccattggagatcaggtctgccgcgctggcgtcttccaccatgtagagtgggttttcgtagcgcatgtcgatgacaccggtgccgatctcaatcgttttggtgcgcgctgcaacggcagccagcagcggaaacggcgagctgagctggcgggcaaaatggtggacgcggaagtaagcgccatctgcgcccagctcttcggcggcgaccgctaagtcgatcgattgcagtaacacatcctgcgcggtacgggtggcggactgagacgaaggcgtccagtgaccaaaggataagaagccaatatttttcatctgtatttctcctgacaggcggtaaacgcccgtggatgcaaggcgatttctgatagagaaaggttacgcccccggagccgccactgatagtcaatatctttcagcgccatattcaggaatttcgacatagctaagcagattatccactttgcctttgcccgccctttctttcactgttcagattcccgcttccgctgtcaggtgaatcatgcacaccggttatctctctctacagcagcgcgcctggcttaaagcgcgcgcacgcagctggctctggcgcagcgaactgccgacctggctgctaatcggtgtgatctatggcggctggtttgcggtgatgctgaacgcgcagacgctgggacggctgcccgccaccctgctgctgatcgtcttcactggctggtatatgtcgctgcagcatgagctgatccacggccatcccacccgctggccgcgggtgaatcagctatttggcaccctgccgctggcggtctggtatccctacggactctatcgcgattctcatctggcccatcatcgcaatcacaccctgactgagccggatgaggatccggaaacctactacctctccgctgctcgctgggcgaagttaccgcgctggcagcagcagctgattcatctgcgtaacacttttttgggacggttgctactcggcccgctgctggatgtagcggcgaccttcggcgggatgtggcaggcactgcgccgtggcgatcgatccgcgatagcgatgtggctgctgcacggggcgctgctggcactactgtttttctggatggcacggcagggattttcgccgctgtggtatctgctgacggtgagttatccggcgctggcgctgaccaaagtgcgatctttctatgagcatcgtgcggcggacgatccgctggcacggtcagtgaataatgaagcggcgtggccgtggcgcatgctattcctgaatctgaactaccattcagtgcatcacgacctccccggcgtcccctggtatggcctgcgccgcctctatctgcgcgaccgcgagcattactaccagcgcaatcatggctttcgcgtggcgggttatcgggtctggctgcgtcagtttctgggtcagaccggtcggggtcaatgtccatccgggacgatcagcggagaaaacgcatgaataacctgctcgccttgccgatgtatgcgattcacccgcccgccacacgagcactgatgcaggcagtggttaccctgctgacgcagcacggcatcgctacgcagccggtctggcctgaggatctgctgacacactggcaggataatcgattgctgctgagccagacctgcggctatccgctggtcagccagcttcctgcggttcagctggtcggcacctttcactatcaggccccaggctgcaccggccgtgactatcgcagctggctggtggcgcgggacaaacaggcgacgctggccgattttaacggccagcgagccgtagctaacagcctggactctcactccggctataacgcgctgcggtttgtggctgcgcttcagggcgtgaggttttcgcagctgctgctgagcggtgggcatcgtcagtcgctggcagcactgcgtgattcacaggcggatatcgcggctatcgactgcgtcagctgggctctgctggcgcgctatgagccggatgcgctgcgcggcctgcatatcatcggtgaaacgccagccgcacccggattgccgttgatcacggcagccccgacgtcagtggaccggctggagagactccgcacggcactgcatcagctggtgaacgatcccacctggcgcaccgtctgcgacgataacctgatcggcggattcagcccggtagagagagacgattatcagggcgtgctggcgtgggaacagcaggctgccgcgctgggcgtcacccggctgtaacacccccctctgtttcgaactgcttaccgggcagggaaaatctgatatctctgcatcgtcacctccctgcccgcgctttcccgacctctcatttcatgctccccgacgcgctctgaccgaggctaagactggtaagcccggtcacggcgttctaaggtagaggttttcagcagagggagagtgggatgcgcattctgatggcaggcgccggcgcgaccggtggatattttggtgcacggctggctcaggcgggccaggacgtgacttttctggtccgtgaacggcgttatcagcagcttcaggccagcggcctggtgttgcagacgccgcaaggcactgaaacactaaagccgcagctggctcaggcgagcagcctgacgggccactatgatctgattatcgtgacggtgaagagctttgcccttgatcaggtgatggaggatattgcacctgcagtgggtccggaaacgctgatcatgccgattctgaacggattgcggcacatcgcaacgctgcaacagcgtttcggcgaagataaggtgattggcggcctgtgcaaaatcaacgcgacgctgggtgacaatggcgaagtaatccagatgacgccgctgcatcagctctattatggcgcgctggatggtaacaacgatgcgcgactgcagcgggttgatgcggcgctgcgtgactgtcaggtcgatacccgattcagcgataacatcatggatgagctgtgggagaagtggctgctgctgagcacgctcggcgcggtttgctgcctggcgcgcggaaatacccaacagatactcacctcgcgcggcggcgaagcgctgttacagggtgttttctcggagattctgtcagtcattactgccgaaggctatcagacgcgtccggcggccactgcccgcattcttgagctgttaagcgatccggccaccccgatgacctcctcaatgtaccgcgatttaacccagggctttgatatcgaagccgatcaggtgataggtgacctgctgctgcgggcgaaacgccatagtctcgccacgcccctgcttaacgcggtggatgtgaaccttcaggtctatctgcagcagcgttaatggccctgccagataccgtgaccgggtgctgcaacgggcccggtttttgtggtcgtgaaagtgtggtgtgcagcagcagtgcagcaggaaaatttgctacactcgtcgcttcatcttttggagagttcaatgacttcccgctccgtgaccctcgatgatgtcgctcaactggccggcgtctcatatcaaaccgtttcacgtgttttaaatcgttctgaacaggtgtcagcccgcacgcgggaaagggttgaggcggcgatgctgcagctcaattatgtgcccaatcgtgtggcgcagcagctggccggtaaggcgacgcgtacgctgggtctggccaccagcgacctggccctgatggctcctgcgcagatcgcctcggcgatccagcagcgcgccgccggggcgggttatcatctggtgatcgccatggacagtggtaacgatgcggcagcaacggtgaatgaactgctggcacagcgggtcgatggactgctgatcaacctgccgctggaggcagatgaggcgcaacagatccagttgctctgcggcagcaaaccggtgctgtttctggatgtcgaaccccaggcggcggtagcgcagtgtcagtacccgaatgagtctggcgcacgtgccgccgttgaacatctggtggcgctgggtcatcgtcagattggtttgttaaacgggccgctgcgctcggtctcggcccgtcagcgtgaaaatgcatggcgtcaggcgctggccgatcatcagctgacaccgcactgttctctgcgcggcgactggagcgcgcagtcgggttatcaggcgctgctggcgcagcttcccgacgatctgccgcaggcgctgctggtggcgaacgatcagatggcgttgggtgcgatgcgggcgctgcatcagtatggcgtagccattcctggcgagatatcggtgattggatatgatgacaccgccgagagtgcgtggtatcagccgccgctgaccacggtgcggcaggatttgcaatttctcggcgcgcagagcgtcgagcggatgctggcccggcttcagggagcagaggcgtcagacaacgcgctggaaaccacgctggtgatccgggagaccaccgccccgcctgctgatgagcgggtcaatttagtggcgctgtcacagcagttacaggtgatcgcccgcaggctggcgggaaaataaccctgcgctgacgcaggcaataaaaaacccgccccaccggagtggatgcgggtttgcataggacgtctgacgcttgcgcgctgctgtctgcccttacgctttcgggtgttcgcccacgcccatcgctttgatctttttcgacagctcgcgacgctctttagacaggtcggcgtttttgatgatgtactcatccacgcgatcttcataatccacacgcatgctggcgatgatttcctgaatagcctcaacgctcatgccgggtttgatatattcgctcaggttgtcgagcagcagtacgcgcttctggttgtcgcgaattttcttctcgttgtcgacaatttcacgctgcagtttgtttttgcggcggaacatacgcacgaactccagtacgtcctgaaatgattgcttggcattttccatgatggcacctttctttgagcctgctgacgcagggagagagtcaaaacgatcagcttagcggctagcccgccaggtaagcaattttcacagctaaattcagactggctcttatcttagcgcaaagaaaccctgtttcacattaagtcattgtctgaggtgattatttgcgcagcgccatccgcatcaggtcggtcatccgttccagctgttttgccagttccagtgtcagccagacgtagccgtagatcggcgtctcctccagaccttcgctgcccgcttccgcgatcagtcgccgcagttcgccactgatttcggtcagctcgtgactgttagccaccacctcttccgtttccccttcaatcgccatgaccgacagcgcccgcagcgtgttctcagtcatctgctgggtgcggcgcaatgcaggcgcgttaagcataatcagatggctctcgcgcgatgcccaccaggcattaatctgcatctcaatggtgtaaaccatattacggttgatggtctggatcgcttcaagcaccgattttggaatgcgcgtctctttgcttgacggctccagcagcgcccgcattttgatcacgctgctcagcaatttgcccagcggcttgttcaggcgtggcttttcaaccaggttgggtgagaaaccggcgtgatagatttttgccatttccgccagcgcgtcggagagctgaatgcgccagtgtgtataggcacgctgcgcccagatagcggtaaacagcagcgccatcagcgagcccagaatcacatcaccgccgcgccacagtgccatcgtgaaatcgccggttggtgcgcccacgaccacgctcagcgtaatcccgatcaacaacgccatgtagggatgtttgcccagcgtcaggtagccgctgatcatcatgatgatgccgcaccaggccagcatcatcggcatcgaaatcagctccagtttcagggcaatcagaccggatattgacccggcgaccgtgccgctgatgcgctgcagtgcgcgcggaaagacattcccccaggtggagatgggccccatcaccaccaccagcgtaatcagcggccaggtgccttcagggatatcggtcgcccgcacaaagataaagcagagcaaaaaggcgatggcaatacgcacaccgtggacggagcgataatggcgataaaaccagaactccagttttgatatgggcttatcgggacgcaaaatgactttccggttgcgggaacatgatgtggctatcttaacgctgaacgcggctcaggcttagcgcgggccggatatttaaaacagttttgacgttcgcttacaattatcaacatccgcctcacatactttcccggtagttaaaaacaacttaatgtgattttttaacctttatcggctctctgtaacacgctcagagcagccagcgtgcaagtaaaaacgggcagcccgcaggctacccgttttagtgctgacaatcggctaatcagaacttctgcctgagataatccgtcaggcgggtaatcacacctgcgggttcaaccgcactcagcgccaccagcggatagtgggcaatctgctgatctttatccatcacctgaatttcaccaatgacttcgttggctttcagcggggcttccagatctttgcgatcgataacatacttcgccttcacgttctgcacttcactgcgcggcagtgacagataaacatcttctgcggtacccacatccacctgatgaggattgccataccagacgttttcgctgccaatcttcttaccggcatggaacagctgaacggtatcaaaggtgttctgtccccagaccagcagtttacgcgcctgctcttcgcggcctttcgggcttttaccgcccatgacgacggcgatcaggcgatgcttgcccaccacattcgaggcgatgatgttaaagcccgcggtctcagtgtgaccggttttcaacccatcaacgtggagattattatcccacaacaggccattacggttgttctgggtaatgccgttccaggtcagggtcttctcactgtacatggcataaaaatcaggctcaccatcaataatggcgcgtgacagtttcgccatatccagcgcgctggagaactgacccggcgcatccagaccatgaaccgtttcaaaatgggtattctgcaggccgagcttctcaacgtagtgattcatcatgccgacgaagttcgcttcgctgcccgccacataatcagccagggcaacgcaggcgtcgttaccggagtcgatgatgacgccacggcttaaatcccggacgctcagcttatcgccaggcttcaggaacatcagcgaggagcctttgaacaccggattacccgccgcccaggcatcttttccgaccgtaaccatgtcgtcacggctgattttcttctggtcaatggcgcgatcaaccacgtaaccggtcatcagtttggtcaggctggcgggattacggcgttcatcgggattgccagcggtcagaacctgtcctgtggtggcatccatcagcacccaggaagccgcatcaatcgctggtggcgtcacaggaaagggaatcgcatcagcctgtgccagcgaggcccaaaaaacagtagcggtaacggtgaacagcagacgccttttcaacacttcatccttaattgcacgggagagaaaatttctaaaacgaaacggaaacagccgcacgttttacggcaaaagcgttgtgaaggtttgaataaattgaaaaaaagtatgaactgcgacgggtatggctgatgcctgcaggagggagataacggctaattgatgcaggaattgagactgaatatttcaatatcatcctgaaaaacgttaaggtcaccacggtatcgccctgccttgcacccagcggcatgagcagcacgcatctggaaacaccggaattacagtatgcagcaataacctggaaatatgtcgaagggaatattatctatcgtggcacatgggatgagcgagctacagcctgagaggtaaaaagtccgctttactccttgcccctgaccgctcagtcagatactacgccccccgctaccatccgaaacttcaggccagtcggattatggtttaccatgtagtgagtgaagcctgagcctgcatgaccttgcccggcaaaggcaccgctctcgcaccagcagccaggcgccgatgaagaaaggcatccagcgaacgggaagcctgatgactttctgttcatcagtttagtgaacgcaatgaacggatatgaaatttgaataacgaccgcgtacagcccactttcctcttccacgattacgagaccttcggcaccagcccttctcgtgaccggccagcccagtttgccggcctgcgcaccgacagtgagtttaatccggtcggcgaacccgaagtgttctactgccgtccgcctgatgactatctgccacagcccgaagcggtgatgatcaccggcattaccccgcagatagcgatgagtcgcggcgtgatcgaagctgagttcgctgaacgcatccacgcgttgttcaccacggagcaaacctgtgtggtgggctacaacaacgtgcgtttcgatgatgaagtgacgcgcaatatcttctatcgcaacttttacgatccctatggctgggcctggcaaaacggcaactcacgctgggacctgctcgacgtgatgcgtgcctgctacgcgttacggccagaagggatcaactggcctgagaatgaagaaggttttcccagtttccggctggagcatctgaccaaagcgaacggcgtgtcccatgaaaatgcgcacgatgcaatgtccgacgtttacgccacgctggcgatggcgaagctggtgaaggagaagcagccaaaactgtttgagtttttgtttacccatcgtaacaaaaacaagctgatgaacctgattgatatcccgcagatgaaaccgctggttcatgtctccggcatgttcggtgccgcgcgcggtaacaccagttggatcgtaccgctggcctggcatcccgataaccgcaatgcgctgattgtggtggatctggcgggcgatatgtcaccgctgctgcaactggatgccgacacgctgcgtgagcgtctttacacgccgaaaaacgatctcggcgatctgcctgcggtgccggtcaaactggtgcatatcaataagtgtccggtgctggcgcctgccagtacgctgcggccggaagatgcggcccggctgaatattgatcgtcagcactgcctggcgaatctggcgctgctgcgtcagcagcccgacgtgcgggaaaaactggtcacgctgtttgccgaagcggagccgtttgcaccgtcagatgatgtggacacacaactctatgatggcttcttcagtgatgccgaccgggcggggatgaatattatccgtcagaccgcgcccgcgaatctgcctgcgctggacctgagctttgagagtgcacgggtagcgaaactgctgttccgctaccgggcgcgtaacttccccggcacgctggacgatgccgagcagcaacgctggttgcagcaccgtcgtgacgtgcttaatgccgatcgggtgcaggcgtttatgcaggaactggaagctctggcgaatctgcatgaagcggatgcagaaaaggttgggcagcttaaagcgctctatctctatgcgcaggagttggtttcctgaagcactaagagtctgacccggtatcgcctgccgggtcagactttctgatgctgcttaatcagagcaaggtccacgccagccaggtcagcgcaaagccgctcagccccattagtgttgtcagcaccgtccaggtgcgtaaaccgtcggccaccgaaagtcccagataacgggtcaccacccagaatcccgcatcattgacatgcgacaatcccagaccaccaaaacaggccgccagggtgaccagtacccgttgcatatccgtcacgccggtcaccgcctgcgtcagcagcccgctggtggtcaggatcgccaccgtggcggaaccctgtgatgcacgcagcgccagcgacaggataaatgccgcgggcaccagcggcagatgcagcgtttcaagggtgaccgccagcgctttacccacgcccgactccaccagcactttgccgaatgcaccaccggccccggccaccagaatcacgctggctgaggtgggaatggcccggccggtcagatcttccagcttatctttgctccagccacgccgcacgcccagcagccatgccgccagccctaaagcaatcagcagggcaatcggcggtgtgccgatcacggtcatcacgctacgcagcagactcccttcagccagcagtgtgtgtgacagagtttcccagcacgatcaatacaatcgggaccacaatcaggccgctgatggtgagcgcaccgggtggtgccggttcattcttcttttcctgcccttccggcttcgccatctgcaactgttccagcacctccaccgacagggggtagcggcgacggttcatgaatttcgctacgtagtagccgatgatcccgaccggcacggaaatcgcgatccccagtatcatcagccatcccatgtcggtgtgcaggatcccggctgccgccgctgcgcccggatgggtcggcaatgccacatgtaccgtcagcatcacacccgccatcggcaggccaaacttcagcggcgagacccgcgccactttggtaaagccataaatcagcggaataacaatgataaagccgacttcaaaaaataccgggatgccaaggataaaggccgccatggttaatgccgcaacggtacgcttcagccccagcgttttactgaaacgctgcgccagcgactcggcaccgcccgaggcttcaatgatcgccccgagcatggcaccaagcacgatgatgatggtgatgtgaccaagcaggccgcccatcccggtgataatcgtctccatgattttttcagccggaatgccggtggcgatggccaccagcagactgacaattaacagggcgacaaagggatgaactttggctttgatgaccagcagcagcaggatcacgatgctggcggtcgctatggctaacagcagtgcggtggacatagtaaacctcagaaattgttatattttttaggttatcggcgtacagaataaacagatgcagggtcagaaaaaggacgaaaaaatctcaaccggtgccgaaacaccggtttttttagcccattaaatcaggtttttctcgcccagggcgcaaaccagccaagaccagcggtagtgctgccgcgcgggatatattcgcagcccacccagccggaatagccgacctcatccagcagtgagtagagataggggtagttgatttcaccctcatccggttcatgacgatccggtgccgaagcaatctgcacgtgccgatagcgtccggcgtagtggcgaatcagatggctgaggttgccatccacccgttgcgcatggaacaggtcgagctgagtgaagacattgggtcgatcgatctgttcgaccatctccagcgtctgatactggctggcataaagatagttgggtttggtggtgggattaagcgcctcaatcagcaggatgatgccgtgcggcgcaaagcgctcagccgcataacgcatattgctgataaaggtctcaacgtagcgctgacggtcagcgtcgggcggcaccgtcgccgccatgatgtgcacctgcgggcagttcagcgccagcgcatagctcagggcgcgatcgatatccgcctttgcttccgcttcccgtccagggatggccgaaacgccccactcacccgctgcgacgttgccgggtgcggtattgaacagcaccaagtccagctggttatcatcaagccactgcttgatctgcgtggcgggatagtcataaggaaacagaaattcgacggcggtgaaaccggcttctgccgctgcagcgaagcgttcagcaaacggcaattcagtaaattgcgtcgaaaggttagcagcaaacttcggcattatcggctccttaattctgccacttcggcatcattgagataacggatcgggcggtcgcccagggtaaagatcagccgggcggtctcctccagctcttcagtgttgtctgccgcttcctgcaacgatttccccactactaccgggccatgattcgccagcaggaaggcacggtaacgtggagccagcgccgcgagatcctcggccagtcgcccatcacccggcttgtagtaaggcacaaccggcacatcaccgacacgcatcaccacatagggggtaaacggacggatgcagttgtccgtgtccagcccctgtaagcaggagagcgccgtcaggtagtggctatgcagatgcaccaccgccctgcagtcgggattattcagatagagcgcgcggtgaaacgcaatctctttggagggtttatcgcctgagagccattcgccgtcaggcgtgacttttgccagccggtcaccctgtaattcacccaggcatgaaccggtgggagtcgccagcagattgccatcctccagcaacattgagaggttgcccgccgagccggtggcatagccgcgctgaaagaacgaagcgccaagacgcaccatctcgtcacgcgcctgctgttccgttaaagagaaagattcagacatcagtaaactccgtttgcgcgcggcggaagaaatcttcatcgccaaaattgcccgatttcagtgccagagagagcggctgatgaatgtcgcgcacccagggcacgccgggcgaaatcgtcggaccgatatgaaaggccgtcacacccaggctctgtgcgaccacgccggaggtttcgccacccgccacgataaagcgctgccatccgcgccgtttcagctcgcgggtgacggcagcaaacagttgctcaacggcttcgctgctgcgctgagcgccaaaacgctgttgaatcgcctgcaagtgttgcgcgtcagcggtggcaaacagcaggggtgccagcgtctgatcgctgttcgcttccacccagtcgcataactgccgggcataagccccggcatcttccagacagcgttcagtctcaacttcgcaggccggtgccagctggcggtatgcggcgacctgacgattggtcatctgtgaacaggaaccggaaagcaccacggcgcgatcgccctgcggacggcctgcctgctccgcttttgcatcactttcagccgctgcccactgccgtgccagaccgatggccagcccggaaccgccggtgaccaggcgcagatcgctcagtgcttcgcccagggtcaacagatgttcctgatgcaggacgtcagttacgacgtagttgatcccctgcgccaccagctgacccagcgcctgccgtactgactcagcgccctgatcgacctgtgccgcagcgatcagcccggctttgcccgtcgcctgtgatgtcatcaggcgcagcaggttactgtcgtgcatcggtgtgaccggatgatgccgcataccggaatctgacagcagctgatcgccgacaaacaggtagccctgataaacggtgcggccattcaccggcagcgccggacagattaccgtctgcgtttcacccaacgcctgcagcagagcgtcggttaccggaccgatattgccctgcgcggtgctgtcgaaggtggaacaatatttgaagtagaaacgctcacagccctgcgtctgcagccaggccagcgcagccagcgactgagcaaccgcctggtctgccggacaggagcggctcttcaggctgaccacaatcgcctgcgcctctgtggtttcctcgctgtcaggaatgccgttgaactgaatagtggtcagcccgttctgcaccagaaaactggcaatgtcagtcgcaccggtaaaatcgtccgctatcacgccaagccgcatcagattttctcctctgcctgcggcagcgtgatgccgctgaagattttaattactgcactgtcatcttcacggccgtaaccggcgttgctggcttcggtgaacatattgagggcggttgaggccagcggcagcgggaagtgcaaggctttcgcggtatcggccaccaggttgagatctttcacaaagatatcgaccgccgatttcgggctgtagtcgccatccaccacatgccgcatgcggttttcgaacatccatgaattgcctgcggcgttggtgaccacttcatacatggtttccagcgggatgccggcacgcgccgccagcgccatcgcttctgccccgaccgcgatgtgaacacctgccagcagctgatggataattttgacggttgatccgaggccgatctcactgcccacgcgataaactttggctgccacggcatccagtacagattgcagttgcgtaaaggccgcttcactgccggacgccatcaccgtcatctcaccgctggccgctttagcggcaccgccggagaccggtgcatccagcatcagcagctgatattgcgccagctgttgttcaatctgctgcgcatcccgggcggacaatgtggatgagaccatgaccacggtgccgggacgcagttttgcggccaggccctcttcaccaaacagaatggcgttaacctgctgcgcatttaccaccagcagcaaaacggcatcaagctggtctgcaaaggcggatgctgaaggctgcgcatcacgcgcgcctgcctggcgtaagttctcaagcgcggcgggattcaaatcgacaccccaggtattgagaccggcacgcaggcaggatttcgcggcacccatgcccatggaacctaacccgataacgcagatattttcagctggcacgatacgcctccactgttaatttaagtgattatttgtttgttactgttaatcctgccagtttactgtcggcaaaaatgtgtttccgctcacaaaaaaacattccagatgtgaaccagaacaatttttaacattacccgattggcagcaccggccctgccgcagtgcagttaccgccgccgttgccgggattgccgctgttattatttattctggttaaccggcagatactttataatgtgaaaaaatggtaatcatcagggagccgatatgattccggttgaacgtcatcaacagattcttgcgctggtggccgatcgtggcgtggtgagcattgcagaactcactgaacggctgggtgtgtcacacatgaccatacgccgtgatgtgcagaaactggaggagcaaggggccgtgctgtcggtctccggcggcgtgcgctcagccgaccggctggcggctgagccgtcacatctgacgaaaagcgccctctacaacgaggagaagcgcgccattggccgcaccgccgcccgacagatcccccgtaacagctgcatctacctggatgccggaaccacgacgttagccctggcaagagaagtggtggatcgcgatgatttactggtggtgaccaatgattttatggtggcgaatctgctgatggaggccagtcagtgccgggttattcacacgggcggcaccgtatgccgggagaaccgctcctgtgtcggcgagtcggcggcacgcagcctgcgtcatctggccattgatattgcctttatttccgcctcctgctgggggccgcgtggcttgtttacgccggatgaagataaagtgatggtgaagcaagcggtgagtgaggtgagcagtaagcgggtattgctgagtgacagttcgaagtacaacaggattgcgacgtttctggctttaccgctggagagctttgatcgggtagtgacagacacgcatctgagtgagtcggcgcgggagttgttaagtgcggggagctgtgaactggtacttgctggttaagctgtcgccgccttccctgagaccgggaaggcggcaacgtgagcgtaattaaacttcttcgctgaactgcggcaccggattacggaagctgcgggttacgaacgccaggtagataatcccgatggcggcccagatcaggcccagctccatagaactctcttccaggttcacccacagcgcacccaccgtcagcgcgccaagcagcggcagcagcagatactgaacgtgatctttcagcgtgcggttacgcttctcacggacccagaactgcgcaatcaccgacaggttaacgaaggtaaacgccaccagcgcaccaaagttaatcagcgcggttgcggtcaccaggtcgaagttaatcgccatcagtgcaatcgcacccaccagcagcacgttgagcgacggagtacgccatttcggatggatgtaaccgaagaaacgctccgggaacacaccatcacggcccatcacatacatcagacgcgagacgccagcgtgcgccgccataccggatgccagcaccgtgaccaccgagaagatcaggatgccgacctgcaacgctttaccggccacgaacagcatgatttcaggctgcgatgagtccgggtgctggaagcgtgtgatgtccgggaagtagagctgcaggaagtaagatgccgcgataaagatcaccccaccaatcagcgcggtcaggaaaatagcgcgcggaatggtgcgttctgcatctttggtctcttctgacagcgaactgatgccatcaaagccgaggaaacgagaagcagagtatcgtcgcaccggtaatcatcggcaccacatgcgcattctcagaccagaatggacggctgctcaccagcgtgccggaaccaacgccgcttgccacaccgtagattaccatcgcggtaatcccgaccatgacaaccacctgcagcaccacaatcacactgttgaagttggcgacggttttgatgcccttgaggttagagagcgtcataaacccgaccagcaacaccacaaaaatccacgacgggatgcccggcaccagcgattcgaaatagtttttagccagcaggatgttgatcatcggcatgaacaggtagtccagcagtgatgaccagccgaccataaagccgacgtgcggactgatcgccttctgagcgtaggtataagcggagcccgcagaggggaagcgtcgtaccagcttaccgtaactcacggcagtgaacagaatcgcaatcagcgcgaaagcataagcggtggcgacgtgaccttcggtcagcccggaaacgatgccaaaggtatcgaacagggtcataggctgcatgtaggctaagcccatcatgacgaccggaagtaacgtgagtgtttttttgagttgcgcacgctgcggtgcggcggaggtattaagcgacatgcttcagtcccccatgtgcgacaacctggctgggctgggtcacagggcaactgcgcattaagcgacagggagtaaagttagcggttaacgcggcgccgtagtcatcacgaaaacgcgtaccagcgttggctggcagagtgtaaaacatccccatctttgtaatcctcaatctcacgcttatgcgtgttttcagtgtttatctatccgggtgcgtgcccggcctcggttaagtcagcaaaaaacgctctaataaaactggatgcaaaaaaataaccggcgcggttagcgtcggttatcatctgattttgcaggccgcgtattctgccctaacccgtggcaggaatacaagccatcggggcatcttatgcaaaaaaaagcgcgtcagatgacaggtaaaaaaacctgtcaggcatttttcagcatccagtcaatctcggtagacgtaatcagccgttcaaactgcatcagttcatgatgcttacagctgtgccagacactggcaaagcgttcgcccagtaacttctgcagcggatagctgttgtcaaactcatacagcgcatcgctctggcgaatcggcagtgccagaccctcggcatggtgaccgttgccggtgaccggatggggcaacggcaactgggtatccagcccatgcagcatcccggcaagaatagccgacaccaccaggtagggattagcatccgcgcccgcaacccggtactcaatacggtgattgtcgatatccccgcacggcacccgcagcgcaacggtccggttgttatggccccacgatgcctgcaacggcacataggcgtccggaacaaaacgacgataggcattcacattgggtgccagcagcgccattgaggcgggcatcagatcgatcatcccggccagcgcccgtttcatcagcggcgaatcactgccgtcatcgcaggcgaaggcgttatgatcggcggcatccagcatgctgatatgcacatgcatgccgctgcccgcatactcctcatagggcttcgccataaacgtggcggtcataccgtggttttctgccacctgacgaatcaggcgtttcagctgcaccgcatggtcacaggcccgcagcacgtcgcgggtatgatgcaggttaatttcaaactgtccgggcgaggcttccgccagcgcaccatcggccgggatgccctgctgacgagccagatcgtcgatgtcacgcagcacatcggcgaaatgatcgaggttatctaccgagtagacctggctctgcatattgcgttcatcactgccgggcgagcacggcggctggataaagccttccgcatcgcgctttttgtccaccagatagaactccagctctaccgctaccaccgggaaacagacctcggttacgcagctgttgccacagccggttaaggacatttcggggttcaacgtcaaagggagtgccatcttggttgcacatggttaacagcagttgcgcaatgtgctgagggtcagacgcggagggaactaaagtaccggtgacgggcaggcagagattatcgggttcgcccagtgactggccgagtcccgcttcttctactgtgttgccgaggatatccatggcaaacaccgaggcggggaaataacaccctttttccagcttaggcagcgcagagaccggaatacgcttgccgcggaacacaccatttaaatcatttaacaggatgtcgacatactgcgtgtcaggatggcgctccagccaggttttcacctcaagctggaacgcgctggttcgtttctcttcactgtgaagcgtgaagtcttccacttctaccaggttagtcatgatctcacccgcccctattaggtttgcgtaatgctcaaaataacagccacaccactaacatagcgccaacataaaaagtgtgcaaatgtaacaaatctgtttgaagaacaaacagcagattgctagattgaaaaaatattgcacacttaaccgccagacgtgccctttcggtagatatttcgaacagcgatgcgaggacgtgagatgggcattatttttgacaagccgttgatcggcgtagtgatgtgccagaaggatctgggcggccatccgagccagacggttcacaataagtataccgatgcggttgtccttgcgggtggcgtaccgctggccctgccccacagtctgatgaaagcgcctcatctattagaaaacgctatggctgttctggatggcctgctgctgaccggcagccccagcaatatcgaaccctggcattatggcgaggcgggcgaagagccgcatgccgatccgggccgtgaccatctcgcctttcagctgatcacctgggccaccagccacaagatgccgatgttcgggatctgccgtgggctgcaggagctggtggtggcaaatggcggtgcgctgtggcgggagctcagcgggcagccgtcgtttcagcgtcaccatgaagatgagacgctgccgctggagcagcagtatgctcaggcgcatcccatcactatcgaacccgacggcctgctggcgacgctgctagacagcaatagtccgctggcggtcaattcactgcatcatcagggggtacgcgaaccgggcccgcagttgcgcgttgaagcgcgcgcgccggatggcctgattgaggcggtgagtctgcgccatcatcccttcgccctggcggtgcagtggcatcccgagtggcagccggaacacacaacgggatcgcaggcgctcttcagcggctttattcaggccgccattcgttatcacaaggaaaaagaaaatgagtgatgccacgctggcgccgggacgacggctggcgcagatccggcagacactggggctgtcgcaacgccgtgtcgccgaactggccggactgacccatagcgccatcagcaccattgaacaggataaggtcagcccggcggtcagcaccctgcagaagctgcttaaagtctatgggctctcgctgtcagagttcttctcggaacccaaaccggacgcggaacctaaggtcattgtccgcgccagcgacctgctggagattggcagtcagggggtttcgctgaagcttatcgacaatggccgtgcacagcgcacgctgggcatgctgctggaaacttatcaacccggtgccagcaccggcgagaagctgcgtcatccgggcgaagagaccggcacgctgctggaaggagagattacgctggtcatcaacggagagcactatcatctctccgccggagagagctacgtcattgatacgggcttaccacacagtttcaccaaccgtgctgaaatcccctgccgcattgtcagtgcccatacgccagccaacttttaggcgcattccggagattgttatgaattacgtggagagttattacgcagcgaccgccaatccgcatgtgccctggccgacattacaggagagcattcagtgtgatgtctgcattattggcggcggtttcaccggtctttcggcggcgctgcatctgaccgaggtgggctatgacgttgtcgtgctggaagcggcgcgggtcggctttggtgccagcgggcgtaacggcggtcaggtggtgaactcctacagccgcgacgtggatgtgattgaacagcgctacggtaaagagagcgcccgtatgctgggcagcatgatgtttgaaggcgctgaaatcatccgcgatcgcattaagcggtacgcgatcgactgcgattaccggcctggcggcgtttttgcggccctgaatgcacgtcagatggcgcatctgcgaaaacagaaagcgttatggcagcagtatgggaatcatgatctggaactactggatgagcgagccatccgccgtgaagtcgccaccgaaacgctacgttggcgggctgctggatcggcgcggcggccatctgcatccgctgaacctggcgctgggggaagcggaggcgatccgtcgacatggcggacgcatctatgaacagtccgcggcgaccagtgtggtttatggcacaccaaaccgggtaaaaaccgcccagggcgaggtcagcgcgacctttgcgatcttcgccgggaatgcctatctggccccgcagctggaaccgcgactgagcaggaaaagcatgccgtgcggatcgcagattgtggcaaccgaaccgctgtcaaccgaccaggcgttgtcgctgatgccgaacaactactgtgtggaagattgtaactatctgctggattacttccgtctgacggcggacaaccggctgctctatggcggcggcgtggtttatggcgcacgggaaccggccgatattgaagcgttgatccggcccaggttgcgccgcactttcccgcagttgcagaacgtgaagctggacttcagctggagcggcaatttcctgctgacgctgtcgcgcatgccgcagtttggccgactggagaagaatgtctattttatgcagggtgacagcggtcatggcgtaaccagtacgcatctttccggcaagctgatcagcgaagtgttacgcggcgacgccgagcgttttgatgccttcgcccgcctgcctcacctgccgtttcccggtgggcgacgatttaaggtgccgctgacggcgatgggcgcggtgtggtatgcgttgagggatcggttaggggtatgaacccgtgtaactaaaatcaaaacgacctttaagatcattggttatctaaattgtaactgcattagatagcttgagtctttattcaaccctgattatgggggttccccccccataactatgaatgtttaatgagtattgtcagtcattttgtatcccttccagacccactctttaccttgtgtaaattgatctttaagataatctggcatggcaaactcaggataaacatcgtgcttatccgttataaagaaactgtcaccatatgcgctgatattcgctacgggatggcaattgttgtcaaggagtgagcatcccataaaataatttttagcctttgctatttttaaaacattgagcaatgttggcgcaaaattcacactattctttccttcggcatcaatcacctgatgctgaacaccttcccaatacataagcaaaggaattttatcaataaaataattctttggagtatcaatgaccgaagtaaactctggagccgggaatgaggcatggtcagaagttagaacgaaaatggtgtttttcgacatcccactgtccttaagatatttaatataacgaccaacctgcgcatctaaattatggaatctattcagtgcaatacttcgtccatctttgtatttaatgtcagggctatcaatagtaagatgagtaccaaaattataaagaccaataaagaatggtgctttatcacttttggtttttttgattaggaaatcaataagtgctttatcacttaatggctctgtagaggaacctttaaactgcatatcatctgcacgtgtataaacgcggtcaaaacctagagatgccagcatagtattaaggttagcaccttgataatgaggactgatgaagtaggtgttataaccctcgtcacgcagaatatttggcagtgtagttaacttatttaatgtatgaagcactacctgtttcggatgacagttgatcaagacctttagctaatgaatctgtcccgcctatatattgataggtagatgtcaattgtcctcgcaatccccggaaagtggcagcagtatgattgtaatagtttttaaaaaccagagaagagttagctaattgatcaatattaggggtaagatctttgtatttaccaccataataatcaatgatatttgctgacataccttcgacaaagaaaactaccacattcggtttatgtggtattttactaaataactcttcatcctttccttctgacggatagatagtgtaatgtttaaattcattatatatcttttcacgctctgaaccattttctttcatagcatccagctttcggttcatctctatataattatgcattgttgtcacaatagaaagcaaaggcgaacgccattctgaaaaagaaggttcatgcctgacattcgcataaacaataccacaatatgataatatagccccaatactaactgctttagtgaattttttattaatatagcctgaattaggacgacaaattaaaaaaagaacaagaaaaacagcaaaaggaaaataacttgatgctgagatatttataaaatcagcggaatctctattccacagtgataaaacggttataaatgcaccagacttctgaacaaactgaagttgtaataatatgaaaaaagctaaaattacagaaataaacctaactatggaaaaatgtaattttgcaaacttgacaaataaaaaaagagttacttgaataaaaaagatctcaacaagtgttggaagtatataaaccactaaattatattgaacatacgtaactgatgcatatacagcaagtaacaaccacacaaaaccccagcgacaattgaacagaaaattcattttacaatcattattagttaagtaatttttagtattataatgcttatgagagttagtgtgaacccccataaacatcacgtatatacaaaatttttttagataggcattttaatcgggtcgtcatagcggtactcaaaaccgagttcgctacagatgcgggaaccatcaatcagcttgccgctattcttttccggctcgggtgcgaaactgcggcggctgcagcccaagctggtgcgtgaccgcaggatagaaggtgtcacgcgagggatgtttcgaggcacacagattgtagacccgtccccctttgggcgactgcaatagcagcgtgatcgcctccaccacatcatccagatgcaccagattcacgccctgcgagccattggccacatcctgcttgccggcgaggaagcgtcccggatggcgctttggtcctaccagaccggccagccgcacaatatctacgctggtgcctggcagatcgtgcagccagttctccagtttaaccagcgtctttccggccaccgtttctgcgtccagcgggctgttttcccgcttagcgccggcgctgctgccatagactgaggtggaactggtaaagataatgcgcggtaccttataaaccagcgccgtatcgaccacattctgcaccgcctgcagataggcttcgccaccttccgcagtgcggctggcgggcagtgtaacgatcagcgcatcgacgttgaatagcggctcaatatcggcggcatcacagagcagttccggcgtcagttccagctggaacgcctcaatgccgcagcggcgtgccgcgtctataccgtctggcgtggttttgctgccggtgacctgccagcctcgcgccgttaacgccgtggccagcggcatacccaaccagcccagtcccacaatcgcgaccttcttcattttgactcctgacgtgaaacatcaaccctgacttcaccgtagtttgcccccggattgcaaaccagaacaacctgtttcagcgctttccgaaccgcccgtttaaaaaagtgttgccaagcgcagccatcttcgctaggttaaaccccacaaatgaatactcattcatcgacgagattattatgacacgcgttcagttcaaccatcatcaccaccatcatcctgactagtctttcaggcgattggtgctggaagactttcaagatcttccagtggtgtgaacgcaagagaacccccggaagatcgtcttccgggggtttttttatgggctgacgtaaccacacattcaggaccgaattaagaggacaggaaccatgttagataacacccgtttacgcatagctatgcagaaatctggccgtttaagtgatgattcacgcgaactgctggcgcgctgcggcgttaaaatcaaccttcagcaacagcgcctgattgcgtttgcggagaacatgccgatcgacatcctgcgtgtgcgcgatgacgatattcctggcctggtgatggatggtgtggtcgatttaggcatcatcggcgagaacgtactggaagaagagctgctgtcgcgccgtgcccagggtgaagatccgcgctactttacgctgcgccgcctggacttcggcggttgccgtctgtcactggcgatggcgacagatgccgagtataccggcccggaatgcctggataaatcccgtatcgccacctcctatccgcacctgttaaaacaatacctcgacaaaaaaagcgtcagctttaagacctgtttactgaacggttccgtagaagtggcgacccgtgccggtctggctgatgccatctgcgacctggtctctaccggtgctacgctggaagccaatggcctgcgcgaagttgaagtaatctatcgttcaaaagcggtgctgatccagcgtgacggcgagatgcctgccgccaagcaggagctgatcgacaaaatgatgacccgtattcagggcgtgattaaagcgcgtgaatcgaagtacatcatgctgcacgcgccgagtgagcgtctggaagaagtgatcagcctgctgcctggcgcagagcgcccgaccgtgctgccgctggcaggcgatgtcagccgcgtggcgatgcacatggtcagcagcgaaaccctgttctgggaaactatggaaaaactgaaagcgctgggtgccagttcgattctggtgctgcctattgagaagatgatggagtaagccatggccttttctaccccgattgagtggcagcagtgcacccccgaaacagcagcaggcgctgctgttacgtcctgctatcgccgcctctgaaaacgtgacgctgacggtgcgcgatgtgctggagcaggtaaagctgaacggtgatgacgctctgcgccagttcagcgcccgcttcgacaaagcgcaggtggataacctgcgtgttaccgcgcagcaaatcgcagaagccagcttacgtctgagtgacgagctgaagcaggcgatggccgtcgcggtgggcaatatcgaaaccttccacaacgcgcagatcctgccgccggtggatgtggaaacccagccaggcgtacgctgccagcagattacccgtccggtgaaatcggtcggactctatattcctggtggttccgccccgctcttctccaccgtgctgatgctggcgaccccggcccgtatcgctggctgtggccgcgtggtgctctgttcgccgccgccgattgccgatgagatcctgtatgccgcccagctgtgcggcgtagaagaggtgttccaggtgggcggcgcgcaggccatcgccgcgatggccttcggcaccgaaaccgtgccacgcgtggataagatttttggcccgggcaacgcctgggtgacagaagcgaaacgtcaggtaagtcagcgactcgatggcgcggcgattgatatgccagcgggtccttctgaagtgctggtgattgcggatgaaggcgccacgcccgcgtttgtcgcgtctgatttgctctcacaggctgaacatggtcccgactcgcaggtcattctgctgacgccttcattgcccctggccgaggcggtcgcggtcgcggttgagcagcagctggcgcagttgccgcgggctgccacagcgcgtcaggcgctggaaagcagccgcctgatcgtggcgcgtgaccttgagcagtgtatcgcgatctctaatctctacggtccggagcacctgattctgcaaacccgccagccgcgcgatttggtggagtcgatcaccagcgccggttcggtatttttaggcgactggtcgccggagtccgcaggcgattacgcctctggcaccaatcacgtgttaccgacctacggttacacctcgacctgttccagcctgggcctggccgatttccagaaacgcatgacggtgcaggagctgacgccgcagggcttcctgaacctggccgccaccattgaaaccctggccgccgccgagcagctggatgcccataagaatgccgtcaccctgcgcgttgccgcactgaaggagcaagcatgagtcaggatattgagcagctggcgcgcgccaatgtgcgcgccctgacgccctatatgtcggcgcgtcgtctgggtggcaacggagatgtctggctcaatgccaacgagtttccgctgccggtgccgtttgagctgtcgcagcagacgctgaaccgctatccggaatgtcagcctaaactggtgattgagcgctacgctgcttatgcaggcttaacgccggagcaggtgctggtgagccgtggcgcagatgaagccatcgaactgatcatgcgtgccttctgtgagccgggtcaggatgcgattctgttctgtccaccgacctatggcatgtacagcgtcagcgccgaaaccatcggcattgaataccgcaccgtcccggccctgaccgactggcagctgaacctgcctgccattgcagagcagctggatggcgtcaaagtggtttacctctgcagcccgaacaacccgaccggcaacctgatcaatcaggaagacatccgtcagctgctggcaatgaccgccggtaaagcgctggtagtcgcagatgaagcctacattgagttctgcccgcaggcgaccctgaccggctggctgaaggattatccgcatctggtgatcctgcgtacgctttctaaagcctttgcgctggctggcctgcgttgcggctttgcgctggcgaataagccggtcatcgacctgctgatgaaggtcatcgcgccctacccgctggcgacaccggttgccgatgtcgccggtcaggcactgagcgaccagggaattgcgctgatgcgtgagcatgtggcacagctgaatgagaatcgtagctggctgcaggctgaactgactcagctggcctgcgttgagcaggttttctccagtgaaaccaactatgtgctggcgcgctttaccgattcaccaaaagtcttcaaaaccttatgggatcagggcattatcctgcgtgatcagaacaaaaatccgggcctgtcgggatgcctgcgcatctccattggcacgcgtgaagagtgcgaacgagtgatcgccgcgctgcaagccttttctgtggagcaagcatgagccagaagaccctttttattgaccgcgacggtacgttaatctctgagccgcctgaagattatcaggtggaccgcatggataagctggcgtttgagccagatgttatcccggcgctgctggcgctgcaggccgccggttatcgcctggtcatgatcactaaccaggatggtcttggcaccccgggtttcccgcaggccgatttcgatggtccgcacaatctgatgatgcagatcctgacctcgcagggcattgcgtttgacgatgtgctgatctgcccgcacatgccggacgatcactgcgactgtcgcaagccaaaaacccgaatggtggaagcctggctggccgaaggcgcgctggataccgccaacagctacgtgattggcgatcgcctgaccgatgttcagctggcggagaacatgggcatccagcctatccgctacggtgctgacggccagaactggcagactatccagcagcgtctgacccagcgtgaccgccatgcgctggtgcagcgcaacaccaaagagacacaggtgcgggtagaactgtggctggatcgcgaaggcggcagcaagattaataccggcgtgggtttcttcgaccacatgctggaccagattgccgtacacggcgggttccgcatgaacatcgaagtgaaaggcgatctctatattgacgatcaccacacggtggaagataccggtctggcactgggcgaagcgctgctgaaggcactgggcgacaagcgtggcataggccgtttcggctttgtgctgccgatggatgaatgtctggcgcgctgcgcgctggatatctccggccgtccgcacatcgagttcaaagcggagttcaactatcagcgcgtgggcgacctcagcaccgagatggtcgagcacttcttcagctcgctctcctacgccatgatgagcaccctgcatcttaaaactaaaggcaagaatgaccatcaccgcgtcgagagcctgtttaaagcctttggccgtacgctgcgtcaggcgatccgcgttgagggcaatacgctgccaagctcgaagggagtgctgtgatgaacgtggtgatcatggataccggttgcgccaacctgtcgtcggtgaaatgggcgattgaacgtctgggctacaccccggaagtgagccgcgatcccgatgtggtgctgcgtgccgataaactgtttctgcccggcgtaggcaccgcgcaggcggcaatgaatcagctggaagagcgtgacctgatcgatctggtcaaagcctgtacccagccggtgctggggatctgcctgggtatgcagctgctgggtcgaggcagcgatgaaaacggcggcgtgccgacgctggggattatcgatgagccggtgtcgttaatggacacgcacggcctgccgctgccacacatgggctggaaccagattaccgcgcaggcgggcaatcatctgttccgtggcatcgacgaaggctgctatttctacttcgtccacagctatgccatgccggtcaacgccagcaccatcgcacagtgtcactacggtgaagctttcaccgccgcggtgcagaaagataacttctttggcgtccagttccacccggaacgctcgggcaaagcgggcgcgcagctgctgaaaaacttcctggagatgtaatgattatccccgcgttagatttaattgacggcaaagtggttcgtctgcatcagggcgattatggacagcagcgcgattacggcagcgatccgctgccacgtctgcaggattacgttcgccagggcgcgaccgtgctgcatctggtggatttaaccggcgcgaaagatccggcgaaacgccagatcgcgctattgaaaaccctgctggatggcgttgatgtgacggtgcaggtcggtggcggcattcgcagccgtgacgatgttcatgcgctgcttgaagccggagcgagtcgtgtggtggtcggttccaccgcggtgaaacagcctgaagaggtaaaacggtggtttgcggaatttggcgcagaggcgattgtgctcgcgttagatgtgcgcattgatgccagtaaccgcaaagaagtggcaatcagtggctggcaggaagcggcgggtgtcacgctggaagaggtgattaccgactttcagcaggtgggcctgaagcacgtgctgtgcaccgacatttcccgcgacggcaccctgagcggctccaatgttgcgctctatcaggaagtgacggcgcgctttccgacgattgctttccagtcctcgggtggcattggcgacctcaatgatatcgccgccctgcgcggcagcggcgttcagggcgtgattgtcggacgtgcgctgctggaagataaattcactgtttcggaggcgatcgcatgctggcaaaacggataattccctgcctggacgtacgtgacggccaggtggtcaaaggcgtacagtttcgcaatcacgagatcatcggcgacatcgtaccgctggcgcagcgctatgctgccgaaggtgccgacgagctggtgttctatgatatcaccgcctcatccgatggccgggtcgtcgacaaaagctgggtgtcgcgggttgcggaagtgatcgatatcccgtttctgcgtcgcgggcggcattaaaaccccggaagacgcggcgcgcattctggagtttggcgcagataagatttcgattaactcgcccgcgctggccgatcccacgctcattacccgcctcgcagatcgttttggcgtgcagtgtattgtggtcgggatcgatacctggtttgatgaagccagtggtaaatatcaggtgaatcagtataccggtgacgaagcgcgcacccgcgtgacgcagtgggaaacgctggagtgggtgcaggaagtgcagaagctgggcgcaggcgagatcgtgctgaacatgatgaatcaggatggcgtgcgtaacggctatgacctggtgcagctgaagaaaatgcgtgaagtctgcaacgtcccccttatcgcctctggtggtgcaggcaccatgcagcacttcctggatgcgtttactgaagctaacgtggatggtgctttagccgcctcggtattccataagcagattattaatattggtgagctgaagagctttctgatcgacaacggagtggagattcgcgcgtgctaactgaacaacaacaggcccttctcgactgggataaaacacagggcatgatgccgatcattgtccagcacttcgtctcaggcgaagtgctgatgcatggctacatgaacccggccgcgctggagaaaacgctggcagaaggcaaggtcacctttttctcccgcaccaaaaatcgtttgtggaccaaaggcgaaacctccggcaactttttgcaggtcgtgagcatcacgcctgactgcgacaatgacaccctgttagtgctggcggatcctattggcccgacctgccatctgggcaccaccagctgcttctcaccggcggtccctgagtggacgttcctctatcagcttgagcagttgctggcttcgcgcaaaaccgccgatcctgaaagctcctacaccgcacgactctacgccagcggcaccaaacgcatcgcgcagaaagtgggtgaagaaggcgttgaaaccgcactggccgccacggtcaacgatcgggatgaactcaccaacgaagcttctgacctggtctatcacctgatggtgctgttgcaggatcaggatctcgacttccgcgccgtgattaacaacctgcgtgaccgccataagtaactgtgcaatatgctgctcagaatgccgtttttatgcggattctgagtagtcttcagctcattcctcacgtccatccggcacaatgacggcaactcaaacctcagggagagaaccgtgaccacccatgagaaattaatcgccctgctcgaccagcaccaggcacgctatcgcctgatggagcatgaggcgaccggtaaatgtgaagcggtcgcggcgatacgcggcaccgaaatcggccagggtgctaaagcgctggtctgtcatgtgaaaggcaacggcgttaaacagcatgtactggcggttttacctgccgatcatcaggccgatctgggtaaagtcgcggccgcggtcggaggaagacgcgcctcactcgccagtccggcggaaaccgatctgctgaccggctgcgtattcggggcgattccgccgttcagctttcatcccgacctcagactggttgttgaccccgcgctttttgaacgttatccggagatcgcctttaacgctggtctgctggaacgttcagtgatcctgaataccgaagattatcgcgcgttatgcgcggctgacgtggtgaagattacgcagtaattgccatcccggcagcccggcgatactctgcataatcactcatcacgacagaataagagcaaaatcatgaacattttcactcaacgcctgcgtcagacgctggctgtggcggttatggcaggctgcgcttttggcgcgcaggcaaaaatcgaacaggtgcgtttcgcggtcgatccgacctatccgccattcgaatcgaaaacgccacagggcaagctggtcggctttgatattgatctgggcaatgcgctttgtactcagatgcaggcaaaatgtgtctgggttgaaagccagtttgacggcatgatcccggcccttaaagcacgtaaatttgatgccattctgtccgacatgggcattaccgaagaacgcctgaagcagattgatttcaccgcgccactctatgacacccacacccagctgattgcccgtaaaggtgctggcatactgcccaccgttgaatccctgaaaggaaaaacggtcggcgtagaacagggaacggttcaggagcgttatgcgctggcaaaatggcagcctcacggtgtgaccgtagtgccttatggcgatcaggcacaggttgaaagcgatctggtttcaggccgactggatgcggtattcacagatgcggcacaggctgccatcggcttcctgaagcatccgcagggcaaagattttgaactggctggcccgattatacaggatccgatcatcggccccggcacggcgattggcctgcgtaaaggcgataccgagctgaaaaccgcactggataacgccttcttcgaaatcaaaaagaatggcacctttgaccagattcagaagcgctacttcgccacggatatctctatccagccttaacctcgcggtcgccctttttcatcctcaccgcgatccggcactatactctaactatttcgggacggcgcgctgtcgtcctttgccgattaaaggacattaacacggtatgcatcaacaacatcatccactgttaagcgcctctttaggcacccagcgtgaaatcatcagtttccatttcgcggaagacaacgagcgtcaggtctacatccaggctgcgctgcatggcgacgaactgcccggtatggcggtggcgtggtttttaaagcagcgactacaggcgctggagtccgccggtcaacttaaagccgcctttaccctggtgccggttgccaatcccctggcgctgggacagcactggcatggcacccatcttggccgattccatacgctctctggccaggacttcaaccgccgtttcccgtcactgggcgcaaccctggcggccgggctggctgagagtctgactcagagtgaaacgcaaaataagagcctgatccgcgaggcgattgatcgccactatcgcgataccgtgccaaaaaccgagctggatgcgcaacgccacacgctgatgcggatggccagtcaggccgatctgatgatcgatctgcactgtgactgggaagccgtgcctcacctgtacaccacgccgcacgcctggccggacattgagccgctggcgcgctggttaggcagtgaggtgcagctgctggcgcagatctctggcggtgaaccgtttgatgaagcctgttgcgaaccctggctgacgctggcggaacggtttggcaaagattatccgatgccacggggattgctgccggtgacgctggagttgcgcggtgtacgtgatgtatcgcctgaacaggcggagaaagacgcggaggcgattatttcagcgctacaggaaggcggttatatcggctacagcgagcctgcgatttccgtggaagtggcggcacccgtgatcggtggcgacgaaaactggtcccggcgagcgcgggcggagacgatatcgtggctatcaatgacggcccgattggtttaaacgtgccagatatcgctgaagcacctggagaagctggcgtcatcaaagagcgtcacagcgaaggatcggcggcggcctcccctgccctgaaaaatccacctacgccgttagcgggctgtgaatatattcattcgccggtatccggactgatcctgcatcgtaaaccgctgggcgcaaagattcggccgggagaagtggtggcggagattgttgacccgataactgaccagattacgccgctggtgacggaacatggcggtattctctatgcgagacactgggctaagtttgcgacggcaggcatgctggttgtgaggctggcaggtgagcgagagattcggagcggggatttgctggtaggataaaaaaagggcttcccgagggaagccctttttagtgattaatctaaccactcggtgtggaacacaccgtctttatcaatgcgcttgtaggtatgcgcaccgaagtagtcacgctgcgcctgaatcaggttagcaggcagcacttctgaacggtagctgtcgtagtaagcgatcgccgcagagaaggttggcgtcggaataccgttctgaatcgcgtaggaaaccacatcacgcagcgcctgctgatactgatcagcgatatctttgaagtacggtgccagcaacaggttagcgatgcctgcatcttctgcgtatgcatcagtaatcttctgcaggaactgggcacggatgatgcagccggcgcggaagatcttcgcgatttcaccgtaatgcagatcccagttgttctcttcagatgcggcacgcagctgtgagaagccctgagcataagagacgattttacccagatacagagcgcgacgaactttctcgatgaactccgctttgtcaccggtgaaggccttcgcctgtggaccgctcagtactttagaggctgccacacgctgggttttcagcgaggagaggtatcgagcgaacacagactcagtgatcagtgacagaggttcgccgagatccagtgagctctggctggtccatttaccggtgcctttgttcgctgcttcatccagaatcacatcaaccaggtatttaccttcttcgtctttcttggtgaagatatctttggtgatgtcgatcaggtagctgctcagttttcgccgttgttccactcagtgaaggtctcagccagctcttcgttgttcagacccagcgcgcctttcagcagagcgtaggcttctgcgatcagctgcatgtcgccatactcgatgccgttgtgaaccatcttcacatagtggcccgcgccgtccggaccgatgtaagccacacaggcttcgccatcttctgcacgtgcagcaattttatccagaatcggagcaaccagctcgtaggcttctttctgaccgccaggcatgatagatgggcctttcagtgcgccctcttcaccaccggaaacaccggtaccgatgaagttgaagccctggtcagaaagctctttgttacgacggatggtatctttgtagaaggtgttaccgccatcgatcagaatgtcgcctttatccaggtgtggagtcagggaggcgatagtcttatcggtcgcttcacccgcctgaaccatcagcaggatacgacgaggtttttccagcgattcgacaaactcttcaacggtgtaaaaaggagcaagtttcttgccctggttctcggcgatgacttcatcagtcttttcgcgtgaacggttaaagatagaaacagtgtaaccgcggctctcaatgttaagagccaggttgcggcccatcactgccatacctacaacgccgatctgttgcttggacatcttttactcctgttatataaaacgtaatgaatacgtttagaactatatatcacatagaagataataacttactgaatgagaagataaatagcatttggtgccattagttaaaatcttaacagtgcgctgacggcaattttatttagaaaaacttccatccatgtttattaaagaatttaaacatcgaatgtgagaaaaggagtatatgcttaagacctttcctggaaacattaccaccatggtggattattttcacatccggaacataagcaacctcagtaacctgacgagctcgtaaactcaggtctgtatcttcaaaatataagaaaaagtttttatcaaaaccattcagttgcaaaagaacgttatttctgaaaaacataaaacagccactaacactatctggctgccacaaaactgtctcagattgcgtttctttcatcatgcagtatgtttcaagtttacttttgaataaatgatggagtgattttggaagaaaagcgcgaagaaataatgtgaaaacatttggataacgcttgcaaagatattgcctatcgccatttctccaaaaagcctgcggtgataacaagccacaggctttatttttttccataaaaaccagagcattagacaaagagtcatctgtaaaaataacatcaggattaagaatcagatgataatcataatcttcagaaaaagtaacattatggccccgaccatagcccaggttttcaccacttatgatgatttcacaaaactggaattgttcaacaactttgttatgaagtggctttaattctttataaccgttttctacaatcacaaaatcgtaacgcagatgatcaatgtaagatgcggcctttttaaatgattcaagtaattcaagtatatcatcatcaatatagtaacaaacaattgaaactcgcaaagaaatctcacgtttcgggattgttggagtttatttcatttgtttgagaattattgactgtatcttccgtggatgccacgtaaaccatgcataactcccctgaaaatcatctttaactcgagcgacttgtttcgagatgcaataatgtaaaaggacatctttactattaatttaaatgcatctaccactttccagttaaaagggatgtagttacgcttgtataatagcaaagcatttcgagcctgatagtagtgtctgaggggagaatgaatagcaattgagttacttaaaaaattaactctttcatcgcctaacgtatgtgtcatatgggcgttacaagctccataactcttaaagcctttactcttagcccttaatgcccattcaacatccacataatcaataaagagcgtatcgtccatcaagccaactttttgaatactttcgacggatattaatgaaccagaagaaattagatgatcaacaataacacatccattatcatctggctgaagttctttatcaatctttaaccctctaatttggataaagcgtgaccgcacattgttatttacgtctaaaaattgtggtcccaccgctgcagcatctgggtatttaaccaaaacttcctgtaaggaagacaccatatcatttgcaggtaaactatcttgatccatcagtaatatatttttatatctattgatgatggcatggtttatacctatattttgagctgccgcaattcctaagttgctatcgcacaagataacttcaatgtgcttatcaaattcgaaagccatatttttcagtgcataattattatccgaagcattatcaacaataataatatcgacattactttttgacaatatattaacttgagacattaattgctcaagctgtggatgataagtaacaatgattgcgagggtgttatttggcatgtgattatctaataaaagggccaaaggcccttatttgatacagctgcgatagatatctttaagctcttcgtattgctcgccgaatgatcgtatgtgtgaatgaggcagttgtactacgtcagtttgtggcaaataggagaaatgcgctatggtttttttaacacattccagaagcgtgccaccatcattattaaaagggataataaacccattttcgccgggtataatatcttctacagcaccacccgcatctgaggtaataacccagacgtttctgattagcgcttcacgtacagtcaatccgaaactttctttagactgagttggatataaaagaacatcgatagaattgaaaaattcgtccatgttatcctgtgaaaaagcaggcacaacttcaacatttttcaatccggctagatcgctctcatggaaagacttaaaaccgaggttaagtgcattatcaacgattattaacttaccttcattttctgctatatgattaaatgcatattttattaagtgataaccttttatgtctgtatttcctcccgcataaccgaatcgtaatggtcggccaggaaactttaggcgaaatacactgaggataagtaactccatttttattaagcagagcttcagtaaaaccttctttacgataaagctcagtggtaaacatacttggagaaattatcttagtagcaagagatagtgcatctcttttcttcatttccagatagtccatttttgctggaatgttgccattcgtatcgtcactacttccacgggacttgtgatcttctttaaagctcaatataaattgatgctcatataaccaccaataatcatgtgtagttacaacgatggggatattacgttcagcgcatatccgtagcatagtaatgccaagcccttgaatagaatgataatgtacaatatctggtttaactagatccagtacatctgtaaacgctttatctatatcagggttaataacctgacggttttcagaaagtaagttgggcaaaactataccataacaatcctggccgtaggcttcgtatcgtcgaagagtattagcagcaccatattcttctggtaaagaagttaatatatgaatattaaattctttatcattaacgaaggatttattcaaagcctctgctacaacagtcgctccaccaaaagaacgtggattataatagcaattgacagagagaacatgcttaaccttattattatttaaacgttcaaaatccttaataattatggaagcttgttcacgggcaatgctttcaggtgaatagtgtttcaaaacagactttttagcgttttcaccgacattctttcgtaataaaggatcttcaataagcatcttaaatgatgcctcccattcttctgtgtcataacagagaaaaccattcactccattttctattacggaaataaagtttggacgaggagagcaaacacttggcaaacctaagattgaagcttccagatacttaatatttgattttgagtcgttgaaaatataattttcaagtggcgcaatactaatatcacactcagcaaggatccttaaataatctgcataaggacaaaatcctattctttctatttgattttttactttatcaaacttgtcaggtagtttctaacatacccgctaaacgtaaatgaacattaggagaagaaacaagaatattatagatggcatctgaagcttctagaaagtctacattatgagtacttgttccagacccatagacaatacgaattataccatcagtttcactttttcttatttctgggatagatcctgctgtttcaattgtttcaggatcaagcgcattttcaatgactattgatttactagctcctgattttaacatagcttcttccagaggctcagtcgatgcaatgacgcctttacaacgcatcattgcatcatggtataacctggcaccatctattaaccctttaaaggtttctttatcaagctcatttaacgttttacttttaagaagtatgtcttcatcgaatatcagatcatcgacttcccagtatgtttctaaatttaaacgtttacactcatcaaagagtgtcatcactgtttcaaacgcaggtacacgataaaaaatgattatcgaatgatactgtaaagcctccatacaaccaattaagtcggtccaattcagagttttgacaggaattcctagctgtttaaataaatcgactttctgatctacacgatatttcttacactgaggaatagacatttcagcaataataagtactcgtggtaagagcaaagattcgttatttaacattacagctgggagagttttagctgataaaacagtttgtgacgcggattgtaagttattaatatgatatatcttgcgaacaatccctttaagcccattctttttatatagagaaagtgttcgattcacacttccttttatgccataactagagaccacactttttgcaactttagccgctttcttaacgcgacgcgcgttaagaactgcctttctcataggcgcagtaattttccagctagtggaggtcagcagagcattattttcaaaggataatctatttgctagctcagactgattgtttagttgcgccttaagatcgtcaatttcagttcgtagtacatcttcaattcttttataaagattaatttgccttgcgcttacagataactgatcggataagctggtattctgagtaacaagttctttccactccatttccggaaagacacttaggttactccatgggttttctgtttgtttctggcgctttaaatacgctgccatttaactcgagattaccaactactacttcttcatcctcaccaacaacgtgacgtagacctaataaattctcttttctggatttttttgtaattatacataatgaatttatgaaagtgacggagtgaatctctgaataatcaacattatctagttctgcactatcataatgtttaaataatgaagagaggtaatctgaagcagaacgctcaataccccagtgttcaaaattggtaatatcagcaagtttttttaaaaaggccatagaagaatatgggtcataaagtcctccttcccattcttgccagtaactacagtgtaggtcttcaacaatataaacaccatcctgctccagtatagggaagtaaagtaaaaaagactttattatgtctgatgaattgtgcgaaccatcatctattatcaagttatatgaaggggtaatttcactaattttatttttaatttctaatgtagaagagttcccgatcaaaactttaatcgatttattttcgtattcaagacgagcacaatcaggattaatatcacaacccactatgttttcagcatttggaaaatatttactccatatttccaaagacccgccattctggacaccaatttcaagaagattttttagagttttttgttgtctggaaaggatattatgataagtttcaagataaatatcccatttatcggatgatttaccatgatgctcctgatagagctcttttaaatttttcattcttgtctcagcttaactttatcaaatttaattccaaccagtccccagcgtacttcactggatgatacattaatgatcatagcatcatgaagccagtgatgctgaacatgattattcaaatctccgtttgcaagggagaccattagtgcatattcaccattaggtagcattggcaatgtaaattcaaatgtggcatgaatcttactatccgcagaagcaaccaacggtttttcagtagtgaagggtaacgtattttctccaaataatacctgccccaaacggtcctttactaaaaaaccaataattggcgagtcaagatcctgataaatgttagccctgacagataactcaactttttcgcctcctttaaagagattcttacttttatgatctttattgataaatgacacatctgttatttctgcagcacctgttttccatccattagcttcagaaaggttgttagcaatcccatattgaaccttataatcgatagctggggtttcatttaattctttaggggttaaatgcttgtcgttttcttctaatgttgcttcattatcttgtttgatactttcgagatgtgtttcatctccataaacttcctgcagagtatattgcagatatttttctgcaacttgcttcgccgttcctgaagttatcatttcacctttgtgtagccagatagctttatcacacaggttaatgacagagttagtatcgtggctaacgaaaagtaatgttccattttctttaaattttcgtataaatcgcatgcatttctgtgtaaaaactgcatcacctacggcaagcgcttcatcgataaccaatatgtctgcatctacatgtgcgatgacagcaaatgcaagacgcacatacataccacttgaataggacttaaccggttgatctatataatcaccaatatcagcaaaggctaatattttttcatatcgatcgcggatctgttcattggttaatccgtatagcgacgctgccatgaacacattttcatgcccggtaaactcagggttaaagcccgcaccaagtttcgagcaatgcagcaatacgtccattgactgttacactgccattcgtcggagtcagtgttccacatatcatctgcagcagcgtcgatttccccgatccattccgtccgatgatgcctactgtttctccctttttgagggaaaatgttacatctcgaagcgcccagaattctcgatacatttttttatgcgatctatagaacatctgcataagacgatgctgaggtgattcataaatctgataacatttactcaacccagcgacttcaatgatattatcagatgacatcagcaaatcctttacgtgttttctgaaaccacaaatatcctaaccatgccagaattgcatttataatcaatcctttaatataagggattatttcaggaacttttccccaatacataacatcacgcgtttgctcgataaaatgggctaacggatttaaagataaaagcggtcttactgaatctggcagtgccgaagtagggaaaaagataggtgataagaacattaaaaccatcgttaaaatcccgacgatttgactcacatctcttaggtataccccaagtgaagctagtatccaactgatgcccattatcataaacatcagaggaagcaaaataaagggtaacagcagacttgttaaatgtggcatcccgacttcaaatacataaaatgttatccatacaatgcaactgatcgcaaaatgaaacaatgcagcgcaaagatttacccatggcaatatttctaaggggaagataaccttttttacatagtttgaattggcaagaatgatgccaggcgcccggtttatgcattccgaaaataaattaaaaattattaatccggaaaataacagtaacgcaaaagacgatttagaagtatgaccttcactccacttggcctgaaacactacgctaaaaataaacgtataaacgactaacatcaatacaggagtgaaaaacgaccataacaaacccaatactgagccccgatagcggctaataacttctcttctagtcagtgtatagatcaatcttcgattagacaccggcgatttaacacattgccaagtcattttaagaagcgaattcattcaaagacctcagctccggaaaataaagaagcaagcttatctttttctgatagcaggacctcatttttcggccactcaatattgattgaaggatcgttccagacaatgctacgctcattctcttttgaataaaagttagtggttttataaacaaattcagtattatcaatgagtgttaaaaatccatgtgcaaaaccttctggtatccataattgccttttattttcactgctaagttcaacaccaatccattgaccaaaaaacggagattgcttgcgtatatcaaccgctacgtcaaacacagctcccgcaacacaacgtactagtttaccttgcgcataaggattaagttgatagtgcaaaccgcgcaaaacacctttgcttgattttgaatggttgtcctgtacaaaatcaacatgcctgccgacagcttcatcaaattttttctgactaaagctttcaaaaaagaacccacgttcatcgccaaacacagcaggctcaaaaattttaacatcaggaattttagtgtcgatgattttcattataaacgcccttccaccagcgccatcaaatatttgccatattcgtttttaagatacggcttagcaagttcctgtaattgcgctttatcaataaaacccattctgaaggcaatttcttccggacaagctactttcaggccctgtcgtgattctatagtctgaataaagttgttcgcttccatcagactctgatgcgtaccggtatcaagccaggcatgaccgcggcccatgattgatacagaaagtttgccttgctccatgtagatacggttaatgtccgtaatctcgagttcaccacgaggtgaaggctgcaggtttttcgccatttccacaacactgttgtcgtaaaaatagagcccagtaacagcataattactgcgagggttcttaggtttttccaccagcgaaatagctttaccctccttatcaaattctacaacaccataacgctcaggatcggtaacgtgataagcaaagacggtagcgccatcatccttcaatgacgcagcttcaagctgcttgtagaggtcatgaccgtagaaaatattgtcgccgaggataagtgcgactgaatcatcaccgatgaactcttcaccaatgatgaacgcctgagccaggccatccggactcggttgcactttgtactgaattgagatgccccactgagagccatcacccagcaggctttcaaagcgcggagtgtcctgcggcgtgctgatgatcagaatatcgttgatccctgcgagcatcagagtactcagcggatagtagatcattggtttatcatataccgggagcaattgcttactgactgccatagttaccggatagaggcgcgttcctgagccaccagcgagaataatacctttattctttttcacaatttcacctttatgaacaggcagcttttgctacctgtttaaattatttaagagtttcaagcaacatacgttcaacacccaatttccagtcaggcagggtcaaaccaaacgtatgttgaaacttctcagtattgagccgggaatttgaaggacgtctggcaggtgtagggaatgcacttgttggcacaggattaatcacctgaacattaagctcaacaccctgcattttagcaaagtcgattacgctcttagcataagcatgccaggtcgtctcacctgctgcaatcagatggtagatgccagcaactgcattattattcaatgccactctgattgcatgtgcagtactgtctgcgattagttcagcgccagttggcgcaccaaactgatcattaatcactgacaatgaatcccgatctttagcaagcttcagcatcgtcttagcaaagttattaccctttgcagcatagacccaactggttcgaaaaataaggtacttcgtcatggtgcggacgattgcctgctccccttccagcttagtctgtccatagacattcaacggagctgttgcatcatcttcacaccaggcacgatcgcctgaaccgtcaaaaacataatcggtagagtaatggaccaaccacgcgccgatttcctcagcggcctctgccagtgacttcatcgaagtggcgttaaccaggcgagccttatcctgctctgattcagctttatcaacagcggtgtaagctgtcgcgttcacgattacagctggttttatcctgcgaaccgtctcagccagcccctttgggttttcaaaatcgccacaatagtcagtagactgacgatcgaccacaatcaaattgcccaatggcgccagcgcacgctgtaattcccagccgacctggccgtttttaccaaaaaggagaatatccattagctacgtttctcgtaattttcttcgatccagttctggtacgcaccactcttcacatgctccacccactgtgaattattaaggtaccactcaacggttttcttcaggcccgtttcaaacgtctcttccggtttccagcccaaatccttttcaatcttagcggcatcaatcgcgtagcgacgatcgtgtcccgggcggtcctgaacataggtaatttgatcactgtacggggtcgcttttggacgcagttgatccagcagttcgcaaaccttcatcacaacatcgatatttttcttttcgttgtgtccgccaatgttataggtggtgccagtcttcgcatttttaactacggtgtatagcgcgcgcgcgtggtcttcaacatacagccagtcacgaatctgatcgcctttaccgtagataggtagtggtttgccttccagcgcattactaataatcagtgggatcagtttttccgggaaatgataaggaccatagttgttcgagcagttggtgacaatcaccggtagcttgtaagtgcggccccaggcgcgaaccagatgatcgctggcagccttggtagaagaataagggctgctgggtgcataaggcgtttcctcggtgaacagagggaggtcgccatccatttcatccggatgaggtaagtcaccataaacttcatccgttgagatatgatgaaaacggaatgccgctttacgttcttcaggtaacgcgctccagtattgacgggttgcttctaacagagcgtaagtgcctaccacgttagtctgaacaaattcagccgggccggtgattgaacggtctacgtggctttctgcagccagatgcatgatggcatccggttgaaactcatttaaagccttagtgatagcctgaccgtcgcagatatcgatctgtttaaaggtatagcgtggattgctgctcacctctttaagagactcaagattgcctgcataggttagtttatcaacgttaatgacttcatcgttcgtattgttgataacatgacgcacaaccgctgaaccgataaaacctgcaccaccagtgataagaatcttcataacgtatttattcctgacaagctatctgaggcatgggtgcccgaataaaaagcagacaatcataggcgttttaagagcacgctaccgcccctgggttacagctcccacgatgctgattatctttgaccgaatgagtatgctgacaacatgaatccgccagatgttcagcattcagttgattgatatcactttattaatgaaattgtttaagtgggtttatcattcaacaatcgtaaattctatcactcaggtatagctattacgaataaaatgcgtttatgtcgcaggtgttagttcaactaatgagcacttttgtggcgcaggagatggttgctgatgcctcagggtgatgcaatcagaattatgagaaaggtctgataagatatttcaaatcaaatataagaaaggcgaacctgagttcgccttttttcaactaccgaaacccatccgggttcttgctctgccagttccacgtatcgcgcatcatctcatcgatgccgcgcgtcacgcgccagtcgagcgtggtgtttgccagtgacgcatcggcccagaaacgcaggcaggtcgccatcgcgacgtggcttgatctcaaacgggatcgccttaccggacgccttctcaaacgctttgatcatctccagcaccgagacgcctttgccgccgcccaggttaaaggcggtgtagccctcaactttgctcagataatccagtgctttcagatgcccttccgccaggtcaacgacatggatgtagtcacgcagacaggtgccgtctggcgtatcgtaatcaccgccaaacacgcccagcttctccagacggccaatcgcaacctgtgcaatgtacggcagcaggttgtttgggatgcccgccggatcttcaccgatttcgcctgactcatgcgcgccaaccggattgaagtaacgcagcgcaatcgccttgaacttcggctccgctttggcgaagtcgcgcatcacgaattcggtcatcagcttagaggtgccgtatggactggtggtgccgccaatcggggtggtctcaacgtaaggaaccggggcatctgcgccataaacggttgctgatgagctgaagataaagttccagacgccggcatcacgcatctcttccagcagcaccacggtgcccgcgacgttgttctcgtagtactccagcggcatacgcgtagattcaccgacggctttaagcgcagcaaagtggatcacggctgaaatgctgttggatgcaaacaggtcacgcagacaggcgcgatcacggatatcgccttcaacgaaggtcgcttttttgcctgccagtttctcaacgcggttaatcgcttcgcgtgaggcattgcagaggttatccagaaccacaacatcatcaccgcgctgcaacagcgccagtaccgtatgggagccgatatatcctgctccgcccgtgactaaaattgccatgtgagctcctttcaatctgccgcgcagggcgcgacaaataaattactgttgttttgcgaggatggtctggatagcttcgcggaaatcgcgaccctgcgcgttgctgcgcaggccgtaagagacaaacgcctgcatgtaaccgagcttacgaccgcagtcaaaactgtgaccggtcagcagcgaaacatcaacggttttatgtttgctcaggctggcgatggcatcggtcagctggatacggccccacgcgcctggctcagtgcgctccagtttcggcccagatatcagcagaaaggacatagcggcctaccgcagccaggtcagagttcagtccggcggtatcttcaggcttctcaacgaaatcggtaatggtgctgatatcgccagggtgatcaatcggctctgcagtggtgattaccgagtactcagtgagattggacgctggcatatgctgcgccaggacctggctgtggccggtctcttcaaaacgggcaaccattgctgcgagattgtaacgcatgtggtcagcggtggagtcatccagcaggacgtctggcagcacgaccacaaacggattatcaccgatcatcggacgggcacagagaatcgagtggcccagacccagcggctgcgcctggcgcacgttcatgatagtcacgcctggcgggcagatagactgcacttcgctcagcagctgacgcttcacgcgcgcttcaagcagcgcttcgagctcataggtggtgtcgaaatggttttctacggcatttttcgatgcatgcgtgaccagcacaatctctttaatacccgcggcaacacactcgtcaatgatgtactggatcatcggtttgtcgacgacaggcagcatctctttcggaatggctttagtcgcagggagcatatgcataccgaggcccgcaaccgggattactgctttaagcttggtcatatttattccgtttaataaaatgaagatgtgggtcgattatgcaggatcggccggaagagcaagtataatctttatctgaaaatcggacagtaactctctgtcataacttggaaattcggcattttgcccattgccagcaacggcataaactgaataaagacaatcagtaatcgaatatcgcctctgttatttccacccctggtcgccgcgcggctgagaccagccataaatgaaaacgggcgaccctgaggccgcccgttgatataacgcaattgtgattacaaccagccttcaaaccactctggcatcacaaacagattaaagtgattgaccagcaacattatgccgacaaatactaccgacaccgccacccactgtcgggcataagggataaaccgaatgccaatcaccggcttgataaagaatggatgagccagtgccgagatcagaatctgcgagatggagagcgtcagcgccacatagagcacgttcggccagataaaggtggttgccagcaccgccagaaccacaatactcgccacgatgttccagtagaaactcaacgttggtccgtccattggcctgggaaattgccccggtcagtccgcccatcggccgcagcataccaaacagcagcatcagcggaatcagatgatagacctgctcgtgggatgcgccgtagagcacacgaacgataaccggcgagaagatgccaatcaccaggtacatcgcgctgctgaacagcatgatccccagcgtgcctttgaggaacagcttcttcagctgctcggcatcgtgctgcttctctgcaaagcgcggcagtgccagtcggttaatcaccggcgtcaccagcttcagcggttgcagcaccagctctttcgccagcgagtagacgcccagcatctctgcgcccatcactttaccgaccaccagcgcatcggcctgggttcgcagctggttaatggtctgcgagccgagctgataactgccgtagcgaatcgcgccaataaaagtcgctttatcgaactcccaggtcggacgccacgacttctcacccagcgcaatcatgcagaggatgcgggtaaaggcgttgataaacagaccaagaatcgccgccgctacggtgagcgaggtgaactccagcatcgccaccacacagaggaaggcaaacagcttggtgcccatctcaatcttcgccagcgaaaccatccgcttggttttgatgtagtgcgcctgatactgcgacagatgccccagcaccaggaagttgaggctggtcagcatgatcagacccaccagctccggcaggtgatagaaccaggagaccgggaaggcgatcagcagcatgatcaggccagtacacaagctgagtgagacgttcacccagtagatagtgctctgctcacgacgggtaatgttctggcgatgcaccagataactgctcatccccatatcctgcagcacacccgccaccgccaggatggcgttgatgatggctaacagacccagctcgtgggtttccagtttgcgggcgagaaagcttagctgtgcaacctgcagcactgccgagaagcaggtgctgccgaacagccaaatcgcctgtgacttaaatccactcacaccagtcgctccagaatctgtgccagttcgccgtaggcgatatgctgattaaattcagtctcaactttgtgacgggcggccgcgaccacgggcgccacatccacttcaccctgagagagcttcagcagcgtctccgccagcgcctcaggatcgtcctcttccaccaaccagccagatacgttgttctcgatcagctccggaatgccgctgtggaaggttgagaccaccggcaggccgaccgccatcgcctccatcagtgcaaccggaataccttccatatcgccatctgcggcggttttggagggcagcaggaagatgtcagcctcactcagcgcgcgacggatctcctcctgcggtttaaagcccggcatgctgacgcaatcttccattccctcgcgggcgatgaaatcacgcatcatctcatcctgatcgccgttaccgataatggtgtactgaaactgaccgccacgctgcttcaggatggcgctggctttgaccgccacatccagccctttcttctcggtcagacgtgccaccgaaacgatacgcagcggcgtctgaaacgcctggcgcggctggaagttaaacttctccggctcaatgcccatacgcgtaacgtgaattttttccggcgggcagcccatctcaatcagcttgttcttccacagattgctgataggcagcatcagctcactctggcggaacagattcacatagtcgagtttgtgctcttccagaatgtgacgacgggaaatatcggcgccgtgaaacacggtcgcctgtttacccttgagcacgcccagctcacgcagcttgttcgccagcgcaccggcatagccgaaatgcaccaggaaaacatctgcggtgaaggtctgtttagcattcgccacaatcgacggcagcagcagtttgctggactgtgcgccataacggcgcacattcagcgaacgcagcagcgacggcttcgtcacttttggcagcaccagcttgatgcgctggttcagcttatcgacaatcgagatcttctcttccggcagcagataatgcgtcttcgccgccagaccatactcatcaaaagcggcatgccggttcactaaatcgccgggaaagactgaaataatctccacctcgtaaccggcatcaataaagtgggttacctgatttaatacgaatgtctcagaggcaaccgggaaacgcatggtgaaaaaagtcagtttcatcacattaccctaatactttgagaatctcttcagtgatccggttgccaatttccctttcattcgcaacggccgtgtcgaccttgagcttgatgttgtcgtaatcggcaagcacagttttcaccttgtcgattagcgagccatccatcaggcttttcacatcggttgccatctgcggcagaccaagctggttcatcacacccatcgacttgtgctcgtagttgatcgccacagccggggtgccaaagttcatggagataatcgccgagtgcaggcgggtaccaatggtcagatgacaatgattcagcaggatgcccagttccaggtcattaaactcatccataatgacatggtaatgttcaggctgcgtcacgtggtcacgcagggtcagtgcaaccatgcggtcatctttggcatagctgtcgatgccggtacaggttgagaaacgccacaacctgatagccttcagcaatcatggcattgatcacccggccaaatgccgcttcatactctttctgcgtcacacccagacgtttatcaaaaggtgccagttcacgcacggtgatcgcgatggttttacggccatcgataatgccctgccagtagagcaggttatggctcggattttcgacttcgcgtgcccgcaccaggaaagcggtatcaacgccagacgcgactttagaactggtcacgccatcgcgcttcatcaggtcaagactgaccgattcacgcagcaccaggctgtcgacccgatcaaagacaaagtttgccagcgcattgacgcgcgggttctggaacggccccaccgagtgaccgatcaggtagatcggctttttcgccatcagtgcacagagggcatggtcaaactgggtcacaccatagaggtcaacgaagaacgatccgccaacctgaataatcgcatcatattttgccaggctgtcagtaaacgccttcaggtgcgggggtacagcgaacgacttaaagatcccgcccttgcccagatgcgccatcatgatatcaggcatcaggcggttcgcgactttacgcttgaacgaaccgaccagacctttgcctgatttgctgttgtgcagatacagcgcatcctgcttaatatcctgctgaagcagataaccggagctggttggataacggcttataacatcaatttctaaatcactgcgtgcagacttcattgaatcaatcagtccacgaagaatcgcgccatccccgcgatttccacacgtatggttacccaccaataaaattttcataacaactccgaatgaatttttttaattctgtaagccgcccagatccgcaatgggcaaaatgaactctgtttaaagtaatgctttacgggataacgcacccaaaggtagtgctcctgttaaaaccggccgcctccattgtggcggccgtgatgcaaggtgttacgacttgattgcgaagtaaggcagtgcgacctgtttgccgttgatcacgacggaaacaaaaccttctggcttgctggtatcgacctgatcggcggagagcggacgcgaagccatcagcaggtcgccctgctcattagcgcccacgcccgctttgccgttgtgcaggctgaagcgctgcggcgcgcgtttagtcgcgtcgcccgccggaggattgcccttctccatcttcgcgttaacgcgcgcacagcgaccggtgacaaagcgatctttaccggtggttttcaccagcacggccaccgacggcgtccagcccgccagtttgacgaagatgcggacatcggtgtcatgctcagccacatagcgcacatcgacaatcgggctgctgccttcggccgaccagctcgcttcagagcgatcttttttgcgctgtacgtggatcatcgcgcggccaccggtggtcttgtcaccgatcaggtccatcagcggcttatcgccactgccgttactgaactgcgactgaccaaaaatttcgatctcccacgaatcacccacggtcggggagtagaggctgccgagatcaaaccaggtttcctgattcgtgttgttctctaaacgccagcgcgaggtgatgtagttgtacttcaggctgccatcgagcgcgacgccataggactccacgcgggtcgatcccatctcccagatgctgagcagacggtcgccctgcatggagttgtcgatccaactgcccgactgcaggctggtctgccgcatattcaggcgcgtgttatgcgcgatcagcggattcttacaatcttccaggctcagcgcatcgacaatccactggccgttggagagatcgcctggattatcacagtgctcaatccagccgttatggataatcgactggccgcagcgcggcagattgaggactttgccaccacgacagtactgcgcattgaagttcgacagctcaatcgcggtgctgtggtcccatttgccctgcttctgacctgaccagcccgatttgatcacatcgccgctgcagcgtgaggcgtaccactggtcgattttacaatccagagtatcctgcaggctgatggcggtgccgccaactgcgttaaagcgcaggcaggcaccacggaaatattgtccgccagggcagttgttatggaaaaagccctgcttgttggggcttttatcgctgttgccgttaaaattcaggttggaaagctcaacccgacgggcattcatctcaaagacgaactctgacttaccatcggagacaatcgtggtcgccgggaagtagccgaagtttaccatcgcaccggacatgcggaagaagttgagatacttatcgccaaggttacaggctgagaccatgaaggtaccggccgggaaactggacacagatctgctggtttgcctgctgtgaccactggaacatcgccataatggcaggtgccgtatcggttttgccatcggcaatcgcaccgaaatcaaacagggtcaggcggttaaaatcgtctaccacgcgacgccaggaaaagccctcaccggcaaagttcacgccgccatcattctgcgcaggctggaagctgccaacaaactcgccgccgccgacttcccgtccttcatgccagcttttcagcttaaccttggccccttcaaacagcggacgggttttgcgtaactccgctacggacgggatctcaccaatcagctgataacccgctggctgcgccagacgctggctgaaatctgcagcgcccggacggctgacatccgcgatgttaaacagcgtctgaccattgctgtcttcaactgccatcgaatgcgacggattggcaatcagcgcagcattgtcctgaataaactgggcaaagttacctttgttcagcgcgataggctgagcaatctccgacactttgccgctggcatcacgcaggaagaccgggatctggttgcccggtttgctggcatctgcacctgctttaccaatccagagtttgccttcaaaaccctgccagaactgcggtggcatggcgtagacattttccggggtcagaattggcacgtcgcctttaggcacgtcagtggcatcaaccggcttcagggcgataccgttactttttgcagcgtagctggaaaaggtgctcacggagagagcccccaccagagcggaggcggcggtctgtaaaacttctcttcttttcatgcatcaattcccgtagtcaataaggccattggccatggcggtgtccctgaggcacgtcgcaagtgagcttttccagctccggttaaaccagtgacagccagctttgcttaatctgattaccgtcgaatttcagcgcggtctgtttcgttttttcgctcatggcatagaacagcgcgtcatcgctggcgagctgctccattcgggccagaaacgtggctttgtcgttcatcggaaccaggaaaccatcttcaccgtgattgatgatctcctgtggaccggtcgggcagtcatatgccactaccggcagtgaccaggattttgcttccagcagcaccagtggcaatccttcgtagcgcgaggtcatcagcgccatatcgctgtcgcgatagtagtcgttgatattgctgaccttaccgacaaacttcacgctgtcggtgatgcccagcaccgccgcctggtcatgcaactgttgacgcagttcaccgtcaccggcaatcaccagcgtccagtcaggatggctgcgggcgaagtcgcgccagatatccagcatcaggtcaaagcccttctggttatccagtcggccaactgccagcgcctggcgatgacgtgtctggcgctgatagtctttgtaaaccaccgggttggggatttgcttgctgggaatgcgccagcggctgaacacctgatgatctttgtcggtcagaacaatcacgcggtcgtagtagcgcagcagcagaaacttgaggaacttaatcggtttgctgaaggagttaatggcgatgtgttcgcaggcgtaggctttgccccgcttcttcttcatcgccagcagattccagaaagcgaacatcacgctcaggcgacccatgctgatcaggaagacggtatcgaaaccctcttcgtgaatccgggcaaccgcgcttttgatcggattgctctgcccttcaaagctgacgatctgtttgacgtgctcaaacgggtaaaaggtttttccactgccttccagcgagtagatggtgacttcatgggtctcgccaagacactctgacatgaagttacagatgttctcggtgcccgcatacgaataagcatctttgatcaccaggacaatttttttcatgaaacgctatccacctcaaattttaaagacaatcctgccgacaggcttaacgatgcttaagggtaaacagcacaccattcaccatataccaggcgtaatagtaatagatttttaaaggattgtttttatagataattcttaataattcaaggtgccactgggccgctttgttcttattacgggaaagggaatcgcctaattcgtaatagttgaccagaatcgtctgaattacgcgtgcctgcttatagcgggtgaataattcatacaaaaacaggaaatcttcgtggcctttgcgctggaagaaaagcccctgcggcgggcggcggaaacagacggaggagaagcagacgcgatactgcttcttcacaaagttttcctgctgcaggtaaggtttgccgtaggtaatgtcgtgctcagccttgcgggttttatagtgatattcggtaatcacaaaatcatcaccggccgcgatggcagcgacctgctgggtcagcttatccgcatgccactcatcgtcgctgtcgagaaaggcgataatctcttcagtggccgcgcgcagcccgacgttacgggtttctgctgcgcccatgttgaccgcgttatccagaatggtaatgcgcggatcctgacaatgctcacgcacaaattccagcgagtcatcggtcgatttatcgttgaccagatagagatgccagtcggtatagtgctgattgataaccgattgcaccgcgcgtaacaccgtctgacgtgcattatacataggcatgacaatgccaacggttccaacagaagtattcatcttcaaccctgaattaatcgtaaaaagagtcgctcctggcatcaggagcagagcgaggcgcggcgcgcgtcaggagatcgctttctcaccgccgaaacgtgctctgaccttgtctttaacccggttcatgaaataagcacggttgtctttgttggtgaggaagaagtagcgcgcgaagctcaggctcgccatcagcgacttaccatccatcttgtagcgcagcggcagcttaaaagctttgtaggtgtggatatcacgcggggtaagatgcggcttcatgctatcgagccagaacatcgagtagttcaccgattcgcctttgtgtttcgagccaaacttagtgaccaggtggtagtttcgccagcggtgcagcgatcatcacaaagtcatagcccatgcggtcggcacgtatgcagaaatcatagtcctgatgacggatgtagcgggtatcgaactgaattttcgccgcgtcttcccgcttaagcacaatggtgctggtctggataaagccgtagcagccgaacagatactccgcgaccgtttcatttttgcctggcggctgcatcggcatcactttcaggaacgtgccatcctgatagatattcacctggctgaaaatgacgaaattctttttgccctgcgcgtccagctgagcaattttttcgctcacctgctgcagtttgtccgccgcccactcatcatcggcgtcaaggaagctgacgtagtcaccggtcgccagctcaatgcctttgttacgtgcaccggctccgttgagtttgacctcggagagcaccagattgatatcgagatcccggtagcgttcgctgcgcaccacatccgccagcgcggcggcatccgcagatttatcatcaacgatgatgacttcgaaattgcgatacgtttgtgctttaacgcaatccagcgtcgtgacaatcgattctgacgcgttataagccggaattacgatggagaaacgaatgtccttcattgccagcacctcattaaagtagttcaaaaataaacagttcattcgacaacggtcgatgaaaaacctgtgttctgaccggcgaccgcccctgggtgaaactcgtcatccagaggcggtcgtcagattgattagtggatcagccaaaactcccgcgccacttcataaccggtaacggcctgtttggttgaaatggtgttgtagtagaggtaatagagcaggaagaacaccagcatggcatacagcgctggcttccaggatcgccttgcctgataaatcagcgaggtcaggatgatcggctcaacctgctgcagatagttggacaggcgcgaacctgacgggaagttgtacaggaagatcctgatcgccccgccgatggcaaaacttaaaatcagcagatagttaaggcgatactgggcgtaattctcgcgcttcagcttatcggtcagcatgaaatagaagaagacgaacaccagcatgatgtttttcaggttcgatacggccaggatgctgccacccattgcataggaggggtcattgttatagcccgatgccctctctcccagcgatcccagatgaccggcaatcagggcaataaagcccgagccacccacaaccgatagcggcagactggcaacgatgataatgaccggccaccagcgccagtcccggataaacaggaacggcacaagcgtcaccaccatgacaccggtgttatggctcgtgaacgacagaataaagaaggcaaatgcccaccagtagcgcttgagatagatcgaccagagaacgccaaggaacagcgcagaaactcaggccaaagcgaatctggttaatgtctttgttaataaagatgtgcgccgaatagagcaccagcgccagcaccggatacggagacatcttcctgaaaaaccaggtattgatggaaacggcaatggcgcagaagacaaacaggaagatgctggcattgtgcgaaaagaggctggtgagccaggccatcgcaaaaatcagcggttcgtaacggaaaaacgcaacggtattaaagaagccattaatctcaatacgtcttacaaagtcttcgaagaagctccggtactgaaagtcatccatgccggtaccaagaccgcgtattcccccgaaaataatcaaagtcacggcggcaaaacagagtagccaggtcagaatataatttgtgcgttcgtctttttttagcgctatttcaaacagcgaaagcagcagtaaaaagcctgatacataccaatatggagccatggtgtgattccttaattccacaagttctcatgccagcaataatcacgcttcgccttcccgactggctttacagcgagtctgattgcacggtcacaaattgcgtgcgggcgatgcctgctggtgatgaattctgttgagtgacgctcgccatgcgatttatagatgtatcgcttttgtgggtttggacagaataacctgtgtaaattgatgcgtgtcgtcattcaaagggacgataaaaaggggcggtcagaccgccccctgttttattgctcaatgatcagcttttgttcgtcttgccgtagtcataggcgtagtagtcatacccatagccatacgcattagcggctttacgcaccacggcgttgaggatcacacctttaatctcaataccgttctgggcaaagcgtttgaagctgacgtccacttctttggtggtgttggcttcgaaacgcgccaccatcagtgaggtgccggccagcttaccgatgatggaggcatcggtgacggccaggattggcggcgtatcgattaacaccaggtcgtagttcttgctcgcccactccagcagctcacccatgcgacgatgcatcagcagctcagacgggttcggcggaacctgaccacgtggcaggaaatcgaaaccgtacacgccctgctgaatcagcgccgggctgaactcagttttaccggacaagacgttggacagacctgatttgttatctgcgcccagcagtttcgtgggtataaccacgacgcatgtcgccatcgataaacagaacacgctgacccgctttcgcgaccagggtcgccaggttggcacagataaaggttttaccaatacccgggctggcaccggtgatcatcaggatgttgtttttcgcttccatcatcgcgaagtgcaggctggtacgcaggctacgaatcgcttcaatggagaggtcagtcggattacccagcgccagcagcgtttcgtgcggatcggttttcaccttgctgccacgacgcgccagggcttcggtatctttcttacgctgccagtctgacagtggaacgctggcatagacattcatgcccagctcttccagctgatccgggttctcgatgccgtgatgcagcagcgctttcagcagaaccagacccactgacacaaacagaccgaaaatcaggctcgcagcgatgatcagcagcttcttcggtgcaacaggcgagttagcggtctgcgcgccatcgatgatgcggacatcacccacggtgctcgctttactgatacccagctcctgctgacggttcagcagctgcatgtagatctcctgaccagactgaacgtcacgggtcagacgcaggatttcctgctgagtctgcggcatgccagcaattttcttgttcagctgagcctgctcaccttccagcgttttgcgtttttcaagcagcgcgcgataagtcgggtgatctttggtaaacagctgagagacttcggcttcacggaaggtcagttcgttcagctgactctgcacgctgacagaggagtccagagcggatttcgcttcaagcgacaggtctacagattcgttctgacgacggaaggtgttcagcttgtcttccgcttcatccagcttgctgcgcacggcaggcagctgagtgcgtaagaactccaggcttttctctgcctgcgctgacttgcgctcaacgttctgtaacagatagttattcacaatctggttcagcactttgctgatctgctctggatcttcacccagatactccagacccagcacgccggtatctttacctttgtctgccacggtcaggttagagagcactgaacggatcgcctgcaggttattcagcttggtcacggtgaagctggtgccttcatcagcgtgaatctcgctgaccagcatgctgatgtcgccatgcgactccagctggccgactttacctttgaacagttcatcgccatcttttgagacggtgtagctatccggaccggtcacttccagttcaacgttacgtttgtcgatagtgcgtgggatttccaggcgcgaaatcgcgatactggcgggtttgttgcccatcaggcgcgacagacctttaccgataaccgggaaatagttctgctcaacgacggtatccagacccagatcgtcaacggttttgccgatgaccatacgggattccagaatctcgatttccgtatcagaggctggtgtcggtggcagaatgctgtcaatttcgttcagaacggtgctggcattcttctgctcaacctgaactaacgcatctgcgctataaatgggtgttgcaaacagtgtgtagagtgttcccgccagcatgaaaaaagcggtaacggcaacaatgatccagcgatgatcaattagctgtcccacaagatgcgccagatcccatccattcgaatcctctcccggcgcggttctgaccttattttttatattcatggataatcccaactatcggcttaatacgttcacccacttctgggtagcgttttccagtaatccgtaaatctcttcaaaggcctcacggctttttctgtacggatccgcaatttctttctgattgagccagtgcccaagcagcatggttttgccacgcgcggccgggtcgatgcgattcacctgttcaatatgtcgcttttccatcaccagaatcaggtcaacgttgcggcacatctctgccgtcaactgttgcgcctcatgtccttccagcgacagaccctgcgcagcagcgacttcagacgccgtcttgtcggccgggtggccgacaagcgcccccaggccggcagagcgaacgtctaaatcaggcagcgcacgtttaaacaggcgctctccggtaggagagcggcagatgttgccaacgcaaacgactaacacggacttaatcatgacgggaccttaattaccccaggtacggattcgcgatgcggcctgtgttgcatcgttgatacctgcgatggtcggtatcaactgcccaatcacacggtttccagcgcgtcagcggcgtagaggtgacataaacgatgtcgtaaggctggagctggaaatcggttcccatcaccatggatgccgcatctttggtgttcaactgatagatgttggcaatcttgttgcgatcggtgccgtgcagtggacggataacgaatacaccggtggcgtcagaggtggtttgatccatcccggccgcattgcccagtgcttccgccagcgtcatgccgctacggtccattttcagggtggtctgctgcttcacttcacccatcacgaagattttcagatcatcgttacgcggaacgtaaagaatatcgcctggatagaggaggtggttctggctcaggtcaccattctgcatcagtgcctgcagagagatacgctgttcacgaccgttgtgcgtcagcaccacgttgcgccagtcagcatcagcggccaggccgccagcggcgttgatcgcatccagcaccgtcaacggaacgttggtgatgggctgctgaccagaagtggtcactgaacccgtcacataggttttctgtgatttgaacgaggcgatgctgacatcaacctgtgggctttcaatgtactgagccagacgacgtgacacttcgtcacgtacttcgccgacggtacggcccgctacacgcacacgaccgatgtagggatagaaaatggtgccgtcagaatgcacccagttaccggtgtcgctggcgctacggtactgacccgctggggtggtcagttccgggtgatcccagaccgttacggtcaggacatcgcccacaccgatacggtattcgtagttctgaatttcgttctgcagggcaggattcgtctgagccaccagtggcttcggacgcatcctttcaaccagtgaaggcgttaacgggaagacgttgacatatttatcgatgtcaaagttgctatcctgctgttcaacaacatcttttcctgatgtagaaaggtgagaacctggttcgatcgtacacccgctaaggaatgtggcggataccagcaagggtatcaatttcattttgattgtaatcatttagatcttcgctatcagttatttattgatagaggcgaaaccgccgctgtgtaagcgtccaacaaaaagtaaatcctacctgacttaagcactgaacctgtcgttcattatccttgctccacttgttataagtagcggccatctaccagggtgtaccctgaacgccacgcatcatagcggactatggatgcacagcgatatccctgatgatggccactatcaacgacacgcctgacaacggcaaaacacctctgagcgcgcattaacgcgctcattccgactcacgattaataggcaccatcgcgtttcaacaccacgcccactgttttaaacagaatcgcgatgtcgttccacagtgaccagtttttcacgtaccacgagtcgaaatagacgcgggtttcatagtcaacatcattacgaccgctgacctgccacaatcccgtcatgcctggctttgccatcaggtaataatcaacatcaccggcataacgacagagttcatcttcaatgaccggacgcggtccgaccagactcatatcaccgcgcaccacgtttccagagctgagggagctcatcgaggcttgttttacggatgaagtggcccactttagtaatacgtggatcatttttgagtttgaaatctttatcccattccgcacgggcaatcggatcagtgcgcagcacctcttccagcacttcttttgaattaatgaccatcgagcggaatttcagacatttgaatttacggccattcattcccacacgctcgtgaccataaatcgggggtccaccgtcacggcctaccaggaagcccagtaccagcagcgctggcatcagcatcaggataatcgagagcgcacccacgatatcgaatgcccgcttcaggaagcgcgacgtgcgtttagccaggttgttctgaacccgcaggatcatcacttcatggctgaagatataggccatgtcagtaccgtagagcggtacaccacgcagggttgggatcactgacactgaacggcagttgtgcatcgccagcgatttaagccagacatcacggtactgactctgctcatactcaaccgcaacgataaactgcgtttcgctgttggtgaggctccagagctcctgctcgtcgcgcagcaccggcacgccgttcatgatctcctgcggacaggttccatcaacgtcatagaaggcgataacgtcaaaacccatgacctcttcgctttgcagtgcctgccaggcttcatgcgcatttttgctgctgccgataataatggtctgttttttccacaagccatttttattcagcagacgtttagaaagcgcgcggcaggtcggaattaaaatcagcgccaggatccaggtcagtaaccagacgaaacgcgacatctgccactgcgacagggcggtaatcgacaggtcgataacagaaaatataagaatggtacgaaaaacttcttttaattcgaaccagaaaggtttgcggtaagtgtagtgacgcagccttacccagaaccagccaatacaaattaccgatagacaaatgtgtgtggcaatttttaaattcatttctttttcagaaatatctgccagcggcgaatctgactgcaaattaattagcatcatcgccaaaaagaacgctgcgttgaaacaaattaagtctgaacatgccagcattaatttggtaataagacttttaaacgtaaattctgtatcgcgcatatttaactctttattttatttccttaaacccgcaacggctatcgcctgtttaatcattaagcgacgaaacctctccagagtgagccgtttctaaggggagctcctgcggcgtttacgccaatgatcttaaccatgaaaccaataatatcgtgatgaataccaacagattactctgacttaaccaccgccagcgctgctcactttatcaacaaaaacgcgattcgggcacgctaccgcccttggctgtcgctgccaatatcgctgtcatcattcataatgctccccgtaatgtgttagcgttaccgcaacgcatcatacagacgttcacaggcgaattactcattcgtgacattgcgattaatgtcgaataggtacgcagattacgactctggggcagagtttgctaacttgttgctatactagttattactggcttgtttacaagcaggtcccgccatccctggactattttaggaaaaagactaccagcaattagtattgaggtctgacgggcagtgcaatcctttcttcacaattcggattaatgccatactcccgatgagataaatcgcataagcccgacaggtgaatatctctttcctgtcagccaatgactaagaattatctctaccgcgccctgtgaagttaatcaaagcgtcacactattatgttcatattttgcacgatatagcgcggttatctgagaacatgccccctgccctgccatttgtacgtggcttcgcactccactatcatcagagaaaactcaatttaagacattcaggtgaacaacgcatgctggaggtaattgcagatccctcgctatgggcgggattagtaacgctaatcgttctggaactggttttaggcatcgacaatctgatcttcatcgccatcctggtggagaagcttccagggccgcttcgcgaccgcgcgcgcgtgattggactgctgctggcgttattgtgccgattattgctgctggcatcgctttcgtggctggttacgctgaaagaaccctggattacgcttatgggccaccccttcagtgcgcgcgatttactgctgctgacaggggggattttcctgctatttaaagccaccacagagttgaatgagcgtcttgaaggggatgatgaggcgtccggtcaacaaaaaggcggcgctaaattctggccggtggtggcgcaaatcgtggtgctggatgccatcttctcgctggatgcggtgattactgccgtcggcatggttaatgacttaccggtcatgatgattgcggtcaccatcgccattctgctgatgctgctcgccagcaagccgttaacccgcttcgtgaacaaccatcctacgattgtgatcctctgcttaagctttctgctgatgatcggcttcagcctggtggcggaaggctttggctttgtgatccccaaaggctacctctatgcggcaatcggcttctcggtggtcattgaggcactgaaccagctggcgcactttaatcgtcgtcgggtgctgtcggccggtcgtccgctacgccagcgcacggcggaagcggtgttacggctgctgcgcggcgccgcagaaccggcggagctggatgcgaaaacttcgtcactgattgctgacagcgatgacagcatgctgtttaaccggcaggaacgggtgatgattgcccgcgtactgggcatgggtcagcgccacattaacagcatcatgacctcgcgccacgacgtcgaacatatcgatctcagtgatgatccggcagagattatgtcgcgcctcgaccgcaatcagcacacgcgaatactgataacggatcactccagcgaaccgctgggcgtggttcacgttatcgatctgctgcaccagtcactgcaccacaattccctggatttacgcgccctgattcgacagccgctggtctttcctgagcggctgacggtgctgcaggcgctggaacagtttcgtcaggcccatactcactttgcctttgtggttgatgagtttggttcggtggaaggcgtggtgacgctgagcgatgtaatggagaccatcgccggcaatctgccgaatgaggcgggtgaaatcgatgctcgctacgatattcagattcaggatgaaggtcactggattgctaacggtcatatgccgctggaagatctggcgctctatgtgaaattgccgctcgatgagcagggtgactatcatacgctggcgggattactgatggataagctgcaacacatccctcaggaaggcgaagtgttgcaactgggtgactatctgctgcgaacgctgcaggtcgaaaatcatcgggtgcagaaagtcgagatcctgctgcagcccgatatcagttacgaggtctgagcgattagcaggcagaaggaaatgcgcccgctacgggcgcatgattttcttcaggttctctttgttctcgccctctttctggcgatcgatccactgattcagccgtgatttcgcctcactctgcagccggttacgcagaacgtcatccaccggcagagagtattgcaggctgtcccagcgaccatacatgcgcagcggaaccggctgactggagagcgctttcaccagcgcatcatcgccacgccagccgctgattttcagccccagggtcatatccagctgttgctgcaccatgtcaactttgcccgcgccctgcaggcccagattctggccgttgccattgatatcgctgaagctgagtacgcccttattcagcgccacctgtgcgctaatcgactcaatcccctcatccaccgcctgatcgctgctgaccttatcgctgacccgcgccacggcacgctgcaccatctgctgcagattcagctctgccagcttcaggttgctggcgctgatggtcgccctgccctgccagcgatgtttggctgcttcgaccgtcagcgtatcacccgacaggtcgccatccagactcaggttcccctgcacactttccggcagttcaaacgctttaagcagcggctgaatcgcaattaaacggagttggggtttaaggctgacccgcgtctctggctgacggatatcgatactgccaggaatggagaaactgccattgcccagcttgccgctgagcgtcttcagcgtcatcactccctgctgattgctggcgttcaccgaaagactggtcagagagagtccgcgccataccgcattgtcagcctgtaacttcagcgccagatccaggtcattcagcggagagtcggcgttgctgcgttcccgcggcgcagctattaccggcgaacgggccacggtggcgtgctgcacgccaggtgcgtcagagacgggcgcactggtgagtaaattatcgacgttaaggttgctggctttcagatccagcgccagctgctgcggtggcgcaatatggccactgccctgcccggtcagggtgctgtcattggcggtgagctgcagattactgaaggagagctgctggcggtcaccatcccactcgccctgcaggctcagcgagcctttgatcccctgtgccggaatgtcggcgccggacaaggtgtaatcaagctgctgcaactggccgctgaggcgatggggatattgcgcggcatccagctggcctttgagattcagtgtggcgttgcgctggttgcgcatcagcgtggtgctcagcgacagggtcgccagcttgttcgcgtcctgttccatattaatgttgaggtcgcggaaattatactcgtcgccgcctggctgctgccagatcaacagactgtctgctacccgcagtttagcgatatcgaatgaccagccgctggaaggcgaagccggctccgcatcacgcggaccctggggcgcatttctggcacgctgcgcgcggctatctggcgtcacccgcactatcgcatttttcagcatcacctggctgacgctgagctgatgggataacagtggccagagatcaacatccagccgcatgttttccgccgagaccatcggctggctggcgcccggcgcggtcaggctcatccggccggccagaatgctgagctgaggccagacgtgccagcgcagatcgctgctgacctcaaggcgataaccactgcgttgttcgacctgctgcaccatataggcacgaaagtcgttgggattgaccagcagcaccagcgcgctcattcccgttacgaccaccactaacaggatggccagcgtggttatcactcttttcattacatcctcagatcagtctttgtcgatacggctggcatcagcgccctgctgaccgcgatatttcgcatcttcacgccggttgtagggacgcgcagccgggcctgaaagcggttcaaaactcagcgcgccgatcaacatgccgggacgcagagccagcggcagtttacctgaattgtagaactccagcacgatacggccctgccagccaggatcgatgcggtgagccgtaacgtgtaccatcaacccaagtcgcgccagcgatgaacggccatccagccagccgaccagatcgtcaggcagcgtcacggactccagcgtcaccgccagcgccagctctcccggatggaggaaaaaggcttcgccatcaggcaacacgatctcatcgctcatgacccgatccagtgccgcgctcacttcctgtttcgggccgctcagatcgataaaggccgcggtatgaccgctgaaggtgcggaaactgattacccagacgcacatcgacggtggctccgttaatgcgctcgaccggcgggcgtggctcaatggccagtttgccattgtccagccaggcttcaatatcgcgatcgcataatctcattgcggtaactccatggcataagtgtagcaaaccggcatgcgtgcctgccgccggtctgcaccacgtccggacggacgtgtgttattcaaaaaactggttgattttcgccttgaggatatcgatggcgatacggttttttccgccgcgcggcacaatgatatcggcgtactgttttgatggctcgataaactgcaggaacatcggacgcacggtcttctgatactgactcattaccgaatccattgagcggccacgctcattgacgtcacgtttcatacgacgcatcagacagatgtcgagcggcgtgtccacgaagatagagaagttgagttcctggcgcagacgggcatcggttaacagcagaatgccttcaaggatgatgaccttttttgcgctcagatgatgcgtttgctgggtgcgggtgtgctcaacgtagctgtagaccggcagctcaatatcctgaccagctttaaccgcctgcagatgctgcaacagcaaatcatgatccatcgcgctcggatggtcataattggttttaaccctctcttccatggtgaggtgactttgatctttgtaataagcatcttccgggatgaccccgatgtgctcgccacctacctgatcacggatttcacgatagagcgtgctggcaattaaacttttaccggatgcggaagcgccggcaatgcctacaatcacgcactgatgagacttgtcagtcatacttttttaagacctgataactggagcctgccactggtcacacattacgcgggcagcggacgggccgaaatggagagggtgtgttcgcgctaagtatagggatttcggccttttgatgccagagaaatggcgtcggcgacttttcagactttctcctttggacgccactcatttcaccgataaactagcggcacaccatactataaaaaaatggcctgcgcggcgcgctgttcagacaacgcgtgtcgctaacgtgacgaccgaagatgcatcaggagtggtatgcactggaagactttgacctattttggcgacagcatgctgttgattccaacagcggtgattattgcgctgattttgccgtggaagagtgataatcgtcatacggtcttttactggattgtggcatttggcctggctggcctgaccgtcagcatctctaaaattctgtttctggggtttggcatcggcagcgcccgctttaattttaccggtttcagcggtcatagtgccatgtccgccacgctgtggccggtcatgctatggctgatttccgggcgctggtccgcgatgtggcgcattgcggcgattggggttggctatctgattcccctgatggtcggtttctcccgcctggtcatccacgcacactcaaaaagtgaggtggtcaccgggctgctgctgggcttcacgctgagcacggcgtttctgatctcccagcgtcgcacctcgctcaaaggcttcagctggccgcaggtcggtgctgcgctgttagtgccgtttgtattgatgagtcacggtcgtgtcgccaccacgcagcagtttcctggagcgtttcgccgccagccttgcgggcatggagaaaccctatacccgcgccgatcttttccgccagtaatcaacgtgctggcaatcaatcttaccgtgcccgtcaattcgccgaataacgggcaatattgatttcaccccttttttctttgccggatgtgctagcatgcagtgagagaatgactggtgcctgattcgccattgtggagcgttgcaccctgccggaagtccgcatgacgatagagatcctgtccccgcaaaatagcacgccaaaccgctggctctcggcgctgctccttggctgcgtggtgtttgtcctgacactcttctgtctggaactgatcgtcgtcagcggcaaaatctccccgctctggtttccgactacgttaatgaccgtcgtggttttccgctgcccgtcacgccagctcccgttgctgctgacagcctgcgtgcttggcaccgccggggctaatgccatcatcatcgggcctgccctctcgaacattaaattcgccctgctcaatcttatccaggccggtgtgggtggcatgctgctgcgcgccctgctggatcggcgcgcgccgctggattcgctgcatgactgggctcggatggtactgtcggtgggcatcgtgacgccggtgctcggcggcctgctggcactctggacgcttcaggtcagcggccacgcctcatttcccttcttttatacctgggtgatctccgaaatcatcggcatgctggtgttaggcccgatgctgttactgctgccgtggccgctgcgtcgcacggggttcagcaatctgcgcctggccgaagctctgctgacgcttcttctcaccctcggggccagttatctggcgctgcgctttttgccgtggccctttacctttatcgtggtgatcctcttctggtgcgcggtccgcctgcccaagctgcaggcgttcgtgctgttcttcctgaacgccagttttatctcgatactgctcgcctttgatctggtcagcgtggtgaacaacaacagcgcgctgggcccggtctccagctggctgccgttcctgctggtgctaatccccagtcacattatgtcgctggtgatggatgcgttccggcgcgaaaagctccatatcactgacagtgaaacccgcttccgtcacgccatggagtactccgccatcgggatggcgctggtggcgccccacggcagctggttgcaggtcaaccgctcgctgtgccagatcctgggctacccggctgaggagctgaagcggctgacttttcagcagatcacccatcccgacgatctcagcctcgatttgcaacatgcgaaccgactgctggcgggtgagattgatacctacacctttgagaagcgctatttccgcaaagatggcgagattgtctgggcgcggctgacggtatcgctggtgcgcgatggtaaccaggaaccgctctactttattgcgcagattatcgatatctctgagctgaagcagagcgagcaggtgaatcgcaggctgatggagcgtattacgctggccaacgaagcgggtggcattggcgtatgggagtggaacctgctgaccggcgagatgttatgggacaagcgcatgtacgcgctgtttggtcttgccccgcatgagtcacccagctatgacctctggatccatctgctgcatcccgccgatcgcgagtatgccgcactgacggtgcaacaggcgattgagcttcgcagcgcgtttcacatggagtaccgcgtggtcgatgaccagggacatcgctgggtgcgcactcaggccaaccggctgctgagtaaagaaggccgcattgagcgtatgctgggcatctgtcaggacatcacgccgctacgcaatcttaacgaggcgctgtttcaggagaaagagcgcatggcgatcaccctggattcgatcggcgaagcggtcatcagcaccgataaagagatgcgcgttgcctttatgaacccggtggcggagaaaatgagtggctggtcgcaggagcaggccgccggtcagccgctgagcgagttgctgcatatcacgcagggacgtaacggccctgaggtagagaatttgctgttatgccagctgccgccggaaaaaatcacccccggtctcgctgaagatctggtgctgcataccccggacggcggccatatcgatattcactacagcatcacgccgctgcgttcggaagcgggtctggaacagggggcggtgatggtcattcaggatgtgagtgagtcacgcaaactgatgaagcgcctgagctacagcgcgctgcatgacaccctgacccgtctgcctaaccgcgccagcttcgaacttcagcttaagcgtctgctgtttgatgccgctgaacatcagcatcagcatgtgctggtgtttatcgaccttgataagtttaaagcggtcaatgacagcgccgggcatgctgcaggcgatgcgttactgcgcgaactctccgatctgatgcagcaccctctgcgcagcagcgatttccttgcgcgactgggcggtgatgagtttgcactactgatgcccgattgcgatatcggacaggctcatgatgtggtgcagcgcattgtcgccgcggtaaatgattaccggttccagtggctgggacgactctatcaggtcggcgccagcgcgggcgtgacgcagatttcagcagaaaactgtcagagcagcgacgtgctttcgcaggcggacatcgcctgttacaacgccaaacgcagcgggcgcggacggctggtggtctacgaacagcatcgcttaccgctgtcgggcaaccatcagggcatggatgcggcgatgattgatgcgctgcagatcgaactgcccgcctgggccgttgcgccgccaaaaacgccgcaggccgcctttatctggctgcttgaggtgcagctgttaaccgctgacggaatgctgctggatgagacactgctgcgcaataacctgcctgatgaaacgctgcgtcgccggctagataataatattcttgaggcttttttccgccacgacgtgcagcggctcaataacaaaggcattccggtgattctgccgcttaatgcccaggtgctgagtgatgccgcctttgtgcagcaactctgtcagcgctttgtcgccgccggtctctccagcagcggctgtggttttgctttccctgccgccagcgtgctgagccagggcgatcagctctatgccgcgctgctgcaactgcggcagtgcggctgccgcatcgtattgcagcattttggccgtaatctggatgcttttaatctgctgagtgacgaggtggtcgattatctggtgctggcacctgaactggttgccaacgttcacaataatctgatggatgagatgctgctgaccatcattcagggccaggccacacagcgcaatatctcggtgctggccggtccggtttcggtaccggccctgctcagcaccctggctaaccttgatgttaacggcgtctggggcagtgccgtggctgagcgccagccgttgcgttcactggctgaagatcacatcttcgctattcgttaattccggcgctgcccgcttgccaccctgctgaagctgcgctaaagtcgcccccttttttccggcatgggggcgaaaatgttcataggattcgattacggcacggctaactgctctattgcagtcagcgaaaatggcacgccacgtctgttaacgctggaaaatgatcagcgcctgctgccgtcgatgatctgtgcgccgacccgcgagtcgatcagcgaatggctctatcgtcatcatcaggtcgcgacacctgacagcgaaaccacggcgctgctgcagcgcgcgctgcgatataaccgcgaagaagatatcgatgtccagcccaatagcgtgcagtttggcctcaccgcgctgcagcactatatggtcgatcccgaagatgtctggttcgttaaatcccccaaatcgttcctcggtgctactggcctgaagccactgcagattgccctgtttgaagatctggtctgcgccatgatgctgcacatccgcaagcagggtgaaagccagcttgatcaggctatcgatcaagcggtaatcggccgaccggtcaacttccagggtttaggcagtgaagagtctaaccagcaggctgaaggtattctgctgcgcgccgcccaccgcgccggtttccgcgacgtggagtttcagttcgaaccggtggcggccggactcgatttcgaagccacgctgcagcaggagacgcgggtactggtggtggatattggcggtggtactaccgactgctcaatgttgctgatggggccgaagtggcgtgataaagctgaccgccgtgaaagcctgctgggccacagcggttgccgcgtcggcggtaacgacctggacatcatgctgacgtttaagaccctgatgccgctactcggtctgggcggtaacacccagaaaggcaccgccctgcctgcgctgccgtggtggaatgcgatcgccatcaatgatgtgccggcacaaagtgacttttacagtcccgcctgcggaaagtggctgcgggatttagtgcgtgatgcggaacagggtgacgtagtggctcgcctgctgaaagtgtggcagcagaagctcagttatcgcctggtgcgcgcagcggaagagagcaagattgcgctgtcagccagcccggcgcataccgcttccctggactttattgccgccgcattagagacagagattggcgtggatcagctgcaggacgccatcagtcagccgctggagaaaattctggaacaggtgcagctggcattagccaccagccagattaagcctgatgtgatttacctgaccggcggcagtgcgcgtttcgccgttgctgcgcgcggcgctgcagcagacgctgccggatacaccgattgcgggcggcgatgatttcgcctccgtcaccgcagggctggcccgctgggcggaagtgatgttccgctaggcttgcactgcaataacaaagacggcacctgagggtgtaatgccagtcagttaagcgacaggtgataacgcagtctggtgccgggccccggcctgctctgaagcttgagtgcatgttgtcagaaagggcacgagagtgaaggcctgagcgcctctgctgctgaaagggctatccgcagcgctgaggcgtgacgccgggccagaagtccacgccgggaagcgtggacagttcggagccggccagggagggccgatccccgaacggttcgtcggcacggcgtcaaagccgaaggtaccgcgtgagcggcgcgaggacggcccggcagcagcagaggtgcgctggcccgcactgcggctcgctcgcccggaaaatcagaaggcgatattggcgctgataccaccgataaacgcatctttcacttcactgactgcgcccggtgcaaccacatactgcaggttaggtcgcagtgacatccagttagttactttagcgttatagtaaacctcatagttgtactctgaaccttcctgaatcggcagataggtcgggctgtcaaagcggctctcgccattagcctgattctgctgacgcagtgagcgggtatagtcgctgttcacatgaatacgtgacgcgcccacgccgatctcatcctgaggacgggcatcaaacggtcctgtccaggtaaacgcaatagactgatagttgtcggtctttgaggtcttgtgatcgttcatcaccgcctgcacccgcacacccagaccgcgattcacatcgccgtcctgcgcggtcagctgttgctgtaacagcagatagccgccataggaatgggcctgatcctgatagccgccgttgcgccagctgccataaacatcgccatccaccgaggaatagtaatagccgatgcggtagttacccggtaatttctccggcccgaaggttggcttccagcccagtttcgaccggcaccagattcccttctgaattgctggtatccagacggaaaccatcaccgcgatcgtagttagcgctgttctgattatagaaaccgacctggaagaaaacgtccggcgtgatattgaatttcacccggccgccccactgcgagaccggccagttaaaccagcgatcgccgcgccagttacccgcctgcccgctacccagcgccaggttctggaacagattgccatcgaagttatcgaagtcttcccctaccgtcacccgcccggctttcacatcgaccacatcgttaaacaatcctttgcgtaaccagaactgggtcagacgccaggtctggccgcgaccgtaaacctcctgcaccgaggagagcataccggtgcgttgatccgcgacctgttcagaaagattctgtccgttacgactggtcacggtcatctggaactcggcatcctgccagtccagcagcttctgcagatcgaaattggtgccaaacgaccactgatcgctgtagcgcatggtggtattggtatctgccccgccgcctaaattcgcggcgctttccatggtgtagttaacgtcaaacttaatgccgtcgtcctgcagctgcgttcggtacccgccccagtcaccaaacatccattcggagtccgggctcagggcgtcagcggcaaacgcctgcgcggaaaacatggccaggattagggtgccggttgccacacggcgcagcgggaaacgctgctctgcttttctgtttttcatcttgcttattcttatgtaagttacggaaaatgacgcgcagaggatagtgctggataacctctgttttttgtaaatacgtgcgcataattacccgtaacatccgtttattaacgcatttgtgatcgggatcgctgattggttattctctgggcggggtgccaattttttgacaggtgtagcgtaaaaaggggcgctatcgccccttgtgtttactggcttgcctgattcagttgttcaatctgcgccggggtcagcgtcagctgcatcgcgccactcagatcgtcgagctgtttcagcgaggtggcactgacaatcggtgcggtgataccgggacgggcgatcagccaggccagcgctatctgcgtcggcgtcacctgatgcgcttcgctgatagcatccagtgcgtcgaggatccgcaaaccgcgcgggttaagatatttatctacgacaccctgaccgcgcgcgcttttaccggcatccgccgcctcgcggtatttgccactgagaaagccgctggcgagtgaatagtagttaataacgcccagcccctgcgccatcaccaccggctccagctccgattcatagggctggcggtcataaaggttgtattcaggttgcagagtttcatagcgcgccagcccctgcgtttcactgacctgcaacgcctcctgcagccgtgccgcgctgtaattggaagcaccaatcgcccgcactttgccctctctgatcaggctgtcaaaggcgctcagggtttctgccagcggcgtatcctgatcgtcgcggtgcgcctggtagagatcgatatagtcggtctgcaaccggcgcagtgaatcttcgaccgcctgacggatatattgcggtttcagcccggttttctccggcgacaattccatgccaaccttggttgccagcacgatctggtcgcgtttgccgctttttttcagccattcacccataatggtttccgattcaccgcctttattgcccggtgcccagcgggaatagacgtcggcggtatcgataaaccacaggcctcgatccaccagcgcatccagcagagaaaaggaggtggtttgatccactgtccagccaaacacgttgccgccaaacgtcagcaacggcaccgcgataccactgtcacccaactgccgggtttgattctgactcatttcctgctccttatttgcctgaaaaaaccgtctgtctttcagcatagcaaagtgatttcacggctttatgacgattgtgatgcgattaatgaaagaacaggcataattaccccgccctgacagatatccttatttccttcaacttctgcccgtcagaggcggctacactctgtcgtttgcaggctacccatttgatgcctgcgcctgggactacgtcactgctggagagcaccaacaatcatgagcacccgacatcctgttatgaagaaaacccttatcgtgctggccctgatcgccgtggccgctggcggctattatgcctggcagcgccatgcccagccgcagagcagcagtcagagtgacgcacctgcgccacgtggcggcaaaggcggcggtgacggcgcccgtcgtcccctcgcgccggttcaggccgctacggccaccagccagagcgtgccgcactatctgagcggactgggtacggtgaccgcggctaacacggccacggtgcgcagccgggtcaatggcgatctgctggcaatccacttcaccgaagggcagcaggtgaaggcgggcgagctactggcagaagtcgacccgcggccttatcaggtggcgttaacgcaggcgcagggccagctggcgaaagatcaggcgacgctggccaacgcccgtcgtgacctggcgcgcttcgagaagctggcaaaaacctcgctggtgtcgcaacaggagctggatacccagcgctcactggtcagtgaaacgctcggcacgctgaaagcggatgagggaagcgtcgccagtgcgcagctcaatcttacctacagccggatcaccgcgccgattgccggccgggtcgggctgaaacaggtggacgtcggcaactacgtcaccagcggcgacaccaccggtatcgtggtgatcacccagacgcacccgattgatgtggtctttaccctggctgagaacagcatcagttccattctcaaggcgcagaaaagtggtgaatcgctgctggtggaggcctgggatcgcagtaatcagaatctgatcgccagcggcaaactgctaagccttgataaccagattgatgtcaccaccggcaccatcaaaattaaagcgcgttttgataatcaggacgacacgctgttccccaatcagttcgtgaatgtgcggctgaaggtcaacaccctgcaggatgcgattgttatcccacctgccgcgctgcagatgggcaacgaaggcaactttgtctgggtggttaacagtgacaacaaggtcagcaagaaaagcgtgattgccggcttgcaggatagcgagaaagtggtggtcagcgccggtctggaggcgggcgaaacgcgtcgtgaccgatgggctggatcgcctcacggaaggcgcaaaagtcgaggtggtcgcgccgcagagcaacgcaccgcgcgctacccgcgccaccctgccgtcaaaaggagagcgtgagtaatgcaggtcatgcctcccgatcacagtggcggaccgtcacgccagtttatcctgcggccggtcgccaccacgctgttgatgattgcgatcctgctggccggggtgctgggctaccgcttcctgccggtctcggcgctgcccgaagtcgactatccgacgatccaggtcgtcacgctctatccgggtgccagcccggatgtggtcacctcctccatcaccgcgccgcttgagcgccagtttggtcagatgtctggcctgaaacagatggcgtcgcaaagctccggcggtgcctcggtggtgacgctgcagttccagctgacgctgccgctggatgtggcagagcaggaggtgcaggctgccattaactccgccactaacctgctgcccaacgacctgcctaatccgccggtctacagcaaagtgaatcctgccgatccaccgatcatgacgcttgccgtcaccacgcgcagcatgccgctgacgcaggtgcaggacatggtggaaacgcgggtggcgcagaaaatctctcaggtcagcggcgtcggactggtgacgctatcgggcggtcagcgtccggcggtgcgggtgaaaatgaatgcgcaggcgctggctgcgctgggtctgaccagcgaaacggtgcggaccgccatcagcaatgccaacgtaaattcggccaaaggcagcctggatggtccgacccgctcagttaccctgtcagccaatgaccaaatgaaatcagcggaggattatcgccagctgattatcagctacaaaaacggcgcaccggtgcgccttggcgacgtggcgaccatagaacagggagcagaaaacagctggcttggcgcctgggccaaccgcgatgcggcgattgtgctcaacgttcagcgtcagcctggtgccaatatcattgccacagcagataatatccgtgccatgttgcccgccctgaccgcagccctgccgaagtcggtggaggttaaactgctcaccgaccgcaccaccaatattcgtgcttcggtcaacgacacgcagtatgagctgatgctggcgatggcgctggtggtgatgatcatctatctgtttctgcgcaacgtgcccgccacgctgatcccggcggttgcggtgcctctgtcactgatcggcaccttcgcggcgatgtacttcctcggcttttcaattaacaacctgacgctgatggcgctgaccatcgccaccggatttgtggtcgatgatgccatcgtggtgattgagaacatctcacgctatatcgagaaaggggaaaagccgctgaccgccgcgctgaaaggtgccggcgagatcggctttaccatcatctccctcaccttctcgctgattgcggtcctgatcccgctgctgtttatgggcgacgtgatcggccgtctgttccgcgaatttgccgtgacgctggcggtggcgattctgatttcagcggtggtctcactgaccctgacgccgatgatgtgcgccaggatgctgagcgcggagtcgctgcgcaaacagaaccgcttttcgcgggccagcgaagcgatgtttgatcgtatcgtggccgcctatggccgcggcctgaaacgggtacttaatcatccctggctaacgctgtcggtggcgcttggcaccctggtgctgacgctgttgctgtggatgatcatcccgaaaggctttttcccgcagcaggacaacagcattattcagggcacgctgcaggcaccgcagtcagtctcctatgccagcatggcgcagcgcacccgcgacgtcgcctccatcatcatgaaagatccggcagtggagagcatgacttcgtttgtcggcgtggatggcaccaatgcctcgctgaacagcgcgcgtctgcagatcaacctcaaaccgctggatcaacgcgacgaccgcattcctgctattcagcagcgtctgcaacagcaggtcagtgaggtaccgggcgtgcagctgtggctgcaggcggtgcaggatctcaccatcgatacccaggcgagccgtacgccctatcagttcacgctgcaatcgggttcactgtcgtcgctcagcacctgggttccggcgctgctgacccggctcagcaccctgccacagctgcgcgatgtcagcagtgactggcaggatcaaggactggaagcctatgtcaaagtggaccgcgacagcgccagccgcctcggcatcagcatggcggatgtcgataacgcgctgtacaacgcctttggtcagcggctcatctccaccatttatacccaggcgaaccagtatcgggtggtgctggagcaggacaatagtgccactcccggcatggagagcctgaatgcgattcgccttaacagcagcgacggcggcagcgtaccactgagcgccattgcccgaattgaacagcgcaacacgccgctcagcattaatcatctcgaccagttcccgtcggcgaccttctccttcaacgtggctgacggctattcgctggaagatgcggtgaaagcggtgtcgcaggctgaagccgagcttggcatgcccgcagagctgatgacgcagttccagggcagcacgctggcgtttgaagcagcgctgagcagcaccgtctggctgattgtggcggccattgtggcgatgtacatcgtgctgggtgtgctttatgagagctttatccaccccatcacgattctctcaacgctgcccacggcgggtgtcggcgcgctgctggcgctgatgctcagcggcaatgagctggatatcgtggcgataatcggcatcatcctgctgatcggcatcgtgaaaaagaacgccatcatgatgatcgactttgcgctggcggccgaacgtgaacagggtatgaagcctgttgatgccatctatcaggcctgcctgctgcgcttccgcccgattctgatgaccacgctggccgccctgctcggcgcgctgccgctgatgctcagcaccggcgtcggtgccgaactgcgtcatccgctggggattgccatggtcggcgggctgattctgagccaggtgctgaccctgtttaccaccccggtgatctacctgctgtttgatcgactggcgcacgccacccgccgccgctttgcccgcacggaggccgcagagtgaagtttctttgccctgttcatcaaccggcccgtcgccactaccctgctgacgctggccatcgcactggcggggatgctgggtttccggctgctgccggtggcgccgctgccgcaggttgattttccggtgatcgttatctcggcttcgctgccgggtgccgcaccggagatcatggcgtcgtcggtggccacgccgctggagcgctcgctgggacgcatcgcgggcgtcagtgaaatgacctcaaccagttcgctgggcagcacccgcatcattctggtgtttgattttgatcgcgacatcaacggagccgcgcgcgatgttcaggccgcgattaacgcggcgcaaagcctgctgcctaccgggatgccgtcgcgcccgacctatcgcaaagtgaacccttcagatgcgccgattatgatcatgacgctgacttcggatacctataatccgggtcagctctacgattacgcctcgacccagctggcgcagaaactgtcacagattgagggcgtgggcgacgtcaccgtgggtggcagctcgctgcctgcggtccgcgtggccctgaatccacaggcgctgtttaatcagggcgtctcgctggatgcagtgcgcaccgccatttccaacgccaatcagcgacggccgcagggcgcactggatgattcgcagcagcgctggcagttgcgtaccaatgacgcgctgcagaccgccagtgagtatcagccgctgatagtgcattacaacaacggcgcggcggtcaggctgtcggatgtggcgacagtcgaagattcagtgcaggacgtacgcaacgccgggatgtcgcgcggtaaaccggcggtgctgctgctgatccgcaaaacgcctgaagccaacgtcatcgatacggtggaccgcatccgcgccgaaatgccgctgctgcatgaggtgatcccggccgccatcgatctgcagatcgctcaggatcgctcacccaccattcgcgcctcgctgcatgaggtggagcagtcgctggtgatcgccgtggcgctggtgattctggtggtgtttgttttcctgcgatcgggccgcgccacgctgatcccggccgttgcggtgccggtttcgctgatcggcacctttgccgcgatgtatctgtgtggcttcagcctcaacaatctgtcactgatggcgctgaccatcgccaccggctttgtggtggatgatgcgattgtggtgctggagaacattgcccgacacgtggaagcgggcatgaagccgctggctgccgcgctgaaaggggtgcgggaagtcggttttaccgtgttgtcgatgagcctgtcactgattgccgtgttcctgccgctgctgatgatcggcggactgattggccgcttcttctcagaatttgccattacgctgtcggtggctatcgtcatctcgctgtttatctcggtcaccctgacgccggtgatgtgcgcttatctgctgaagccgcacgcgccgcgcagccagccgcgccagcgcggcgcgggccggctgctgatggcgatccagcagggctatggtcgctcgcttaacgtggtactgaaccatgcgcgctgggtgatggtgctgtttttcgccaccatcgtcctgacaggctggctgtttgttcatattccgaaaacctttatgccggagcaggataccggacgactttccggttttatctctgccgaccagagcatttcgtttcaggcaatgcgcagtaagctgcaggattttatggagattgtcggggccgatccggcggtagagagcgtggtgggcttcaccggcgggatgcgtaccaacagcggctccatgtttatttcgctgaagccgctgtcggagcggaaagagagtgcagtggagattatcgcccgcctgcgcaataagctggcgaaagaacccggggcgagtctctatctgaatgcggtgcaggatctgcgcgtcggcggtcgggaatcgaatgccggttatcaatattccctgctgtcggacgaccttaacgccctgcgtgagtgggagccaaaaatccgtcaggcgttctctgccctgccacagctggcggatgtgaactccgatcagcaggataaaggcagcgaaatggcgctgacctatgaccgggaaagtatggcgcggcttggcatcgatgtctctcaggccaatgccctgctgaataacgcctttggtcagcgtcagatctccaccatttatcagccgcttaaccagtacaaagtggtgatggaggtcgatccgcgctacacccaggatatcagcgccctgtcgcagatgtttgtgataaacagcgaaggtaaagcgattccgctgtcgtggtttcgcccactggcagcccgcgaatgcgccgctctcggtcaaccatgaagggctgtctgccgcctcgaccatctcatttaacctgccggaaggtgtgtcgctgtcgcaggcgtcggaggcgattgaacgcaccatgaccgcgattggcgtgccctccagcgtgcgcggcagctttgccggtacggcgcaggtgtttcagcagtcgcaaagcaatcaactctggctgatgctggcggcgattgcggcggtctatatcgtgctggggatcctctatgagagctatgtccatccgctgacgatcctctctaccctgccctcggcgggtgtcggtgcgctgctggcgctggagctgttcgatacgcccttcagcctgattgcgctaatcggtattctgctgctgatcggtatcgtgaaaaagaacgccatcatgatggtcgattttgcgctggaggcagagcgcaacggccagctcagcgcgcgggaggcaattttccaggcgtgcctgttgcgcttccggccgattatgatgacgacgctggcggcgctgtttggcgcgctgccgctggtgctgaccagcggtgacggcgcagagctgcgtcagccgctggggattaccattgccggtgggctggtgatgagccagttgctgacgctctacaccacgccggtggtctatttaatgatggataaattgcgccgtaaaaaacgcccgctggtcgccgcgcagcagccgtaacaggtatggcggcaacaggcatcggacgtgacgcctttatcggggggatcgatgagtacgcaaagcactaacgtccgctggcaactgtggattgttgccatcggcttctttatgcagacgctggataccaccatcgtgaataccgcgatcccgtcgatggcgcacgatctgggtgtcagcccgctgcacatgcactcggtcatcgtctattacgtgctgacggtggcggtgatgctgccggtcagcggctggctggccgatcgctttggtgtgcgcaacattttcttctgcgcgattgtgctgttcagcctgggatcactgctgtgcgcactttccggcactctggatcagctggtgctgtcgcgggtggttcaggggattggcggggccatgatggtgccggtgggtcgcctgacggtgatgaaaatcgtgccgcgcgagcagtatatgtccgccatgacgtttgtcactctgcccggccagatcggtccgctgctgggtccggcgctgggcggtgtgctggtggagtacgccagctggcactggatctttctgatcaatatcccggtcggcattgcaggcgctatcgccaccctgatgctgatgcccaactacagcatgcagacgcggcgctttgatttcggcggttttatcctgctggccgccggaatggcaaccctgacactggcgctggatggtcagcgcagcagtggcggctctccgctgctgctgggtgccatgatcctcattggcatgttctctctgctgttctacctgatgcatgcgcgcggcaatgataatgcgctgttcagcctgaagctgtttgataatcgcatctactccatcggcctgcttggcagttttaccggccgcatcggcagcggcatgctgccctttatgacgcctatctttctgcagctcggcatgggttacagcccgtttcacgccggtctgatgatgattccgatggtgctggggaatatggggatgaaacgcattgtggtgcgcatcgtcaatctttatggctaccgcaacgtgctggtgatgtcgaccgtggcgctggcgctggtggtcctgctgttcccgctggtggcaattctgggctgggtctggctgctgccactggtgctgtttctgcagggcatggtcaacgccatccgcttctcttcaatgaataccctgacgctgaaggagctgcctgatgagctggcgtccagcggcaacagcctgctgtcgatgattatgcagctgtcgatgagtattggcgttaccgtggccgggctgctgctgggggcatttgctcaggagagcgcagcgaacagcacggcggaacatcagatgtttatttatacctacctttgcatgtcgctgattatcatcctgcccgcgctggtgttctggcgcgtgccgccacaggtgagtaccaacgttgatttgcgacgccggagaaaaaaatgagagataacctgcgcttgggcatcggggccaaactgtttatggcgattttcgccacctgcatgctggtgctgattaccatgcactggggggttcgcctcagtttcgagcatggctttgtcgactacattaagcgcggcaacgagcagcggttaaatctgctcagcgatgccctggccgatcaatatgagcagcacggcaactgggattttttgcgccacaacgaccggctggtgttcaccatgctgcgttcgctggagcagaatcccgacagtaacagtcagctgccgccgcacggctggcgcacccagttctggatcctcgatcagcaatataaagtgctggccgggccaaaatcgccggtgccgcccgaaggcacgcgacgcaatatcaccaccagcaataataaagtggtcggctgggtcatcggctcgccgccggagcggctgacgcgcagcaccgacattaactttgatcagcagcagcggcgcaccagctggattatcgtcgggctgtccacgctgctggcggcgctggcaacctggctgatggcgcgcggtctgctggctccggtcaaacgactggttgacggcacccatcatctggcggccggtaattttgccacccgcgttgaggtcagcagccgggatgagctgggccagctggccagggactttaacctccttgccagctcgctggagaaaaatgagagcatgcgccgcgcctttatggccgatatctcccatgaattacgcacaccactggcgatcctgcgcggtgaactggaagcgatgcaggatggcgtgcgcaaactgacgccggaagcgatcgcctcgctacaaagcgaagtggtggtgctgaccaagctggtcgacgatctgcaccagctgtcgctgtccgatgagggcgcccttgcctaccgcaaacaggcaaccgatctggtgcaattgctggaagtgacggcaggcagctttgccgaacgctatcgtgcacacgggctgacgctgaaactcaatctgcccgataacgcccccttctttggcgatcccgaccgcctgatgcagttgttcactaatctgctggagaacagcctgcgctacaccgacagcgggggccgggttgaagtgacgctgaactatgaggcacccaactggcgcatcgagtttgatgacagcgcgccgggcgtggatggggaacatcaggcccagatttttgagcgcttcttccgcaccgaaggctcgcgcaatcgcgccagcggtggctcgggcctgggcctggccatctgtaaaaatattgctgacgcgcatggcggcgatattcatgcggcgcactctgatttaggtggactgaaaatcgcgctacacttgcgctatgttccccttgtgtagacgcttatgagcctggaaaaccacgacccgctgattctggtggtcgaagatgagccgaaactggcgcagctgatgatcgattatctgcatgcctcgaactaccgtacccatcacatcgccgacggcaacgcagtgctggagtatgtgcgccagacgccacccgacctgatgctgctggatttgatgctgccaggcaccgacggtttaacgctgtgccgtgaaatccgtcgtcattccgagctgccgattattatggtcaccgcccgcaccgaggagatcgatcggctgctggggctggagctgggcgcggatgactacatctgtaaacccttcagcccgcgtgaagtagtggcgcgagttaaaacgattctgcgccgggtaaaacggtcggcggaagagccgcaaagcgcctcgttacttcgcgtcgatgagagccgcttcttcgccagctggcgcgacaagccgctggatctcacgccggcggagttccgtctgctgaaaacgctgtcgctggagccgggcaaggtcttttcacgcgaacagctgcttaaccatctctatgatgactaccgcgtggtcacggaccgcaccatcgacagccatatcaagaacctgcggcgcaagctggagaatctcgacagcgagcaaccttttatccgcgccgtctacggcatgggctatcgctgggaagccgatgcctgtcatttgatctagtttgatcccgatcaatttacttcccttttctcactgcctacaattccgcaccttttgcagggcttaactgccctgcacctgccgcctgaggcgacatgctgacctgacatcagtgagaaaatcatgaaacccgaactgctttcccccgctggcaccctgaagaacatgcgttacgcgtttgcttatggtgccgatgccgtttatgccggccagccgcgctacagcctgcgggtgcgcaacaacgaattcacccacgaaaacctcgcactgggcatcagtgaagcgcacgcgctgggtaaaaaattctacgtggtggtgaacattgcgccgcacaacgccaagctgaaaacctttattcgtgacttagcgccggtagtggcgatgcagcccgacgcgctgattatgtccgatcccggcctgatcatgctggtgcgcgacgctttcccgacgatgccggttcatctgtcggtgcaggccaatgcggttaactgggccacggtaaaattctggcagcagatggggctgagccgggtgattctgtcacgcgagctgtcgctggaggagatcgccgagatccgccagcaggtcccggagatggagctggaagtatttgtccatggcgcgctctgcatggcctactccggtcgctgcctgctctcaggctatatgaacaaacgcgacccgaatcagggaacctgcaccaacgcctgccgctgggagtataaagtggcggagggtcagcaggatgaggtggggaatatcgtcggtatccaccagcctgtcgccgtacaggatgtgacgccaacgctgggcgttggtcagcccaccgacaaggtgtttctgctggaagagaagatgaagcccggcgaggtgatgagcgcgttcgaagatgagcacggcacctacatcatgaactcgcgggatcttcgcgcggtcgcgcacgtggagcggctcagcgagatgggcgttcattcgctgaagatcgagggacgcaccaagtcctactactactgcgcccgcaccgcccaggtttatcgccgggcgattgatgatgccgctgccggtaagccgtttgatccctcactgctgttaaccctggaaggcctggcacatcgtggctataccgaaggtttcctgcgccgccacactcacgacagctaccagaattatcagcagggcttttcggtgtccgaccgccagcagtttgtcggcgaattcaccggcgaaacgccggggcgaatgggctgaagtggcggtgaagaataagtttatgctgcacgacagcgtggagatcatgacgcctcaggggaacctgaattgccagctggacgcgctgcagaatgcacgtggtgagcccactgaagttgccccgggcgatggccatcgcgtctggctgcgggtgccagaggaggtggatctgcgttttgcactgctgctgcgcaactttgatcatggtgaagatacccgggaccctcataatcgtttaccaacggaaacattttgaggaaatcagaacaggatcacagacccttgcgcggtgctgctttatagtcccgcctgctgctaacgagtaacaacaaacggcagatttaccaggaaccacctcatttacccgcccggctcccccgtgcgggttttcttttttctctctttcgccaataatttactgctggcagctgtgttataaatcccttcttactctgtagatcttcaaggaacgcaaaatggataataaaccgcttacgctgctcatcctgaatgggaaaggcgcgggtaatgatgatctgcgcgaagctattacgaccctgcgtgaagaaggcttcgacattgcggtgcgtgtcacgtttgaaaaaggtgatggcgatcggtacgtcaaagaggccattgcgctgcaggccgcgaccgtggtggccggtggtggcgatggtacaatcaatgaaattgcgactgcgctggcttcttctgaagcggatcatcgcccggtgctgggcatcctgccgctgggtaccgccaacgattttgccaccagcgtcggcatcccggaagagatggaaccggcactgcgactggcgattcagggcaaagccagtgccatcgatctggccagggtaaaccagagccactacttcatcaatatggcgaccggcgggtttggcacccgtatcacgactgaaacgccggaaaagctgaagtcggcgctgggcggcgtctcctactttattcacggcctgatgcgcatggatacgctgaaaccggatacctgcgagatcagcggccccgatttcgcctggcagggtgatgcgctggtgatcggtattggtaatggtcgtcaggcgggcggcggtcagcggttatgcccttctgccctgatcaacgatggccgactggacgtcagtgttgtcaccgcgcaggagttgctgcctaccctgctgcactcgctgaccggcgacgatgacaatcccggcatcgtcaccacgcaactggagtcactgacgatccgttcgccgcatgagatgacctttaacctcgatggcgagccgctttccgggcgcgaattcgtgattgaggtgatggcgggcgcgctgagctgccgcctgccgccgcagtgcgcgctgcttgcctgaaccgacatcaggggcgaaagccccttttttcttctgctaccattagcgcccattgtcttcgtaacattcctcctgctgcctcgctttatcacgccttaacgggcgttttcaggcaatgtaaacactctgtgattccgttcacaactctgccaccctaacttgtatggtagtattaaagagcgtactttttcatcattgaacgctgacttaaggcaaccaggatgaaaattgttaaggcagaagtatttgtaacctgcgcaggcagaaactttgtcaccgtaaagatcaccaccgatcagggtctgaccggcattggcgacgcaacgctgaatggccgtgaattaccggtcgcctcctacctgaaagatcacgtctgcccgcagctgattggccgcgatgcgcatcagatcgaagacatctggcaatatttctacaagggcgcttactggcgtcgtggcccggtcaccatgtccgctatctcggcagtcgatatggcactgtgggatatcaaaggcaaagccgccaatatgccggtgtatcagctgctgggtggtgcatcccgtaccggcgtgatggtctattgccacaccaccggtcactccattgatgaagtgatggatgactacgcgaagcacaaagagctgggcttcaaagcgattcgcgcgcagtgcggcgttccgggcatgaaaaccacctacggcatggcgaaaggcaaaggtctggcctatgagcctgcaaccaaaggtaactggccggaagagcagctctggtcaaccgagaaatacctcgattttaccccgaaactgttcgcggccatccgtgacaagtttggtttcgacgagcacttgctgcatgacatgcatcatcgcctgacgccaattgaagcggcgcgttttggcaagagcgtggaagattatcgcctgtttctggatggaagatccgacgcctgctgagaatcaggagtgcttccgcctgatccgccagcataccgttacgccgattgccgtgggtgaagtgttcaacagcatctgggattgtaagcagctgattgaagaacagctgatcgactacatccgcaccaccattacgcatgcgggcggcattaccggtatgcggcgtatcgctgattttgcctcgctctatcaggtgcgcaccggctcgcacggtccttctgatctctcccctgtctgcatggcggctgcactgcactttgacctctgggtgccgaacttcggtgtgcaggagtacatgggcttctccgaacagatgatggagctgtttgatgcaaactggacctttgaccagggctacatgcatccaggcgacaaacccggtctcggcattgaattcaacgagaaactggcgtcgaaatatccctatgaacctgcctatctcccggtcgcccgtcttgaagatggcaccctgtggaactggtaaggagaagctgatgaaaagcgttgttattgaacagccgggtgaactggtggtggctgaacgtccactgccacaacctgcggcgggcgaagtccgggtcaaagtggcttatgccagtatctgcggctctgatgtgcatatctggcacgggcataacccgttcgcgaaatatccacgggtaattggtcacgaatttttcggcgtcattgacgcggtgggcgacggtgttgatccggcccggctgggcgaccgcgtggcggtggatccggtggtgagctgcggcagctgctatccctgctcggtgggccgtcccaatgtctgcaccacactacaggtgattggcgtgcaccgtgacggcggcttcagcgagtttgcgctggctccggcaaaaaatgccttttccctgccggacagcatccccgatcggctcgccagtctggttgagcctttcactatcgccgccaatatcaccgcgtttctcaagccgcagccagacgatgtggcgctgatttacggtgccggtccgatggggctcactgcgattcaggtgctgaagggcgtctataaggttaaaaaggtgatggtggtggatcgcctgccggaaaggctggcacttgcagagcagagcggtgccgatcaactgtttgataacaatgaaatcccgctggcggcacagcttgagggcgtgcagcctacgctgattatcgacgcggcctgccatcccaccattctggctgaagcagctgccctcgcctcaccggccgcacgcattggcctgctgggcttctccggcgagccgtgcagcattactcagcagagcctgaccagcaaggagctgtcgctgtttacctcacgtcttaacagcaatcgtttcccacaggtgatcgaatggatggaaaaagggttaatccagccagagaaactggtcacgcactacttcccgctgcaggagattgagcgtgcgatgaccctgtttgaaaaagatccgcgcacctgctgcaaagtcatacttcagatgggttaattatccgctgaacaccaggtctcctcagccggtgcgtacccgccggcatgactataaagataaaacagatcacggagtttgtatgttcaagaatctgcgctggaccctcgttttgctgctgtttcctggtttacatgattaactacctcgatcgtgtcgccctgtcgctgacggtgccgctggtggaaaaagatctggcgatcaatgctgagcagtttggcatgatcttcggcagctttttctttggctatgccctgtttaacttccttggcggccttgccactgaccgctatggccctaaaatcgtgctggccgtggcggtaggagcctggtccattttctgcggcatgaccgcactggccaccggcttctggtcgctgctgatcctgcgtgtgctgtttggcatggctgaaggcccgatctgctcctcggccaacaaagcgattaacggctggttcccgaaaaaacaggccgcgacggccatgggcttactgagtgccggatcacctttgggtggtgcggtcgctggcccgatcattggttatctggcgctcgcctatggctggcgtccggcgttcgtgattgtctgctgcatcggtctggtgtggatggcgttctggctcttcttcgccgctgacaatccggcgaagagcaagcgtgtcagcgaagaggaacgtctgctgattgatcgcctgaaagcgacgaacccgaatgatgaagttgatctgtcggaaacgtcacatccgtttggctactacctgcgccagccgattatcctggtcaccgcttttgccttcttctgctacaactacattctgttcttcttcctgagctggttcccggcctacctggtgcaggcgcacggcctggatatcaaatcgatgagcatcaccaccatgatcccgtggatcgtcggtttcgttggcctggcgctgggtggctggatctccgataagatctttaacatcaccggcaagctgttgttgtcccgcaaaattgtgctggtggtctcactgctggccgccgcaatttgtgtggcgctggcgggtacgataaaagatgtggtgcctgcggtaattatgatgtcggtgtcgattttctttctctatattaccggcgcaatctactgggcgattattcaggatgtggtgcacaagagccgtatcggcagcatcagcggctttatccatctggtgggtagcctctccggcatcatcgggcccatcgtcaccgggtttattgttcatcacaccggtaaattcgatagcgcctttatccttgcgggctgtgtcgccgcgctgggtgccttcctggtgttatttgtgattcgcagtccgaaaacccaggataaaccggtttcggtctgagtgttgtttcgctaacagatgtatgatttcggggcgctttgcgccccgtttgccataaggatgaactatgttacagattgatcgcctgcccgctgaggtcaagcgccccgcttacgaccgcagccagttaaaaacccgcatggtacatatcggttttggtgcatttcaccgcgcccatcaggcgctctgcagcgataagctggctgaacagggcagcgactggggttattgtgaagtgaacctcaacagcggcgcgttgattgaggccctgcgagagcagcatctgctttataccctcaccgagatggccgatgattcattgcatacccgggtgattggcgtcattactcaggcactgcacggcaaaagtgacggtattgaggcggtgatcaatgccatgagccagcctgaggtggccattgtctccatgaccgtcaccgagaaaggctattgccaccagcctgccagtggcaatttaaatcccgatcaccctgacatcgtgcatgacctgcagaatccgcattcgccgcgtttcgctgcccggtctgattctggccgcgattcgccgccgacgggatcagggcttacccgcctttagcgtgatgtcctgtgacaacatgccggaaaacggtcacgtgacccgcaacgttgttgtacaactggcacagcatcaggatccggcactggcagactatattcagcaacacattaccttcccctccaccatggtcgatcgtatcgttccggccatgaccgatgcagcgtttgcggcactaagcgagcgtctgggttccgatgacccggttgcggttgaagcggagcccttctttcagtgggtgattgaagataacttcgtcaatggccgtccggcgtgggaaaaagcgggcgcagaactggtcagtgacgttctgccctatgaagagatgaaactgcgcatgctgaatggcagccactctttcctggcctatctcggcttcctggcaggttatgaatacatcagcgactgcgtggccgatccccatttccgcgccgccgcccgtgcactgatgatcgatgagcaggcgccgacgctgcgtacccagggcgtggatctcaacgcctacgccgattcgctgatcgcccgttacgaaaaccgtgccattaaacatcgcacatatcaaatcgccactgacggatcgcaaaaattgccacaacgcatgctcgacagcctgcgctggcatctgcagcgcggcagccgctgcgacctgctgctgctgggcgtggcgggctggatgcgctatgtcggcggcgtcgatgaacagggtcagccgattgagatccgcgatccgctgaaagccacgctggcagagacggttgccggtagcgaagaaggcgaagcgcgtgtccgtgcgctattgggtctgcgcgacatctttggcgacgatctggcgcagaacgccgatctggttgcccgactgacgacgtattaccagcagctgacgactcagggcgcgcgggcgacggtgcaacagtgtatgagtcaggcataacagcctggtgacaaagcgctggcgcagatgcagcgcgctgattagactgacactttcccatcgcgctggcccctgccagccgtaatatggatattgctgcatgtcgatcgcctataccattactaccagcgaaccggtaaatcagcagatttaccggtatctgcgcaaagatatcgtcacctgcgcaattcagccgggctcgctgctctcggaaaaagaggtgtccgcgcgcttcaacgtttcacgccagccggtgcgtgaagcgttcatcaagctggccgaagccggactggtacaggtattgccgcagcgtggcactttcgtgcgcaaaatctccgctaagcgggtggcggatggccgctttatccgggaggcagtcgaggtgtcggtggttcgccgtgcggcactggagattgatgatccggctctgatggcgctggagcataacctgcagctgcagcgcatggccgctgaacggcatgacagccaggcttttctcactctggacgatgagtttcatcgcctgattgctgaaagcattgactgtaagctggcctgggaaacggtggagaacatcaaagcggccatggaccgggtgcggtttctgacgctgagtgaagtctctccaccggacaagctgattgagcagcatgaagagatttttgcggcgctgaagcgtcatgacgccgatgcagccgaagcggcaatgcgtcgtcatctgcaggagatgatcttctctatcaccccgattgccgagcgtaacagcgcctggtttgaagcaccctgaacctgaaaccgcccgcaccacctgattaccaggtcgatgcgggccttcgtcgttaccaccattgatgaaaatggtgaaccggcccaatacccttcccgacctccagcgaatccgcctgcagcagcgcctgctgtaaccagtttttggcttccccaatcgtctctgcccagtcagcatgacgtggtcgcaacgcggctaaggctgccgacagcgtacagccggtgccgtgcgtatgacgggtattcacccgcggcgtactgaatcgctgctctgctgagtgcgtgatcagccagtccgggctctccgccgccgtaaggtgaccgcccttcatcagcacggcctgacagcccagtgccagcaatgcccgtccctgctcgcgcatttccttttcatctgccgcaatggcgcaatccagcaacgccgccgcttccggcagattaggcgtgatcagcgagacctgcggcaataacagctctcgtacactggctacggcgtctggcgagagcagcgcatcaccacttttcgcaaccatgaccgtgtccagcacgataaacgggattgccgcattgctcagccgggccgcaacctgctccacgatagccgtttctgacagcatgccaatttttgcgctgtcgatgcgcacatcactgagcaccgaatcgagctgggcggccacaaagtcaggcgtaatgcgataaaccgactgcacgccgcaggtgttctgtgccaccagcgcggtgatgacgctggtgccataggctcccagagccgagaaggtcttgagatcggcctgaatccctgcgccgccgctgggatcggtacccgcaatcgtcagagcgttaatacgcttcatgattaccctccagcgtccagagtgcatcaataaacgccgtggcaaagctgccggggccggcagcctgcgccgctgccttttcacccgccagcgccatcacctgacaggcggccgcgacattcatcagccgatcgccaggcagagagctgaaacccgccaccactgccgagagggcgcagccggtcccgactacccgtgtcattaaggggtttccaccgtgtacagcaaggagtcgctgaccatcggtggcgtagtccacttcaccggtgacgaccaccagcgtgctccaggtttccgcgagctgttgggccgcatcgagtgctgcatccgcctgatgcagcgtgtcgacaccgcgcccgccgctggcctgttgtgccagcgccagaatctctgacgcattaccccgaatcaccgccggttgctggcttaacaattgctggcagaagtcactgcgcagcgtcagcgcgccgacggcaaccggatcgagtgtccagggcgtgcccgcctgattagccgcagtgacggcagcctgcatcgcctgctggcgctcgcgggttaaggtgcccacgttaatcagcagtgcatcggccatgctactgaactgggcggcctcagcggtatcgatcaccatcgccggtgaggcatggagagccagcaacacgttggcggtgaagttctggaccacgtcattggtcatacagtgcaccagcggtgactggcggcggaaagcgtgcagaatgggcgcgaagtgcgcggcagaaaggtgttgagattgatgtgtcatcgtagctcccaaccggcgaaacaagaaggcgaatgcggtcaggcatcagacttccctacgctggcattatccagttcaggtcagcgggtttttctcagccctttccttgtggaaagcggcaccccgagtcgtgttacggcttgcagcataggcaagccgcgcagcgaaagcaagcgactcccgcctgggaaataatcagagctgaaacaattcacatgatcccgatcaacgcctgagggtgcaaaaaaaggcttaatgctgcgggttaacgagatacctctttataggtagtcacacttattacccggatgggtaatatttcccgcagtgactctggtcaccccataataattaacctgctcgcagtatcatcgtaaaaaacactttatttcatggagtcagaaaactcctgaagcggaacttcatactattcaggatgtatgatgcgatttttagcgcttattccacaccgccatcgatggcaggatattaatattgaacgcaagggtgccgtggcacccaatggcagacagtacctctccacctatatttccgcccgttgcacaggctgtggtgaaattattcaccgtgtctattatcgcgacatcagcgatcggcaggcgcgccgctggttaggttagcgtcccggcaacggtcattccggacacagttcaggttaacagttagttagcaatttgttagtctggtaactaatcatcgtctgaccagactctctctatgccactgctgtttgaaagcttaagtcatcaaatttacctgtcagccccgctgtttatcctgatcctgctggggtactgcctgacgcgcctcgggaaatggcccgccagcatcagcgaagggatgaaccgctttgtgtttaacgttgccctgccctgcatgctgtttcgggtgatgagcaccttctcgcaaagtccaccggtagatgcgcgcctgttgctggcctttttcggcagttgcctgctggtgtttatcgtgggacgactgctggcaacaaggctgtttaatctggatggcgtagcggcgtcggtttttgcgctgggcggcatcttttccaataacgtcatgctggggatcccggtggccacggtgctgctggggccagaagccctgcccccggtggcgctggtgctggtgtttaacagcctgatcctctggaccttactgaccgtttcggtcgagtgggcaaaacagggcagcttctcgctggaaggactctggcgcaccctgctcggcgtgctgaagaatccgctgatcatcggtattctcagcggtacagcctggagctttctgcaacgtcccttgccgctgctggccgctgaaccgctaaagatgctggcctcactggccgcacccttgtcgctggtgacgctgggcatgagcctggcgcactatcgggtgcgggatggcttaaaagagagctataccatctgcctgctgaagctggtgctgcaaccgatgacggtatgggctatcgcgtggctgaccgatctgccgccgctggagagtaaagtggtggtgctgctgggatcgatggcagtcggggttaacgtctatctgatgtcgcagaagtttaatgtcattaccggcccggcggcggcgagcatgctcttttctaccgtgtttgcggcggttacaacgccaatctggatgatgctgatgacgctggcgggctattaacaaaaaagcccctcagcacacgtgctgaagggctattgtatggctaactaaatgttactctgccgatttggtacgaatcagatagtcaaaagcactcagtgaggctttagcaccttcgccgctggcgatgatgatctgcttgtacggtacggtggtgcagtcgcccgcggcgaacacgcctttcaggctggtttcgcatttaccatcgatgatgatctcacccattttgttgcgctcaaccgcaccttccagccatggggtgtttggcaacagaccaatctgaacgaagataccggagagcggcagctcatgagtggtctgcgtcgtgcgatcgatatagtgcaggccggtgactttggtaccgtcgcctttcacttcggtggtctgggcgttcaggatcacatccacgttcttcaggctgcgcagcttatcctgcagcacctgatcggcgcgcatctcaccagcaaactccagcagcgtaacgtgttcaacgataccggccagatcgatggccgcttccacgccggagttaccgccgccgatcaccgccgtgcgtttgcctttaaacagcgggccatcgcagtgtgggcagtaggtcacgcctttggtgcgatactcttcttcacccggcacgcccatgttacgccagcgtgcgccggtcgccaggatgatgctgcgtgatttcaatactgcgccggaggcggtttcgatggcgtgcattccgccctctttcgctgccgggatcagtttgatggcgctctggctttcaatgacgtccacgttgtaatcatccacgtgtgcgcgcagtgaaccggccagttttgccccttcggttttcggtacggagatatagttttcgatatcgaccgtgtccagcacctggccgccaaaacgctcacccagcaggccggtacggatacctttacgtgctgagtagatggctgccgctgcgcccgccgggccgctgccgataatcaggacttcatacgcgtcacgcttgttcagctcttccgctgcacgtttgtcggcattggtatccactttgctgacgatttccgccaggctcatgcgaccctgaccaaactctttaccattgaggtaaaccgctggcacacccatcacgttacgttcctgaatctcgttctggaacaggccaccgtcgatagcggtgtggctgatgcgcgggttaatcaccgccatcaggttcagcgcctgtacgacgtcagggcagttatggcatgagagtgaatagtaggtttcgaaatggaagtcgctgtccagcgcggcaatctgatccagcaggctttgtgcttctttcgacggatgcccaccggtctgtaacagtgccagcaccagtgaggtaaattcgtgacccagaggtgaaccggcaaaacgcgggccactgttcgaacctgggttggtgatcagaaatgagggcttacgcacctgacgatcgttctcttcgcggaagctgactttgtcagacaaaccggcgatatcaaccaacagttcacggatctcggttgattttgcaccttcgtccagcgtggcaatcaactcaacaggtttggttaatttctcaaggtaagccttgagctgggttttcagatttgtgtcgagcatagtgatatcctggtcaaaaaatcgggtgccgcagcacccgattggagaatggtcgaaaggccgaagcggaattagattttaccaaccaggtccagagacggagccagtgttgcatcaccttctttccatttagccgggcacacttcacctgggtgagaagccacgtactgagccgctttcactttgcgcagcaggtcagaggcgtcacggccaatgccttcagcagtgatttcgattgcctggataacgccttccgggtcaacgataaaggtaccacggtcagccagaccttcgtcttcgcgcatgatttcgaagttacgggtcagcgcgccagtcgggtcaccgatcatcgtgtactggattttcgcgatggtgtcagaagaaccgtgccaggctttgtgggtaaagtgggtatcggtagaaacggagtagatatctacgcccagtttctggaactcttcgtagtgatcagccacgtcgcccagctcggtcgggcagacgaaggtgaagtcagctggatagaagaagaacacactccatttaccttcaacgtctttctcggttacgtcgatgaattcgccgtttttgaatgctgcgtttttgaacggcttgattttggtattgataatagacatctggtggcctccgttaaaatatgtgatgcaggttacataatttccgggccaacatctaatatgcagtcgttatcaatttgattaacgaaagctatcaaacgctaagagcctgatgctctctggcccggcaggcagtgtacagcgatttacgtgacatttaacccgctttatcttttccgcccctctccgcgaatcgctgctagttttgtaagaccggattaaaagggagctgacttgtggagattcgtccgtttactgaagccgatcgtccttttctgcgtacgctgtttctggcggcgcgtcggcataactggcgctggctggacggcagcgagtggcagctggaagattttgatggggtaatcctgggtgaaaccgtgctggtcgcggaagctgacggacagcgggtgggatttgccggcctgctggagaacgataacttcctgcacagcctctatgtcgatcctgactggcaggggcgcggcgtgggcagcgctttgcttaaggcggcagaggcgcgctttacctcaaccggtgcgctaaagtgcctgcagaagaataaagcggcgcaggccttttacctgaaacatggctggaagatgatttcacagggcgaaggcgaacatggcggctacgtgttaatgcactacccgctggcctcgcaatatgccagcgggtcgggtcgtgcttaaagcgcgcggaaggcgatgtcgccggggatgacttcgccctgccagtaaagctgggcagcaacgcgtccggccagctggcgataaagcgcggtaaactcgctatcgggccggcgaatcaccgtcggctgaccttcatcgagatcttcgcgcaggtcaatgtgcagcggcagctgggccagcagctgcgtctggtaatcctctaccagtttctgtgcgccgccagtgccgaaaatcggctcatggaagccacactgactgcagacatgcaggctcatgttttccaccacaccaagtaccggcacattgaccttttcaaacattaccagccctttgcgggcatcaatcagggcgatatcctgcggcgtagtcaccaccagcgcgccggtgaccggtacgtttctgcgccagcgtcagctgaatgtcgccggtaccgggtggcatatccagcaccagataatccagctcaggccacagcgtctcgttcagcagctgcatcagcgctttgctggccatcggcccgcgccacaccatggcattgtcgtccgtgaccagataaccaatagagttggttgccagcccgtgcgccatgatcggcgccatgtgggtgccatccggcgaggtaggccgttgatcctgggtgccaagcatgttcggcactgacgggccataaatgtcggcgtcaagaatgccgacccgcgccccctctgctgccagcgccagcgccatgttcacggcggtgctggatttacccacgccgcctttgccagagctgaccgcaataatatttttcacgccgttgacgcccggctggtttttcacccgtttcagggtggcaatgtcatggctgagtcgccagtcgatggcacccgcgccggtctgacgcagcagttcggcgctgacctgctctttcaggacgtcgaacccgctggcccaggcaaacggcatcagcagctccacatgcagcgtaccgtcaagctgtgccacgtgatgtaacgccttcagggcggtgagattctgcttaagggtcggatgctcaaagcttctcaatacgccagctacgatggcgcgcaggccttctggcgtctgcggttcccgggattgtgctgtcatcccctactccttatttctgctgtgcttacgctgtgtttcagcgatgtattgtcaatgatatcagatgcccgtggatctgcggtgaccgtagggggtgaatcccttgtgtttacgcaggagaagccttcagttaccatctaagcccgttttttcaatcaacagaaagctacgcaaactatgactcaagtcgctaaaaaaattctggtaacgtgcgcactgccttacgcgaacggatcaatccatctcggccatatgctcgagcatatccaggccgacatttgggtgcgttatcagcgaatgcgtggcaatcaggtttatttcatctgcgccgatgatgcgcacggtacgcctatcatgctgaaagctcagcagttagggattgcaccggagcagatgattgcagaaatgaaaagcgagcatgaagccgactttgccggtttcaacgtcagctatgacaactatcactcgacccacggcgacgaaaaccgtgagctttctgcgctgatttatggtcgtctgaaagagaacggttttattaaaaaccgcaccatctcccagctttacgatccggaaaaagggatgttcctgccggaccgttttgtaaaaggcacctgcccgaaatgtaaatctgccgatcagtatggcgataactgcgaagtgtgtggcgcgacctacagcccgaccgagctgatcgagccaaaatcggtggtctctggcgcgacgccggttctgcgcgactctgaacacttcttctttgatctgccatccttcagcgccatgctgcaggcctggacccgctcgggtgcgctgcaggatcaggtggcgaacaaaatgcaggagtggttcgaatcgggcctgcagcagtgggatatctcccgcgacgcgccttacttcggctttgaaattccggacgcgccaggcaaatatttttatgtctggctggatgcgcctatcggctacatgggctcgttcaagaacctgtgcgacaagcacggcgacatcgacttcgacgaattctggcgtaaagactctactaccgagctctatcacttcatcggtaaagatatcgtctacttccacagcctgtttctggccagcgatgctggaaggcagtaacttccgcaagccgaacaacctgtttgtgcacggctatgtcaccgtcaacggtgccaagatgtcgaagtcgcgcggcacctttattaaagccagcacctggctgcagcatcttgatgcggacagcctgcgttactactacgcggcgaaactctcttcacgtatcgacgatatcgacctgaatctggaagatttcgtccagcgcgtaaacgccgacatcgtcaacaaagtggttaacctggcgtcacgtaacgcgggctttatcaccaaacgctttgacggcaaactggcggctgagctggccgatccggcgctctatcagacctttgtggacgcgtcagagaagattggtgaagcctgggccggtcgtgaatacagccgtgctattcgtgagatcatggcgctggctgacctggcgaaccgttatgtcgatgagcaggctccgtgggtggtggcgaagcaggaaggccgtgatgccgatctgcaggcgatctgctcaatgggcattaacctgttccgcattctgatgacctggctgaagccggtgctgccgtcactgagcgcccgcgcagaaggcttcctgaactgcgaactgagctgggatgctatcgcgcaaccgctgctggaccaccaggttgcgccattcaaagcgctttacagccgcattgagatggcaaaggttgaaggactgattgaggcctcgaaagaggatgccgctgccgcaagtgcaccggccgcaagcggcccgctggcagattcgccggtaggtgacaccatcaccatcgacgatttcgccaaagttgatatgcgcgtggcgctgattgagcaggcggaactggttgagggttcggacaagctgctgcgcctgcagctcgacctgggcggtgaaaagcgtcagatcttctcgggtatccgcgccgcctatcccgatccctctgtgctggtcggtaaaatgaccattatcgtggccaacctcgcgccgcgtaaaatgcgttttgggatctctgaaggcatggtgctgtcagcgggtcctggcggcaaagatctgtttgtgctgtccgtcgacagcggtgctgtaccgggaatgcccgttaagtaacactctgcattctgcggctttaaccgcttagcgcagtgccgttctcaaacccttcgtgcctcatcacgggcgcgaagggttatcactcctcgctctgaatgtgcaccgcttccattccactcccgcccctgaaaaactgtatctgctgcggccacaccgctgcataaatgtgatcgctagcacgctaagcggttaatgcgtatgatgaagctcagtgaaaacaggagcctgccatgctcaccgtgctgtctgtctgcgggcgctatcttcgcgcctttatcatcatttatctctgcttatacgccggaatcggcatcgcctcgctgctgcccatcaaactgcctggcagcatccttgggatgttaattctgtttgccctgctcgcctcgcagatcctgccggtcagctgggttaaaccgggctgccatctgctgattcgctttatggcgctgctgtttgtgccaatcagcgtcggggtaatgagctacaccgatattctgaccgcgcagtttggccctatcgtgatctcctgcgtcgtcagcactttcctggttctctctattgtcggcgtaagcgcccaccagcttcatagtcgccgtccggccggggagtcaggcgatgagtgaaatatggtggtcactgccactgaccctggcggcattttttctggcgcgcaaactggcgatacggctgaaaatctcgctgcttaatccgctgctggtcgcgatggcgattattatcccgattctgctgctgttgcagctgccctattcgcgctatttcgcgggcagtcagattcttaatcagctgctgcaaccggctgttgtcgcgctggcactgccgctgtatgagcagatgcatcagatccgtgcccgctggaaatcgattattggcgtctgctttatcggcagtgtgaccgccatgacctctggcaccgctattgctctgtggatgggtgccacgcctgaaatcgccgcgaccatcattcctaaatccgttaccacgcccattgcgatggccgtctccggtttcgctgcacggcattcccgccatcagcgccatctgcgtgctgattgccggggtactgggggcggtgttcggacataccgtgctgaatctgcttggcgtgaaatctaaagcagcgcgcggactggcgataggtaacgcgtcgcacgccctcggcacagcacgcgccgctgaactcgactatcaggaaggggcattcagttcactggcgttggtgatctgcggcatcatcacctcactgctggcgccgtttatttttccgctgctgctgcactggtttggctgaaagtttgcgagagatctcgcaaagttgaaacatgcaacacaggttacattgtcagagcgatgtggatcacatataaaccggtgactggcacatcgccctgctgaatctaatgaggctcacatgcaatcccgtttcctctctgcctttgaggcattgccgtcaacgctgcaaaccgcactcgctccgctgctggacgatcctggctttcaggcggtgctgagcgccgaccaggtcgcctcactgcagcaacagacacagatggatgccgatgctctggcgctggcgctgctgcccctggcggcggcctgtgccgttgctaccgtgtcgcattttaacgtcggggctatcgcccgtggcgtcagcggcaactggtacttcggggccaacatggaatttatcggtacgcctttgcagcagacggttcacgccgagcagagcgccattactcatgcgtggctgcgtggcgaaagtcagcttgagacgatcaccgttaactacacgccgtgcggtcactgccgtcagtttatgaacgagctgaacagcggcacgaacattcgcatcagcctgccacaacgcgcgatcagcaccctggccgattatctgccggatgcctttggaccgcgcgatctggacatcacgaccttcctgatggacagcgtggatcacggctatctagccgaaggcgatgaactggtgcaggccgcagttgccgctgccaatgccagccacgcgccttacagccagtcacacgccggtgttgcgctgctgaccgcaaccggctcgattgtcaccgggcgctatgcggaaaatgccgcctttaacccgagtttcccgccccttcaggcggcgctggtcctgctgaacatgcagggtggcgatgttcgtcagataaaaaaagcggtattagccgaagtggaaaatgccacgctaagccagttcgccgccacacaggcgacgcttaagacatttggttgcggtgagctgctgcaggtgacgctgaacaaagcataacccgctgtcagagaggccacagttttgtgagcttttatgaacaaacgctgtacttctgcgggaaatttcataggatctggcgccagaattcacgtcattacaaattactctgaataattcaggttgcaggatggcagcacggtcgtgaatgtttctgcagcggttaccctgccgctgccaggcctgcagtctgagctataacgggtaagaaaactggcgctacctttccggcgtgacgccagacaacactgcaaccggagcattaccgcatggaactcgactacgaaagtaaacgcccgctgtatatcccttatgctggcccgattttgctggaatttcccctgctgaacaaaggcagcgcctttagtatcgaagaaacgtaacgaattcaacctcaacggtctgctgccagaagcagtggaatcgattgaagagcaggcgcagcgtgcctggcgtcagttccaggacttcaaaaacaataacgataagcatgtctacctgcgtaacattcaggacaccaacgaaacgctgttctaccgcctgctggataaccatctcgaagagatgatgcccatcatctacaccccgaccgtcggcgcagcctgcgaacacttctctgaaatctaccgtcgtgcgcgtggcgtgttcatctcctaccctaaccgcgaccatatcgaagatatgctgcaaaacgccaccaagcagaatgtgaaggtgattgtggtgactgatggcgagcgtattctgggcctcggcgatcagggcatcggtggtatgggtatcccgattggtaagctttcactctacaccgcctgtggcggcatcagtccggcttacaccctgccggtggtgctggatgttggtaccaacaaccagcagttgctgaacgatccgctctatatgggctggcgtcatccgcgcatcactggcgaagagtatgatgcgttcgtgaacgattttattcaggccgttaaacgccgctggccgaaagtgctgttgcagtttgaagatttcgcccagaagaatgccatgccgctgctgaaccgctatcgcgatgaagtctgctgctttaatgatgatattcagggcactgccgccgtgaccgtgggtacgctgattgccgccagccgcgccgccggcagccgcctgtgcgaccagaaagtggtgttcctgggcgccggttccgcgggttgtggtatcgctgaacagatcatcgcacagatgaaatccgaaggtctgagtgacgaggaagcgcgtggccgcgtaatgatggtggatcgctttggtctgctcactgacaagctgcctaacctgctcgatttccagagcaagctggtgcagaagagcgaaaacctgcagcagtgggatgtcaccaatgattccatctcgctgctggacgtggtgcgcaatgcgcagcccgatattctgattggtgtctctggccagccgggcctgttcaccgaagagatcatccgcgagatgcacaagcactgtaagcgccctattgtgatgccactgtctaacccgacatcacgcgtggaagcgacgccagccgatatcatcgcctggactgacggtgccgcactggtcgcaaccggcagtccgtttctcgccggtgagctggaacggtaaaacctatccgattgcgcagtgcaacaactcctacatcttcccgggcattggtctgggtgtgattgcttcgggtgccagccgcgttaccgataccatgctgatgaccgccagccgcgcgctcgctgactgctctccgctggtgaatgaaggtgaaggcccggtgctgccagagattaaagatatccagggtgtatcgaaaatcattgcgatggaagtcggtaaagctgctcagctggcgggtgtcgccgtggtgacctctgaagatgtgttgtcacaggctatcgccaacaacttctggctgccgcagtaccgtcattatcgtcgtacctcgatttaatcttcagactgccggattgcatccgatccggcagtgttcaaaaagagcacagccagccggcagtaacttgcttcacagtgacagctcaagtagccttgtcccatctcactattctgacatcgagtctccaggcgcatgctgaaacgcgttttcattggtctgcttttcatcatcttactgatgatggcaacggcgctcggccttgatcgctggatcagctggaaaactgcgccctttatctacgaaaatgtcgcctctttgccacatcgtcaggtcggtgtggtactgggtacggcgaaatattatcgcaccggcgtcatcaatcagtattacctctatcgtatgcagggcgcgctgaatgcctacaacagcggcaaggtcaattatctgctgttaagcggtgataacgcgctgcaaagctataacgagccgatgacgatgcgccgcgatctcatcaaagccggtgtcgatccggctgatatcgtgctggactatgccggtttccgcacgctggattcgattgtgcgcacccgcaaagtgtttgataccaacgacttcattattatcacgcagcgtttccattgtgagcgtgccctgtttatcgccttacagctgggtattcaggcgcagtgttatgcggtgccctcaccgaagaacatgcttagcgtgcgcttccgtgaggtaggtgcccggctgggcgcgctggtggatctcttcctgctaaagcgcgaaccccgcttcctgggcccactggtgccgatccccgccgtacgcgatgtccctgaagatgcgcagagttacccggcagtgacgccggagcaactgctggagctggaacaaaagctgcggaaatagctcacgcgctgcggcttctttatgctggttactgctatgtcgaggtctggcagtaacgtgcagggctctaggagctgacggtaatatgctggctcagggagcatacgtttagtcgccgtctgttactatgcagcgatcattaagctgattaattacatgactacggtagataattcagtgctacttcccctctgaaagccgacttagactgctgagaaatctgaagagggtgaatcttataacaatgaataagctcaacgcgcagggatcacggtcagaagaggaaagcgtcccacgccagggatggcgtgggccgagcgtgtcatggatgacggcttttgcgactttccgatctgaccgtgttccctacgcatactcgatctcacagcaacgaccccagcactctccgctataaaaagcgttctgcggaggaatgacacgggcagatcatttactggccttagcgactttccgatctgaccgtgttccctacgcatactcgatctcacagcaacgaccccagcactctccgctataaaaagcgttctgcggaggaatgacacgggcagatcatttactggccttagcgactttccgatctgaccgtgttcccttcgcatactcgatctcacagcaacacccaccacttccacataataaaaaagcgacccgaaggtcgctttatgagcactgaagaagacttacttcttacgagaatatttcagggaatccagcgccacggcgaagatgatgatgccgcctttaatgatgtactgccagtaagggttaacgccgatataggtcagaccatagttgatgacggtgaagatcaacacaccggtcactacgcccgccacgctacccacaccaccggcgaaggagacaccgccgaccacacaggccgcaatcgcatccagctcatacataaagccaaggttgttggtggccgaaaccgatacgacccgcttccagcatcccgccgaaggcatagaacacacctgacagggcataaatcatgatcaggttcaggttgacgttaacgcctgagactttcgccgcttccgggttaccgccgatagcaaaaatgttcttgccgaaacgggttttattccacagcacccagacgaaaataatggcaatcacggcgtaaaaggtgatgaacgaaagcttgaaatcaccaaagcgtaagaagccctgggtaaatttcgagaaccctgtatcaaaaccggcaatcggtgatgcgccaacaaagtcgtaatagagtgagttgataccgtaaacgatgatcatggtgcccagcgtggtgataaatggcgttaccttgaggtaagcaataatcacaccgttgaccagaccaatcacgccgccgatgatgcacacggtcagaataaccagtggaatcggcaccgtatccagcgtcgggaagactttgttcgcgttatccatcgcctgcagcagcgtcgcggcgaccaccgccgccagaccgacctgacgtccggctgacaggtcagtaccctgcgtcacaatcagacccgccacacccagtgcaataataatgcgcaccgaagattgggtcagaatattactcaggttcattaaacttaaaaatgaggggtcctggaaaataataatagccagcaataccagcagcacgacataaatgccgccctcttttaaccaggttagcgcattcttttttgtagtcgctttcatgttaacagcccttgcttcattaaaggtgtaatgacgctaaacgcaatatttcgttctgcgtggtcgttttggtatcaactatgcctgctaccagaccattactcattaccagaatacgatcggtaatgcctaacagctccggcatttcggatgagataataatgatgcccttttctcttttcgccagctcagcaattaactggtaaatttcgaattttgcaccaacatcaataccgcgagtgggttcatcaagcatcaggatttcaggctgggtcaataaccagcggccaataatcactttttgctggttaccgcccgaaagcgaaccaatctgagtatggtggcctggcgtttttacacgcatagaatcgatcacccattgggtatcactcttcatgcgtttattatccagcagtcccatactgtttttatattttttgatattggaaataagcgagttaaaaccaatgtcgaggaaagcataaataccggttgagcgacgctcttcagtcaccagcgcaaaaccgtggttaatggcttcattggcgctgtgattattaatcggtttgccatgcagtttaatggtgccgcccgatttttcgcgaatgccaaacagcgtttcgacgatatcggtacgtttggcgcccaccagcccggcaatgccgagtatctcccctttacgcaaatcaaatgagatgtcgcgaatcgatggctgacgcagtgacgtcagatgacgcacctcaagaatcgtctcgcctggcacgttggtacggtcagggaaacgctggttcagtgaacggccgaccatcatggagatgatcttatccatatccagcccttccagcggctgagaggtgatccactgaccatcacgcaggatagtgatctcatcacacagctggaaaatctcttccattttgtgcgaaatataaacaatgccacagccgcgatctttcagcttacgaataatcgtgaacaggtgattaacctctttctcggttaacgaggaggtcggctcatccataatcacaattttcgcgtcgtaggaaaacgctttggcaatttcaatcatctgcatctgcgatacagaaagattggcaactttatcgcgcggatcgatatcaatatccagctcgtcaaaaatcgctttggtatcccggtacattttatcctgatcgacaaagaagcctttgcgcggataacgcccaagccacatattgtccatcacggtacgctgcaggaccagatttaattcctgatgcaccatcgacacgccattttccagcgcctctttggaacttttatagtcgatctctttaccctgaaacaggatactgccggtatcttttttataaataccaaacaggcattttaataaggtggatttcccggcaccgttctcgcccattaatgcatgaacagagtgaggccgcacttttaaattcacattatctaacgctttaacgccgggaaatgattttgagacatccgtcatttccagcagatattctcgctgcgcggtcgtattatcactggccatattttacctggctaaaaaacggtggtgacataaaaaaggcgcgacagcggtcgcgcccgtaatcgatcttatttcacgaactgagacagattttctttatcaaccggcacgtaaggaacgcggacgatcttatcaaccatcttgaagtttgttccgtcggtggcggctttgccgttagccagattgttggcaatatccagcgttgctttcgcctggttttccgcatcgttcagcacggtaccggccagcgcaccggatttcaccagcgccagcgcttctggcagtgcatcgacgccgaagaccgggattgaggtcatgttgtgcgctttcagcgcttcaaccgcacccatcgccatcgcatcgttgttggcaatcaccacttcgatttttttggcattcgggcctgacagccacgcatccatcttatctttggcctgcgcggtatcccacattgcagtatccatcgctaactgctgggttttcagaccatctttgttcagggtatcgatcacatatttggtacgggcttctgcatcaggatggcccggctcgcctttcagcagcacgaaactgaatctgaccatctttgttcagatcccacgcgggtgtggctttccagtgcttctcaatcagctgaccctgaatgatgcctgactctttagagtcggtaccgacatagtaagctttgtcataaccggccagcactttggcgttaggttctttgttgaagaagaccaccggcacgtcgttggcacgcgctttgtctactaccaccgcagccgcagccgggtcaaccaggttaatcgccagcgctttcacgccttttgccatcagcacgtcaatctgatcgttctgtttggactggtcattctgtgaatcattcatcagcaactgcacgccaccgatcgctttcgcttctttctcgatgtctttgcgcaccattgacatgaagttgtcatcatatttgtaaatggtcacgccgatacgggtgtcagctgcgtgagcggttgcaccaaacatcatgctggcaaccagtgctgtaagcgtgaaaaccttcttattcatggtatctccggttttattatgcagggtctttttagcgctaccgcgccatacaggcgggagagcaatcggtaaaacagatcggcgcgtcggttaacgtaatgagaatgttaagccattgaacaccgtctaaaacctgacttccctgtgacagaatgcttccatgaagagggtataaaccctttaaccggctactgagaccacaactgatgccgttacactggcgttacataatgtttcagtccggtaagacgctgccatcatagtgagagcaatgttaattaactgtgaatgtaatcacagattgaaaacggttacatggctgaatcgcctgaattagtgacggactccacattttgccgctgcgccaccgaatgacgccgcaccagcgttggcataaagatgtgcgttgccgtgtcatccagcagtccggctgcgccctgcagcgccagttcagtggcgatttttgccatagatacaatgggatagcgcacagtggttaactgtggatcggtgtaacgggaaatggggatatcatcaaagccaatgacagaaaaatgctgtggcacctggatgccgttgtctttcagcgcagtgagtgcaccagccgccatgccgtcgttataggcaaacaccgcactgaggttgagattgcgtcccagcagctccaccatcgccgcttcgccgccctgcatatcgggctctgcgctggctatccagctctcctggggccggatgccctgctctgccatcgcctgaatccacccttcacggcgctgcgccacatcttcgatgggatggcttgaacaaaggtagccaatgcggctatgcccctgctgtagcagggtttcgtgaagccatcaacgcacccgtgacgttatccagactgacactgcggtgttcaaatccgggcacgatgcggttaatcaccaccatgcccggaacgtggcgcataaaatccgccagctcagcgtcaggcagtgttttcgcgtgtaccaccagggcgctgcaacgctgacgaatcagcacttcaatggcatgacgctctttctcttcctgatgccaggagttgctgattaacacatgtttgtgcacgcgctgcgccacggtatccaccgctttaaccagtgcaccgaagaagggatccgaaacatccatcaccaccacaccaatggtgtcactgacctgcgtcgccagcgcctgcgcattggcgttggggcgatagcccagcgcttccaccgcctgtaacacggcgtcgcgggtgtcagaggtgacggcgctgctctgattgaggacgcgcgacacggtcgccaccgacacgccagcctgacgggcaacatcacgaattgttatcatgcagcagttccacaaaggaaaaataaggcatcacgccgggttgaacaccggcgctattttgtcaggggcaggaggcgtacagcgtgaattgcgtcacatcaatgaaaacggttacatacaattctgtaacctttgtgatggcggtcattatctggcgttgtcagtgatgcgcgatttaccggctgagatcagcgtgagccgccgccacagccactccagcggaccctgtgcgaagaaatgtaaccagatgagtgaaaacaggatattgataagccagaccgcaggcaccatcagcaccagctccagccgggtgaagtgcatatagaagccgaagcgatagaacagcgtggtgcagatcagcgactgcagcagatagttggtcagcgccatgcggcccacgcactgaatggcatagctgatgcgccagcgcgctatctgcggccagtaagccagacagagcgcggcatagcccaggctaatcagcgggctggcgagatcgcgcggggcttgcagataaaaagcggtccagcggaattcccaatgtaacagccattgcgctgccacaccggccaccgcaatcaacaaccccatcgtcagcagcagcgccgccgcctgacggtaatgttgcgctgaaaactcgccgatcagccagccactgcgcagcagtgcgccaccaatcatcatcaggcccgccagctgccagccatactgcgccgccagcgccatcagtcctgacgagagatgatccagccggttctgtatcgcttcccagccgccggtcagtttccagtactgttcatattgcagatcggcagcacctggcagccaggatcgggtcggttcaggatcggagattgacccaaacaccagcagaacgccacagcccaccagatagagcagaatgccggtattcatcaggctgcgggtggaagggacatcgcgcaacacccgccagaccaccagtccgataatgccgtagtccagcaggatatcgccctcccagagaaagacgccgtgcagaaaaccgatcagcaccagcagtgagagccgggcagtcagccagcgactgccgcgtggcagctgcatttgcagacctgcgccaaacagcagcgcaaacagggtgaggaatttgagctgggcaaaggcgtcagagatcgcccatgtccagacatcggacaggctgacgctgccctgccaggccggattaaggtaggcggcagaaggcaggccaaagccgacaatattgagcagcagaatgccgagaatggcacatccacgaatgaaatccagcgcgtgatagcgttgcatgcggcacctgcaccattgaggcgggcaacgttatgcgcccgccgtagactcaactatggcgcaccgcgcgcaaaaattcctggcgggtattctggctggacttgaacaggccgcccagagaggtcgtcgtggtggcgctggtggcatcttttacgccacgcgctttcacgcagtaatgcaccgcatcaatagaaacagccacattgttggtgcccagcagcgtctgcagtgcgaccagaaacctgctgcgtcagacgctcctgcacctgcgggcgctgggcgaagaactgcacgatacggttgattttcgacaggccaatcaccttttctttgggaatgtaggcgacggtcgctttgccatcgatgatcacaaagtggtgttcacaggtgctggtcagcgtgatatcacgcacggtcaccatctcatcaaccttcattttattctcaatgacggtgattttcgggaagttggcgtagtcgagaccggaaaagacttcatccacatacattttggcgatgcgatgcggcgtttccatcaggctgtcatcttcaagatccagattcagcagctgcataatctcggtcatgtgcccggcaatcagacttttacgtgtgttgtcatctatatcgcgcgtcggtgcacgtaacggcgtttccagtccacgcgccagcagcgcttcgtgaaccagggcagcttcctgacttagggtgctcatcttactcttctccggctggtgttgcgcccgccagcttttgccagcgggccctgtaatcaggcgcgtattgtgaaactttctttgcggggaatccagcaatcaatcagattggtgatgaaagcttttcacccggttcgccgccacaccagcaggccggcccagaccaggctaacccctgcaacccacagggcaggctccagccgatgtaacagggctgtggagagaaaagagagcagcgggccgaccagctgcccgatagcatagccggtggtcagcaggccagccatgtagcgcagatgattgggtgccagctcacgggcgcagagcagcgacagctgcaccacgctgaggaaaccgccccccaccagcagcgcaccggccagcagaccgctaaagcctggcagcagcgccgcggcaaatacgcccagcgcctgcgcccacagcaccagtgccaggcggacgtggctgtgcccccagcgtcgcgtcaggatccccagcaggatgccgatcatcgccgcgccgccaaaaatcggccagacaaactgcgcgaagatgccgtcaggaaaccgcgtggcggccatctgcgacaaaaaggtggcgggcagaatgtagccaaagcccgccagactgtaactcagtaccagccgtttaaggttgcgatccagcaccagcggctcgggtgcctgatccgggcgatgcagttcgccccgacgcggcagattacgggtaatcagcgcaatcagcagcagcgccagcgcaccataagcggcccaggccagaccggcagaaacctgcaatgtgtgcagcgctacccccagcagaccgctgacaaaaatgccgcagcctggcccggcaaaaacggccgctgacagccctgcccggccatggcgatgtagctgttcattgctccaggccgccaccagcaccatcgcccagccgctggcccagccaatcagaaagcggattgcgccgtgcagccacggtccgctggccaatgctgagagcagggtcaggatcaccgcgccccatacgcccgcctgcaatcgcagctcaacccgccggtgcgcgcgcatggcatcaaatgagccacacagatagccaagatagttaagtgccgcgaccaggctggcactggtgagtgtcagctggtgtgcctgaatcatcagcggcacctggggcgtaaaggcaaaccggccaatgcccatcgcgacaaataaggttaaaaacgcgctgagcgcgacgcgtaacgccattgctgaactcctgttgttctgccctgagatctcttctgacttgctaacagcatgcaggatgattaaactcacggaaagtgaataatattaaccaacttgcttacaggaagagaagatatggatttagttcagctgcgtatgttctgttccgtcgccgaaacgggttcactggcgcgcgcagcagaaacagctgcatcgcgtcccctctaatctcaccacgcggctgcgccagctggaagaagaattaggtgtggatctctttattcgtgagaaacagcgcattcgcctgtcaccaatgggccataattttctgaattatgcgcagcgtatcctggcattaagtgaagaagcgatgagcatgacccgcaccggtgaaccggcgggcaactttgcgctgggctcaatggagagcaccgcggcgacgcgtctgcccggcctgctcgccgcctatcaccagcgcttccccaaagtggcgctatcgctgattaccggcacctcgggcgaaatcatcgatcgggtgcgtgaaggcaccctggcggccgcgctggtggatggcccggtctcccatgacgatctcaatggctgcatcgcctttcgcgaagagatgatactgatcaccggcctcgatcatgcgccaatcgccaccgcgcgcgacgtgcaggacgataccctgtttgcctttcgcaacagctgctcttaccgggtgaagctggagagctggtatcgggacagccagaccgcgcccaacagtgtgatggagattcagtcctatcacgccatgctggcctgcgtggcaggcggtgcgggcgtagcgatgatcccggcctcggtgctgaagcagatggcggatcggacacgggtgcaggcgcatacgttacctcccgcttatcgcgacaccgccacctggctgatgtggcgacgcgacgcctttacgccgaatgttgaagcactgaagtacctgattattgaacaatttgacgatcgtccgctcaacgatgagctgatttacccattacaggcggcggaataagcgttccacgctatgtttaagagcctgacccaccaggctttgaattatcacgaccacccggcgccactgcgcgtcacaatctgactggaagagggattgcatgaatatgatcaaaacccgtgccgctgttgcctgggctgctggcgaaccgctgaaaatcgaagaagttgatttaatgccaccgcagaaaggtgaagtgctggtgcgtatcgtcgcgaccggcgtctgtcataccgacgcctacaccctgtccggcaccgacccggaaggcgttttcccggcgattcttggccatgaaggcggcggcatcgtcgaagccgtgggcgaaggcgtgaccagcgttgaagtgggtgaccacgtcattccgctctacaccccggagtgtggcaaatgtaaatattgtctttcaggcaaaaccaacctctgccaggcgatccgcaccacgcagggtaaaggcctgatgccggatggcaccacccgcttctttaaagatggcaaacccattttccactatatgggcacctcaactttctctgagtacacggtaatcccggagatctcgctggcgaaaatcagtaaagaagcgccgctggaagaggtttgtctgctgggctgtggcgtgaccactggcatgggcgcggtgatgaacaccgccaaagtgaaagaaggcgacaccgtggcgattttcggtctcggcggcattggcctctctgcggtcatcggcgcgaaaatggcgaaagcgggccgcatcattgccatcgaccttaacaccagcaaattcgatctggcacgcaaactgggtgccaccgatctgatcaacccgaaagattacgacaagccgattcaggatgtgattgtcgagctgaccgacggcggcgtggatttctcgtttgaatgtattggtaacgtcaacgtgatgcgttccgcgctcgagtgctgccacaaaggctggggcgagtccgtgattatcggcgtcgccggtgctggtgaagagatctccacccgtccgttccagctggtgaccggtcgcgtctggcgcggttccgcgtttggcggcgtaaaaggccgttcgcagctgcctggcattgtgcaggattacctcgacggtaaatttgcgctgaacgacttcatcactcacaccatgccgctggaagagatcaacgacgcctttgatttgatgcacgaaggaaaatcgattcgctcggtcgtgcattttaacaagtaatcaggaggcgttatggcatccactctggagctactggaagaacaccgtatttttggcggctggcagcagcgctggcgtcatcagtctttgctgctgaactgcccgatgaccttcagcatctatctgcctgggccgcacggtgatgcgccgccgccggtggtctggtttctggccgggctaacctgcaacgatgagaacttcaccagcaaagccggcgcacagcgggttgcagcggaactgggtctggtgctgattatgccggataccagcccgcgcggcgaaggggttgcgaatgatgaaggatacgatctgggtcagggcgcgggattttatctcaatgccacccaacagccctgggccagccatttccgcatgttcgattatctgagcagcgagttacccgccctgattgcggataacttcaaggtcagtgaacgtcagtcgattatgggtcactccatgggcggacatggcgcactgatgctggcgctgcgtctgggtaaccgctttgcctcggcttccgcttttgcaccgattgtgaatccgatgcaggtaccctggggccagaaagcgtttcaggcctatctgggcgacgatcgtgcaacgtggcgggaatatgacagctgccagctgatggcggaggtgtcacatcggctgccaatgctgatcgatcagggcgacagcgatcagttcctggccgatcagctgcaaccggagcggttagaagacgtcgcgaatgaggtgggtttcccgctgacgctgcgcattcagccgggttatgaccatagctacttctttatagccagctttgtggaagatcatctgcgcttccatgcgcagcatctgctggcgtaaacaatcagggccgcaatcgcggccctgaacttttatgcctgctctgctggctaacgctctgtcacagagccagcgtcctgccagcctgccctgtaaaaattcctttctcagaacagtgatgctcagcgccctaccgggcgcctcctcaatatcagaccagtgccgggccggtcagcccgtcgatcatcacctgcgggataccacgcgagcagtgttcgatacgaccatcgacgccatacacttttgccagagtggcaggcgtgatcaccttatccggctgcccttccgccaccagcgcgccctgcttcagcatcagcgcatgttgcgcatgacgcagtgcaatattgatgtcatgcaccactaccaccgtcacgatgttacgctgagcggtttcgcgccgcaccaggtccattacgtgaaactggtagttgagatccagcgcgctcagcggttcatccagcagcagcagcttagggcgacggatcagtgactgcgccagcccgaccagctgcttctgtccgccggagagctgatcgagatatcgcatcgccagatgggcaatgcccagctgctccagcagatgcatgatttccgcttcgctgctggcgctgtgcagaccaccggaggcacgctgcgccacgatgatcgactccagcacatgcagatgcacgcccgcaggcagcgactgcggcagatagaccacgttcttcgcacgccgggcaaacggctgggtcatgagatcctcaccgttgagccacatctcgccctggcctttattcagaccggccagtgcacgcagcagcgtcgatttaccacagccattcggccccaacagcacggtgatctcgccgcgcggcagcggcgcgatattaagattatcaatgactttattttttgggtacccggcactgaagccgcgtaacgtcagaccctgttccatcataccgtcccccgatgacgcagaataatactcaggaagaaacggcacgccaatcagtgaggtgacaatgccaaccgggatgattacaccagggagcaggtttttcgaggcgaccgacgccagcgacagcaccagcgcgccgaccagcgcactggcgggcagatagaaacggtgatcttcaccaaacatcatgcgggcgatatggggagcgaccagcccaatgaaaccgatcgggccgacaaacgcgaccgccagggcagagaggatactgatgcgcagtaacgtagtcaggcgcagacgacgcacatcaatgccaaagcttaccgcgcggtcttcgcccagacgcagcgccgtcagcttccagctgctcatcattgaaaacggtaccagaatggccagcgccacgctcagcacgcccagcttctcccaggaggcgcgcgccaggctacccatggtccagaacaccaggccctgcagggtatcttcgctggcgatgaactgcatcatggataccagagcgttaaaggtgaagaccagcgcgataccgaacagcaccacgcccgccgaagagacctgagtccagcgggtcacggcatccagcatcagcgcggcaaacagagcaaagacaaaggcgttggcagaaattaaccactgatcgggaatgccgggaatacccacgccgaggatgatggccagcgcggcaccaaacgccgccgccgatgagacaccgagggtaaacggactggccagcgggttattcaggatggtctgcatttctgcgcccgccagacccagcgacaggcccactaccagcgccatcagcgcatagggcagacgaatgtcccagacaatgacgcgcgtgccggcatcgacgctctcggggctgagcagcgtattccacagcgtttcaagtgagagtcccgccggacccagcgtgaagtcgaggatcagcgaggcgagtatcgccagcaacagcacgccaatccagattaagcggcggcgcagcacctgatgatagttctgcatggtgtggtgaagcgtctcttcccccgccagcagcgaagtttcggtagtcatgtttgaaccctgtgtggctatcacgtcagaaaacgcagccacaatagtgcaggtgataataattatcaattcgagaacataagcgagacgtgaaaaaacagtaaaaaacggtgttgcaggcaggagaaaagctcagggagcctgcgcctttcgcaaagacgcagaacccgccatccctggcgggctcagcgtgggcgataacgcagagttaatctttgtgaaccgggaactccatctcgctgtacttcacgaaacggctaccgcgcgtcagcttgtagccgaaccagataatcaggaacagcggaatgccgatgtaggttgccgccacgccgtaccagtcgatgctgtcgttgaggaatgcctggtagttctgacccagcgtgatgatcaggcagagcacaaaggcgaaaatcggacccagcgggaagaagccggaacggtaaggcagatcgttcaggttacgtccctgggccacatagccccgacggaagcgatagtgactgatggcaatacccagccaggcgataaacccggtcatgcctgaggtattcagcagccacagatagacttcctgattaccaaattttgaggtcaggaagcacagtccggccaccacggtggtggcccacagggcattacgcggcacgccgccctttgagagcttcgcgaaaatccgtggcgctttaccttcgctggccaggttataaagcatacgcgttgacgcatacatcccggagttacccgctgacagcacagccgtcaggatcaccgcattcatgacggcggcagcagagagcagaccggcgtttctggaacaccagggtgaacgggctgacgctgatatcgtcgatatcattgtgcagcaactgcggatcggtgtatggcaggatcaggctgataatcaggatagcgaacacatagaacagcaggatacgccagaaaatctgccgcacagcgcgcggaatatttttcgccggatcttcagattcgcccgccgcgataccgatcagctcggtgccctggaaggagaatcccacaatcatcgccaccccgatcatcgccgcaaagccgcccgcaaacggcgcgtcgcccacctgccagttctgccagcccgcatgttcagcaccgcgcataatgccggtaatcatcagcacgccaacgatgataaagataatcacggtggccactttaatcagcgagaaccagtattccgcctcgccaaagccttttaccgaaatgtagttaagcaggaacatcagccccaggaacagcgcgctccagatccagccaggcgtgtcggggaaccagtagttcatcaccagctgggacgctaccaggtcaaccgcgatggtcaccgcccagttgtaccagtagttccagccgagtgcgaaaccaaagccctcttcgacatattttgcgccgtaggtggcgaaggaacccgataccggcatgaaggcagccagttcgccgaggctggtcatcaggaagtagaccatcaggccgatgaggatataggagagcagtgctccgccggggccagcctgagcgatggtggcaccggaggcgacaaacaggccggtaccaatggagccgccgatggcgatcatcgtcaggtgacgggcttttaacgcacgtcgtaatgcaggttgttgtgttgtatttgagtcattatgcatgtgttaacgctacgctgggtaaaaatgaggcgcgattgtagcagccagatcgcctctgtatagcgaatgccaacctgttattagttaacttcatgatcgcgccggaattattagtaattactcgcgacaataggaaaaaaaccgcgtcagtgctttggaaatatgcttctgccggtggtggatgcgatagagcgtgcggataagacgcggcagcggaatcgtcagttcaaccagcgtgcccgcctccagcagatcggcaatcacccggcgcgaaagacagctgatgcccataccgtgccgcaccgcatgcttgatcgcttcggaattgcccagctccatgcccagctgaaaactcggcagatgcgacagcagcagataatcgacaatttcacgggtgccggagccgcgtttcgcgcaggatccacggggcgtcagccagggtttgcagcgtcaccggctgttgcagaatcgccgcgtctggtgcggcaaacaccaccagctcatcttcgagccagggttcactgaccagctcggtcatatggcacggcccttcaatcaatccgacatcgacgcggaaatcggaaaccgcctgaatcacatcctgactgttgccgacactcagctccagcggcaggcggggaaaatcgcgacgataagcggccatcatgcctggcagcagatagttaccgatggtgctgctggcaaagatgcggatcgcaccgttatcctctttaaacagctgctcgatttcgcccgcctgctccagcagccctactgcacggggatagagcagccgtccatgctcattcagcaccagccgtttgccaacccggtcaaacagttgcactccgagctgactctccagatcggccagcgctgcactcactgcggactgcgacagtgccagcagttgcgaagcctgagtggtggaaccgctcttaagcacttcggtgaaaacttcaatttgtcgcagcgtaatgtgcatcgttgcctcttaactcagtgactgcctgaccaggtaaatgattaatgccagccagatcagccctatcgccaccagccagcctgcaatctttttgccgcgcgaacgttgagactgcgcccgctcgctgctgctgatgcgcacctcttgcggcagtaaacgcagcagcaccatgacgcccgtcggaataatcaccgcgtcatccagcagaccgacaaaggggatcacatcaggaatgatatcgatcgggctgatgccataggcgaccagccccagcatccccagcttgttccaccagggtgtgcggggatcacggaaggcaaaccccagcacaaacacatctcttttgatcagcgtcgcccagcggcgcagacgcgaaactatcatgattgctgccttatcgtttattctggttaattataaatatattatcaatttcacttttaagccagtcgccgtcatgatcgggtctcaaccaggaggagtgaccaccatgactgaactgagcatcgctaaaccgcatcatcccgttccgctctggatcccgggtctgctgctgaccgccgtgattgccggggcagccagctggctggcgcagcaaccgatgattgccgcgctggggctgggttcactgactctggcgattatgctgggcatcctggtcggtaacagcatctattcgccgctggcgtcacgctgcgacaacggcgtgctgctggctaagcagaaactgctgcggctggggatcatcctgtttggctttcgcatcactttacaacaaatcgctgacgtcggtttcagcggcatcctgattgatgcgctgaccctgaccagtaccttcctgataacctgcctgctgggcatgcggctgctgaagctggatcgcgataccgtctggctgataggtgcgggcagcagtatctgcggtgctgcggctgtactggcgaccgagccggtagtgaaagccgcaccgtcgaaagttgcggtggctatcgcgaccgtggtgctgttcggcacgctggcgatttttatctatccgctgctgtggccgctggcgcatgagctgttcccgggactgagtgcggcgcagttcgggatttttaccggctcaaccatccatgaagtggcgcaggtggtggccgccggacacagcatcagcccggaagccgagaacagcgcggtcattgccaaaatgctgcgggtaatgatgctggctccctttctgctctgcctgagcgccgtgatacgcggtaaacgtcaagggagcaacgcgcgccaggctgtgacatttccctggttcgccctgctgtttatcggtgttgcactgtttaactcgctgcagctgctgcctgccatggtggtggcgacgctgaatcagctggcgggtctgctgctggcgatggcgatggcggcgctgggattgaccacccgtttcggggcattgcgtgaggcaggcgttaaaccgctgctgctgggtgcgctggtgtttgtctggttaatcgcgggcggcggtgcaatcaatctgctggtgcaacatttcatgggctagcggcatcgggtatcatgccgtctcatccgtgcacagccccaggagaaaggcatgaaatatattggcgcacacgtgagtgcggcaggtggcgtggatcaggcagtgatccgcgcccatgaaatagaagccaccgccttcgcgctctttactaaaaatcaacgtcagtggaaggccgccccgctctcgactgaggtgattgatgcttttcgcgccgcctgcgagacgtacaaattcggtccgcagcaaatcctgccgcacgacagtttcctgataaacctgggtcatccggttgaagaggcgctggagaaatcccgcgcggcttttattgatgagctgcgacgtgccgaccagctcggcctgactttgctgaacttccatccgggcagtcatctgcatcagattgatgaggaggcctgtctgaagcggattgcggagtcgatcaacatcgccctcgatcagagccagaaacgtcaccgccgtcattgagaataccgccggtcagggcagtaatctgggtttccgcttcgagcatctcgccaccattattgagcatgttgaagataagtcgcgtgtcggtgtctgtattgatacctgccatgcgtttgctggtggctatgatctgcgtaccgaagcggattgcgaagcgaccttcgccgaatttgagcgcattgtcggctttaactatctgcgcggcatgcaccttaacgatgctaaaagtgccttcgacagtcgcgtcgaccgtcatcacagcctgggtgaaggcaatatcggcaaaacagcgtttagctggctgatgaaagatacgcggtttgatggcatcccgttgatcctggaaaccattaatcccgatatctggaaagatgagattgcctggctgaaagccgaacagcagggatagaaaagggagccagctggcttaatgctggtcagttaagattagatttgtaaaggctgtcacggtcaaacgtggcagcttttttgtcagtgcgagcgagccgcagtgcgggccagagcaggccggtggcgatcaggagcaggcaatccgcagcgctgaatagaatgagtctgccaggagagcccgcaggacgcgggcgaaaggcggggcggcacaggatgtgccatccccggcggtccgtcaggcagaggaatgaagtgaaggaaccgcgcagcggcgcgaggaccgccagcccctgagcggcaccagactgcgttatcacctgtcgcttaactggctggcatgctcccttttcgtttagagagtacgctggctcagggagcatacgccttccgtaaagacgcaaaaaaacgccatccctggcaggcgcagcgcgggcgattacgcacctcatccctgaggtgcgcccgtagccgggccaacgctttgcgttgttcaaaaacgctcccggctttttgtccatggcccgcgatgctttactccaggcgtatgctcccatcgctttgacttcgggaaccgtctgtaaaagcaaacagggagccatccggctccctgttattttcacttcagcagattatgcacttctgcaaatcaggctttcaccagctgctcttccggacgtttcagtaccgcatagctcagacccgcaatcgcggtgccgatgataatcgccatcagatagccgataaccggggtaatcgcgccagggatcagcagtacgaacagtccaccgtgcggagccatcagttttgcgccaattgccatggagatcgcgccggtggttgcaccgccaacgatacagcaaggcagaacacgcatcgggtcacgggcggcaaacggaatcgcgccttcagagataaagcaaagacccagaaccagtgctgctttaccaccttcctgctgacctttattgaatttacgacgggcaaccagcgtcgccagccccatcgccagcggtggcaccataccggctgccataatggctgccattggcgcataggtctgcgaaactcagtaacccgacgccaaacgcgtaagccactttgtttaccggaccgcccatatcggtacacatcatgccgcccagaatggcacccagcaggaccgcattcgccgttcccatgttggccagccagtgcgtcaggccgttcatgatgccagcaaccggtttacccactacgtagatcatcagcagaccggtgatcagactggcgaacaggggaataatcagtatcggtttcagcgcttccatactctgcggcagtttaactttgccgctgatcagcttcgccgcataaccggcaataaagcccgcgataattccgcctaagaaacctgcgttaatgctggtggcgatcataccgccaatcagacccggcgtcagacccggacgatcagcgatggagaaggcgataaagcccgccagcaccggcaccatcagggcaaaggcgctgccaccaccaatttgcatcagcgccgcagccagcgtgccctgctctttaaatgccgtgataccaaaggcaaacgacagcgcgatgctcagaccacctgcgaccaccatcggcaacatgtaagaaacaccggtcagcaggtgacgataagcccctgctccgcctttcttctcttcttcactgctattgttctgtccgccagccgccgctttatacggcttcgcttctgctaccgctttatccagctcctgcgcggttttcttcagcgccagaccggttgaggtacggtacatcggcttaccggcaaatttcgccaggtcgacttcgatatcagctgcgacgatcaccagatcggcggcagcgacttcttccggagtgatcgcattaccggcacccactgaaccacgggtttcaactttcacccaccagccgcgacgggtcgcttcagcctgaatggcctcggcagccataaaggtgtgcgccacgccggtcggacaggcggtaaccgcgacgacgcgtttctgtgcaccagcctgagccggtgcagcaggtgcgcctgctgcaggtgttgctaccgcagccggagcctgccaggttttcgcttctgctttcgcgcggttcaggaaggtttctggctcacgtactgccagctggatatcgcccagccagaccgctttgccgttcagcgccgcatcgtccggcacgtttttgcccagcacaatcgccagctcagcgtcggcaggattatcagtcagggtcaggcccgccgcagcggcggcagccgccagacgttgttgcgccatatatgcggaagccagtcccagtgtagggtctttaatcagcagcgttttcattatcgctctcctgctgtcagttaacgggttgtaagtcgacgcgcgccatcattgcggccaactgagtacgatcggaaacgccaacattgctctggctgacggccatcgccgccacggcagtcgcaagacgcagcgtgtgttcgctggattcgcgcatcagcagtccataaatcaggccgccaaccattgagtcgcctgcacccacggtgctgaccacttcgcacaccggcggtttagcgatccattcaccagaagcgttgacccacagagcgccttctgcgcccagcgaaatcaccacatgggcgataccctgctcgcgcagttcgtgcgcagcgccaatcacatcctgcagggttggcagtttgcgaccggcccagatttccagctcacgtcggttaggtttaaccagccacggtgccgccttcagtcctgccaccagcgcctcgcggctgctgtcaaagatgatgcatgggcagtgggtgcgaagttcggtcatccagcgggtaaaggcatcgtggtcgacgccctcaggcaggctaccgctgacgcagaccatatcgaactggcccagccaggtcagagaatcggtagtaaaacgatcccagtcctgcgccgtcacctgaaaaccggagaaattcagatcggtgacgtcaccggtctgttcagtgagtttaacgttgatacgggtacggccaggcacgacatggaaacggttggctatgcccagctcactgaacaactgctggaaaccgtcctgattctctttccccatgaagccaccgacggtgacatcgatacccagatccttaagtactttggctacgttgatgcccttgcccgcagcatgcagcccggtggttttcaccaggttaacttcgccacgttcaatttcaggggtataacccaccaggtcatacgccgggttcagcgtaatggtggcgacgcgtctgctcatgatgccccctcacccagaccactggtgatcgcttcttcaatcgcgttcagcgcctgctgtgcatcttcaccgctggcggtgaagcgcaggcgatgacctttcttcacgcccagcgcaaccactttcatcaggctgcggccattagcgggtttgccgctgccgtcgagattggtcacggtaatgtcgctgttgaactgcttgatcacgctaaccagcgccgtgcccggacgggcgtgcaggccgtgttcgttgcgaatggtaaattcagccgtcagcacgtcagcctgctcatcgacttcgctggtgagcagtgcgtaaacgcctgcagcatccgctttcaacagacgatccgctttgccctgctgcagcaatgcgctgaggtaacccagcacttccagcggacgttcatcggtcgccgaaacgctgattaacatcgcagccgattcgccctgatggtcgaaggcatgttcagcgcggctgatagccacgccgctgcgcaggttgccgaggctgctgtcgctgagccagatgccctgacccagattcagcggaggcgttgaaaccacgtctgcgacgtaactggcatccaccacaccagcggactgcagccgaccggcgttcatcgcctgtaaggtgatcagatcactggcagccacgttgagcgtgattaatgaggtgtcgaagctgaattcagcggcttgtttctcgcccatcagcaacgcacgaagatcttcagcagaggcggtttttagctgttctgcaatggtgtcatcgctcagcacatgggtcagctgacgcagcagcgccagatgttcatccgacttagcggcaatcccgatggcaacataggctgtctgatcgtcaccccaggcaatgccctgcggaaactggaaaacctgaacgccggttttcagcaccagatcgcgggtatcggtggtgccatgagggattgcgatgccgttgccaagaaaggttgaggtctgctgttcgcgcgccagcatgccgttgacgtatccttcggtcacattgcccgccgcggttaacgcggcagcaacctgacgaatggcctcttctttattctgggcgctggctccggtatggatggcctgcaattcgagctggaacataattctcctcgcttgctgagattgaatcgtttcagctagtgggaaagattttacgccatgctgaggaaaacagatggcgcagtcaccgctgaaacgtttcagggattgtggtacagccgctttcaccaggcaagaaaatgcgcaaatggcgtagcagatttttgacgttacgcacatttcgggcaggtttagcggattaacggacgaacaggctgacgctgctgctgtaaagtgagaatgagtggaccgaaaaacttcagcagcgtcagcgcctcagggcgcggtatccgcttcggtttacagcagatacgtttgcaattggtggatgcattctgcgcacgtcctgatgctgtactttcatgggatcgcgcagcggtagatgcaaccactgaaatcaaagcggcgctggctgctgccggaacgcccattggtcccaacgacaccgcgattgccgggcatgccattgcggccagggctattctggtgacaaataacacacgcgagttagaaacgggtacccggattgcagctggaagagtgggtcagctaaccgctgacgcgggattaaatctaagcggtgggagggttctcaggcacgagtgctggcttcaagctcaatcaggtaggtcatggctgaggtacggtctgtaagacacatatcaactgaaggttgcagacttccgcatactttcggccttaaatctgaaccgaaaatcatgcacaaattttcatccgataactgaatgcagcggacattcgcgggtttaccctgcggcattccggggatggggctggagattgacggcgcgatgcagcaggcaccacaatcaatacgacactgcattaacacctctcacgcgaccttcaggatacaacagacagtaacagaacctcagagggagcgacacctcacccttcagctcttaacttcctgcttaaatcgttcactgtcacccatgtcagaaatcggtgaagaaatagcgcgcgctgtgcaacaggcaccgccctggctacggcattgcatgctgtgccccggcagagaaagtcgcggcgacaatagcagtccggggcggcaattgccatgaaagccgcggcctgagacaaaatttcacgccggtgatattgccagttttcatcggcgcgagtaacgttgcgcgcacttcactctcaagatagcgagaacagcaatgccaaaagccaatgaaatcaaaaaagggatggccgtcacgcacaacggtaaactgctgctggttaaagatattgatgtccagagccccagcgcacgcggtgccgccaccctgtataaaatgcgctttaccgatgttcgcaccggtttaaaagtggaagagcgctttaaaggcgacgagattattgatgcaatttcgctcagccgtcgcagcgtgaccttctcttatatagatggtgacgaatatatttttatggatgatgaggattataccccctactcctttaaacaggagcagattgaagaagagctgctgtttatccctgaaggcggtatccctggcattcacgtgctgacgatggaaggtcaggtgctggcgctggaactgccacaaaccgtggatatggagatcgtggatacttcaccaggcattaaaggtgcttctgccagcgctcgcaccaaacccgccggtatgagtacaggcctctcgattcaggtaccggaatacctcagcaacggtgaccgcatccgcatccacattgctgaacgccgctatatgggccgcgcagactaaatcagaagcctgctgccgatcgtgatagtgttatattattacattatcacgttattccccggcaggagtcacccccatgacacgcgttaatctgattaccggttttttgggcagcggcaaaaccacgctactctgccatctgctggctgccaggccgtccggggaaaactgggcggtgctggttaatgaatttggtgagatcgggatcgacggcgccctgctggccgatcgcggtgccacgctgaaagagatccccggcggctgcctgtgctgtgtgaatggcctgccgatgcaggtcgggctgaatatgctgctgaagagtaaacccgatcggctgctgatcgagccaaccggcctgggccatcctcgtcaggtgctggagatgttgagtgcgcccgtctatcagtcgtggctgcaactgaatgccacactgacgctgctggatgcgcgtcagctggccaatcctcgtatcgttgccaatgaaaacttccgcgatcagctggctgccgccgaccttattatcgctaataagcgcgactgctgggatcaggcggatcatcagcgactggctgactggcagcagcagatgcagcctgcgcgccctctgatagagacagaatttggtcagatccccctttccctgctggatacaccccggcagccgcgcgagcttcccgtgccgcagcaccatcattcgtcgggtcccaccagcggtctggcggcgttgcgactgaatggcgaggcgcgctggcgtcgggcgctgaaccacggacagggctatagcgcctgcggctggctgtttgatggtgatacgctgttcgacagcggcatgctgctggaatgggttcggcaggcgccggtagatcgcgttaaaggagtgatgcgcacgaaagaaggcgctctgcgcatcaatcgccaggcaaatgagctgcagagtgaaacactcccctcaccgccatccgatagccgcattgagatcattcattctcaacaggctgactggaatcgactacaatcggcattgttgaagtgccgtttacgctgacagaggtattgtcggcggttatttttaataataatgagtttaactatgcgcgtaactcgccttattactatcctgctgcttaatgcactgggcgtggtgctatttctgtcatggtatctgcccccggaacatggcttctggttcggcgtcgataaatctattttctttggcttcaatagccagatggtgacccatccgctgttcgcgctgatcgtcgctatcacgaattaccgtggttttgatgcggtgtcattgctggcgatgggtctgctttacctgtcgatctggcggcgcgaaacgccacaggcgcagcgccggatgctggcaatcggcatcaccatgctgctgaccgccgtcgtttctcaatcagctgggccatttattgccggttaaacactccagtccgacactgttcttcgagaacgtgcatcgcgtcagtgaactgaccggtattcccgcaaaagatgcttcaaaagatagcttccccggcgaccacggtatgatgctgatcattttcgcctgctttatctggcgttattttggtttcagccgctttttaattgccacggctattgtggtgatattttcactgccacgcatcatggccggtgcgcactggtttaccgatgttgccgtcggttcaatgtcggtggtattagtgggtctgagctggtggctattaacgccagccagtgacgtattggttaactggttttatcgcaaattgccgggtaaatataagcccgtgacgtaaatgttaagcgcgggcgatttaaacccctggtttgaaccgcccgtgcttataaaaaacaccccatcactattagcctgctaattaaattcacgaaaagaaaaggttatgaccctgctggcaggttaaatagtcgccaatatcctctgtcaataaagaaaactctaaaaatagcggctatgccccgaattagcccccctttaactccctgttctcaccatcatttgaccacaattgtagctaaattagtcagtgtgttacggtttgatttcacatcaaaaaaacctatatgaaattgattaaaagcactcgccacggcgtctgtaatcagttaacctcagtcgcagtgaggcaaaagcggcagaaaattcggattttttaccgttaaaatgtgtccattaacacattttagtaattaaggatttgtcttagtctgtttcgcttattaatctccctgttttgtcatctggctggcgacaatcttgtcgtaaggaaatcgaaggaaaacccgaataatggtcaagtctcaaccaatactgagatatatcttgcggatcgtgcccgcagtggcgctggcaacactcctctcagcttgtagcagtacccatagcagtcaaaacgcgaataacgagaatcatgaagttaacaaccacaatggttttttacttcaggcgtctcaggatgagtttgaagaaatggtgcgtaatgtcgacgttaagtcgcgcatcatggaacaatacgccgtctggaaaggtgtgcgctatcgcctcggtggcgataccaaacgcgggatcgattgttccgcctttgtacaacgcaccttccgcgatcagtttggcttagaattaccgcgtttctacctcacagcagcaggacaccggtaaagagattacccgcagtaaactgcgtcccggcgatctggtgatgttccgtgcaggctctacgggccgtcacgtaggcatctatcttggcaacgataacttcgttcatgcctcgaccagcagtggcgtaatgatctccagtctgaacgacgattactggaaaaagcgctaccgtgaaggacgccgtgtattaagtcgtaacccgacctgataaccactttcgatcttctctcagccagagaacatgaaacgctgcttatgcagcgtttttttttcgcttttaatcatttttaccagcagttatataagataaaagcattctgactcagattaatagcaagacatttcccgccgtctcgttatattctcggtcgcttaaaccgaagccgtcgtgcgcaataacataataataatttgattaggggaagctcctcatgccactgtcgggggcgctacggcgccatgccacctatcctcgccgtatcgcatggagtagtgcgatggctggcggcttattctttctgttatttgctgcactctcgcttcaccagacctggcagaagcgcgaaacgacagcatcagcaactgctggagaacagccgcacggcattacagcaaacgctctccagcctgattaacagtactctcagtcccctgcttccgtttacccacactgcctgcaataccatcaatcgtgaactcacctcacgcgccgcctttgccggaaatcttcgtgccatcctgctggttaaagaaggtaatgccttttgctcctcggccaccggcagttttaatctgccgctcaatgtaattgcgcccctgagtgatatttcgcgtgatatcgatctgcagctgatgccgggcacgccgttgcagcccaataaaccggcgctggcgttgtggatcaaaaatcccggcagcctgcagtcaggcgttttcgcgacgctgaatattaccctggcaccctatcagctgctggcgtccgggcatccggaaatcaccggtatggcactgatggcacaacgcagtgccttaaccagctggcaatccgtcgtcatgcagaataaaaacctgccgacgccgctgcaccggcaggcgctgacaggctatccgctgcagtttgtgttgtacggttccactctgacgttcagcgattatcagaatatcctgctgagcggcctgctactgtcgctgctggtttcaggcgcttgctggctgctgttgtcggtttatcagcgccctggtaaagagctgattcggggcatgaagcgcggtgaatttcacgtcgaatatcagccgctggtcacctcccatgatggtcagccgtatgggatggaagcgttactgcgctggacccacccgacgaaaggcccgatcccgcccgatgtgtttattcactatgccgaggcgcagaacctgattattcccctgacccgacatctgtttcagctggtttcccgtgatgcccacctgctgtgtcataccattccccgtcatgcctgcctcagcctcaacatttcgcccctgcatctggctgacagcggtttccgtcaggatgtgctgcgctggcttgatactatgcctgcggaccactttacttacgtgtttgagatcaccgagcgagccatggtgcgcgacgaaaacgtcggagaaactgtttgactggttgcatcagcagcagatccatatcgccattgatgatttcggtaccggtcacagcgcgctgatctatctggaacgttatgactttgattatctgaaaatcgatcgcggctttgttcagagcatcggtacggatagcctgacctcgccggtactcgataccgtgctgcagctggctaagaagctgaacctgaaaagtgtggccgaaggggtagaaaccggcgagcaggctgcctggctgattaaccgcggtgtgacccatctgcagggttacatctttagccgtccgctgcggccggaaacgctgatagactatttccggcgtcataacgcctgacactacctggcccgaatcgcgccagacatctgacaggagagtgcatgctgtttcgttccggacttctgctgctgtgcagcctgctcagcgccccgctgctggcggcctctgtccagcaaagctacgcgttcacccaggccggtgaagcgaaatatccgcccggcttcagccattacgactacgccgatccccgcgcacccaaaggcggcagcatcaccatggcggtagtgggtacttacgacaacttcaaccgctacgcttctcgcggtaatccgggcattaacaccggcacgctttatgatgggctttacaccagctcagacgatgaacctggcagttattatccgctgattgccgagtcagcgcgctacgccagcgattttacatggattgagatccgccttaatccccgcgcccgttttcagaatggcacacccatcaccgcccgcgacgtggcgttcacctatcagaaattcatgaccgagggcgtgcctcaatttcgcgtcgcctaccgtggcgtgaccgttaaagcgctgaacgatctcactgtgcgcatcgaggcacagaagccggataaagatctgctgcttggcttactgacgctgccggttatcgcagagtcattctggcgcgataagaagtttaatgagccgttaagcgagccacccttgtcgagcggaccctatcgcatcactcgctggaagctgggacagtttattgagttcagccgggtaaaagaatactgggccgctgatctgccggtcaatcgcggacgctttaattttgatcgaatgcgctatgactattatctggatgacaatgtggcatttgaagccttcaaggcgggtgcttacgatctgcgtgaagagacatcggcaaagaaatgggctacccagtatcgcggccgcaattttgacgatggcagcatcgtcaaagagaccacgcctaacgatgccgctatcgatacccgctggctggtattcaacaatgaaaaaacgctgttccgggatcgccgcgtgcgtcaggcgctgtcactgatgttcgatttcgagtggatgaacaaggcgctctattacggtgcctggcagcgcgccagcagctatttccagaacacggcgtatgcggccagcggcgtgccggatgcacagcagcaggccctgcttgaaccgtggcgcgcgcaactgccacctgagctgttcagccagccttatcagccacacaaaaccgacggcagcggctatgaccgcgccagcctgttaaaagcgtctgacctgctgaaacaggcgggctggcagataaaaaatcaccgtctggtcaatgataaaaccggtcagccgtttaccatagaaactcctgctgcgcggtggcaccaataccgactgggcgttaccgttccagcacaatctttcccggcttggtattacgctaaacctgcggcagatcgacaactcacagtatctgcggcgctggcgtgaaggcgactatgacatgattgccacggtctatggggcgatgccgatcccgacgtccagtctgcagatcctgtggcagtctgacttcatcgcctcgtcgtggaataccgcgcgggtcaaagagcctgtagtcgatcacttcgtgaaacagattgtggcgcatcagggcgatcccaacgcgctgcggccgctggcccaggcgctggaccgggtgctgctgtggaatgcgtatatgattccgatgtggtacaacgcagagcagcggctggcgtactgggataagttttctcaccctgcccgcaagccagcctacagcgtcggactggaaaactggtggtacgacacaaacaaagccggacgcctgccggccagcaaacgctaaggagatcaccgttggccgcttactttctgcgcagattgctgctgatcatcccgacgttatgggcgatcatcacgcttaatttttttatcgtgcaaatcgcgcccggcggaccggtcgatcaggcgctggctaacattcagtttggtcagacaaccggtctgcccggcagtggcgcagacagcgccggttcacgcgccagcatcagtcatctcaatccggccgataatcagtaccggggcgcacgcgggctggatcccgaagtgattgccgagattaaacagcgttatggtttcgataaacctctctggcagcgttacggcgagatgctgtggaattatctgcgtctggattttggcgacagcctgtttcgcagtgcctcggtgatcgggctgatcaaagagagcctgccggtttcgatcagtctgggattatggagcacactgatcatctacctggtgtcgatcccgctggggatccgcaaagcggtgcgcaatggcagcgcttttgatgtctggagcagcgcttttattatcattggctactccatcccggcttttctgtttggcatcatgttaatcgtgctgtttgcgggtggcagctatctggactggtttccgctgcgcggcctcacctctgcgcagcacgacacactgccctggtatggcaaagtgctggactacttctggcatatcgccctgccggtgctggcgacagtgatcggcggcttcgccacgctgaccatgctgacgaaaaacgcgtttctggatgagatccgcaagctctatgtgatgactgcgcgcgccaaaggggtgccggagcgccgtattctctatcaccatgtgtttcgcaatgcgatgctgctggtgatcgccagcttccccgccacctttatcagcatgttctttaccagttcagtgctgatcgaggttatgttctcactcaacggacttgggctgctcggctatgatgcgactctgcaacgtgactatccggtgatgtttggcacgctctatatttttacgctgataggtttactgatgaatattctcagtgatctcacctatacgctggtcgatccgcgcatcgatttcgggagccgctcatgacgctctctccgctaaatcaacagcgctggcagcgctttcgtcataaccggcgcggctactggtcgctgtggatctttctgatcatctttctgctgtcgatgggtgccgaactgattgccaatgacaagccactgctggtgcattaccagcagcgctggacagtgccgctgctgtttgactacagcgagaccgactatggcggcgcactggcgacagcggcggattatcaggatccctggctgcggcagcgcattgagcagaatggctgggccatatgggcaccgattcgtttcagcgacagcaccatcaattttgctaccgaggtgcccttcccctctccaccctctgcgcagaaaactggctcggcacggatgccaacggcggcgacgtgatggcacgcctgctctatggcacgcgcatttctctgctgttcggactgatgctgacgctcttctccagtgtcatcgggattgtggtcggcgcggtgcagggctatttcggcggcacgattgacctgattgggcagcggctgattgaagtctggtccggcatgcctgcgctgtttctgctgattctcctctccagcgtgatccagccgggtttctggtggctgctgctggtcaccgtggctttcggctggatgagcctggtcagcgtggtccgggccgagtttctgcgtacccgaaactttgattacatccgtgcggcgcaggctctgggggttagcgacggccggattatgctgcgccacatgctgccaaacgccatggtcgccaccctgacctttctgccgtttattctgtgcggatcgattaccacgctgacctcactcgattttctcggctttggcctgccgctgggttcgccctcgctgggcgagttactgctgcagggcaaaaataacctgcaggcaccctggttaggcctggcgggctttttcaccctggcgatcctgctttcgctgctgatttttattggcgaagcggtacgcgacgcttttgatccgggcaaaggagcctgaatgaacacgccattgcttgccatcaatcatctctcggtcgcctttcgtcagggcgagacgcttcgccaggtggtgaatgacgtttcactgcgcattgacgcgggcgaaacgctggcgctggtgggcgagtcgggttccggtaagagcgtcacggcactgtcggtgatgcgactgctgcatgaggctgcggtggcttatcccagcggggagattctgtttaacggtgaagatctgctgcgcgcacgtgagcagcgcctgcgcgggattcgcggcaaccagatcgcgatgatttttcaggagccgatggtatcgcttaatccgctgcacaccgtggagaagcagctgtatgaagtactgtcgctgcatcgcgggctgcgtcgtccggcggcacgcggtgaaattctcagcgtgcttgatcgggtcgggatacggcagcccgccacccggctcaatgatttcccccaccagctctcgggtggggaacgtcagcgggtgatgatcgctatggcattgctgaccgagcctcagctgctgattgctgatgagccaaccaccgcgctggatgtgacggtgcaggcgcaaatcctgacgctgcttcgtgaactgcagcatgagctgaatatgggcatgctgtttatcacccataacctgaatatcgtgcgtcagctggcggataacgtcagcgtgatgcgcaatggtcacatcgtcgaacagaaccgctgccagaccctgctgaatcagccgcaacacccttacagccagcagttgctggccgccgaaaccggaaggaaaagcgctgccgctgcccgcagacgcgccggtcattcttcgggtcgataatcttcaggtcagctttccgctgcggcgcgggctgttccgccggcagagtggtgagaaacaggtgctctccggcctgagctttagcctgcggcgcggcgaaagtctggggctggtcggcgagtccggatcaggtaaaagcactacagggctggcactgctgcgactgattgcctcacgcggcgaagtctggtttgacgaccagccgctgcatcagctgtcacgtcgtcagttattgccgctgcgtcagcgcattcaggtggtgtttcaggatcctaactcttcactgaatccgcgtatgacagtgcagcagatcattgcggaaggcctggcggtgcatcagccagaacttagccgtgcgcaacaggagcagcgggtcatcgcggtgatggcggaggtggggcttgaagcggaaagtcgccaccgttatccggccgaattttcgggcggtcagcgacagcgtattgccattgcgcgggcactgattctggaaccggagttgctggtgctggatgaaccgacctcatcgctggatcgcacggtgcagaagcagattctgacgctgttgcgccgcttacagcagcagcggcagctcagctatctgtttatcagtcacgatctggatgtggtgcgcgccctgtgccatcagcttattgtgctgcgtcagggagaagtggtggaacagggagagtgtgaaaggttgtttgcttcacccgcggccgggtatacccgcgagctgctgcagtcggcgcaactcaacctgcgataaaagtctcggcaatcgctacgccctgatttttcaggcagcagttggtggcgctttcgtcacgacgctgaatgaacaggcagggctgtccttcgcactcggccactttacaatcgacctgaatatccgccagaacctcttttagctgctgaaggatctcccacgccggaatgccatcatggctgatcaagcgcagcgcaacgaaatcctgctcgtccagcgtggtgtcatcggattcgatagcactgtggtgatcgctggcccagcgaaaatgctgtggcagacgatgcacaatcgaaagttgcagcatagtttactctccccggatgagtttatgtcgcaacacaaagcagcccagctggaagcggcctgataaccgctgagtccggacagggtttaatggcccgtccgtgtggattgcagaagcgcattttttgcgactcacatcgcacttcagcctatatgtaccgcgttcacacgccgttaacaatcattttagctgcattgtgattacttttttaactaaatattttcacaatatcgaaacaaagtcaggaggcgtgcaagtcggcaggtcattgcagagggaaaccactgcgcccgattaccgggacgcagtgcggggacgtgaagcgtagaaaaagagcagcagagagattgtcgcgcacagtgcaatcgtgccgaccattggccaggcgctgttgaaactcaccagcgacagcagtgcgccgacaaatgccccgacgccaaaacgcagggtgcccgccagggacgatgccgtacccgccatatgcggaaactcatccagaatcaccgccatcgcattcgatgagaccatcgacacgcaaccgataaacatcgcgatccccatcaccagcggcaaaaagccgaggctgaaggcgctgaccagcagcagccagatccccatacagaactgtatcagcagtcccatccggaacatcgccaccgggccaaagcggcgcacggcgcggctgttaatcagcgtcaggacaaacagaaacaccacattgaggccaaagtagtagccaaagttttgcggtgaaacgtgattcagttcgatgtaaacaaagggaccggcattgagaaaggtaaacagcccggcaaaggagaaaccgctcgacagcatgtaactgaaacgcgcgcttgtggcgaaacagcgttacgaaattgcccagcgtagtacgcagatgaaaccgctgtcgctgctccggcttcagggtttcacggatctgcgtggtcaccagcacggtcgtcactaacgccgcgcccgccagcgcccagaagatggcgtgccagctccagagcaccagcagccagccgccgatgatcggcgccagcaacggcgcaatggtggtaatcagcatcacaaaggacatcatgcgggagaagtcctctttcgagtaactgtcacgcattaacgcattgatcaccacactggctgcggcagccgacagtccatgcagaaagcgcatcgtaatcagctgatcgatggtttgcgacagcgcacaggccgcggcggcgcaggcaaagatcagggtcccgagcgcaatcaccggcttacgcccatagctgtctgccagcggcccatagatcagctgcccaatcgcgaagccaagaatgtagaggttgagcgacatctgcacgctaccggctgaaacgccgaactcacgtgcaatctgcggcatggcgggcagatacatgtcgatcgacaacggcatcagcatggctaacagaccgaggatgaccaccagtcctgttggcgaattcttttccttacgcacaccctctcctgcccttatggtcgtgatgcgggccgccgggcccgtccggttattttgtctgcagctctttcggcagaccgatgctggcgatctcttcttctgtcagcgcacgatattcgcccggttccagatcggcgtccagtacgatgtcaccgatgcgctcgcgatgcagctcaaggacccgattgcctactgccgcaaacatccgttttacctgatgataacggccttcgctcagtgtcagccggacgtctgtcggggtgatcacctccagctgagccggtttagtcaggctcttctcattgtgcagttgcacgcccgccgtaaactgcgcggcggtatcgtcactgaccggtgattccagggtcacacggtaggttttctcgcagtgatgacgtggcgaggtaatacggtgtgaccactggccatcatctgtcagcagcaccagtccggtggtgtcgatatcaagacgccccgccgcgtgcagtttgaatgacatcggttcttcaatgaaatagatgatggtgggatgatcgggatcgtcggttgagcagacgtaaccctgcggtttgttcagcataaagtagcgtggaccagtctgcatctgcagtacgttgccgtcatagacgacttcgtggtcgggcagcagtttaaacgcggtatcgcgtacgatttccccgttaacggtgacacgctggccacggatctcgcgatgggcgatggcgcggctgatttccagttgctgagagatgaatttgtcgagtcgcatgaattcgttttgcctgttactgcggagggaatctgaaacggcctggttaaccgttgaaaatgtgcgggaagtataacgtgatccgcgccagcctgacagcgcgtttaccgcactttcatggcataattacccccagttttgcaaaagtgagcatcatgtcttttaccttacgcccctatcaacaggatgcggtgaatgccaccgtggcgcatttccgtcgtcatcaacagcctgcagtcattgtgctgccgaccggtgccggaaagagcctggtcattgccgagctggcacggctggcgcgtggccgggtgctggtgctggcgcacgtcaaagagctggtagcgcagaaccacagtaaatatcaggcttacgggctggaggcggatatctttgccgccggacttcagcgtaaagagagtcaacgcaaagtggtgtttggcagcgtgcagtcagtggcgcgtaacctcgaccagttcgacagcgccttttcactggtgattgtcgatgagtgccaccgtatcggtgatgataaagagagtcagtatcagcagatctttaatcatctgcgtcagcataatccgcaactgcgtttactgggcctgaccgccacgcctttccggctgggtaaaggctggatttatcagtttccactatcacggtatggtgcgtggcgacgaaaaatcgctgtttcgcgactgtatctatgaactgccgctgcgctacatgatcaaacatcagtttctggtgccgccggagcgactggatatgccggtggtgcagtatgacttcagccgcctgacggcacaaagcagcggcttgttcagcgaagccgatcttaatcgtgaactgaaacagcagcagcgcgtgacgccccatattatccgtcagatcgtggagttcgctgaagatcgactgggagtgatgatttttgcctcaacggtggagcatgcgcatgaaattttgcggctgctgcccgctaacagcgcgctggtgtcagcggaaacgcctgccagagagcgcgatgccctgattctggcctttaaggcgcagcagctgaaattcctggttaacgtggcggtgctgaccaccgggtttgatgctccgcacgttgatctgattgcgattctgcgcccgaccgagtcggtcagcctctatcagcaaatcgtcggacgcggcctgcggctctcgcccggtaaaaccgactgtctgattctcgattatgccggtaatccgcacgatctctttacgcccgaggtcggcgcgcccaaaggggccagcgacaatcagccggtacaggttttttgtcccgcctgcggtttcgccaacaccttctggggcaaggcgaccgaagatggcatggttatcgaacattttgggcgacgctgtcagggcgtgctggaagatgatgagggcgagcgcgaacagtgtgacttccgcttccgctttaaaagctgccccgactgtggcgcagagaatgatattgccgcccggcgctgtcaccagtgcgacaaaattctggtcgatcctgacgatatgcttaaagcggcgctgaagcttaaagatgcgctggtgctgcgctgtggcggcatgacgctggaacagggccgtgatgccaaaggtgaatggctcaaggcgacctattatgacgaggaaggcaccagcgtcagcgaacggtttcgtctgcagacaccggcccagcgcaaagcgtttgaacagctctttatgcgcccgcatcagcgcgcgcccggcgtgccgctgggctggcaaagcgccgctgacgtgctggcgctgcagccgctgctgcgtcatcccgactttgtggtggcgcgggccaaaggtcagttctggcagatccgcgaaaaaatgttcgattatcagggtcgctatcgccgtgccaatgagctgcgctaatgagcgctatcgggtccggctaaccggatgccgagcccggctggcgggtatatcgtttgctaccacccggcataacggctatactgccgcccgcttttgcatgtgcatcagcggtattgaataaccagcctgttactgggtcgcctgtagcaggaattaaataaagagatatattaatgctcactatcaatgcagtagaacgtaaagagcagggtaagggtgcgagccgccgcctgcgtacagcaaaccgtttcccggccatcatctacggtggttctgaagcggctgttgccatcgacctggatcacgactccgtaatgaacctgcaatctaagccaggtttctacgacgaagtgctgaccctgtcagttgacggtaaagaaactaaagtgaaagttcaggctgttcagcgtcacccgtttcaagccaaaactgttccacatcgacttcgttcgcgcttaatcgcgaacttcgttgaaagcagaagggccggttgcgaaaccggcccttttcttttggcgctgcccggtgaaatgatcgccgcgtgcagggaatgaaagccgggctaagcccggcttttttatttgctgctggtacggcgctgcagctgatcgcgcagattgggtggtgtgcccttaatcgtcagggtgtccgttgccggatcccagaaaatgcgttcgcccagcaacatcgcatcgaagttcagggtcagtcccccgccgcttccggcaaacttcgtcagctggcgcagagtactgcgatccgccgggaagctctcttccagttcatacccctgctcctgggtaaaggcctggaacgttttttcacccagcggtggcagttcgctcgacaactcttccagcgcaatctcctcgcccgcctgcagctgctcgttgcagtagctgtagacctgctggcgatagttctgccgctcctgcttatccagttccgattcgttgcagtagtcatctaccgcctgcaacagaccgcggttctgcgccttggtgtctaatcccacttcggcacccaggaagtccataaagaagtcagccactttacgtccgacgcggccacgcaggaaagtcagataacgggtcgattccgggttagtttcccactcggttaaatcgatgcgtgccaagatgtcggcatgattgatgtcgagatagtgggtgctgctgatatccatctgctcgttgacgcgcatgctggactggctgttcagcaccgcaatcagcaggtattccaccgccagatagcggtagtgaataaacagcaccacgccgccttcagcgaaggggtattttgcaagctcatcgcgcagacgaccggtcgcggcacggctaaaagcgagaaaatcatcgttgcccttacgacaattacgcagcgcttctgccagttcactctctgcattgaacaggccataggctttgctttttgcgctataaacccggtgtaactcctccaccatcgcgttgaccgtgttggtggcaggcagcagcgaatcgcgcagcgccagttcaagctggttttcatcgcgtttaattaactgatgcagggcaatctggtcgatatccagactcatggtagactctccttttagcacaggcgcgtattcaaacaccgccagcatcggctttcaactccatgcgtatagcgaacgcgctgctttcgataaaattgcggtaaaaagtgcgctgttccggtaatatatcgccttttgaaatgagcttagacgacgatatggcacaatcatcccgttacagtgacgaacgcgtggaacaactcctcgcggaaatggcccaaatcctgcacaaggacaaggcccccaccgatctctccctgatggttctgggaaatatggtgaccaacttaattaacagcgatgtcgctccggcgcaacgtcgttcactggcacgatctttcgccgatgcccttcaggcgtctgtgcgtgacgataacgcccattaattggctgatttgacttcataatatggtaaccaaccggcagcgctaccgcgaaaaagtttcccagatgatcagttggggtcactggtttgctctgtttaacatcttatttgcgctgattttaggcagtcgctacctgttggtcgccgactggccttcttcgctggcggggcgcatctacgcctataccagctgggttggccacttcagttttgttgtttttgccgcctatctgctgattatcttcccgctgacctttgtggtgatgtcgcaacggctgatgcgggtgttgtccgcggtggtcgctaccgccgggctgacgctggtgatggtcgacagtgcagtgttcagccgcttccacctgcacctgaatccggtggtgtgggagctggtcattaaccctgatcagagcgagatggcgcgcgactggcagctgatgtttatcagcgtgccgctgattttcctggttgagatgctgtttgcgacctggagctggcagaagcttcgcagcctgaatcgccgttcgtttggtaagcctgtcgccgccctgtttatcagcgccttctttgccagccacctgatgtatatctgggccgatgcgaatttctatcgtccgattacgatgcagcgtgccaacctgccgctctcctacccgatgaccgcccgccgcttccttgagcgtcatggtctgctggatgcccaggagtatcagcgtcggctgattcagcagggcgacccggaagcagtggcggtggaatatccgctgagcgagattactttccgtgatgccggcacacgcaacaacctgctggtgctgacggtcgatggtctgaacaacgccacgctggccaaagcgctgccggagcttaatcagttcgccagcgagaacgtgcgttttacccagcactacagcgcgggtgatacgccagagaaagggttatttggcctgttctatgggatctcatccagctacatgaacggtattctggcatcccgaacgccgtcggcgctgctgggcgcgcttagcacccagggttaccagtttggcctcttctcctcggaaggctttaatccgccgctctaccggcaggcgttgctgactgattattcactgcctgcaacgaccagccagcccaacgccagtactgtggcgcaatggcagaactggctggagaaacagaacggttcacaggcgccgtggttctcatggattgccctgaacggcccggacgtcaccggcgacagtgcaaaagcgcgtcagcgcagctatctgcgccaggctcctgccgttgatgagcagatccacgcggtgctcagcagcctgcaggcgcgtgatttactgaagaacacggtggtggtgattacggcgcagcgtggactggcactggatggcaatcctgacagcgctggaaaccgccagacgctgcaggtgccgttagtgattcactggcctgatacgcccgcacagaccgttgatcgcctttctgatcatcaggatgtgatgtcgacgctgatgcagcgactgctgcatgtgcggaccaatccagtgaactactctcagggtgaagatctgtttgctgcgcgccgccgccatgactgggtcgtcagcagcgaagagaataagctggtgattaccacgccgcaggtgacgctgctactcaacaataacggcagctatcgcgcttatgatgcgcagggcaacgccctgaaagatcacaagccagaactggcgctgctgttgcaggtattaactgaagagaagcggtttatcgctaactgattaataatcaggcaaatagccggcaggtatcttgcattaatggtgataacaagtagactaatcctccagtgttcggcacgtagcgcagcctggtagcgcacggtcatggggtgtccggggtcggaggttcaaatcctctcgtgccgaccaaattccctgaaaagcagccctaaaggctgctttttttgtttatgtcatcaaaccttaactttcctcgcacctcccacaattcgttctatacttaactgcgtgtgggtaacaagaggagagttcatgacatatattgaaaaagacgatccaacagaagcacccgagtcaggcgataagcaaccttccccgccagaccagaagtaacccacggggccgcgtctgacgcggcctttctatgtcagcttacctctccgtttaacattcagaatagtcccgtatggcagttaacattcctcttacaatcagtaggttaacagttgcattataatctgatctgcttcacaaaatcggctaccggctgcgcttattcatcaaactgaaacaaaaatgtcacataaaatgcctaccctgaaatccccagaaattgacggataatttttatggcgatcaaagcgaaaagcctgaaagatgcagaagcattgctgcattcaggcattagcaaagtggaactggcgtatgacattggcagcgacgatttctttcgtctggcaagccactggtgcgaccgaggtgcacgcatcagcaggggtcaccaccatttcgttgtttctctgaagagttttgccattcctcccaacgactgattccggcgggctgcttgccctgatccatcgcgcctgatttaatgcctttttggttttgatgatggtcccgcatgcgctatcccgacctgccgctgccgcctgttgcaggcggctttatcctttcccgacacattaaccgcagcgatcccttgctggcggtgagtcaattcgatccgcaaaagtatcaggatgggctggctatcgaatgggatattccgctgcctgcccgactgcagcaggctgtcagtaaacggcgtgctgaatacctcgccagccgtctgctggtccggtcagtgatggcagaactgggtattgctgatttcattctgactaatgcagccgatcgatccccctgctggcccgctggcattcaggcgtcactgtcgcacagtgcaggcatcgttgtggtagcggcaacccgtcagccctgcgctgttggggtggatgtcgagcagttcatgtcggagacgacggcgcatgaaacggctgagttgctgatgaacgagcaggaacagcacctgttacggacgctgcccgtctctttttgcgctgccgctaccctgctcttctcactcaaagagagcgtttataaagccatgtggccgcaactgcttcagccgatggactttccggatgcggaactggtgtcggtagatttctcacagcagcgcgcgacgttgcgactgactcaggacttcagcgggtgttttgcgatgggaaacgttactggaggcaagctttgtgtggcgggatactcaggtaatcacgctaatcacacatcggctttaaaaaaaccggctaaacaatacgcgttaaaactttgcggtttagccgggggtaacacagacgaaagaaaaggttcagaatggcagaaaccggagtttctgctgatcgctaacgtagcctggttcaggcgaagcatgccactacgcttttttgctaagctttgccagctgccgttaaagcccggtgtcggtgcgtttcaccgagtcgagcgtggcaagatcgcgctcattaccggtcagctccgtcaacttgccttcacgcatctccagcagccgatcggcatgaatgaagtagtgatcgtcatggctgatagcaaacaccgttttacccgcctgctgtagccacggcagcagctcgcgatagaagatacgtcggaagtgagggtcctgatccgccgcccactcatccagtagcagcacatcgcgctcttctgccaccgccagcagcagtgccagtcgcttactctgtcctttagaaagctgcagattcagcactttgttaccttcaatcttcagcttatcctgcatcttcagtctctccagccagagctgaaccagcgccggattagccgcaatcccctcccgcccgattaaccggtcaaacaggtgcaagtcggtaaagaccgccgagaaactgactgcgccacacatcaagctcatccgccgttatcggcttgccatccagcagcagcgtgccggactgaggctgataaagaccggtcagcagcatcgccagcgtcgatttcccgctgccgttgccgccaatcagaaagaccagttcgccccggcgcagcgtcaggttaaccggcccgacctggaagccgttatcaccatagtgaaaagagacatcgcgcaactccagcgtttgccagtctgaggacgtggaggcggagtggaatcctgactgataaggagcgaggtcaaaggcgttgagcttacggaatgcgacctgggcactgagcaacgtcggtagcgcgcccaccgcggagagcagcggtgtgcgtaaaaacagcagcgtcagggaaaaggtagcggcgacggcggtattggcccagcccaggctgttggccataaaaaagaccatgccgatagcgcctaacgtcatgatatttgaccagttgaccgcactgagatggtaagtatcggcgcggacaatgtggtgtcgccaggcgcgggcatcttcctgataaaccgtgtcgtagacctgctgagcgcgtgagcggttaagctgtagctctttgcgcccttcaatcaccgtctgataatcgcgatagaggttatcttcgatttcccgcagctttgccatgtgctggtaaacccgcgagaccagcagccagccgccaaccagcgtgacacccagccagacactggttaccagcagcattttaggcgacagccacgcgagatagatcgttgagccaagcgtaataatcacgccctgaaagagctccggcaggcgtacaaaggccagagtaatggcccgcacgtcgctggtcagtcccgccagcagttgcgcactaccgagttgctcgatgcgttcaatgcgggtatcgaggatacgcttgataaattcgccgcgcagtcgccagacaaactgatggccaagcatggtcagcgccagctgcgaggccagtgtcaccgccatcagcaccaccagctgcaacagaaactgcggcagtaccgcaaatgaggtgttgatggcgacaatcatttcgcgattgataaaggcgatcatgccgatacccagcacggcgcttaacaacgtgagcgcaatcaccccgataaaaggccagcggaactggcgaaaaacaacgcttagcaacgtcatgcaggcaatccagcagtcaaaaaacagcctgcagtgtaatgggatgcaaaatgatagcaatagttattcgtaccacgccgtaaccggcgtggtgggtcagaaagcgcgtcgaaacgtcaggttataacgccaggcacccaccagcggatgaacgcctggcttaagtggcaggatgccgtggtaacgcaggcgcgacggcccgccccacaccacaatgtcgccatgctccagcagcacacgctgggtactgtcaccccgttcgaaaccgccaaactgaaagaccgccggtaaacccagcgacaccgaaacgataggctgacgcagatctttctcatctttatcctgatgcagcgtcagcttcgcgcccggctcatagcgattaagcaggcaggcatccggattaaagccagggaaccccgcctcagacgccgcctgctgcgccagagtacgaaacagcggcggcatagccggccatttacgcccgttcaggttgtcctgctgctgatactggtagccgcgtgaatccaccgaccagccgaaatcgccacagttggtcatcgccaccgacatgcgatggccaccgggcgtaatgcgatgggcaaacggattctgctccgcaattgccattatttgctgataaagcgcctctgcatcctcacgtgcgcgccgccgcaggatcaccgcgccctcagccagcgtctcctgccagggttgctcttcactaaacagatctaacatcagggtttctccggattcagcggggatcaggaaagcagcgaactgcggcgacatccagctgacaaatttatcgccctgcttgctgatcagatagaccgccagatgctgttcaatcgccagcgcctgggctttttccgtgccaagtaccatcagtccggtatcccagccatcggcttccagcgccgtggtggcgatcaccgtggcggaaaccagtttatgctcaattggccgtccggtaacgggatcgataacatgagaaatgcgtttgccgtccagttcataatagttgcgatagctgccggaggtactgatgccgtgtccctgcagattaacgcgcgcctgaaccgcattctcacgatcggtcggtttctgaatcgccacccgccacggctgctgctgcgcattaaggccacggctcagcacggcgccgcccacagacaccagatagttattgatgccgagctgctccatcagtcgcgccagatgatcggtggcgaagccctcgcccaccgtcgagagatcgacatagagacctggcagatctttctgcagccactgtccgtctgcgccctgcaccacccgcagatgctgcaatccggtctgcgcccgggcggcggcgatttgtgccgcatccggcgtatggccgggctgcttcgtcgggccaaagccccataagttgaccagtggcccgatggtaatatccatcgccccgccggttttacggccaatccgcagtgaggtcgtgacaatatctgccatgttttcactcaccggctgcggtgacaggtcacggctttggttaaagcgcgataaggcggagtctggcttccaggtagagagttccgcatcgtccgcatccagctgctgctgaatccgctgttgcagttccgctctgcgctcactcgccacaccggccaggcttacccgccagacggttcccatggtttttccttccagcaccagcgcggatgtggtcgctggcttatcacaggccattaacatcaacgctaacatcgccataaacagcagattaatctgagaacgcatctttcctcacttgtaacactttattcagctctgctacaaagcataaacttcgggtaaagacgcttaaagagagttgaatatttctctgaaacctatcagtatccaccggtcatctaccctgtatccgcctttcatcaggcgactaacgttaaccaaagtaaggagcggcagatgatctatctgattctcgtcattgccctggggctgtttatcttcagtagctataaagtcttgcatcagcgtcgtcaccgtcacatgacaccctcacgcccgcgccaataacaggcttaactgcacctgattggggcaagatcgccctgacgcgcgcggcaagtgtaccaaagtgcgcgcgaggtctgtggctatgagagcggtaaagctggcatgaattctgcactgttgaaacagtgtttatctctgagaggtgcagaatgaaaaattcacagaagtggcagtcagcatggcatcactggctgagcttttcagccttcaccctggcaggcgtggcatttgaaggcgcgcgattcggcagcgtggtgtcgtcagtgacaaccgcgccggaagccactaagtggcgaaaggctgaagcgctcagcccgaaaggtgacgcaggagcgcagcggtaactgcgctcccgtacaactcagaactggtaaaccagacccagtgccaccacgtcgtcggtattgataccggctgcgtcggtgaaagcgttgtcgtccagcaggttgatctggtaatcaacataggtggacatgtttttgttgaagtagtaggtcgcgccaacgtcgatatattttttcagattctgtttaccccagttctgaacatcggtgccgcgtgaggtgacgtacgccagggatggacgcaggccaaagtcaaactgatactgcgcaaccagttcccagttgtccgctttatccgcatagccataagctgaagagtcgttggtgctgtcgccgaagcgggtcgcattgtacgagcgtgagtacatagccgccagatagacgttgttcgcgtcatatttcagaccgccagtatagacttccgctttatcgccactcccgaggatgcctgatgttgcgctgttctggtcgttggtacggtcagactggaaagcagccgcaccaatgccgaaacctgaacccagatcataagttgtgctcagaccccagccgtcgccattctgacccagtacgtcacggccattcggagactcggtgctgttgccattcttgccctgatactggactgcaaagttccagccatccaccagaccgaagaagttattgttacggtaggtcgccatgccgttaccgcgctgatacataaagttatctgcgccgtaggtgtcgccgccgaactctggcagcacgtcggtccatgcgccgatgtcgtaagctacgccgtagttacgaccgtagtcgaacgaacctgcatcaccaaatttcacaccggcaaagccaacacgggtgtagctgtcagccgtaccttcagactcggcgttgttcagcgcggcctggtattcccactggccgtaaccggtcagctcattgctgatttcggtttcgcctttgaagccgaagcgaacgtaagactgatcgccatcagaaccatcgttatcagagaagtagtgcagaccgtcaactttaccaaagagatctaatttgttgccgtctttgttatagatttcagctgcgtttgctgatcctgctgcaaccagcaacgcagggatcatcagggagagaacgcgacgtttcattttattaccctctgttatgtgcctttattatttgccactgctaactgaatgattaaaaattcagccggcaggccattgttgttttataacgggcaataatccaccaggaaaatgctactaaatttccaaaagtgtttcatacgtcgaaacagttatttcataatgtaaataacggggaactaataaccagcacggatcgataaaaaatggcgcacaaatcgataaaccgattcagagagctatgttatcaacaggttacaccagagtattccgaagcactgaatgataaaacttatacggcatctggtaatagaatagaccccgctatcatcatttattccattattaccttcattctccccgaatgagatgtacaacttattatttcccgccggacaagttgtccggcatttttttgcctgctgtttgccgttccgttatatcttcgtaaactttcttaaccgggttaaattaactacggcctgtttccgcacatattgttaaaatacgcacactttgcgccctgactgcccaaatatccgccatgttaatttatcaccgtaattaagcaggcggatattttagctggtgcggattttcagcgctcgcgcatcgattctttgactttattcaggggcttaatcagataatccataaccgatttctgaccggttttaatctctacattggccaccataccgggcacgatcgggaattttcgtccggcacggttagtcagctcggctttctgggtacgaacataaacacgatagtaatattgatcacgttttacctcatcctgcagggtatctggcgagaccgtttcaacttcgccgtgcagatcgccatagatggaggagtcataggcggtcactttgacggtagccgccagaccgggccggatataagcgatatcgcgtggattgatgcgcgtctcaatcagcagttgatcctccagcgggacgatttccatcagtttaccgccaggctccagtaccccaccgaccgtggtgacctgaatatctttaacaatgccgcgcaccggtgaatagagcgtggcacgcgtcagctgatcctctttgcctgcagcaacctgcagttgcgcatccagttcggcattatttttcacctgctcttcgtgggcgcgcaccagatagtcattgcgcgcctcatcgattttgccgcgcagatcgctgacctgacgacgcagtcgaatcacctcgacctgccctgctgcgcctttggcaaccagcggttccgtcaggcgcagttcatcctgcaccagtcgcagcgactgctgcagattactgatggtttcggtgagattacggcgtcgcgactcgtagagctgccgtttcgcgcgtcaccaggttcggctccttcagcgtttcggcgctgaatgtcagcggcgtgcccgacagctccgcctccagccgctcggacgaggcgcgcagggtgcgcactttggcctgcgcctcgccgaagttcgactggaagcgtgtcggatcgagggtcgccagcacctgccctttttcgacaatgtcgccctcatgcacgttaagctgtttgacgatgccgccatccaggctgtcgatcacctgcgcgcggctggaaggggtgactttaccggtgccgaccgtgacctcatccagaatggcaaagtgcgcccagatgagaaaaatcgccagcgcggcggtgcagagccagataatcgccgatgtccggcgctcatgacgggcaagatctttatcaacaataaccagactcatgcggtgtctcctttacctggcgacggtgccggcgcgggtgtcgtcgcacggcgcaggatctcgtcgcgcgggccgtcggccacaatccggccgttatccatcaccactatacgatcgaccatcttcagcagcgccggacggtgcgtcaccagcaccagcgtccggccgctgatccagccctgtagctgacggatcacatgctcctccagctgttcatccatcgccgcggtgggttcatccagcaacaccacctgcggctgacgcaggatcaaccggctcagcatcaccatctgacgctggccgcccgaaagtccgcgcccgccttcattgataatgcggtccaggctggcggcatcctgctggaccagcgacagcgcgccactgatgcgcagcgcctgcagcatctcctgttcgctggcatggggattgcccagcatcagattctgccgcagcgtgccaaaaaagaggcgggagtcgtgcgacagccagccgagctgacgacgtaaatcggtgggatcgatacgctcaatatcgacgccatcgacaatcactttgccctgggtagccagcgcctgaccggcgaggatcttcagcagcgtcgatttccctgccccgactttgcccagtatggcaatcttctcgccgggcttaatctgcagctgctgaacgttgagcacattcttttcattctcttcgtcatagctgtagtgcacattgcgcagatcgtactggccggtgagcgtcgggcagtgtgccagcgtggtcgcttcaggttgatcaagcggctttttcagcaactcatccagccctttcatcgccattttggcatgctgccagcgcgagaagaccatggtcagctgcatcagcggggcgatggtgcgtgatgagagcaggctgcaggcaaccagcgtaccggtagtgatttgcgaatcgagtaccagatagacaccaaacaccagcatgcccgcataggtgagctgctgcacagtcgaggcccagccggtgaggcgcgcgccccacaaccgctgctgattactgattgaggcgctgacttcgtgcgtctgctcccactgacgctgaaaatagggttccgcctgcagcgccttgatatcctcaatgccttcaatggtctcaaccagcaccgcattgcgcagcgcgccctcgcgcagcccctctttggccagccgcgccatcgggatctgcaccagcagaccgggaatgacgatcagcgggatcgccgccagcggaatcagcaccagccagccgccaacaaacgacataataaacaggaacaggataacaaacggcagatcggccgctgcgcctaccgtggtcgaggtgagcagctcacgcacctggtcgatctcacgcagctgcgagataaacgaaccggtcgacttcggacgcgcctcattacgtatgctcatcgcccgggcaaacagcatggccgagactttcaggtcgatgcgtttgcccattaagtctgacacctgggtccgcatcagccggatcagatactcaatggccgcagcgatcagcacgccgacaaacagtacccacagcgtggactgcgactgggccgggatgacccgatcgtagacctgcatcgaaaagagaataccggccagtgccagcacattactgatcaccgaggccagcgaaatttccgtgatacggcggcccataccgcgaaaatttttccagaaccagtgtggttcataaggctgaacgaattcgtcgatgcgcgcatcacggccacgcgccgctacgccaatcacgccgacatcgccctgggcgcgtgccagcagttctgataacgcgctttcacgcaccacatcgccaccttcactgagccagtagcgcgcgctgttgtctgaatcgatgctctccagcaccgccacgctggcattctccagcaccagcaccaccggggtgatctcctgacgccagcgcagtttgttctgcggcaccatggtcagatgcagtcccagcaggccggagagtcgttccagctgctgtgacaccggcagatgttcaaaccagcgcatctgctgacgcagggttttgccatcggcaggtttaccgaatcgcgcggctacgcgcagcatggcggcaatccagttatcggtattcagggttgatgtactcattattaatgccttatcgctattgcagcgaaggaaggagatcgccgctgctttgctggcgatcgatacccatgatatcgagcagattgtctaccgcggcggcataacgcacggtggcgtcccagccatcgtaaagcgcggtgatacgtgagctgtcagcctgaaacacatcctgttccacgctaagcagatcgttcaggctgcgcttactcaggcgatattcatcggcgtagacattacgggtatggtcggcgctggccagctgcacttccccggcagcctgccgctgctgcgcgccaatcatgtcggcataggcggtagaggcgttttgattgatggcgagcttggcctgctgaatagcggcctgcgccgcttcacgatcgccctccgctgactgggttttcgcattcaccaggccgccctgataaagcggcgcttccacctgcagctgcacttcatcatcccagtaagattgacgatcgttttcatagcgggtccggcccgcctgcactttaatcgtcggccagtgaccggactctgcctggcgcacccgttcacgagcggcttcctgcttcgactgcgcactgcgcactgcgcaccgccgcgctgctttcataggcgattttgtcgagggtgatctgctgcttaagcagcgcctgtggcagttcaggcagcgtagcggggaccacgccggtcagcacggtcagttgcgcggtggcggaacgatgctgggcgcgatattgctccagcgtggcctgcatcgcggcgatgcgggtttctgcctgcagcacgtcggactgggaattgaggccggcatcggcgcgcagcttcgcgatatcccgcacgcgcttcagtgaggcaatattggtatgcgccgtttctgccagcgcctggtaacgtttgacttcgaggtaggcctgcagcgtatcttccgccacggtggtcatcgagtcgaacaggctgtaacgataagcatccgacagcgcgtgctgctcatcgatggcgctgccggtgcggccaaagtcgtagagcagctggctgagcgtgatgccaccggagccgttattgttcaggctcccggcggagtcggtctgatgagagcgtcccgccgcgccctgcagtgagatctgcggataccaggcgctgcgggcggcatcaagatccccctcaccgatgtggatctgtgccgccgcttccgagattttcggattgcgggcgaaggcccgaagaatggcgtcgcgcagcgttaagctggcaatctgctcttcggtgggcgcggcgcgccagttaaattcggctttaggtaacggtgcggcaaaggccgcgtgcactgcaacgccactcagggcgcacaacaaaaaagttaatcgcgctttgttcattatccataccaacaggggttcttatcatcatggtgtttttcctggtgaacaaagcgagcaaaaaggggtgctactcagcgtctgacagatttactgcgttattttatttatggttcgcaagcgagacgctaaacgacctttaacattattagatcagatcccgcgcttattcctgctaaaaacagatgaaatcgttaatatttctgctgaacgaacgaaaagcaaccactgagcgagctcgcgccaatccagacaggcttaacagacctgtccggaaggcagtgcgtttactaatgtgtcagcgtcagaccagggggtgtgccgcaggatgctgcagcaggtggtcggcgagcgtataaggaatatcagagaacagatgactttcctgcggtgcggcggcggcagaagatgcatacgccacgtgcgccgtctccgcctgctgggtcaggctgaccgtctccagcaactggtccaccgtctgaccctccagcgggttggcactttcggtatgtgaggccacctgtaccgtctggctggcactggccagattaccggcgctgtctttgccgctgactgtcatctggtactcaccatcgtccagcggtgccagctgcccggccagaatggtcagcgcccagccgccatcggcttttacactggcgctgtaatgctgatcgcccagcgttaattccaccaggctgcccggttgcagatgactggagctgccctgaatcagatgccagctgttgacatcggcagcatcaattttgttatcaccaaaagccgtgtccagggtcagcgttggccgctggtgcacggctacggtaaagagtttatcgctggtctgggtgtcgctgttgccatattcatcccagcggtgaaaggtggcggcgaccgggccatccggcagtgccagcagctcgctggaggtcagtgttaccatacctttggcatcgggctggtaggttttaccgttgatctccagggtgttggcgccttcaacgtagaagctcagatcgtgctgcgcctcctgatagttaagcgtcatgtcaccgccgatatccatttcggtgtagatcggaataaaaccggtgtggatattcagctcatgcgtgacgtcgatgtagttttttgccccgtcgatcgaccaggcgcggatttccccaacgttgataaaggcgtgcacatccgctgccgggatcaccacctgccagtgtccatcatcgcctatggtggcggcataatctttctggttggcacccgtgatcaccagacgatggcccggcatgacggtggagagcgtgccgctcagtagcagatcctgctggctttctgccaggtttatcacatcgtccgcagtgaccttatcaaaggtaatttttggcaggctactcagatgggtgatcagcgtcagatcgtgatattcggtggcggttttcccattgggatcggtcgccgtgactttcaggctgtagaccccgtctttcagcgcctgcatatcgctttcatgaaatgtgccataccacttaccgtcatttcccatgctggcggtggtggtttgcgtccccagcgtcagtttcagcaccgaccccaccggcaagtgcgttgcgctgccgctaatctcgacgccataaatgctctcagcaatactcaccgcgttgtcaccactgaccgtgtccacggtcagggtaggtttgatcgtgcggtcggtatagagaccaaaatctacggtggttgccgtgctttgccctgctttatcggtaatggtcagcgtcagcgtgtgattgccatccgctacgcctttcagcgtatcagccggcatggaggcgttccagtagccccacttattgacggtgctgtgccagctttgatcgttgaaggtcagcgttacggtggagcccgcttcaccttcagcacgaccgcgcagatgcaccggcttttgcgcttcccagccggcgatcacgccatcactggcgatcggttcatagggtcgcagcatagcgggcggcgaacttttcaccgcgctgacagccagtgtgctgtcgttgagcgggctgccatgcagtgactcggtggagagcgtagtgatcggcaggctctggcccggcgtggcgaaaggaaggctcagactttgcgtagcggctggcgcaatggcgggcactgcgctatcggcgacggcaaaatcgctcaccgccgtctgaaaaatggattcaagccggatggtacgaagcgtatcgcgtgatgacataggtaacctcagttcagaacagaaacgcagacaaaaactatcggataaaccgatcgtttagtctgacgacatggtagtgggacagctgaagctgcccgtttccgctggtcggaaccggttacccgcaggtaacaaggattgataaacaggacgctaataaaagcgccaaatagagtcagaatgctgattttacggcgtgacgccgtttgttgcgcctaccctaatctttcatcctgctaatgaatagtggcgataatctggaaaatgcaattatcacgtgactaaaacaaaaaaagcgggtgctttcgcacccgctttattcatcttctgaacagacctttcagtcactacacaacatgaacctgcaggttctgctgcaccagcacatcgcccagggtgttatcactggtcagcgccgagttgtggtagatctcaaagactctgccctcaacggtacgctcgcccgtcacttcccagattccgccgttgctgttagccagtgtcacctggctgccatctgcgcctttgatcagcaaatcgtcactctgcttatccgtgatattgagtgcttcattgagatcgagcttcacggagttggttccggttttacccaaatcgagcacctcaatgtgttcgaccttcaggcccagcgcggtgagatccagactgagatgctcaccattcagcaccagggtatcggtgcctgcgccgccatcaatatgggtaaagttaaggtcactgaccgtcacgatatccgccccgctgctgccggtcactgtcgccccctcaatggtgctgccatcggccagcgtaatcacgacgccgccgatggtgtaccccgcctcctctgccggtgccggtgccaccgcggcgtcatttgccgccgcgttttcactgctgccgacgggtgtcacggtatccgcttcggtgatcagcgtggaagccactgccacatgggcgctgctctcgtcgctgctggtgctgctgttatgctgcgtctccgcgctggcgacagtagcgctgtcatccgccaccgagaacagggcaaccgattcgtttgccgccagcgtcaccggtagcacggcacccagtaacagggtattggtggtcgagtagctgttaccggccgcgtcggtaatcgtgactttcgccagcgtttcccagcgacagcagcaggccccccaccgacagcagtgaaggtgagaagttaaccgcgtaacgccccagcgcatcggtcgtggtgtttagcgtcgggccgttgttgccgttggagagcagcagcgtaacgctcactttcgagccctgcgcggcattcagcgatcccccctgcaccaccagacccgccagtaaggaaccgacgatgctcagcaccggatcgactccgaccagcggctgattgtgcgacagcgcggtaaagctgctggtactggttgcggtgttgccgccaatgtccgccaccgtaacggtgagtggatggctgccatcggcgatccctttcagcgtcgctgacggcacgctgatgctccatgcgccattcgcaccaatggtcgtggtaaggatattacccgccacgttcaccgtcaccgtgccgcccgccgcgttggtgctggttcctctgatggtttcagtactgttggcttccgcaatattgaggtagccatcgccgccaaagaagctgttgacgctgaccgtcggcgtggtgtgactgaccacacccagcgacgccgaggtgttgccaatgctgcccgcaccgttggtcacgctggcggtgacggtctgcagaccgtcagtaatggcagcaaggttagccgccggaacagagaggctccagttgccgttgctgctcaccgtggtgctgtaagtctggccgcccagcgtgacgcgcacgaccgatccctcggcgttgctggcggtgccgctaatagtctgcgccgttttgacatctgccgcactcagcgcactgtcaccaaacagcgaggtaatggcgaccaccggcgtcgactgactgatgacgctcagcgttccgctgctgtttgccacgttaccgtaggcatcggtgccggtgactgtgacggttttactgccgtcagtgatagcaacaagatccgctttcgggacggtaatactccagttgccgccgctgaccactttggtggtgtaggtcaggccattcagcgtggcgctgacggttgaaccggcagagaggctggacgtcccgctcagggtctggttagaggccagatccgcggcgctcagcacgccatcgccaaacaccgtattcaccgacagggtcggctggaacagtcccagtgacacgcccgcgctggtgctgctgacgtttccgaccggatcggtgacggccgcgctgacggtgaagttaccgttcagcagcgtagacagaatcgctggcgagacggcggttgagaaactgccatccgcgttgacctgcgcgtcgacgatagtgttgccaattgccagcctgacgctgctacccgcagccagcccggagaccgtgccgctgatggtctgagtcaccagcgactccgccaggttcagcacgccgtcgccaaacagcggattgagggtgactttcggcaggttgtgaataccgaccagtgccccggccgtggtgctgttagtgttacccgcgctgtcggtgacgctgatgcccacggtcagattgccatctgcaatcccctgcaacagcgctggcgtcagcgagacgttaaagttgccattggcatcggtcgccgtcaccaactgctgtgaacctaccgacaccaccacgcgcgatcccggttccgcgccgccaatcaccccaccgatcacctgggtgaccagcgaatccgccacgttcagcaaaccgtcgccaaacagcggattcacggtgatggtcggcagcagcgtatcgacccggataccggcgctggtgctggcggtattgcccgccgcatccgttaccgacgcgcccaccgtcaggttgccctgcgccagcgtgcccagaatatctggcgtcactgtggcgctgaacgccccgcccgcacccacggtggcggtcacctggctgttgccaaccgagagcgtcaccacactgccctgcgcgacgttgttcaccaccccgctgatcacctgtccggtggcgatatcggccaggttcagcaccccatcaccaaacagtgaggtcagcgagattgatggcgtctgagtaaagatgccgatggatgcgctgctggaggcgacattacccgccacgtctctgacgctgacgcccagcgtcagattgccatccagcagagaggtcagatcgctgcccggcaggctaacgctccacactccacccgcctttaccgtcgtactgtaactcttgctgccaaaggtgaccgtcacctgggaacccacagccgcattttctatcacgccactgacgagctgtccggcagcggcttccgcaatgttcagcaggttatcaccgccaaacagcccggtgagcgcgccaaccaccggcaccgcatcgacaatcgcggtgacggtttcaccgacggtacgggtgttgcccgcggcatcggtcagggtgacgtcaagcgcaagattgccatcgcttaacaggcccagcaccgaaggcggcaccacgatggcccatttaccatcctggcccactgacgcagagagcgttgtgccgcccagcactaccgataccgtggcacccacgcccgccgaggtcgcaaccccggagatagtctgcgccaccgtagtatccagcgcgctgagcgtgccgtcgccgaacaccgaatcgaccaccagcgtcagcgcactgttgaccactttgttgaccgtcagcgtggcgtcggtctggtttccggctacatcattgacccgcacgccaaacaccagcgcaccttcagtgaggctcgccaggacatccggcgcgagatcgatgctccagcgtccgtcagcacccaccgtcgcggtggcgatcggcgcggcatcgcccagatagagaccgatggtctggccttctgctccctgcgcgctgccggtcagcacctggcttagcaccaggtcagcggcgttgatcacgttgtcgccgaggaacgcgtcgaccaggaccagcggcgcggcggtatcgaccgtcaccgtctgggtggtcgtcgtcacgttaccagccgcatccgccagctgcgcggtgatcaccggcgagctgccatcgggaagagcctgcatcgcgctggcaggaaccgttgtggaccaggtgccgttgctctgcaccacggcgttgtaggtctgattattgaaggtcaccaccaccgtgcgacccacttcgctgagatcggcggtgccactgatggcctggctggtggcactttcattgccattgacctggttgtcaccggtaaacggattgagagtcagtgccggtggcgtaaggtcgatcagcacgttaccgctggtggttacaggattagtgccgtcggtagcattcaccgtgatggcgacgctgccgtccgcattgccaaaggcgctgaccggcaatgccgccgttgaccagttgcccgacccatccagcgtagtcgcgtactcctgaccattgatcgacaccgtcactaccccacccgcgccgaggttagcggaggtgccactcactaccacaccgcccgctacatcctgagtgctgatgatgttgtcgcccgacaccgtgcccagcgtgaccagcggccctggcggtggggtaagatctaccgtcagcgcaaccgtgccgttggcggtattgcctgccagatcggtcactgccagcgccagagtcgtcgatggaccaaaggtggccatctgttctggcgtcagcgttacactccagttgccgttggctgtcactatcgcggtgccaagcagcgagtcattcagcgagatcgaaaccactgatcccggctcggctcccgctgcggtgccgctgagactctgcggctgaatgctctcggcgtagttcagcgcattgtcaccggtaaaggcggcaacattaagcaccggtggtgtggtgtcgagcaccagcgaactgttaatggtggtgctgttgcctgccgcatcggttgccgtcacggtaaccggataggtggcatccggcagcagtgaaagctccgccgttgtcagtggcaccgtccagttcccattggcatccactgtcgcagaataggttgtgccgccaagcgtaagctgcacagtctgattcgcacccgcctcaccggtggttccgctcagcgtcactcccgcggccacatcgccgccattcacataactgccaaggaattccggattgaccgcaggctgcggcgcgctgagatctgcggtgaacggcagctgcgccgatgcgctgttgcccgccgcatccacgacgttaaccgtcagtgattgcgcaccgtcacccagtgaactcagggcgttggcaggaatgttaacagtccagttaccgttgcttgccaccgtgccagaatagaggctgccgttgacatccacggtaatgctgaccgcctggttcgccccgacactgccggtggtgccggtcagggtcacccctgccgcggcttcactgatgttcagcaggttgtcgccgccaaatgcgcctgggttgaaggtcggcacaggcagcgccacctctgtcaccacgttctgcgccgtcgcgtcgctgttacccgcgatatcggtcgccgtcacggtaatggtgtgggtgccgctggtgaaggtggctaactgcgctggcgacagggccagagaccagctgccatcggtctgcaccgtggctgccagcggctgaccgttgttaaagccggagatgagcaccgttaccgtctgtccggcaccggtaatgccggttgtgccactgaggatctgttcaccggccgcctctgctgcgttcagcgcaccgtctccaaacggcaggttcagcgtcacgtccggcagcgcattcacggccaccagcacagtgccactggtgctgccgacgttgccgttcgcatcggtaaccgtcacgctcaccggccagttgccatccggcaatgactgcaatacagaaggcggcagatccagcgaccagcgcgaaccatccgcactgagcgtagcggaatagaccgtgccattaacggctaccgtgaccgaggcggcgttattaatattcaccgcaccagtcagggatccgcctgaggcggcctcttcagcattgatacggccatcaataaatggcgtatccagcgttggattagcaatcggcgtaatcgcagcgacgaacgttttggtcgtttcaatgctgttaccggcccgatccgtggtggtgagggtcagggtatgttcaccggttcccaggctggcaatgaactctgggggcaggctggcagtccagttgccattggcatcgaccgtcaccgacagcgggatattgtcatcgcctaccgtgacgctcagggtctggcccggcacgacggtggaggtgccggtgaccagctgaacggagcctgcttcgctgatattaatgatgttatcgccgaacagtgtcgtgtcgaaggcggctgaaacaggatcactctgcaggatctcaacgcctgcggtaacctgcgccggattaccggcaccatccgcggcgctgaccaccacctgtgtcaatccatcggccaggcccgtcagcgcgcccggtgccaggttcagcgtccagttgccgctgacatccgtggtggtgctgaagttctgcccgcctacagagatgttcaccacgctgccttccggcagattggtactgtcaccactcagcgttaacgccccttccgcatctgccgcactgatcagcgcatcgccaaacggcgtattcagcgtcagcgctggcagggtattaaacgctacgtccagtgtcgtggtgctatccgtggtgatattgcccgccgcgtcggtgaccgaaacggtaatcgcattggggccgtccgccagctgctgcaggtcagcggtcggaatagtaagtgaccagttaccgtcggcatctgccgtggtggtatagctgacgttattcagcgtcaccgtcaccggcaatgcgcccgtggtgctgccgctgatggtgagatcctgcagcgactccgccaggttaagggtatctcccgcatcgaccgtgatattcgtcagcgcaggcggtgtggtaatgaaactaacctcctgagtggcggtcgccggattgcctgcgacatcagtggcggtcacggtaaagatttgcgtgctgcccggagccacgctggtaaaggcagctgacgggacattcaccgtccagttgccgtcagcgtcgagcgtggtgctgtagtcagtgccgttaaacgacaccgtcaccagcgtacccgctgccagcagggtgctgctgccgctgaccgcgacatccgctgtggcctcggtggcgttaatcacatcatcgccggctaccacgttcatggtcagcgtcggctgaacctgctcgctggccagcacgaccaggctggtgctggcgctggccggattgccagacgtatccgctgagaccacgaccagcagctgatcgccatccggcagattacccagatcggcggccggaacggtcaccgtccagctgccgtcggctgccaccgtgccgctgtactgaatgttattcagcgtcaccgtcaccagctggccttccaccaggttgttactggtgccgccgatgttcagatcctgtagcgactccgcctggttaaggaagttatcgtcactgatggtcccgatggtcagggttggcaggttcagagtgtcagcatcacgcgtcagggtctgggtggccgtggccgggttccccgccgcatcggtcatcgagacagcaacggtgtagctgccgtctgccagcccctgcacgacgctggctggcagtgtcacctcccaggtgccgtcagagagcacctgagtggtgtaatcgacgttctggaagctgacggtgactgtctgtccggcatccgctaccgacgcactgccgctgatagcgaccgcttccagcacctctaccgaattgatgatgttgtcgccgccgatggcattgacggtcagcactggcggtgtgagatcgaccgtaacggcgctggtcagcgaaccactgttaccggcggcatcgctggcattgaccaccagcgtagtaaccccctcgcccagcgtctgcacctgatctgctgttaaggtcagcgtccagttaccctgcgcatccaccgtagcggaataatcattcccgcccagcgtcacgctgacggtctggccgttgcccgctacaccggtgctgccggtcagcgtctgaccgaccccctgttccgccaggttcagataaccatcgccaaacggggtgtctatgctgacggccagcgacgccgtcgccacggtgatttcacgggtttcggttaccgggttacccgccgcatcgctgaccgtcacggtcagaatgtacgccccggccggaatgccggccagcgaacccgcaggcagcgtcagattccactcgccgttctggtcaaccgtggtggtccaggtctgattgttcagggtaatggtgacctgctgtccggcttcggcattgctgttgccgctgagaacaatcggcgcggtgctttcggcaatattgatactgttatcgcccgcaaccgtattcagtgtcagggtcggtggcgtcagatccaccgtcacgctgccctggctgctgccggtgttacccgctgcatcctggactgtgacggtatagttcaggagatcttccggcaggccggccagcgcggaagccggcacgctgatctgccagttgccattgccgtcgacggtgccgttgtaggttgcgccattcagcagcacgctcaccgtctggccgtcaccggttatgccggtggtgccgctcagggtttgtgctgtggcgatctcgctgctgttgagcaggccatcgccaaaggccgagacgagctgcggtgctggcagcgtcgccagcacgctgagcgctgcctcgctgctcagggtcgccccgccgctgtccgttgcggtgaccgtcagggtgtaaggcccatcggcgagcgccgtcagtgcctcagccggaacgatcactgtccagcggccgctggccgagacctgcgcggtgtagctgatgttgttaaacagcaacgtgaccgtgctgccctctgccacattcaccgacgtaccggtgacgaccagggcctgacccagctcctgcgcattcaggtagttgtcttcgctgatggcatccatcgccaggccagaggcattgctgttgacgtcaaaggtgagattgctggtggtggtgttgcccgccacatcgctgaccgccacggtaaaactggcgctgccatcattaatcgcggccagcgcaccggctggcacgatcaggctccatgccccgctcgcctgcacggcggcgctgtagactgtgccgtcaacggtgacggtgaccagctgacccgcttcgacgttggtggtggtgccggagagacgttgatcggtgaggcgctccgcgccatcgaccacgttgttaccggcaaaggcatccagcgtcagggtcggcagtgtgcctggctccactttcagcgcgaggtcgcggctggtggtggtggcatttcctgccgcatcgctggcggtcacggtcagcggatagctgccgttgcccagcccggtgtaaaccgtggcgggcagctccagcgaccagacgccgttgacgtctgcggtggtgctcagggtggtgccgttgaagctggccacaatcagggcgttagcttcgctgctgccggtcagcgtcagcggctgctgactttcagcggcgttaatgatgccatcggatggcgtaatgaagttcagcaccggaggcagcgtatccaccacgaggttgccatccgcctggctgttgttgcccgccacatcactgacgaccacggtgtagccactattgccctgtggcagcgcagacaagacatcggccggaacggcgacctgccagttgcctgcggcatcgaccgtgccgctgtagttgttgccgcccagcgtcacgacgacggtctggccgtcgccggtcacgcccgtgttaccggtgatcgtgccaccggcggcggcttcctcaccgttcagaatgccatcatcaaaggccacgcccggggtcgccaccggcaatgcgctggcgatcaccgtcagggtagcgtcgctggtcgccagcggctgtccgttagcgtcgctggcggtggcggtgatggtctgcgggccatctgccgttccggtaaaggtgcctgccggtaaggtcaggctccagcttccatctgccgtcacggtggtgctgaccgtggtgccgttggccagcacggtgacaatgctgccgtcaggcagaccgctggtgctgccgctgactacaacggcgccacccaattcctgcgcattgaggtagttgtcgtcactgacgggtgccagcgcgatcgacggcagggtgttgtccacactgaagtcaagcgggctgctggcggtgttacccacggcgttgatgacgctgacgttcagtgtctggttgccttctcccagttcagccagggcgcccgcaggcagaataatgctccagttgccgctggcctcaaccacaccgctgtattcgatgccattcagggagatgatcacctgctggcccggttcgacattcgtgctgctgccgcgcaccgttatcggctgcagctgctccgctgccgtgacgatgccgtcaccggcgaaggtgctgctgtcgatggtcagtacaggttgcacgtccggcgcggttgccacattcagatcaaccacctggctgctctgattcccgttagcactggtttccgtcaccgtcaccagattactgcctggaggcagtgccgccagcgcttcaggggcgatctgcagcgtccactggccgttaacgccaacggtggtgctgtagagctggtcattgagctggactgtgaccacgtcaccattctgaccactgccacttaccaccagcggctctgccagtttccccgacgttcagcgcgttatcaccgctgaccggcgcgacgaccagcggaggcggcgtagtcgcaaccgtcagggcactgttctggctgctgctgttaccggctgcgtcggtgacggtgaccaccaccggatagctgctgccattggtcagaccggcaagcgccgctggcggaacagccagcgcccagtttccgtcaccatcaacggtgccggtgtaggtcacaccattcagcgtcacactgacgcgatcgccttcactgcctgcgccgctgaaactgaaccctgccgcctgctcagcgatgttcagcacgccatcacccgcgggcgcagcgatactgaagtctggtgccgtggtatccacggtaaccgacactggcgtagtggcgacgttgccgctgacggtggtgacggtcacgttgagatcgtaacggccatctggcaactgttgcagattcgcagcagacacggtggcggtccagctgccatcggcggcaaccactgcgtcataggtctggccattcagcgcaaggctgacgctgctgcccggcgtaacggtgccgctgagggtcagatcggtggcggtttcagcctcattaatcgtgccatcggtagcaatcgggttaacggtcagcgccggtacgccggtatcaacaatcagcggctcgctgatgctggtgctgttacctgcttcatcactcaccgtcacggtaatcggattgctgccctgcgcaagtgcctgcagtctgtctgcgggtatcgtcacgctccattcaccattcgcgtctacagtggccggatagctggcaccgcccagggtcacgctgacggcctggcctggcagcactgtgccggtcagcgtctgcgccgcgctggcttcatcggtattgagtatgccgtcagtgaatggcgtgttgatttgcgggtctgccagcggcgcggtcgccaccagcagcggcaggctgttctgcacatcacccgaagagacggtaacgctggtcgtgccctgcggcagcgtcgccagatcggcagccggcacggtcagggtccacgcaccggtttcatcggttgtggtggtgtagacggtgccgccagtcaccagcgttacgctgatcgggctgttagccggcaggttcgctgaaccgccgctgaggataagatcgctctgcgcctccagggcactcagcgcattgtcgtcactgattggggcaatcgacagcgacggtacgggtgaagtaaccacgctgaactgcccttcagcaggcagcgccgggttaccggccacatcggtaatcgccacggtgaaggttttatcgcctgcaccgcccagcgatccggctggcagcgacacactccagctaccgttcgcctgtactacgccatcgtaagactggccattgatggtcagcaataccggctgacctgccggtacgccggtgacgttaccggtgaccagaatgtcggtgagctgttcagcgctgtcgacctgattatcgccggtcacgggattaatggtcagcgccggcgacgttgccgccagcacagtgacgctggtcggtacggtgctgctgttaccatatgcatcgctgagtaccacatccaccggataggttgcgtcacccagctggctgataatcgcggcgggcaccgtaacactccacgcgccatcagtatccacggtggcggtgtaggtctcgccattgaaactcaccgtgacggtgtcgccctgggcccccccgcgtccgtcgagtgtgagatcctgagtgtgttcagcgatattgatataaccatcactgcccggcgtggagacttccagcaacggcggtgtggtggcgaaaatcagtgaactgctggctggcgtggtattaccatcggcgtctgtcgccactaccgataccggttgggtaccgttgggcacatttgccaggtcggatgccggaacggtgacactccagctgccaccctgcgccaccacggcgctgtaggccacgttattcagcgtgacgcggatgatgtcgccttcgtcgccggttccgctgacgattagcggctgctgcgcgtcgctgacgttgatcacgccatcatcgctgagatcgttgagcgtcagagcgggcaccgcggtagccacccgcagttccgtattctgagtgctgatgttaccggccggatcggtcacggtgacggtcaccggataggtctgattggtcagcgtgccgagatcggccaccgggacggatgcactccagttactgttttcgtcaacaatggcggtgtaggacttaccgtttaactccaccgtcacgctgtcacccggtgtgccggtttccgctgatttgcagcggcgtagtgagttcgttgttggtcaggacgccatcaccgcccggagcggtaacggttgcaaccggaggctgcgtgctgaccgccaggggctgcgtctgcgtggtggtgttaccgctggcatcagtcagcgtaactaccagcgtatagctgctgccatctgacagggcctgcagcgccgctggcggcacatccaccgtccagttaccctgcccatctacggtggcgctgtaactctcgttattcagcgagacagacaccacttcgcccggcaacgcacctgaaccgctgaccggcagaccggcagccacttcgctgctgttgagaatgccatcgccgcctgcgacctctgccacaatcagattcggtggcagcgtgtcgacgctgaagttgagcgtctcatccacgcggttgcctgcttcatcaatcgcggtaatgatcaggctgttggcgccctgtggtagtaaggcgagatcggcggccggcagcgccaggctccagctgccgtctgcattgaccgtggtgctgtaggttttaccgttaagttccagttcaacctgctggcccggcacggctttgccggtgctgccgccgatcagcagatcgctgcccgcttccacccggttgagaaggccgtcggtgatcgcgctctcctccagcgtgatttgcggcagcgtggctgcgaccacattcaactgagcggagtcggtcagcagtgcgccggtggcgtcggtggtggtgaccgaaatcagttttacgccgtcggtgatagtggtgagatcgcctgccggaacagtgacgctccagaagccattgctgttcactaccgcgctgtaattgctgccgttaaagttaacctgcaccgcctggcccgggttaacgcccactgcagagccgctgatgatcagatcgctgctcagctcctgctgattcaggaaaccatcaaggctgacaggttcactaatggaaaccacgccaggttcgcctgccgctggggcgacgttaatatcgcgggtgtcggtggctgaggcacctgccgccgttgtgacgctgaccgcgatggtgctgctgcccgccgccagtgcgctgagcgccgaagaggggatctgcgtgctccagctgccatccgcgttgaccagcgcagtgtaattttggccgcccagggtaatggtgaccgtctggcccgcctccacgttgctggtgctgccggacagcgtctggtccagcgctttttcgctgttatccagcagatcgtcaccggcaaacagggcgatcgtcaccgtcggcgtacccggttccgctggcgcttccaccgcaatcacccgatcttcgctgactgttacgcccgcctgattggtgactgtggccgcgatagtcgcgttgcccgccgtcagtgccgccagcgcgctggccgggacgctcaggctccagctgccatccgcgccgaccgtggcgctgtaagtctggtcgcccagcgtaacggtcacgacctgacccgcctcgacattggttgagctgccgctcagcagctgatcgctggttttctcatcgttgctcagcacgtcatccacggcgaactgatcgagcgtgatagtgggctggcccggctcggtaaccggcggctcaaccgtgatcggcagcgtgtcactgacggtggtgcctgccgcgttgctgaccgtgaccaccagcgaggcagaaccggctgccagcgcaccgagtgcatcggccggaatggcaatgttccagctgccgtcggcgccaaccgttccgctgtagctctggccgcccagcgtcaccgtgacaatctggcccgcctcgacgttggtggtgctgccggagaccgcctgcgcttccagcttctcatcgttgctcaggatgttgtcgtcagcaaaggcattgagggttagcgtcggggtgcctggcccggtgcccgaggactccaccaggaagtcgcgggtttcagtgatctgagtaccagactgatctgtcaccgtcacattcagggctgcgctaccggctgtcagcgccgccagtgaactggcaggaatcgacacgctccagctgccatccgcgccgaccgtggcggtaaaagtctctccgttcagagtgacagtgacctgctggccttcaccgatattagtggtggtgccgctcagcagctgatcgctggctttctcgctgttgctgaggatgtcatccccggcaaaggcgtcgatggttacggtggcttcacccggctgcgttaccggggcttcgacagtgactggctgcgttgaagtgactgtgtcgcccgctgcattactgaccgagacggtcagtgtggtggtgcctgctgccagcgcattcagcgcggctgacggcacggcgacgctccagctgccatcaccctgcacgctggcactgtaggtctgaccgcccagggtgaccgtcacgatctgcccggtttcgatattactggtgctaccgctgacaagctgatcgaccgctttttcgtcgttgctcagaaggttatcgccggcgaaatcattcagggtcagagacggcacgcccggttccgttactggcgtctcaaccgcgatatcgcggatttcggtagtgctcacgccatcggcattgctgacggtaacgctgatagcattagctcccgctggcagattacccagcgcggctgccggaacaattacactccagttaccactgccatcgacggtgccaaggtaagtctggccaccgaaggtaacggtcaccgtctggcccgcttcgatgttggtggtggagccggagagcgtctgggccgtccctttttcatcgttgctgaggatgtcatccccggcaaactgaccaatggtgactgtgggttcgcccggcaatgtgacaggggcttccacggtgatgggcagcgtgccggtcacggtatcaccggccacattgctgactgaaaccgtcagcgtcgtttcacctgccgccagggcgctcagggccgccgatggcaaagtaacgctccagttgccctgcgcatcaacgctgccgctgtaagtctggccgcccagggtgacggttaccagctgaccgggttcaacattgctggtgctgccggtgagtgtctgatcggtggctttctccccattactcagcacgttgtccccggcaaaatcatccagcgtgacggatggcgggcccggaacgaccggcgtatcaatgctgatcgcgcggttttcactggcttcaatgccagcctggctggtgacgaccgcggaaatcgcaaccgaaccggttgccagcgcattcagtgccgcaggcgagagcgtgacgctccagttgccctgcgcatccactactgcgctgtaggtctgatcgcccagcgtgatggtgacaatctggcccgcttccacattggtggtggtgccgctaagaacctgatcgctgcttttctcggcattgctgagaatgtcatcaccggcaaactgatcgatggtgataacgggcgtacccggctgagtcagtggtggttctacgtttacggtcaggctaccgctggcggcggttcctgcctggttagcaacggtggcagtcaccgtggtggtaccggatgccagtgcggtcagcgcatcagcaggcacggtaatgctccagctaccgtcgcctgccacgctgccgctgtagctctggccgcccagggtaaccgtgacgatctgcccggcttcgacgttggtggtgctgccgctaagagtctgatcgctggttttttctgcgttgctcagcacgtcgtcgccggtaaacggggcgatcgtcagggctggcacgccaggggtggtgtcaggtgcctgcacctggatacccaggctggcggcagccgccgtgcccgcggcgctggtcacactgaccgaaatggtgctgctgcctgcagccagcgccgagagtgcggcagccggaattgagacgctccagctgccatccgcccccacagtggcgttatagctctgtccgcccaatgtcacactgacctgctggcccgcttcgacattgctggtgctgccggacaacgtttgtggcgtggttttttcgctgttatccagcaggttatcgcccgcaaacgggttcaggctaatggacggcgcagccggtgtgccgggatcggcggccgcgacggtaatgggcaggctgccggtggtcgtcgtgcccgccgcgttagtgacgctgacgtcgatggtggtggtgcctgcggcgagtcccgccagcgcggcagcagggatagtaacgctccagctgccgtcagcaccgacggtggcgttgtaggtctggccgcccagcgtgacagtgacaatctgacccgcttcgacattactggtggtgccgctcagtacctgatcgctgcttttttccgcgttatccagaacatcatcgccagcgaatgcattgagcgtgatagcaggcgtccccggcgtgaccggtgttccaggatcggtgccaccgtcattgccgccaccgttacccccaccgccgccaccaccaccaccgccgacgccaacggccagaccggctaagccgagcacacccagaccgcccgccgttatcacacccatcgaggtgttggcattatctgccagcagcagcggctctacgctgtcgagtgattcataggttggcgtgaccgacgtggaagcgagttcagccccttctgcggtctgcggaaagagcgcgtgttccggtgggttgacgccatcatcgaacaccagtttcgctgtgctggccatcggcgtcgtcgaggaagaatttctgatagcggacagtcttgccgtcgcgcatatgcagcaccagatcgttaccctggcgctcatactgcgtcaccatgtcgcgggtgccgctgatgcgcacgacgctgggctcggtgaggttaatggattgtgacgaaccgctgacggactgcgagatgagtgtgccgttttcgcgcgagataatgtctacacggccttgcgtgagttctgccatttgtaacctctactccaccagattagctaatatactgaacccataaacataaaattattttatgcttacagtgttcacacatagtttcaccttctgaagatcagaagatgtcttaacctggtgtatgtcgaaacggcaaagccaaagctggtcacacgtccctaatcagagtggcgagtgacgctattattgttagttttacttgtacagactcacgcaaaatgtaacgtttctgacagattaacttttagcgtagccgtgttaaaaaacaatttcaatgtacagatttcattatggtttaatcttcattacataagcctcacttgaaaaaaggttttcataaaatccgctttgcctttgtttttacatgtcaatttattgctgactgtttccggaaatgatgcggaaaggttaaaaaaccaccactaccggaacatcagggctgtaaaaaaaatttgttcattaagcgattcagccatcatttataagtggccctgttccgatttttcagcagcaagtcgttgaaaaacgacagtgaaatttgagttaagtcattctgcggggcggtggtcatgccaggaaagttctggaaaaaattcgcagcgcgacaaaagtcggtaaactcccggttttgtcatttatgccatgttgcaatccccttcctgataagaggcgcaacgaccactgactcacggccagtgctacacttttccgctttaccattgatgaatctgacctatgaccgcactggacgctgcacaacaaaacaaacatcagagccgcctgaactggggcacacgcaccatctttttgatcaatggcttaggaatgtcagcctgggctccgctggtgccgtttgcccgcgatcgtctgcagctcagcggcgcatcactgggcgcgttactgctctgtttgggtattggttcgctggccgcgatgccggtgaccggcacactggtggcgcggtttggctgccgtcgggtgatgtgcttctctaccctgttagtgctgatgatgatgccgctactagccacggctgactctcatctggtcatggcggctgcgctgatgctgtttggcgccgggctgggcatgctggatgtggcgatgaattatcaggcggttcaggttgagcaggcggcggataaaccgatgatgtccggcttccatggcttcttcagtcttggtgggattctgggtgcgggcacggtcagcctgttgctgagccagtctttttcacccctggccgccacgctggtggtaatggcagtgatgttgttgctgttgctgtggcgactgccggtcttaatgaatgaacgcctgcatcagcccgatcaaccctggctggtgatcccacgcggctgggtcgcgtttcttggcctgctctgctttatcctgttcctggcggaaggggccgtgctggactggggcgcgctgctgttgctgcagaaacccggagatgtcacccgcctgggccgggctgggctatgcggtcttttccgtggcgatgacgctgggccgttttagcggcgataagatcatccagcgttttggtcgctacccggtgatgctgaccggcgcgctgaccgccgccgcgggcatgagtctggccgtctggctgccgtggccggagatcgccctgctggctttcctgctggtcggctttggtttatctaacacggtgccgatgttgttcaatgctgccgggaatcaacaggatatgcctgcgaacctggcgatttctgccatgacaacgctgggatatgcgggtattctctcaggtccggctttaatcggattcatttcgcaatggatcagcctcagcggcgcatttttagcgatcgccctgttgctgttagcggtagccgccagtgcgcgaaaagttgcgcaataattcaggtacctgacacgctatgttgtataagtttccactgacctccggcaacgtcacccgcttttttgtggttttcaatctggtgctcctgctggcgctgggctttatggtgcataactcggtgaatgcctggctgaccgggaagcgctatgccatggacgatctggcacgtgacgttcagaagcgcattgatgcctatcgctttgccacctggcagatctatgaaaacctctctaccagtgcggcaggtgcaacacccggcagtaacctgcaggagacgcgactgcgtcctgacgtctactacctggaaaaaacccggcgtaaaacggaagcgctgattttcggctcacatgacagcagcacgctgggcatgaccatgcggatgtcgaactatctcgacacgctgtggggcgcagaaaatcccacctggtcgatgtactttttaaatggtcaggacaatagcctgattatgatctcgaccctgccgctgaaagatatggcgacgcgctataaagagagcgccatcagttcaatggtcgatggtcgtcgtgctgagatgttgcagcaggcgaatgcgctcgatgagcgcgagagtttctcaccgctgcgccacttcgccttccagaacgatcactatttcacgctgcgtaccacctttaaccagccgggccatctggccacggtggtcgcctttgatctgccggttaacgatattgttccgcagaacatgccgctggaaaatttccagctgcgtcaggacagctcaatgcctgccagcagcagtgaacagcaggaggtggaaaatacccgcatctcactggttaatcccaatatcgagattacggccaccctgcccagcacctcgctgcagctggtttatcaggtgccgattggccgtctgattatcgacaccctgcacaatctgctctggccgctgctgattaacctgctgctgttcctgctttcactggcgggtatcgtgctgctgcgccagcagtcgctgcgtcccagcgagaaccagagcgctgaactcgattcgctgcgggtattgaatgaagagattgtggccagtctgccggtcggtctgctggtatatgactttgccagcaaccgcaccctgctgagcaataagattgctgaacatcttttgcctcacctcaatctgcagaagatcattaatatgtccgaccagcatcagggcgtgctgcaggccaccatcaataacgaagtgtatgagattcgccacgcccgcagcgtgctgtcgccgcatacccagctgtttatgatgcgtgaccaggatcgcgagctgctggtgaataagaagctgcaaaaagcgcagcaggtgctggatcgtaaccatcagatgcgacagcagctgctgcacaatctgggccatgcgctgaatcaacccctggagaagatggtgacgcagctggtacagctcagccagcgtgatgccgatgagaccgtgctggatctgctcgatgagagtcaggggctggcgcggctggtggatgatatcgtgctgctgaaccggcttgaggcgcacgactggtcacccgatgcgaccgtctttaacctgcaggaactgctggatgagatcgcgctggaaagcctgccgctgatgcgccgcaaagggctgtcgctggtggtgaataatcacctggctaatgatgagacgcgctttggcgaccgtcgcgccctgcgtaaggtgctgaccacgctgatgcactacgccctgaccaccacccgctgggggaaaatcaccctggaagttaaggctgcggacaagcaggccgatagattgattatcgagctggtggataccggtgcgggcctgacggtggatgaactggccaatgtcgacttcccgttcctgggcgataccagtcaggatcgctacggacaggcttctggcatggcgttcttcctctgtaagcagctctgcaagcagatgggtggcagcctggatatcgtggcaaaagcggatatcggcacgcgctacaacatgcagttgccgctggtgctggagcagaagcgcgaagaagaagaggaaaaaattctggatggcgttaccgcgctggtggagatcaccgtggaggacgtgcataaaattgtctgccgccatctggaaaactggggagcgcgttgtctgacacccgacgagcgcatttccggtcaggatcacgatgtgctggtgaccgacgatccatcaaagcttagcggctgggcactgctgctggcggaagatgaactggggcaccatgcactgaacgaccagcagtatcgggtcaatttcaatctcagtaatgcgctgctggatgcattgctggcactgatagagaagcaactgtcgcatgatgtgatggataacgacacggaagacgacgcggccacgccattgatgagcggcggctatttccagctgtttacggagacagtaccggttgatgtgaagaggctgtatactgagtcggcggaaaaggactacgcctcgcttgctcagacagcgcatcgcctaaagggcgtgtttgccatgctcaatctgactcccggcaaacagctttgtgaagagttagaacaccacattaaagcgtgtgacgattcaaacattacaaataccaccagtgatattgacgcttacgtcaatcaactgctgcagcaaggtaaccaataagatgaataacttaaacgtaattattgccgatgaccatccaattgtccttttcggtatccgaaaatctctggaacaaattgaatgggttaacgttgtaggtgagttcgaagactcaacagcactgatcaataatctgtccaagcttgatgccaacgtcctgatcaccgacctctctatgccaggtgagaagtatggcgatggtattacgctgattaaatatattaaacgccactacccggatctctcgattattgttctgaccatgaacaataacccggcgattctgagttcagtgcttgatctcgatatcgaagggattgtactgaaacagggcgcgccaaccgatttgccaaaggcactggctgcactgcagaaaggcaagaaatatacgccggaaagcgttgcgaaactgctggagaaaatcagcgcgggtggttatggcgacaaacgcctgtcaccgaaagagagcgaagtgctgcgtctgtttgcagaaggtttcctggtcaccgagattgccaagaagctgaaccgcagtatcaaaaccatcagtagccagaagaaatcagcgatgatgaaactgggcgtggataacgatatcgcactgctgaactacctgtcgtctgtcagccagactcaggtcgaaagagattaagttacttcctgaggcggtgcagcctgcaccgcctcgcctctgctctatcccatccgcgttttacgtacccgatcagcatagattgccagcgtcactttcagcacatctaacgtcaccggtttcgacaggcagttatccatgcccgcatccatgcaacgctgtttctcttccgccagcgcattcgccgtcacgccaaccaccgggaagagatggcccagctgacgcaaccgctgcgtcaggcgataaccatccatattcggcatgttcacgtcggtgagtacaatatcaatctcgttacgactcagtacattaagtgcatcaacgccatcctgcgcagttttcacctgatagcccagcgtgccgagctgttccgacagcagcatgcggttaatcggatggtcatcgacaatcagcaccatgatgtcatcgttatgcactttctcttctaccggtgcggccagcaacagcgcatctgcggcgtcgttgcccagtgcgattcgatagatgcgcgccagcagcgccggaacctcatgcagcgtggcggtagagtggatccagcggccaggctgacgtttcacgtggcatatccacatgcgatccatcgaaagtgaccagcgcccgcaacggaacatcaatatccagttcgtaatcggtcattaccacatcgtcatggccaggcttaccgttatactccccgacctgaatgccctgctgctgaatctgacgcgtaataaattccgcgaggtactcattgcgcatcgccagccagattttcttatcctgtaaatcctccagcagcatcagtgacggcttctgccctttgtagattggaatacgcacaataaactggctgcccatgcctggctctgagtcgacctcgatgtcgccatccatcatattgatcagcttttcacagatcgccagtcccagcccggtgccctggaaattacgctgcacgccatttcccacctggaagaaaggatcaaacaggcgtggcagctctttcgccggaatgccgacgccagtatcacggacgcggaacgccagatagccctgcgcaacgtaagcatggaggataatacagcccgtatgcgtgaacttaatcgcgttattcagcaggttcgagatcacctgctgcagacgcagcggatcgccatccagcacctgcggaacgtcatgttcaataaagcagtagagcgtaatccgcttcttcaccaccagcgacagatagttgccgacgatgtgggtcacgatttcacgaggtgcaaacggacgcggctcaattttcagctgctctgattcgatttttgaaaagtcgagaatatcgctgatgattttcagcagcaggctggaggagttgttcatcgccgtcaccagcgagtcgataccgctgggcagctctttggtctgcagcagatcgagattaccgataatgccataaagcggcgtgcgcagttcgtgactgaccgtggcaaggaacatcgattttgactgactcgcctgctctgccgcgtgggccatctcctgcagcgactgctccatccgcacgcgcgccgagacgtcgaccagcacgcaaatcgccacgttctcattacgatagcgcgaatgcacgaagctgatttgcaaattggtattactgccggtgagcacatcgacaaagttgacctgctgcccgccaataatctcattcagccgcaggcgatcttcctgcgtcagcaacgtcagataattgtgcgccagctcgttactcagaatattggtgccgtcgctggtgcgtaaaatacagatcccgaccggcgcagaggcgacaatcttacggttaaactgctcatgctcttccagccggtgcgcattctcctccgccggcaggaacatccggcgctcaaacagccaggcgagggtaaacagaataacggcgctgaaaatattgagcagcagcgcattaatgatcatcagcttgagctgatccaccatcacgtcggtagatatcgaccacaccacgttaagatcggaaggcggcagcggctttttcagaaccagctgacgataaccattcaggtatccgaaccaggttttatcatcaggaagactatcgagcgagaaacccagcccgccgcgccgcgaatttagcagtggacgataattttcatcggtaatggacgcgataatcggcaggctgcccggctgaataaactcatccagccggatattctgttcgacgcccagcagcgcctgtaacttattagcaacgtagacgggcaccaccataaagaaggttccgacgcctggctgagcactgctgttaatccagtacatcggattgcggcgatcttcttcgctgctattgcgatagcgcagcacattctcacgcagcgatttcaggctgcgtttcccggtcagcattgctgctgccaatcgtgaagtcggccagacactgactctcgccaccgataaagaacacccgattcagctcatacgatgaggcgaagttacttttccagtaattgatgtagtaactgagtgaatcgagcgagttgcgccaggtattgctcatcgaggtacagtcgccatccgaaaacaggggcgtaaactgcggctgagatgttttgcctggcatcataccggtcagcacatccagaccgctgctggcgttggttaagcggttctcggtgatatatttcagctcacgcatcatgtccgccgaatggcgcacataccactgtatcgtgccgtagttgctggcaaactcctgccgaacctgcgtctctttattgtgcagcacgctgataatgtaaaacgcagtaagaacggcgcccagcgtccagattagcagcgccagcgcgcggaaaagatagcgcgagatgcgaagcgtagtgcggaaagagacaggatatttcaaaggtaactcgcagttggcaaggttagtcgcatcatcgatttttaatgcccatacactagctttatcgggcgtaaaaagccagccagccgcaggcttagcgggcggtttgggaatcttttaagatagccaaagcaacatctttatctactcaaagcggttccaccatcccaataagaaaggcctgctgtgcccgaagagcaaagcgtccacgccagggatggcgtggccgatccgcatggatgcgggaatcctttgcgatcgggcacagcaggccttgcgacggctcccatctgacagccatcagccagccattttcccgccccgcctctaagacctcaaacaacacgcccatcccctcaaagcgacacccaaatcccaccaagaaaggcctgctatgcccgaagagcaaagcgtccacgccagggatggcgtggccgatccgcatggatgcgggaatcctttgcgatcgggcatagtgggcctttcggcggctcccaactcacagccaccagccaccagccaccagccaccagccatcagccattttcccgacccgcctctcacacctcaaacaacacgcccatcccctcaaagcgacacccaaatcccaacaagaaaggcctgctatgcccgaagagcaaagcgtccacgccagggatggcgtggccgatccgcatggatgcgggaatcctttgcgatcgggcatagtgggcctttcggcggctcccaactcacagccaccagcaaccagcaaccagcaaccagcaaccagcctccagcctccagcctccagccctaagctccctgctccctccccatcacacaaaaaaaacggcaggccgggtttcccctgacctgccgtttctgcaacgaacctcagctcacgccagacaaattactcttcgtcttcagccgcgtcgtcttcgtcttctgcatccgcttccggcgcaatctcttcatcgtcgttctctgcttccggcgcgatatcttcctcgccttccgccacgctaccgtcgattgaatccagctcttcttcttcaaccggctcggcaacacgctgcagacccacgacgtttctcatcctctgcggtacgaatcagaatcacaccctgggtattacgacccacgacgctgacttctgaaacgcgggtacgcaccagcgtaccggcatcggtgatcatcataatctgatcgccatcaacgacctgaacggcgccaatcaccggaccattacgttcggtcactttgattgaaataacaccctgagtcgcgcgcgacttggtcgggtattcgctgttggccgtacgcttgccgtaaccattctgcgtcacggtcataattgcaccctcttcacgcggcacaatcaatgacacaacgcgatcgccttcagccagcctgatgccgcgtacgccagaggcggtacgacccatcgcacggactgcggtttctgcaaagcgcaccactttaccggccgctgagaacagcatcgcttcatcgttaccgttggtcagcgccacaccgatcagctcatcgtcgtcacgcagattcacggcaataatgcccgcgctgcgtggacggctgaactctttcagtgcggtcttcttcacggtaccgagcgcggtcgccataaagatattaaagccttcggtatactcacgtaccggcagaatcgccgtaatacgctcgttggcttccagcggcagcaggttgacgattggacgtccacgtgcgccacggcttgcttccggcaactggtaaaccttcatccagtagagacggccacggctggagaagcaaagaatcgtgtcatgcgtattggcgaccagcagacgatcaatgaaatcctcttctttgatacgtgcggctgacttgcccttaccaccacgacgctgcgcttcatagtcggtcagcggctgatacttcacatagccctgatgcgacaatgtcaccacaacatcttcctgattgatcaggtcttcgatattaatgtcagccgtgttggcagtaatctctgtgcgacgctcatcaccgaactgatcacgcatcagctccagctcttcgcggatcacttccatcagacggtccgcgttcgacagaatgcgcagcaactcagcgatctgctccagcagcgctttatactcatccagcagcttctcgtgctcaagaccagtcagtttctgcagacgcagatccagaatcgcctgagcctgctgctcggtcagatagtattgaccatcacggatgccatattgtggatccagccactccggacgcgcggcgtcatcaccagcacgttccagcatcgctgacacgttaccgagagcccacgactgcgcaatcagacccgcttttgcttctgccgggtttggtgcacgacgaatcagctcgatgataggatcgatattcgccagcgcaatcgccagaccttccagaatatgcgcacgatcgcgtgctttacgcagttcaaagatagtacgacgcgtcacaacttcacgacgatggcgaacaaaggcgtccagaatctccttcagcgccatgatcttcggctgaccctgatgcagggcgaccatgttgataccaaacgaggtctgcaactgggtcagtgaatagagattattcagcacgacttcgccaaccgcatcgcgcttgatctcaatcacgatacgcatgccgtctttatcagactcatcgcgcagtgcgctgatgccttcgacacgcttctctttcaccagctccgcaatcttctcaatcaggcgtgccttgttaacctgatacggcagctcatgaatgatgatggtctcgcggcccgttttagcatcggcttccacttcgccacgcgcacgaatataaattttaccgcgtccggtgcggtacgcttcttcgatgccacggcgaccattgatgatagcggcggtcgggaaatcaggccccggaatgtgctccatcagctcttcaatgctgatgtcttcattttcaatgtaagccagacagccgttaatcacttcacgcaggttatgcggcggaatgttggttgccatacctacggcgataccggaagagccgttcaccagcaggttagggattttggtcggcagaacttcagggatctgctcagtgccgtcgtagtttcggtacgaaatcgacggtatctttttccaggtcagctaacaggtcgtgggcgattttcgacatgcgaatttcggtataacgcatcgccgcggcggagtcgccgtcgatggaaccgaagttgccttgtccgtccaccagcatgtaacgcagggagaaaggctgggccatacgtacaatggtgtcgtaaacggcggaatcaccatgcgggtgatatttaccgataacgtcaccgacgacgcgggcagattttttatagggtttgttccagtcgttacccagtacactcatcgcaaaaagtacgcgacgatgaaccggcttcaggccatcacgcacatcgggtaaagctcggccaacgatgaccgacatggcgtaaccgaggtaagaattttttaattcttcttcgatattgaccggtgtaatttctctcgcaaggtcgctcatggagccgctatccctctacttaatcccggattttaaaggtgcgaaagtatatcacactgcaatgctctggtgaacgctaaccaccgatttcacccgcttttccttgcgcctgaaaggtgtgccatctgcggttaagcgtttatactgtgggcacattttgtcaggagttacgattcaatgaatgcacaaccgcagaatcatcagcagaacgtcgatgcgcaggaaattgccaagtttgaggccgttgcctcgcgctggtgggatctggagggtgaatttaaaccgttgcaccgcattaacccgctgcgcctgggctatatcgcgcagcacagcaacggcttattcggtaaaaccgtgctcgacgtcggatgcggcggcggcatcttagccgaaagcatggcgcgtgaaggtgccgtggtcacgggtctggacatgggcgcggaaccgctggccgtggcgcgcctgcatgctctggagagcggagtgacgctggactacgtgcagcagaccgtagaagagcatgcggagcagcacgccggaaaatatgatgtggtgacctgcatggagatgctggagcacgtgccggatccgcgctcagtcgttcacgcctgtgcgaagctggtcaaacccggcggcgaagtctttttctctacgctgaaccgcaatccaaaagcctggctgctggcgatatttggtgcggaatatgtgttgcgcatgctgccgcgcggcacccatgacgtgaagaaatttatccgtccttccgaactgctgggctgggtcgatgaaacggccctgcgtgaacgccacatcattggcctgcactacaacccggtgactaaccgattcaaactggctcccggcactgacgtgaattatatggtgcacacccaccgcgccgtctgagtgacccgcccgcctgaatcagggcgggcatctcctcttctgcgcccgttctccctgtgccggtcacagcactcaccgcgccagaggcattctgatgtctgccaataggttacatcagcccggttccatcctcttcagcgttaccgcatccggttctctgctgaccagcaacccgctagcggcttttagccatttttcatcccttttcctgctgaatcctgaggattgaataagaaacacgcgcccgatcataataagaaaaaaaagtgtgatctggttgacatgatgccaggccttacaaggcgtgggctaagaaatttcgcaagaattacaacccctccagccatcattttttgctcttgttaagcggccgtaaaatactaaaatatgcccccatgtagttatggcttttcccatcaccccctagatgtagtgtttatccacacattattcacaatgaataggctgtgtataaaccgggatttcttttaatttttggatactcacgcaaaggtaaaaacgcgacatgaaccagagtctgctcgttactaaacgcgatggccgccaggagcgcattgatctcgacaaaattcaccgtgtgctggactgggcagctgaagggctgaacaacgtctcagtttcacaggttgagctgcgctctcacattcagttctatgatggcatcagaacctctgacattcatgagaccatcatcaaggccgcagcagacctcatctcccgcgatgcccctgactatcagtacctggctgcccgcctggcgatcttccacctgcgcaaaaaagcgtatggtcagtttgagccgccaaagctctatgaccaggtcgttaagatggtcgacatgggcaaatatgatcgccacctgctggaagactacagccaggaagagtttgcgcagatggacgagttcctcgaccactggcgtgacatgaacttctcctatgccgctgtgaagcagctggaaggcaaatatctggtgcagaaccgcgtttcgggtgaaatctacgaaagcgcgcagttcctctacatactggtcgccgcctgcctcttctccggctacccgcgcgacacgcgtatggattacatcaagcgtttctatgatgcgatctcgacgtttaaaatctccctgccgacgccaatcatgtctggcgtacgcaccccaacacgtcagttcagctcctgtgtgctgatcgagtgcggcgacagcctggactccatcaacgccacctccagcgcgattgtgaaatatgtctctcagcgtgccggcatcggtatcaacgccggtcgtatccgtgcgctgggcagcccgattcgcggcggtgaagcgttccataccggctgtatcccgttctacaagcatttccagaccgcggtgaagtcctgttctcagggcggcgtttcgtggcggcgcagccacgctgttctacccgatgtggcatctggaaatcgaaagcctgctggtgctgaagaacaaccgtggtgttgaaggcaaccgcgtgcgtcacatggactatggtgtacagctcaacaagctgatgtatcagcgcctgctgaaaggcgaagatatcaccctgttcagcccgtctgacgtgcctggcctgtatgacgcattcttcgccaatcaggatgagtttgagcgcctctataccaaatatgagcaggatcagagcatccgtaagcagcgtgttaaagcggtcgatctcttctcactgatgatgcaggaacgcgcctctaccggccgtatctacattcagaacgtcgatcactgcaacacccacagcccgtttgacccgagcattgcgccggttcgccagtctaacctctgcctggaaatcgccctgccgaccaaaccgctggaagatgttaacgacgaaaacggtgagattgccctgtgtacgctctctgcgttcaacctcggcgccatcgaaagcctcgacgatttggaagagctggctaccctggccgtacgtgcgcttgatgcgctgctcgactatcaggactacccgattccggctgcccagcgtggcgcaatgggtcgtcgtaccctgggtatcggcgtcattaactacgcctactatctggcgaagcatggtgtgcgctactccgatggcagcgccaatggcctgacgcacaagacctttgaagcgattcagtattacctgctgaaagcctcaaacgagctggcgaaagagcaaggtgcctgcccgtggttcaatgaaaccacctatgcgcagggcattctgcctatcgacacctacaagaaagatctggatgcgatcagcaacgaaccgctgcatctcgactgggaaagcctgcgtgaagagattaaaacgcacggcctgcgcaactcgaccctgtctgcgctgatgccgtctgaaacctcgtcgcagatctccaatgccaccaacggtattgagcctccgcgcggtcacatcagcatcaaagcgtcaaaagatggcatcctgcgtcaggtcgtgccggagtatgagcgtctgaaagatcagtacgaactgctgtgggaaatgccgaacaacgacggctacctgcaactggtgggtctgatgcagaaattcatcgaccaggcgatttcgtccaacaccaactacgatccgtcgcgcttcaccaacggtaaagtgccgatgaaacagctgctgaaagatctgctgacggcgtataagttcggcgtgaaaacgctctactatcaaaacacccgtgacggtgctgaagatgcgcaggatgacctggcaccttctatccaggatgatggctgcgagagcggcgcctgtaagatctaatggtcaggcgggagaatctcccgcctcattcatttcacgaggcctggcttcgtctacttttggacaacttttatggcttactccactttctcacagaacaaaaatgatcagctgaaagagccgatgtttttcggtcagtccgtaaacgtggcgcgcttcgaccagcaaaaatatgacatctttgaaaagctgatcgaaaagcagctctccttcttctggcgtccggaagaggtcgacgtttcccgcgatcgcatcgattaccaggcgctgccggaccacgaaaaacatatctttatcagcaacctgaagtatcagacgctgctggattcgattcagggccgcagcccgaacgtcgcgctgctgccgctgatctcgattcctgagctggaaacctggattgaaacctgggcgttctcagagacgattcactcccgttcttacacccacatcatccgtaatatcgttaacgatccggcagtggtgtttgacgatatcgtcaccaatgagcagattctggcgcgtgctcaggatatctcacgctattacgacgatctgattgagatgaccaactactggcatcagctgggtgaaggcacgcatcaggtcaatggcaaacctgtcgtcgtcagcctgcgcgccctgaagaagcagctctatatctgcctgatgagcgtcaatgcgctggaagcgatccgtttctatgtcagcttcgcctgttccttcgcgttcgctgagcgtgagctgatggaaggcaatgccaaaatcatcaagctgattgcccgcgatgaagcgctgcacctgaccggcacccagcacatgctgaatctgctgcgcagcggtgaagacgatccggagatgaaagagattgcggcagagtgccgtgaagagtgcttcgagctgtttaagaaagcagcgctgcaggagaaagagtgggcagaatatctgttcagcggcggctcaatgatcggcctgaacaaagatattctctgccagtacattgagtacatcaccaatatccgtatgcaggctgttggccttgatttgccgttccagacgcgctcaaacccaatcccatggattaactcctggctggtctctgacaacgttcaggttgcgccgcaggaagtggaagtgagctcctatctggtgggtcagatcgattctgaagtaggcgctaacgacttcgacgacttccagctttaactatgagccgcgacgttgttattctgcgcagttccggcacccggctggaatgcacagacgagcataccaatctgctgacgctgctggaagccaacaatctctgcgtggagtttcagtgccgcgaaggttactgcggctcttgccggatgcggctgctgaaaggcgaagtgcattacccacaacggccgctggcttttgtgcagcaagatgagattctgccctgctgctgcaaagccaaaggcgagattgagctggagttataactgaggtgggataagtctggcttgatttgctgtgagatcgagtcagcttagggaacacggtcagatcggaaagacgcaaaaagcgtcatccctgacagctcggcccgcgcgattacgcacctcatccctgaggggcgcccgtagccgggccaacgcgttgcgttgttcaaaaacgctcccggcgtttttgtcccaggcgcgggacgctttcctcctctgcccgtgttccctgcgctttgagctaatttattgctgcgataatgacgctgtatgggattaattcgcagtcacatacaagacgggcgcctcaggcgcccgttttattttcactgatattactgtctgacagtttcaaccacatcaatccagccgtgaccggtgctcacttcgctgccgtgtaaccagcggcgcagcatgttcatcgccatcattgccaccaccttctgccgcgtctccagattatggcgaccggtactgaacttcacgcgctgaccaaaactgccatccggtgtatgcagcgccaccgaaatctcctcctgctccaggctgccaacagagagcgccagcgcggcctgctgctgtgcagcaagttcgcgggtgcggatcacctgctgctccagcgtctcctgcccggatggcaggatgtcagccccacgcagcggcacgctggcgccagccaactgccagtagagcagtccggcagtgtattgctcactgactgccagctgctcaccgcgctgctccagctcacgtgccagcagcgccggtaagccttcggtgccttcgaaaatggtgcactccgccagttgcaggcgcacctgctgccacacctgctccatcgctacccgctgactggccgggccggtgagcttgatctcaatgatcggcatggacgagcgatatcccatgaccacgccttccggcagcgccagcggctccagtttcggcggcaatatcgctttcaccgcgaccaaaggtggtcagccgcagacaaatcggtggctcgggcggcgaaaatttcgctttcagacgggggatgatctgctgctccaccatcactttaaattcagacggcacaccaggcgtgaagaacatccagcagcgattgagttgcagggcaaagccacaggcggtaccgaccggattatcaatcagttccgcattggccgggatttccgcctgcttgcgattgctggccgccatcacgcgtccccggctggcgaaccaggcttccatctgttccagccactcctgctgcacctcaagctcaacgccacaggctctggcggctgccagcgcactgagatcgtcactggtcggccccagaccgccattcacaatcagcacatctgcctcatggctgcgcgcctgtagcgtggcgattagcgattcgagtgaatctcctaccgtggtacggctggtcataggcaacccttgctggaacaacatatccgccagccaggctgcgttggtatcgacgatttggccatgcagcacctcatccccggtcgacagcatctctactctaatcacgttgagttctccttttcacgtttgctttactgtacgaactcctcccgccagacacaatcggcatcaccagggattgtgaccattgcgtctcaggcacgttgcgcataaagatagcgagggtgaagcaggatcaagggtggtgaaggtgttcagggagttaaaaaccaataaaaacggcgggattgccccgccgcttttttactactgttgtctgctacaactgagtcagcgaatcgcgattagcgacgtgccagcagcagaccaagtaccagaccggctgttgcaccgataccgacaccctgccacggtttttcgtgcacgtaatcgtctgcacggtaagccgcttgtttagcgcgatagtagtagctatcggacgcctggctgacacgggatttcacatcgttcagcgcctgttcggctttgctcttaagctcaatgtacttctgatcggccggatcacctgatgccttaagaacttcttccagcgtttcggtcagtaacgcaatatcgtcatcgaggcccgtttcgaattgatttgtctgatttaccatcgtttcctccgtgtgaattgcaaagcagttcattaactatagtcataatctggcgctctgctgatttcctgctccaggaatcacctgatttttcatctgttaatcttgctcagtgcaggctgtgcgccgtttcgctacgcaaagaagtgtaagacgcagcggcaaccgcggaatttcgcttcgcttctttgattaatctgataaattttgtcgtgactgaattttccagtaaccctactgtcgtacccctctgttgcctgtgattatcgggccatgaaagtgcattttgcacgacagtcacgacaccctcgaacagctaaggaataatctctggcatgaatcgaagaatgtttatgaaagcgtcaatggccttctccgccgtcagcggcatgaccggcctgtcaacgctgtttgcgcaatccgcatgggcagaagatggcattgctgacggaaccgccgtacgcttcgatttcgacgtattgaagaaaaacgcggctgcgctggcgaaaaaaccctggggcggagcaccgggcgcgctgccggagacgctggccacactgaccccgcaggcgtacaacgaaattcagtatgacgccaaccactcactctggaacaacctgcccgatcgtcaactggacgttcagttcttccatgtcggtatgggcttcaagcggcgcatccgcatgttctctgttgacggcgagagtcgcgaagcacgcgaaattcacttccgtcccgaattgttcaactacaacgacgccaaagttgatacgaagcagctggagggcaaaactgacctcggcttcgccggtttccgcgcctttaaaaaaccggaactggcccgtcgcgacatcgtctccttccttggcgcaagctacttccgtgccgttgacgatactttccagtacggcctctcggcgcgtggcgtagcgatcaacaccttcagcaatggccaggaagagtttcccgatttcaccgccttctggtttgaaacgccaaaagcggaagataccacctttacctgctacgccctgctggatggtgccagcgtcaccggtgcttataaattcatcatccattgcgaagagaaacgcgtggtgatggaggtggaaaaccacctgtttgcccgtaaagagatccgtcagattggcatctcgccaatgaccagtatgttcagctgcggcaccaacgaaacgccgcatgtgcaacacttaccatccgcagatccatgactccgatcgcctggcgatgtggaccggtaaaggtgaatggattgcccgtccgctgaataatcctcagcgtctgcagttcaacgcctatgaagatgagaatccgcgtgggtttggcctgctgcagcttaatcacgacttcaaagattatcaggatgtgattggctggtatgacaaacgtcccagcctgtgggttgagccggttggtaagtggggcaaaggcgcgattaacttgatggagatcccgaccacgggtgaaacgctggataacgtggtctgcttctggcaaccggctgagccggtcaaagcgggcagcgagctgaacttctcctacaagctttactggagtggtctgccgccggtgcgtagcggtctggcgcgcgtggatgcaacccgtaccggtatcggtggtttcccggaaggctgggcgcctggcgaacacttcccggaaacctggtgccgccgcttcgccatcgattttattggtggcgatctgcaggctgctgcgccgaaaggtattgagccggtgattaccgtttcatccggcagcgtgaagcaggttgagattctgtatgtcgatccgcttaagggctatcgcatcctgtttgactggtatccgaacagcgattccaccgagccggtagagatgcgtctgttcctgcgcagcaaagatgagacgctgagtgaaacctggctctatcaatatttcccgcctgcgccggatcagcgtaaatatgtcgatgaccgccagatgacggtgggttgatgtaaacaggcgaggctcaggcctcgccttttttatggcgcgttcttcagcatatcgacgtgagggatcccatcttccaggtagttctcccccacagcgacaaagccatgctgcccatagaaactttccagatgcgcctgcgcggagagaaacagatcgcggcccggccagtattgctgacaactgttgatcgcctgctccatcagacggttccccagccgcgcaccacgaacccgatctgaaacaatcacccgtccgattttcaccggactggtctcatcctccggagagagcagtcgcgcataggccaccagctggtcatccgccattcccagcagatgccggttttccgcctgcaaatctttgccatccacatcaaggtaagcgcactgctgttccaccacaaacacggcactgcgcaacgccagcagtgcatagagctgtgagggggtcagttcgctatggtgtttatcctgccagttaatgtccatggtctctcctttaaaccacacactctacatcagcgcggtgtcgccagcacctgctggtgacactctcttacaggcaaaaaaaaatcaggcccggaggcctgattcgtcagtcgcagcaacgcgcttacatcagcggctgagccatctgcaccagtctgatcagcggctgcgggtaaacccctaacagcagcaccagaatggcagaaatcagtactaccacaccaccggccgtaaatgcccagttagccggggtatcacgggtatgcagtttccggcgggctgaggtagagactcaccgtcacgcgcagatagtagtagaggccaatcgcactacccgcgactacagcaccggtcagccaccacaggtgcgcactgacgcctgaagcgataacgtagaatttaccgataaagcccagcgtcatcgggatacccgccagtgacagcatcatcaccgtcatcaccgctgacagaataggacgatgccagaacagaccgcggtaggagtagagcgagtcagcatccgggccacgatatgggctggacatcagactcaccacaccaaaggcacccaggctgctgaacagataaccggccaggtaaacgcccgacgtttccagcgacagctgatgatctttcaccgcaatcagtgccaccagcagataaccgaggtgggcgatagaggaataacccagcagacgcttgatgttgctctgcgaaatcgccatcaggttaccgaacagaatcgacacgaaggcgatcatggccagcactgtgcgcaccgcttcgctgtcggtcaccggcgcatacataaacagacgcatgatgacaccgaagatagcaatcttgctggcggtggccaggaaggttgaaaccggcgcaggcgcaccctgataaacatcgggagtccagaggtggaacggaaccagtgagagcttaaagcccagaccgataatcatcatacccagacccaccagcagaagtggctcgtggatcatgctgtcagtcaggctctggcccagcgccacaaagctcaggttaccggagtcggcgtaaatcagcgcaataccaaacagcaggaacgacgaggccgccgccgaaagaatggtgtacttcagtgcggcttccagtgaacgtttctggcggaaggcgtagccaatcagaccaaacagcggcagcgaaagcagctcaataccgatgaacagcgaagccagatggttagcactggccagcacgatgccaccaagtgccgcaatgagcaccagcaggtagaactcatctttgttgtccgggaagcccgccagccatggataggcaaaggtgcaggtcgccagactcgccagcatgaccagcgcggtatagaacatcgaatagccatcgacgcgcagcagcggcgtgacatccatcgccccgacctgaccgacaaagtagagcgagagcagcgccaggttcaggccaactaccgttagcgtggcgttaacgaagtggttgcgtcgccaggcaatggacagcatcacaaccaccaccgtcaatccgacgattaacagcggtagcaacgcaatcaattggtgaggagttattgtcatggcgaattacggccttgtagttgaaattgaagcggtaaaccactgctgaatattgctcatggcagcgtgcgaagtatccagaatcggctgtggatagacgcccagcagcaccagcagcaccaccagaacaccgatggtcataaactcacgcggtgacatgcctggcagcggatctttcgatttcgcttcgccgtaataagcgcgctgcatcatcaccagcgagtaaatcgaggcaaacaccagaccaaaggtcgcgatgatgataatcatcggcaccacctggaagctgccggtcagaatcataaattcgccgacgaagttaccggtgcctggcataccgaggttggcaaccgcaaagaacagcgacagacccggaatccatttaatgcgcgaccacaggccacccatctgacgcatatcacgagtatgcagacgttcatacagctgaccacacagaatgaagagtgctgcagcggagagaccgtgcgcaatcatctgaatcaccgcgccctgcagcgccagctggctgccggtatagatggcaatcagcacaaagcccatgtgcgaaatcgaggtgtaagcaatcagacgtttgatatcagtctgcgagaaggccatccaggcaccgtagaagataccgatgatgcccaaccacatggcgattggcgcaaactcggctgacgcattcgggaacagcggcagactgaaacgcagtaaaccgtaagctgcggttttcagcaggatacccgccaggtcgacagaaaccagccgttggtgcctgactgtgcgcatccggcagccagccgtgcaacggtaccaccggcatcttcaccgcaaaggcgataaagaagcccagcatcagcagatattcaacaccgctcgacattggggtctgcagcagctgttcgtagttgaatgtccagacgccagtcgcgttgtagtggacaaacaccaggcccagaatcgcaatcagcatcaccagacctgaagcctgggtgtagatgaagaatttggtcgcggcggaaatacgggttttgccgtccgatgctttatgaccccagagcgcgatgaggaagtacatcggcaccagcatcatttcccagaagaagaagaacaggaacaggtcgatggagaggaaaacaccgattacgccgcccaggatccacatcaggttcaggtggaagaagccctgatactttgaaatctcattccaggaacagagcaccgccatcagaccgagcaggccggtcagcaccaccatcagcagcgacaggccatcaatggctaaatggaagctgatgccgaagcgtgggatccacggaacggagaaacttgactgccactgcggaatgcccgctgcctgcgtcagtgaatagcctccctgcaaccagagttgcagtgaaagcgccaacgtcagccccatagtgatcagtgcgatccagcgtggcaccttcgcgccgaggcgctcagtgagccagcagatcagaccaccgacgaagggtatgataattagccaaggtaataacacggcacacttcccttttctttgtcttagttcgggctatcttacttgccattttggctcccggcagtgctcgcaatcctcacatacctcggtatgctccggttgctgtgcgctggcggtaaccaaactggccgcgacgataacgcccttgctcaggacaatttttgacattctcaatgggcagattagctaacctgccccgctcatcaatctttaaatcaccagcagcagagccagcaccagcacggcgcccacgctcattgacgcaacgtaccagcgcaggtagccattctcactgactaccaggcctttgttggcaatacgtgacagcagcgcaggcaggttcatcaggccattcagtgggtcacgcttcagcagccacgcaatacccagataaggtttgacgaacactttatcgtagagccagtcgaagccccaggccgcaaaccaccaggtgccgaagaaacggcctggtgcactgtttgcgatacgggtaaccagctcacgtttgcccagccacagcgcggcagcgatcagaatgccgacaatcgctacgacgcccgaggtgatttcaagtcccactttgcccgcttcaccgaactcattggctggcagtacacctgccagcggcggcgtgatcagcgcaccaataaaggtggagagcagcagcagcacaatcagcggcagatgatgggtaatacccttaccggcgtgcgcatgaattttctcttcgccgtggaacacgatgaagatcatacggaaggtatagatagaggtcaggaaacgcccccaccagacctgcaaccatcaggttgatgtgaccgttagccagtgcgccaaacaggatctcatctttactgtagaagcccgccgtaatcagcggcagtgccgccagcgccgcgccgcccaccaggaagcaggtgtagaccagcggaatgctcttacgcaggccacccattttgaaaatgttctgctcgtgatggcaggccagaatcactgaacccgaagagaggaacagcaacgctttaaagaaggcgtgcgtcatcagatggaaaatcgccgcatcccacgcctgaacacccagcgccaggaacatgtagccaatctggctcatggtggagtaagcgagaacacgtttaatgtcggtctgtaccagcgcggcaaagcctgccagcaccagggtaatcgccccgataatcccgaccagatgcagcacttccggcgtcagcaggaagagaccgtggctacgggcaatcaggtagacacctgctgtcaccatggtcgcggcgtggatcagtgccgaaaccggtgtcggaccagccatcgcatctgccagccaggtctgtaacggcagctgagccgatttaccgaccgcgccacccagcagcatcagcgttgcccactgcagcatatggttatctgcggcaaagtgcgcaggagccagctccatcatctcgcggaagttcagcgtgcccagctcgttgtagaggatgaacagaccaaatgccaggaagacgtcgcccacgcgggtaatgatgaacgctttcatcgccgctttgccgttttccggattgctgtagtagaaaccgatcagcagataagagcagaggcctaccccttcccagcccagatacatcagcatcaggttatcggccagcaccagaacaaccatgctggcgataaacaggttggtgtaggcgaagaagcgggagtagccctcttctccacgcatgtaccaggaggcgaacatgtgaatgaagaaaccgacaccggtcacgacagacagcatggtcagcgacaggccatccagcgtcaggttcaccttcatgtcgaagttgccgacatgcatccaggtccagagcgcctgcgtgtaggcttgctgaccgttggcgaagaagtcaaaaccgaccatcgccgtggtcagggccgccagacccacggatcccataccaatcgtggccgacaggttctctgaccagcgaccgcgcgaaaacgctaacagcagaaagccgatcagcggaaacaagacagttaaatagagaagattcatccgcgcatctcgctcacagtatcaatgttcagcgtctgacgacgacgatagagctgaagcagcagtgccagaccaatactggcttccgctgccgccaggctgatcgccaggatatacatcacctgtccatcggcctgaccccaatagctcccggcaaccaccagggctaaggcggcggcgttgatcatgatttcaaggccgatcagcataaacagcagattgcggcgtattaccagcgacgtcagtccaaggacaaacagcacggcagcaagaatcaatccatgttgtaacgggatcatgcgttctcctttttcacctgagcggcgtcagcattacggttactcaggacttcgccctgacgctcttcacgaccgatatggaacgccacgaccagacccgccagcagcagcattgaggccagttcaaccgccagtacgtaaggaccaaacaggctgatgccgaccgctttggcgtcgatgatggtgccatcgatgccctgatcgttggcggtcaggatggcgtagaccattacgaccagcagcagcaacgagacgatacccgggccaatccacagtgacgggctgagccactcacgctcctgcttctcggtctgcttgcctaagttcagcatcatgaccacgaagacgaacaacaccataatggcaccggcgtagacgatgatctccagcgcaccggcaaaataggctcccatagagaagaagacgcccgcgatcgataacagcgaaacgatcaggtacagcaacgcatgtaccggattagtgtgggtaatgacgcgcaacgtcgtcagcaccgcaaccagtccgcaaagataaaacgcaaattccatgccttgctccttaaggtaataagcctttgacgtcgataggcttcgcttcgttttctgcttcgcccttatctttaccgtcaatcgccatacctgccatgcggtagaagttgtactccggatatttacccggccccgaaatcagcagatcgtccttctcatacaccagatcctgacgcttaaactcacccagttcgaaatcgggggtcagctgaatcgccgtggttggacaggcttcctcacacatgccgcagaagatgcagcgtgagaagttgatacggaagaactccgggtaccagcggccatctttggtttcagctttctgcagcgagatacagccaaccggacaggcaaccgcacacaggttacaggcgacgcaacgctcctgaccatccggatcgcgggttaacacgatacggccacgatagcgtggtggcagataaaccggctcttccggatacatctgagtttcacgtttggcgaaggcgtgcagcccgatcagccagatactgcgaactgtcgtgccaaagcctacgacaatatctttcaaagtcatttgttaaccccttacggcgctgtgtagagaatcactgcggcagtcgccagcaggttcaacagcgtcaacggcagacacactttccagccgaatgacagcacctggtcgtagcgcggacgcggaagcgcagctcgaatcaggatgaacatcatcataaagaacgccgttttcagggcgaaccagatgaacggcggcaggaatgggccgtgccagccaccaaagaacagcgttacgatcagcgctgaaacggtggtgatcgccacatattcgccgacaaagaacaggccgaacttcataccggcatattcgatgtgataaccgtccgccagttcctgctccgcttctggctggtcaaacggatgacggtgacacaccgccacgccagcaatacagaaggtcacgaaaccgaagaaactgcggaatgatgttccacaggtgggtctggctgttgacgatatcgttcatgttgaacgagcccgcctgcgccaccacacccatcagcgacagacccaggaacacttcgtagctcagggtctgcgccgaggcgcgcatcgcacccagcagcgagtatttgttattactcgaccagccggcaaacagcaccgcatagaccgcaaggcccgccatcatcaggaagaacagcagaccgatattcaggtctgtcaccatccaggttggcgaaaccggcacgatagcaaaggccagcagcagtgaaacaaaggcgataaccggcgcaagggtaaagataaagcggtcggtaaacggcgggacccagtcctctttaaagaacattttgatcatgtccgctaccagctggagcgagccgccccagcctacgcggtttggtccgtaacggttctggaacaggccgagcagacgacgctcggcgaagctcatgaacgcgccgcaggccacaaccaccagcagaatcacgatggctttaacaatggccagcagaatgtcgataacgtccggtgttaaccagctcattgcgccgcctcctgcagagtgtcgattttaccgttcgccaggaatggcggaacgcccggcatgcccagcggcagaccaatctgtcccgcctgcagtgacgccgagaaacggaccggcagacgcactgtctcaccggcacagatgaactcaaccgccgcgccattgttgacgcccagcttcgctgcatcttccgggttaatcaccagtgcaggcggtgccatacgctgctggaagaccggtgaacgctgtgacatctcttcgctaccaaacagctggtagagaggggccacgcgccactgcgcttcactgacgaatgccgccggaacgttgctgaaccagggcagactggctgcgctggcttcaaacagccgtacacccggatcgccattacgcagtttgccgcccacttcaacctggaacttgttccacgcctgcggtgagttccagcccggtgcccaggcaaacggaatctgcgaacgcggtgcgcctggctggttgttcccttccattgagaaggcgaacatcgtgtcctgatcctgcggctgacgcggttcgtgcacgctgatattggcgcgcgccgcggtacggccactggcacggtgcggtgaacgcgacagtttctgtccacgaatacggaagctggcatccggtgccgcatccttgattccggccagctgtggcagatgactgaccaccgcatcgatcacgtggtccagctgcgtccagtcgacgtgacggctttccagcgtgctgtgcagcgaatgcagccagcgccagctctccagcatcactacgttgttgtcatagtaagaaggatcgtaaacctggaagaaacgctgtgcgcggccttcatggttgatcgaggtgccatcactttcggcgaagctggcggttgataacaccagacccgctttctcaagcgtcgcggtgcgctgatgatcaaccacaatcacgttagtggtctgggccagcgccgcatcaaccagcgctttcggtgcatggcgatagaggtcattttccagtaccaccagcgcatcggcttcaccgttgctcagttgctccagcgcgctttccagaggattgccgcccatcaggccaagacccacgctgttggcgtgtcccgccagcagcgtaatcccgacgtcggcaccgcgcgctttgagcgctttggccacgttggcagccgcttcgatcatcgcgctgctgccggaatgggtcccggaaataattaacggttttttcgcgccagccagcgcctgcacgatgacatccatcttgccgttcagtttgctgtcgaaatcggtcaccgccggggcggtttcatccagcgcactggcgatagcgaaaccgagacgcgcctgatcttcaaccggtgcgcgatagctccatgccgcgatatcatccagacgggtttcatcgacgttggtgataaacagcggatgtttcgcattctgaccgatgttcaggatcgcggcgatctgccagtctgccactttctgagcggcagccatgtcgcgcgctttgcctttcacggcctgacgcactgacagcgccacgcgtgcgcccacctgggtcagatcttcgcccagcaccagcaccgcatcgtagctttcaatttcacgcagcgatggcgtatagataccgccctcacgcaggattttcagcatcagttcaagccgtgcctgctcgcccgctggcatgccggtagagaagtttctctgcaccgaccagttcacgcagcgcaaagttactttcgatgctggcgcgcggcgagccgataccgatcacttttttcgcctgacgcagcaaatctgcaccggcattgaccgcctgctctgcgttcagcgtcacccagtcgttgccgcgcagcagcatcggctggcgtgggcgatctttacggttcacgtagccatagccaaagcggccacggtcacacaggaaatagtggtttacggtgccgttataacggttttcgatacggcgtaactcaccataacgctcacccgggctggtgttacagcccacactgcactgctggcagatgctcggcgcaaactgcatatcccatttacggttatagcgttcggagtgcgttttatcggtgaagacgccggtcgggcagatttcaaccaggttaccggagaattcgctctccagcgtgccatcttccggacgaccgaagtagacgttgtcgtgcgcgccgtagacacccagatccttgccatcggcataatctttgtagtaacgcacgcagcggtaacaggcgatacagcggttcatctcatgggagatgaacgggccgagatcctgattacggtgggtacgtttggtgaagcgatagcggcggaagctgtggccggtcattactgtcatatcctgcaggtgacagttaccgccctcttcacacaccggacagtcgtgcgggtggttggtcatcagccactccaccacgctttcgcggaactctttcgcttcgccatcatcgatggagatgaatgtgccgtcagaggccggcgtcatgcaggacatgacaagacggccgcgggtatcttcggcattctggaattgctttaccgcacactggcggcaggccccaacgcttcccagcgccggatgccagcaaaagtaaggaatatcaaggcccagagagagacatgcctgtagcaggttgtccgctccgttcacatcatactctttaccgtctacatgaattgtagccatagtgacatgcttccgtaaggctcgtcagagacgagcgttaatcatattcttgccccgacgcacgacattgtcggggcggcggcaccaggcctgttccgtgttcttcggcgaattaccagcgcgctttcagcaggtttggctggatcccgccaatagcgcgggtattgccaaacacctgcggtgccatgccggcttcaaactcttcacggaaatatttaatcgcactctgcaggggctcaaccgcacccggcgcatgcgcacagaaggttttacccgggccaagctgacggcagagttgcagtaaggtttcgatatcgcctggctgaccctgcttctgctccagcgcacgcagaattttgacgctccacggcaggccatcgcgacacggtgtacaccagccgcacgactcacgggcaaagaactcttccaggttacgcaccagcgagaccatgttgatctcgtgatcgaccgccatcgccagcgccgtacccagacgactgcccgctttgccgatgctggcaaactccatgggcagatccaggtgctggtcggtcaggaagtcagtccctgccccgccgggctgccaggctttgaacttcagtccgtcacgcataccgcccgcataatcttcaaggatttcacgtgcggtgataccgaatggcagctcccagacgccgggatttttaacccgtccggagaagcccatcattttggtaccggcatcttcgcttttagagatgtttttgtaccactccacgccgttggccagaatcgccggaacgttggagagggtttccacgttgttcacgcaggtcggtttgccccacgcgcccgcactcgccgggaatggcggtttcgaaacgcggattggcacgacggccttccagtgagttaatcagtgccgtctcttcgccgcagatataacgacctgcgccggtgtggacgatcaactcaaagtcgaagccggtaccgagaatatttttaccgatatagcccgcttccgtcgcttcagcaatcgcacgacgcagatgcaccgcggcttcaatgtattcgccacgtaagaagatatagccacggtaagccttcagcgcaaaggcgctgatcagcatgccttccaccagctggtgaggcatctgctccatcagcaggcggtctttataggtgcccggctccatctcatcggcgttacacagcaggtaacggatattcatcgactcatctttcggcatcaggctccacttcagcccggtggagaagcccgcaccgccgcgccctttcaggcctgaatcttttactgccgcaacgatttcatcctgcgacatgcttttcagcgctttttccgcaccggcatagccgtttttactgcgatattcgtcaagccagacaggttgcttgtcgtcacgcatccgccaggtcagcggatgggtttctgcagtgcgaatgatctgtttaattgtcattgatactgctccagcaaaccagggatgccttccggcgtcagatgcacatgcgtgtcttcatccaccatcatcgttggccccttatcgcagttacccagacagcaggttggcagcagtgtaaagcgtccatcggcagtggtctgacccggtttgatattcagttgctgttccagtgctgactggatgccctgataaccggtgatatgacagaccacgctgtcacagtaacggatcacatgacggccaaccggctgacggaagatctggctgtaaaatgtcgccacaccttcaacatcactcgccgggatacccagaacctcggcaatcgcattgatggcgccgtccggcacccatccgcgctgtttctgcacgatcttcagcgcttcaatcgaggctgcacgcgcatcttcatagtggtgtttttcgtgctcaatggcgtgatgctcttccgcgctcagcacgaagacctcgttagggtcgatcgttttaatggcaatgtgttgatcgtgcataattagcggtccacgtctgacataacaaaatcgatactacccagatatacgatcaggtcggataccaggctgccacggattactgaaggaatctgctgcagatgcgggaagctcggcgtacgcacgcgggtgcggtagctcatggtgctgccatcgctggtcaggtagtagctgttgatccctttcgtcgcttcaatcatctggaacgactcattggctggcatcaccggcccccacgaaacctgcaggaagtgcgtgatcagcgtttcaatgtgctgcaacgtgcgctctttcggtggcggcgtggtcagcggatgatccgctttaaacggaccctctggcatgttgttaaggcactgctcaagaatgcgcagcgactgccacatctcttccattttcagcatgacgcggctgtaagcatcgctgatgccgtcgccgaccgggatttcaaaatcgaagttttcgtagccggagtagggacgccatttacgtacgtcaaagtcgagaccggtagcacgcagaccagcaccggtagtgccccacgccagcgcctcttccatgttgtaagcagcaacgcctttggaacggccaatcagtacgctgttgcgcagtgccgctttgtcatactctttaagacgttttggcatccagtcgaggaagtcacgcagcagacgttcccagcctcgcggcaggtcatgcgcgacaccaccgatgcggaaccacgccgggtgcatacggaaaccggtaatcgcctcaaccacgtcatagattttctgacggtcggtaaaggcaaagaacaccggcgtcatggccccgacgtcctgaataaaggtggagatataaagcaggtggctgttgatgcggaacagctcagagagcatcacgcggatcacattaacgcgatcgggcaccacgataccggccagtttctccaccgccagtacgtacggcatttcgtttacgcagccgccgaggtactcgatgcggtcagtgtaaggaatgtagctgtgccacgactgacgctcgcccatcttttcggcaccacggtggtgatagccgatgtcaggcacgcagtcgacaatctcttcaccatccagctgcagaatgatgcggaatgccccgtgcgccgacgggtggttaggcccgaggttcaggaacatgaagtcttcgttggtggtgctgcgcttcatgccccagtcttcaggcttaaaggtcagcgcttccatctccagatcttctttctgcttggtcagcgtaaacggatcgaattcggtggcgcgcgccgggtaatctttacgcagcggatggccttcccaggtcgacggcatcatgatgcgcgtcagatgcgggtgaccatcaaaggtgataccaaacatctcccaggtttcacgctcataccagttggcattcgggaaaaggcgggtgatggtcggcagatgcatatcgttttcagagagtgccaccttgagcatgatgtcgcggttgcgttcaatcgacagcaggtggtagaaaacggaaaaatccgccgcaggcaggcctgcacggtgggtacgtaaacgctcatccacgccatgcaggtcataaagcatgacgtaaggcttgggtaatttacgcaggaactcgataatttccagtatctgttcacgcttcacccacaccaccggaataccggtacgggttggctgaacagtgaaggcatccggcccaaaacggttacgcaactcgccgatcaccgggtcatcaaggtgatcacgggtttgccatgaaggctgagcgagatcttgcgtggtcaaatctgtcatacgttactcaccattccggcctggtctcaggcactcaaatgaaggcgtcaggatggggccatgcattaaattgtgatgttctgctgcaggcgctgttttccatccatacggttttaaacttcgtccgggctgcgcaggtttgtgactgcaatgcgctcgccgcgttttctttcacgctcagatggcatgttggcgcgataaacgccctgatcgccaaccacccacgagagcggacggcgctctttgccgatcgactcctgcaacagcagcagtgcctgcatatacgcttcaggacgtggcggacagccaggaatataaacatcgaccggcaggaatttatcgacaccctgcaccacggaatagatgtcatacatgccgccagagttggcgcaggcacccatggaaatcacccattttggttccagcatctgatcgtacaaacgctgaataaccggggccattttggtgaacggcgtaccggcaatgaccatgaaatcggcctgacgtggcgaagcgcgcataacttcggcgccaaaacgtgccacgtcgtggaccgcggtgaacgatgttgtcatctcaacgtaacaacaggacaggccaaagttataaggccatagggagtttttacgcccccagttcaccatgtcatgcagggcattttcgagtttgcccatataaacgctgcgatgaacgtgctgctccagcggatcgctgacgatttcctgcttttgcagaggataacggtcgttctcaccaccgttcgggtctatgcgggtgagcgtatagtccatcttattgcctctcttttactgcttatgaggattggtgtggctgaccgtagtggttttgaccaccacgcgacggcgagctggagcccagtccagtgcgccaatgcgtaccagatagaccagacccgccaggagcaccaaaatgaaaattgcggcttccacaaagccgatccaaccgctttcacggattgaagtcgcccatgcgtataaaaagagggcttcgacgtcgaagatgacgaaaaacatcgcaaccagataaaatttcgccgacaggcggatatgggtatcaccaacggattcaatgcccgattcgaatggcgtgtctttgtagcgggcgcgcgctctgccgccaagcagccatcctccggtcagcatgaaagcacacaggccaaaggcaataacgataaatacgataaacgcccagtgctgagcgatgatttcggtggtagttgacatactcattgcttactcatcaaaagtggcgctggcatcctgcacgcgtttcccgcagcaaactgaccacatcgattcaagggaaggataaaaacctttcaaatgtcgctgttattacgtaataagcagctattttatggggttttttactcctttctataaccttttgtcaactttgacaaaagtatccaaacattatttcacacctgcatcatattattaacaaatgatgccccgctttccagctaaatcgcttcagtctgtagggttaattttagtgtagcgggtattcacatgcatggatcgtgcatttaacaaacatattttgacaggtatcactgaattttccctcccctttccagggctatttttttgatccagaacacacttttgccctttatgcgttaattttccccacctgaaacggtgattcggaacaaagcgttcggttttttggtctggatgtttcaattaagcaggtggtgaaacttttttagtcgggtcaggagaggcagatgagcagtaaggaacatcggacgagggtcaggcacaaaaaagcctctcgttcttttcagggaaggagaggcttatttataagcgtttattaaggcaatcacgcaggtattgagtacaacacgttagcgaaattactcttcgtcatccagcaacagtgaaccgtcgggattattgctcaggttataaggatcattggtggactgcatggcattgaagatagccagcgccagttcattatcgctgtcaggattacgacacagcagatattgcgtatccggcagtaccggcagtccttcagctgcacccataacacgcagttccgggctcatcatctcgaccggacgtgccgtcacacccagtcccgctttcaccgctgcacgtactgcagccagtgtggaagcgacataagagatacgccacgggatgcccgcttcgttgagatgatcgatagccatatcacgataaggacttggctcatccagcaataccaatggaatggcttcgccacgctggaagatataatccgctgcgcagtaccacaaggtaggtgaagtacgcagtacctgataggtaaaattgcccgggctggaagtggtcacaaccaggtccacttcaccctgattgagcatttccatcataaacggattacgtttaacccgcacatcgattgccagtttcggatacaccgaggtcacccggtttagcaggaacggcagaatagtgtcagaggtgtcatcagaggcgccaatagtcagcacgccctgaatgttgctgtacatcagagatgtgcaggcttcgtcgttaaaacgaagaatttttctcgcatagcctaaaagctggataccgtgctctgtcagaagcttattacgtccatgtctggcaaacagctctttacctaccaattgttccagacgttgcatctgctgactgactgctgactgggttctgcagaccgctgcagcggcagctgcaaaggtattcaaatccgcaacggcaacgaaggttctcagcagatcgaggtcgagattcagtatcggacgatttgcattagtcatgttttttcttcacttataagatttttacgaactactaccctggtgttatcacaagcttatcaaagtgataagcagtaatggtgctcaatgacagtcctgtgtgaagactgacacaaaaaaagtttatgtggatcctgcactgttgactcctctgaagggtcatagtgctattcaagacagatacaacttctgaaccgatggcgctgggtgcgcaaatgcaggaagctgcgtagttgtcttattcccatcagaaagaatcgtgtgggatagaaagcgcactttacgggctatcaaagcgaagcggcaaagtgcactaaataataaattatacttaatcatttttgacttcaaaatggaaatgattttgtgaaaagcgctgtaaattttgtgctaaaggcatttccagacccttatgccacattattgatcactttttaagccttcagcgttctgaaatttagtgaggaagtgttaagtacggctcacaatcctgcaataaaggtgccatatgaagctctgcttttggcacttttccggcgaaacacaaggccttaaacacgccactcttaagcagcgttaaggcgtaatctttaggcacgttataaaatcgtccataatttgaacatttataaaatatcctttaactatttctctaagtgtatatttcaggtgcaaagaaaagttccatttcaataacttccagatagcgttcatgatgctaaagccatatgtcggttcagcagcgctttggacaagttaaaatcctgcattaatgcaaatttatggttttattaaccagtttacgcgacaacaaatattttttacgctgcgcaccgggcaaaaagttgttgaacccgccaaaacggggcggcacccttcttttgtgactgtcaggagagtacattgtgctggttggatttctgtggcagccaaaaggattctgcccattaaggcggtaacaatgacttttcaaattgataaatccggaaaactcgataacgtctgctatgacatccgtggcccggtactgaaagaggctaagcgcctcgaagaagaaggtaacaaagttctgaagctgaacattggcaacccggcgccgtttggttttgaagcaccggatgagatactggtcgatgttattcgtaaccttcccagctctcagggctattgtgactccaagggtctctattccgcccgtaaagcgatcatgcagcactaccaggcgcgcgacatgcgcgatgtcaccgtagaagatatctacattggcaacggtgtttcagaaactcatcgtgcaggcgatgcaggcgttactgaacagcggcgacgaaatgctggtgccggcccccgactatccgttatggacggctgcggtttccctctccagcggtaaagcagtgcattatctctgtgacgaatcagcaggctggttccctgacctcgatgatatccgcagcaagataacgcctcgtacccgcggcatcgtgattatcaacccgaataaccccactggcgcggtctacagcaaagagctgctgttagaggtggttgaaattgcgcgtcagcataaccttattattttcgccgatgagatctacgacaagatcctctatgacgatgcacagcatcactgcatcgcagcgctggcacccgatctgctgactgttacctttaatggcctttctaaaacctatcgcgttgccggtttccgtcagggctggatggtactgaacgggccgaagaaacatgctaaaggctatatagaaggactggagatgctcgcctcgatgcgcctgtgtgccaacgtaccggcgcagcatgcgattcagacggcgctgggcggctaccagagcattagcgaatttatcatgccgggtggtcgtctctacgagcagcggcagcgcgcctgggagttgatcaacgatatcccaggcgtcagctgtgtgaagccgcagggcgcgctttatatgttcccgaaaatcgatgccaaaaaattcaacattttcgacgatcagaagatggtgctggattttctgttacaggagaaggtgctactggttcagggcagtgcctttaactggccatggcccgatcacctgcgcattgttacgctgcctcgtgtggatgatcttgagatggcgatcaataaatttggccgcttcctgcaaggctatcgtcaataatcaggcccgcgtatactgacgctatttggggagagccagagcctgtctctcccccgccagccaacaggaacgctcatgacacaaagccacttctttgctcatctctcccgtcttaagctgatcaatcgctggccgctgatgcgcaatgtgcgcaccgaaaatgtctccgaacacagtctgcaggtcgccatggtggcgcatgccctggccgtgatcaaaaaccttaaattcaacgggtcgcttaatgccgatcacattgccatgctggcgctttaccacgatgccagtgaagtgctcacaggcgatttaccgactccggtaaaatattacaacgcgcagatcgcccacgaatataagaaaatcgagaagattgctcagcagaagctgattgagatgctgcctgaagagtttcaggcgatctatcgcccgctgatcgatgagcatctgcacagcgaagaggagcaggcggttgtgaaacaggcggatgcgctctgtgcatatgtaaaatgtcttgaggagttgtctgccgggaacaacgaatttttactggccaaagcgcggctggaaaagaccctggcacttcggcgtttcaccggagatggattacttcgttgaggtgtttattccgagcttcagcctgtcactggatgaaatctcgcaggatacgccactctaagcccggcggtctggccgccgggccagcccttaagcctgctgacggaaggtaaagctgccgtcagactcgcgggttatcaccagtgacgccagtgagtcgagctgaagcgctacctcatccagccggggtgtctccgccggcgcattgatggcaatcaccgcacagccagcattcaggccggataagattccggcaggtgcatcttctgcaaccacgcacgatgtcgccgctaatcccagcttctccgcgccaagcaggtagggatcgggctccggtttgcccttagccacctgttcagcggtaataaacacggcaggcttcggtaagcctgcggctttatgacgtgcatgtgcgaccggcactgaaccggaagtgacaatcgcccaaggaatctgcagttcgttcagccggttcagcaacgcgttggcccctggcagcgcctgcacaccgtcggtgtccgccgcttcagcctgctccagcgcaacaaactccgcctgaatagcctcttccgactggcctgccatgaaatgacgcagagaggtgatcgcctgtttgccatgaatgaaatccagaatctcatcagccgcgatgccatgacgggcaccccactggctccaggctcgttcaaccgctggcagtgaatccaccagcgtgccgtctaaatcaaatagaaaacctctgtaggtcacgcgctcctcctcatcaggcattaatcacttgcgcaatttcgtttgcacttaaatggtactggcgcggacaagtctgccacaaagctaacatccgttgatacttttcccacattggggtctgcgcattaaaaccatgggtgccggaatcgaagtgcgtataacgcccttctgtattgaccataaaacggacataacccagcaggcgcgcttccgttgccgcatcgaagcccagaaaggccagacggcgctcttcaagctcacctttctctttaaggttcgaccaggagacgtggagagcgtgatgcatttccataatatcgatcaccgtccggcagatcgcttcgctgagttcgccaaactctttgtccagctcccgcatctgcagcgcataaccgcgttcgatgatggtctggtaacgacgaaaacgctccgcattttccggctcaagcatggccatcattttgtactgattagtgagaatcaaacgctgcgcatgggtcatttccatcatttactcccggtcagagaccgctcagttaatcgacaatggagaaatcattgcacagcgttagcgacacggaaatcgccgtatcaccattctttgatttggccgcaggttagcggtaaatattttaccgccagcccgggataggtcagagatcgtcgaggaaagtgcggtcgagttgtttgaacgcccgctttagcagatcggccagcgcctgataggtcggcttgccttctactggcgctgtcgcctgccccgcttcttccagccgggcacgaacttcatgaaaccagttaagcagcgtcggcggcagcggcgtcacagaaacgctttcccagccaccataatccctgcatcggcagggtacaggcaaacagcgcggtcgccacggccgggcctaactgaccgcccatcgcgatctgccaggtcagcgtaaaaatcgccaaagggggcataaagcgaatagcaaaacgcgttgccgatgaaacacggttttccgggaacataggtgccaggcgcttatcagccggccaggtcttcatatagtgttggccgcgctgaaacatccgaaaccaattggtactgccagattcattcgccatggctcacctcaactaatgctgtaaaaattaaaaaatagttataactacacaactttacgtgacatccttcaattatttttgtctttaaaggtgactccagctattctgacgccgttttaccccctttccggaagcggattgcgcttttgggaaaaggcctgagccaggttcagacgaggcaatcttcaaattttcgcgtaagattgccgaaattttttgcggaaatgcagaattctgtctaccgcatgatgtttgtcattaatctaccagctttcatgggctacgctgttagtctgattgcgttttatttagccactctcaaaaaataggtacttccatgtcgagtaagttagttctggttctgaactgtggcagctcttcccttaagtttgccatcctcaaccctgccagcggtgaagaattcctgtctggcctggcggaatgtttccaccttcctgaagcccgcatcaaatggaagctggaaggcgaaaaacaggaagcgcctctgggtgctggcgcagcgcatagtgaagcgctgaactttatcgttaaaaccattctggcacaaaaacctgagctttcggcacaaattgctgcaatcggccatcgtatcgttcatggcggcgagaagctgactcagtcagtcatcatcactgaagaagtggtacagggcatcaaagacgcctcttcttttgcaccgctgcacaatccggctcatctgatcggtattgatgaagcgatgaaaaacttccctcacctgtcagataagaatgtcgcggtatttgacaccgctttccatcagacaatgccggaagagtcttatctctatgcgctgccgtacaaattgtataaagaacatggcgttcgtcgctatggcgcgcatggcaccagccacttctatgtgacccacgaagcggccaaaatgctcaacaagccgcttgagtcactgaatattattacctgccacctcggtaacggcggttctgtctctgccattcgcaacggcgagtgtgtggacacctcaatgggcctgaccccactggaaggcctggtgatgggtacccgcagtggcgacatcgacccggcaattatcttcttcctgcacgatacgctgggtatgagcgtcgatgccatcaataaactgctgaccaaagagtctggcctgttaggtctgactgaagtcaccagcgactgccgctacgtggaagataactacaccaccaaagaagatgcgaagcgcgcaatggatgtcttctgtcatcgcctggcgaaatatatcggcagctacactgcgctgatggatggccgccttgatgccgtggtatttactggcggcatcggtgaaaacgccgcgatggttcgtgaactctcactgaaaaaactggcactgctgggctttgacgtcgatcacgatcgcaacctggcggcccgtttcggcaagtctggttacatcaataaagaaggcacccgcccggcgctggtgatcccgaccaacgaagagctggtcatcgcccaggacgccgcgcgtctgactgcgtaaacacttctctccgtcagctcaggctgacggagttgtttttgacaccctgccattactgagaggttcaaacgtgtcacgtacaattatgctcattccgaccggcaccagcgtcggcctgaccagcgtcagcctcggcgttatccgcgccatggagcgcaaaggcgttcggctcagcgtctttaagccgattgctcagccgcgtaccggcggcgatacgccggatcaaaccaccactattatccgtaagaactcctcgattcctgccgctgaaccgctgcagatgtcacgtgttgaatcactgctgggatcgaaccagcaggatgtgctgatggaagagatcatctcccgttaccatgccaacacgcagaatgcggaagtggtgctggttgaaggtctggtccctacccgtaagcatcagtttcgccaacgcgctgaactatgaaatcgcgaaaaccctgaatgcggaaatcgtcttcgtgatggcgctgggcaatgactctccggcacagctgaaagagcgcattgaactgacgcagagcagcttcggcggtcagaagaataaaaatatcactggcgtgatcatcaataaactcaacgcgccggtcgatgatcaggggcgtacccgccctgacctgtcagaaatttttgatgactcgtcaaaagccagcatcgccaatatcgatcctaagcagctgttctcagacagcccgctgccggtgctgggctgcgtgccatggagctttgatctgatcgccacccgcgcaatcgatatgtgccgccacctggatgcgcgcatcatcaacgaaggtgagattcagacccgccgggttaaatcggtcaccttctgcgcccgtagtatcccgcacatgctggagcatttccgtccaggctcactgctggtgacttccgcagaccgcccggatgtactggtcgccgcctgtctggccgccatgaacggcattgagattggcgctatcctgctgaccggtaactacgagattgacgatcgcatcgcgcgcctctgtgaccgtgccttccagaccggcctgccggtgttcatggttaaaaccaatacctggcagacctctctgagcctgcagagctttaatcttgaagtgcccgctgatgatacgcagcgcatcgagaaagtgcaggaatatgttgccagctacattaatgctgactggattgagtcactgaccgccacgtcagagcgcagccgtcgcctgtcgccaccggccttccgctatcagctgactgagctggcgcgtaaagcgggcaaacgcgtcgtgctgccagagggtgacgagccgcgtacggttaaagcggccgctatctgtgctgaacgcggtatcgccacctgcgtactcttaggcaacccggatgagattcagcgtgttgctgcggctcagggtgtcgaactgggcaaaggggttgagattgttgatccggaacaggtgcgtgaaaactacgtgccgcgtctggttgagctgcgtaagagcaaagggatgaccgaagtggtcgcccaggaacaactggaagataacgtggtgctgggcaccatgatgctggaaagtggcgaagtggatggcctggtttcaggtgcggttcacaccaccgccaacaccattcgtccgcctctgcagctgatcaaaacagcgcctaacagctcactggtttcatcggtgttctttatgctgctgccggagcaggtgctggtttacggtgactgcgcgattaacccggatcccaccgctgagcagctggctgagatcgcaattcagtcagccgactctgctaaagcctttggtatcgatccacgtgttgcgatgatctcctactctaccggcacgtcaggtgcaggcagcgacgttgaaaaagtgcgtgaagcaacgcgtatcgcgcaggaaaaacgtcctgatctggtcattgatggtccgctgcagtatgacgccgcgatcatggaagatgtggcgaagtcgaaagcgccagattcacaggttgccggtcgcgccaccgtctttatcttcccggatctgaacaccggtaacaccacgtataaagcggtacagcgttcagccgatctgatctcaatcgggccgatgctgcagggtatgcgtaagccggttaacgacctgtcgcgcggtgcgctggttgatgacatcgtctataccatcgccttaaccgctattcagtctcagcaggctgaacaaggctaagcgtcaggtaagaaacgcaaaaggcatgccccagggcatgcctttttttcgccggtaacagagtcggaggctttaatgcggatcgctgagacgcgttaaagcgcccgttttcaggcccggttatcgccgttgcggctcatccacagagagagcgctttaagcgaatcgtcagtgaactcatcacaacgtgcggtgatctcatcgggcgtcatccagataatctcatcgacttccgattcctgcatggcgaatggcccatgtgacacacaactgaacagaccgccccagacgcgacagtgctgatcttcgaagtagaatttgccatgctcagcaaacggcaccgcggcaatccctaactcctcttccgcttcacgtcgcgcagactccagcatatcttcaccgctctgcaccacgccgcctgcggttgcatccagtttgcccggcataaaatcttttatctctgtgcgacgctgcaccagaatcttgcccataccgtcatgaaccacaatataggtagcgcggtgacgcaggcactcagcgcgcatctgcgcacgtgttgcctgagcaacaacttcattctcttcgtttacgatatcgacccactcgatgccgtcacccgcagtttgatccaccatccgtaaccctttcctgtttggcgtacacttgggtacgcagtttgccacgtctttatttttatgtggcgtaaggtaatcacttccggcagcctgagcaagccctggctgttaccgatttttaccactttctgctaaccacagctgtactgaggctcgctgccactgaaactcagcataatcccgcagacgcgcgggcaaaggatcgccatgcaataccagccggttaagcatcaccgccagatcggtatccgcaattgaccactcgccaaacaggttctgttgcccgtccggcagcaggcgatcgacggccataaccagtttatccaccgcctgctgcgctgatgcggtcagcggcgcaaagcgctcaccggcaaacagcacttctgtgggacgctcctgacgtatccacaggaagtcactgcgcagccaggcctggatctctctggcgcgggcacgcttctcgcggtcgcggggatagaggcgctcaaattcgggcgccggaaagcgctcttcaagatattcggtaatcgccgaggattcgcttaacaggaacgcatcaatctgcagggtcgggacccggcaggtcagcgacagctcgcggtaagccgcggcgtattgctgattctgcgacaaatcgacgcgcttcagctggaaagggatccctttttcggtaagagcaacataggccgacatggcgtaaggactgaaaaatgatgaatctgaccacagggtgatggacggataattcatcggttacctcaattggctgtcagggttgcatcatgtttaccgatttttatttgggaaggcaacgctgagctgatccgatctctgcctccggaataagaaagcgcgacgcgactcacgatagagtggctcgactcttctatgctgaaagatgcaaataacaaaaacatcaagggagccgcaacatgcacattcttattaccggtggcacgggactgattggccgtcacctgattccgcgcctgcaacagctggggcatcagatcagtgtggtgacgcgtgacgtggtcagcgcacgtgaaaaactgggcgaagaggtcgcgctctggtcagggctggcgcaacagtcgaacctggatacgatcgatgcggtcattaatctggcgggagaacctattgccgacaaacgctggacggagccgcataaacagcagctgtgtgaaagtcgctggcagataaccgagcagatcgtctcactgatcaacgccagcgccacaccaccgtccgtgttgatctcaggttcggcaaccggcttttatggtaacaccggcgatctggtactgactgaagaggatcagggtcaggatgagtttactcatcagctctgcgcccgctgggagcagctggcgctcgcggctgaaagcgaacgcacccgcgtctgcctgctgcgaaaccggcgtggtgctggcgtctgagggcggcgcactcagcaaaatgaagctgccctttaaactcggcatcggcgggccgattggcagtggtaaacagtacatgccgtggattcacattgatgacatgctaaacgccattatctggctgctggagcatgacgatctgcggggtccgttcaatatggtcgctccctacgcggtgcgtaacgagcagtttgccgccacgctgggccgggtgatgcatcgtccggcctttatgcgcacgcctgccagcgccattaaactgatgatgggcgaatcgtcggtactggtgctgggaggacagcatgtgctgccaaaacggctggaagcctcaggctttggcttccgctggtacgatttgcaggaagcgctgcaggatgtcgcaggataaacatacggcggccctgggccgccgtatgtttcgttagttacgctgctctgctacacgcgacttcactaccttctcttcacgcgtatgccccggttgtggcacacgaataataaaggtcagcacgccagcgaacacgtatagcccggtataggcccataccacaccgacaatgtcgaagaacggcagcatgactgaggcgatagccggtgccacaaagttactgagtcctgcggagaggttgtaaatagagaccgcagcgcctttatgatgcggttccagcgtgggaaatacagcggtcatcggtacaaacgcggcgacaaaaatgcccagcattaccgcagggattaatgcgacccagaagttatgacccgcatacagcggcagataataaaaggtcaggctggagatggccatccccaggcaaccaaaccagcgcacctgacggatccagcccagcttctctcccgtgaggccccagaagatattcgtaaatatagtgacaaagaagaacaccgcccagatttgtagccattcagagatggtaaagccgagacgatcgacaaacagcagtggcatgataatggcgaaaccaaacagcgacagcgtgttgatgatgcgaatcaggcaggcataaaacacattctgattggtgaacaggatggtcacggcacgcgccatctctgtcatcttgtcacgcatcggcaaattcacacgagagcgatccaccggtaccttgcgcaggctgaagtatgcgaggatcccaccacaggccacccagataatagccagccacagcgtccccgtttcccccagcatcggaatggtgagacttggcagatagctgccaatcaccccgatgccgacagaatacatcgcccagaaccagccggtcgccgccgccagtttttcgcgcggtaagacctgcaccagcatcatcatgaaagagtagataaacagcggataagccagcccgcgaatgccgtagaacagcaccatcagcggatagttgcgcaggccaagccccagcgacataaacagcgtatgcatcacgatccataacacaaagccaatcatcatcgcgcgctgcggtgtgatcaactcggctaccacgccagatgcccaggccgccagggctgccgctaagccatagaaggtgaatacgactgcagactgcgcgggcgtaaagcccatatcggtgatatgccgcgacagaaacgccatttcaaagccatcacccgccataaagattgcgatagcgagaaagccccagaacatctttttcggtaagccaaaccagtattcgttcgattgcatcacaattaccttctgtctggttagtcgttatgcaggcagcaaactgcgcacctgttgttgctggacgtagagtttcccggaacagacatagccgcttttgcagcacggcaccgcgcgtctcatccggttggcagcgcgcctgcacagccggcttcagacacacctcatgctcaaggccgccatcagccagccacgctaaacgtgccgcacccagcgcgccagatgcgctggcgggatgggtaacaatgggcagttgcagcacatcggcaatcaattgagcccacaatgtgctacgtgcgccaccaccggtcaggctgcactgctgaatgtgatgcctggcatcgccgagcacactcaacccatcagccagcccaaatgccacaccttcaaccaccgcatagcccagcaaggcgcgcggggtttcatggcgcagattgaagaaagaaccggatgcgtcaggatcgttatgtggtgtgcgttcaccagacagatagggcaggaaaaccggggcgctacgcacttgctcatcactgagctgggccatctcctccatcagctggctttcactgaccgacagcagattgcacaaccagcgcagacaactggcggcgctaagcatcacactcatctggtgccagcggcccggtaacgcatggcaaaaggcgtgcaccccgcattgagggtcagcccgtaagcggtcgtttacgaaaaaaatcacaccggaggtacccaatgagataaacgcatcaccgggattcaccgcccccacaccgattgccgatgcggcattgtcaccgccgcctcccgcgacagtaaccgcagtagataagccccactcgctcgccagcgtcggctgcaggcgtccacttatggcactgccttctaccagttcaggcatttgggtacgcttcagtccggtgatggccagcagttcttccgaccagtcacgccgggagacatcgagccacagcgttccggcagcatccgaaggctcactgacaaagcgcccggtaagacgccagcgcaggtaatctttcggcagcagaaccttatcgatgcggctgaaaatttctggctcattttccgcgacccagtgcagtttcggcaaagtgaagccgggcataatcatattgccgctaatttccattatccggggattgctcttccgtagcctttcacactgcggtgcactgcgcgtgtcgttccagaggatacacggacgcagcaccttccccccggcatccagcaacacggccccgtgcatctgtcccgataatccaatagcgcgaatcgcggcccatgccagaggaaactgatgacgtaatcccgccagaacctcgctgcaggcttgccaccagcattcaggatcctgttcagcccagtggggatggggacgctgcacgctcagcgtggcgtgctgagccgccacaatctcaccgtgcgtattaatgatcagcgctttaagctctgaggtaccaatatcaatgccgagatacataattacaccgccgccagttcaggctgtttcagccactgctgcaaacttgcaacacggcgggtgactaattcatgaaacgccttatcagatgccagttccgcaaacagcgcgctatcactcaggtatgcatggagcggatcggcgctggcgaactgcttacgtagcgtatcgacctgtagcgcaccgtcctgatagcaatagggtaaattgtcatcggcccatcgctgcataaacaggaagaacagtgccggaatcaccgccgttgcggtgggctgcgcaccgcgctggtagcactgttgcagggttggcgtcaccatgccgggaattttggataaaccatcggcaccgacgcgctgattggtatctttaatgtaaggattactgaagcgggccagcaccacgtcacgataatccgctaaatcaagcgggctgggagacagagaaggaatgacatcctgggttacgtagtcgtgagccagttgataaatcgccggatggctggtgctctcatcgatatagttcagaccaatcagtgtgcccgcccaggcaatcgcagcatgtgtcgcattgaggatgcgaattttcgcctcttcccacggcagtaccgattccaccagttcaacaccgaccttttccagcgctgggcgcccggcaataaaatcatcctcaatgacccactgaataaaagattcggccattactgctgcgccatcctgtttgccagtcgccgcctgcacgcgtttctgccacctccggagtaggacggggtgtaatgcgatcaaccatggtattcggtgagcgggtttgcgtgcgcacccagtcggccagcgcggtatcgcctttggccgtaagaaacgccaggaaggcgtcacggaaacgctcaccattgtgccgcagattgtcgcagttcagcagcgtaaccggcggaccgccttgcgcaacacgctgtgtcagaatatggctgagtgcaccgtagagggtgcggatatcgccacccagatcggccttcacatctgcctgattgagatccagggtaaacgcgggcgtcaggtagtaacccgcttcggtcacggtaaagctaatcacacgcgtttccgcactggccccctgctcgatcaacgcactgatatcactgtcccagggcaaaattttgcgcagcgaagtgatggtttcgtagtcgcgcttaccttcaggcgtcacggtttccagcacatattctccctgctgcgccgcgagctgattgagcagcggcactgcgtcattacggatattgccgagcgcgatgctccagctttcatcaccctgttcacgcagtttatgcagataccacgcctgatgtgcacgatgaaaagatcccgcgccgatgtgcatccacactgattggttgttcataatcgcctcacttaaacatttgccacacctaagggcatttgcccgatgacctgtagcatagtgcctattacgaagatccttctgcgagctgagtcacaaataatatttttgctctcattccgggcttttgctcagttagtgcttttcgacccgcacggcgttaagatgtcccctcaaattcgacggaacatcgtgatgagcagagaagaaaaaaagcaggagctggccgcacgtgccgcatggatgtattacgtcgcaggcgtgacacagcaggagattgcgcaggcattgggattgtcacgacaggtagcgcagcggctggtatccagtgcacgtgaaatgggcatggtgaacgtaaaaattgatcatcccgtcacacactgtctgcagctggcgcgtgaggtacaggcgaagtttggtctggatttgtgccgcgttgtgccatctgccagtctgaatgatgaggctattcaacaaatgctggcagttgaaggcgcggcggtgatgacacaattcatcaatgaggaaacgcctcaggtgttcggtattggttccggtaaaaccctgcgctcaatgattgatgcgctaccctgggttgatcgcccgcagcatcattgcgtttccatgattggtgccatcgcgcgggatgattccggtactcgctatgacgtaccgttgaagatggccgaaaagatgcaaggtaagtatttctttatcccagcgcccttatacgccgacaccccagaggataaagcgatgtgggttcagcataaggtttaccagcgcgtcattgatcgcgcattacaggcggacgtggcttttgtgggtattggcgaagtgatgccgggctgtcctttgaatgccgagggattcatcacagatgcgcaggtcgaggcgctaaatgggcgcggcgtggtgggcgaaatgctcggtcactttttcaatcagcagggtgagcgggtatggggcgaaacggatgagctactgaccagcgtgcgactggaaagccggactcagcgtaaaattattggctttgcgggtagcgagcgcaagtatccagcaatccgtgccgcattacagggcggctgggtatcgggactggtgaccgatgaggatacggcgctgaagctactgcaaaagtgatatctcagcatggatgcagagtgcgagggcagaacgcagagatgacgcaaaatctcaaacgcggctcgcacttattctgcgcagggcacgttacgccggtgccctgattccctcgccttaactaacatctaaccgttacttcagcgatcccttgaggaactgctgtaaacgcgggcttttcggactgccgaacagttccgcaggcggtccctgctcttcgattttaccctgatgcaggaaaatgacatggctggagacgtgacgggcaaactccatctcgtgggtcacgaccaccatggttttgccctcctcagccagcttctgcatgatgcgcagtacttccccgaccagctccggatcaagcgccgaagtgggttcgtcaaacagcaacacctctggctccatcgccagcgcgcgcgcaatcgacacacgctgctgctgaccgccggagaggtgaaccggatattttgcctgtgcccgcgcatcaatcccgactttatcgaggtatttgatggcacgctcacgcgccgccgctttactcagccccagcacctgaatcggggcttccatcacgttttccagcacggtcatgtgactccacagattaaaatgctggaacaccatggtcaggctggtacgtaacgcgcgcagctgctctttgtcagccactttgagctgaccatctttgtcacggactaaggtgatttgttggttattcaccatgatgctgccctcactcggtttttcgaggaagttgatgcagcgtaaaaaggtacttttccctgagccggacgatccaatgatactgatcacatcgcccgctttagcagttaacgagacccctttcagcacttcatgttcaccgtaacgcttatgcaattcggtgacgcttaatttattgtcagccatagttctactcaatgcgatgaagagggtttcacgtgggccagccagcgacgtttccgccaggcggaacaggctgatcaacacgtaagagataatcaggtacaacacagccgccagaccaaaggcggtaaacggctgataggttgccgagttaatatcgcgcgcgattttcagcagatccggcacggtggcggtgaaggccagcgccgtggagtgcagcatcagaatcacttcgttgctgtaggccggcagtgccgtacgcagcgccgatggcaggataatgcagcgataaagtttaaaagtagagaagccgtacgcccgtgccgcctcaatttcaccgtgtggcaccgagcgaatcgcaccggcaaaaatttccgtggtgtaggcgcaggtgttgagggtgaaggcgagcagcgtacagttcagaccactgcggaaaaaggcattcagcagttcagtgcctttcacaatctccagcgtgtacatgccggagtagaacaccagcagctgcacatagagcggcgtgccgcgaaagacgtaggtgaagagccagaccggaaagctgataaaccggttaggggaaacccgcgctatcgccagcaggattgccagacatccgccaatggtgaccgagaggatcagcagccacagggtgatagctacaccggtaaaacgataaccgtcagtccagagcagcgatttccagtattcctgaataatatcaatcataactcgccctctttacacctaccgtatagcgccggttgagccaccacagcacaccgtttgacagcgtggtaaataccagataaatcacaccggccacaatggcgaagtagaacggctgccaggtactttttcctgccagctgcgtcgccttcaccacatcttccagccccagcagcgagaccagcgcggtggctttcagaatcacctgccagttgttgccgatgcctggcagcgcgtagcgcatcatggccggaaacagaatgcggcggaacacctgcgcgccggtaaagccaaacgcggttgctgcttcaatctgcccctgaggcacggccataaaggcgccgcggaacgtttcggtgaagtaggcaccatagataaagccgagcgtgatgatgccggcgaccatcgggtcgatatcaaactgcgccatacccagcgcatcggttatctggttgaggacaatctgcagaccgtagaagatcagcagcatcagtacaaggtctggcacgccacgaatcagcgtggtgtagccttcaaaaattatcgccagtggccggctgcgcgacagtttcgcgcctgcgccaatcaggcccagcagcactgccagcacgacggaagtgagcgccagctccagcgtcaccagcgtgccccgaagaattacatcagaatagccatacagcatcgagagggtcctgtcgtggggtgaaaacgaaacgctgcccgcaagcgagacgggcagtttagctttacctctctgttgcagatgccatccgccattagcggaaaagaacccgattctgcacctggcagaaccggctcagacccggcaaaacggacacagagggtaaagcgacaggatggttagtcgccgtacacgttgaaatcgaagtatttcttcgcaatcttgtcgtaggtgccatctttacgcatgtcagcaaaggctttgtcgatggcggctttcagttcgctgtcatctttacgcagtcccatgccggtaccgacgccaaaaatcttgtcatctttcacggccggaccggcgaaggcgtaatttttaccgaccggctgcttcaggaatccttcgctggcctgcacttcatcctggaaggcagcatcaatacgaccggcattcagatcctgatagaccagatcctggtttgcataaggtgtgacgttcaccccttttggccgccagttctgattggcgtaagtttcctgggtggtgccctgcagcagaccgatgtttttgcctttcagggactcaatggtcggctcaattttcgatcccttcggcgcgactaaacgcgcgttagcggcgtagagtttttccgagaaggcgatctcttcctgacgtttcgctgtgatggaaagtgaggagatgatggcatcaattttcttcgctttcagcgaagggatcagcgcatcaaagtcgctctctacataggtacattgggtatgaatacgtttacagatttcgttagcgaggtcgatatcgaagcccactaacttgccttgcgcgtttttcgactcaaacggtgggtaagttggatctgtgccgatacggattgaacccggaaaccgccgcgaagacgctggcagcactggataagcccagcatcagggaaagagccagaacacgctttttcatagattaccctcaagtgaagtgctttttgttatgtggttcgtgatgtgtttgcgcaaagtaatttgcatgtttcatgccagttctgcaagttaaccacgctgttagcgtgaagtcagacaggcgaaaacgctgtgtttgtgaggggaatatagcagtgaagtaaaagagaaaaagcgacgttgttaacttttggtgcgtcaaatgcacgaagagtgatccgaggcgcgcttatgcactaaataagtgcgccagcggaactttatgcaccctgccagcgcgtgaagagatcttccgataattcgatatcaaactggtcgatcacccggttaacggtctgatcgatcagctgatcgatcgtttcaggccgatgataaaatgccggcacgggtggcatgataatggcacccagctctgcggcggtggtcatcattcgcagatggccaacatgcagcggggtttcgcgcacgcacagcaccagcttacgctgctcttttaacaccacgtcagccgcacgggtcagcaacgagtcactgtaactgtggacgataccagagagtgttttcattgagcagggtaaaatcgccatgcccagcgttttaaacgatccagatgagatatttgctgcaatatcgcgcacgtcatgcaccacatcggccagcgcctgcacgtcacgcagcgaataatcgctctccagtcccagtgtctgacgcgccgcctgactcataaccagatgcgtttctacttcttccacctgctgcaacacctgcagcatgcgcacgccatagatcaccccgcttgcgccagagatgccaatgatgagtcgtttcatattccaaccttatttcagccaatgggccatcatacgcggcctgcgggtttctgaaaacaaacagggcgggattgctcccgccctgttttatgctgcccgcctgctgaaagtatcagccttcgttgtgcagctcgaggttttcgacttcgtttctgccgctgaagcgctttggcatcatcattacgcagcgactcaagatactccagatattgctgatcgacatctttcgtcacgtaaatgccgttgaacaccgagcactcaaattgtgcaatgtccggattctcttcgcgaaccgcttcgatcagatcgtccagatcctggaagatcagcgcatcggctttaatcagctggcgaatctcttccacttcacggccatgcgcaatcagttccgtggcgctgggcatatcgataccgtagacgttcgggaaacgaatttccggcgccgctgacgccagataaaccctttttgcgcccgcttcacgcgccatctcaataatctgctctgaggtggtaccgcgaacaatagagtcatccaccagcagcacgtttttatcacggaattcggcgcggttagcgttgagcttgcggcgcaccgcgctgcggcgtaactgctggcccggcatgataaaagtacggccaacgtaccggttcttcacgaagccctggcgatagggtttgtcgagaatacgtgcaatttccagcgcgatatcggtggaggtttcaggaatcggaatcacaacgtcgatatcgagatcttcccactcgcgcgcaattttctcacccagcttggtgcccatacggacacgggcgctgtagaccgagattttgtcgaggaaggagtcgggacgcgcaaaatagacatactcgaacaggcacggattgcttttcggattttcagcgcactggcgggtagagagctggcccgcttcagtcacataaaccgcttcacccggtgcgacgtcacggatgaactcaaagcccagcgtatccagcgccacgctctcggaggcgaccatatattcggtgcgaccatcagcgataacgcgcttgcccagtaccagcggacggataccgttaggatcacggaaggcgaccataccgtggccgataatcatcgacaccaccgcataggcaccgcgcacctgctgatgcacggcagcaaccgcagcaaagatgttgtcggctgtcagcggatcgttttgaaaacgatctaactcctgcgcaaaaatgttcagcaggatttcagaatctgaggtggtattaacgtgacggcggcccttttcaaacaggtgcttacgcagcacgtgggcgttggtcaggttaccgttgtgcgccagggtgatgccatacggggagtttacatagaatggctgcgcttcagaggcactggagcttcccgcggttggataacgcgcgtgaccgatccccatattgccctgcagacgctgcatgtggcgtgcttcgaaaacgtcgctgaccaggccgtttgcctttcgcaggcgaaaacatttcagcgcatcgatagtacaaatgcctgcggcatcctgcccgcggtgctggagcaccgttaacgcgtcatagatcgactggttgaccggcatgaaaccggtgataccgacaataccgcacatgttgtcatttcctcattaagccgcactcccggtcacatcaccggggtaaaaaactcgacgtgcttttcaggtaatcaaaaaaccacctgattatataactgaactcgggaatgagttgagactgttgccagtccggacttttggaaaagccagtgaatgtatcgaggaagaacagcaaagcggctacgatcagcacaccacgcaatgccccgaaacacacgcccaacacccggtcggttcccgacaggccggttttttccaccagcgtgccgataacgtagttcacaatggcccccacaatcagggtcgccacaaacagcacaccgatggcgataccgttacgaaccagtttcgtcgtcaaaacctgtaaaccagactgcaaggtaggcgtagtaatgactggcgacaaaaaacgcgcatccccaggtaacaagagataaggcttcacggacaaacccacggaccaggctgaccagagccgaaaaaccaactaccgcaataatgacgtaatcaatccagatcatgaactcttccagcgccagtgcaattgcacccctgcatccagttcggggcgcattctaacagaaaaagaaaacgtttgcgtagcggttttctttttctgcatccataaaaaaggcgatgaaaaaaaacgctatcgcccgggtaattctcagccggacaggccgttgaaaatcgtcattttttttcgcggcagcgcgcattaagcgcgctgtctgaggggtaaaagacgctgcctgttactgctatcggcagcgccaatcgcccgttttagcgggcgctgtatggtttcacgacaccgcccagtcctgagatacttttcagctcgccaaccgcactctgcattttggctttcgacgcatcaggcccaacgtaaatgcgggtgatctgaccctgtaccggcgttgaaggaacggtaaaggcgcgatagcccgacagccgcagctgcgcgacaatctcattcactttgctggcgtttttcagcgcacctaactgcaccacataagcctgccctgccggcgctgtcgtctctgctgattttggcgcctcttcctgcttcggctgttcgaccactttaggctgttcaaccggtttaggtttaggctgctccacggcttttggcttctgctgtttcgaccggcttctgcttaggctgttctgttactttcggtttctgctgctcaacgaccttcggcttcgtcaccgtctgtgcgggcacagactgatggaccggcggcggcgagaccactaccggatcgctctcgtcttccggttgagtccgaccctgctctgccgtagcgttggttttaccgttgccattgctgctgctgaccgcattgcccgcgccttccggcggctgtgccggcagcgactgggttaccggcggcaccatttcgctgtcctgctgatcgtcaggtttcggcaccagcggaatggcggcaaactcctctttgtaatgctttttctgaccatccagcagccctggcagcacaatcacgccaacggcgaccagaataacggtgccgactaaacggttctgaaacttacttgccacgtcctttctccgtttcaatcgattccatgacctgtgcaacggtgtggaatgaaccacagaccagcacaatgtcctgcggcgctgcccgctggcgtgcctgctgccaggcgagctcaaccgaactaaaagcctcgccctgcgacaggttgttcagcagttgctcagcactggcgccgcgcggaccctcgaggggcgcgcagtaccaggtatcgaccaccggtgccagcgccgccagcgttccggcgatatctttgtcatgcagcatgcccaccacggcatgcactttgccgcgtttcggcagtgcagccagccgcgacgccagatatgctgccgcatgcgggttatgggcgacatccagaataacgcgcggtgattcgctgagggtctgaaaacggcctggcagcatcgccagcggcaggctggcgcgaatctgcgcctcactgacctcaagcccggagacccgcagcgccaccagcgcggtcgccgcgttaggcagcggcacctgcggcagcggcagatcgttcagctcacctgtcgcatcacgcagtgaccagctttctgcctgcgcatgccacgaccagtcacggttgcgctgcaacagctgcgcacctttttcctgtgcgaccagggcaatactctgcggcatatccggttcacccactaccgcaggttttcccgcccggaacacaccggctttttcacgcccgatgctttcgcgatccgggccaagccagtcggtgtgatcgagcgcaatgctggtgaccaccgcgacatcggcatccacgatgtttgtcgcatccagccgtccgccgaggccgacttcgaggatcacgacatccagctgcgcctggcggaacagattcaacgcggagagcgtgccaaattcaaaataggtcagcgaaatatctgcacgtccggcttcaatctccgcaaagctggcgcagtgctgtgcttcactcagctcctctccctgaacccgaacgcgctcggtatagcgcaccagatgcggtgaactgtacacgccaacgcggtagcccgcggcgatcagcagcgtttccagggtgcgacaggtggtgcctttgccattggtaccggccacggtaaagacaaaaggagcgggtttcagcaggtcgagacgaagcgctacctgacgaatacggtccagacccagttcaatggcctgagtatgcaggtgctcaagataataaagccacgtggccaaaggcgacgtggcttggggaaggtgaagattgtccatatgtcccgttttgcttatttatacctggcaggctgctgctgcggtatacggtgcattggtaagaggtgctttggacgcacctctctatctcctgtcaggcctcgttgctttccgattcagtcgtcgccggagcggactgttcaccgtcatgcagcggtgccggcaggttcatcatttttgccagcaggcttgccagtttgtagcgcatttccggacggcgaatgatcatatcaatcgcgcccttttcaatcaggaactcactgcgctggaagcccggcggcagtttttcacgcacggtctgctcaataacgcgtgggccggcaaagccaatcagtgctttaggttccgcgatattgaggtcgcccagcatggcaaaactggccgaaacaccacccatagtcgggtcagtcagcacggaaatataaggcagaccgcgctcacgcatttttgccagtgccgcactggttttcgccatctgcatcagcgactgcagcgcttcctgcatacgcgccccgccgctggcggagaagcagatcagcgggcagttatcttctaacgcctgctcaaccgcacgtacaaaacgcgcaccgaccactgagcccattgaaccgcccataaaggcaaattcaaaggctgccgcaacaaccggcatgccgtgcagctgacctttcatgaccaccagcgcatctttctcaccggtgtctttctgggccgcgatcagacgatctttgtactttttggagtcacggaacttgagcagatctttaggttcaagttcactccccagctcaaccatcgtgccctgatcgaggacgctgccgaggcgctcacgggcgtgcatccgcatgtgatggtcacacttcgggcagacctcaagattacgctccagctcggcgcggtagagcacctgaccacagctgtcacacttggtccagaccccttccgggatactggctttgcgcacaggcgttccggtgcttttattaagaatgcgttcaatccagctcattgatgacctttctgtttaaaactgacctggtccagtcgtcttgatactgctgaaaaccgcttcagcagacggtaaatgtcgctcattaaaccacaacctgttcagactgtggataaaaatctggtcttacccctgagcgcagccttacggctgcttctgctgcttagcctgacggcgatgacgccagacttcaatcacacctggcagaatcgagaccaggataatgcccacaatcagcagcttcaggttttcctgcaccaccggcagatcgccaaacaggtagccggcataggagaacagcagcacccagagcagcgcacccgttacgttgaacagcgcgaagtggcgataggacatatggcccataccggcaacaaacggcgcaaaggttcgcacgatcggcacgaagcgcgccaggataatggtttttccgccgtgacgggcataaaacgcatgggttttatccagatggctgcgacggaaaatcttcgagttcgggttactgaacaaccgttcgccaaacaggcggccaatggtgtagttcaccgcgtcgcccagaaaccgcggccaccactaataatgccaccatcacatgcacattaagatcgttacccggcaacgccgccagtgcgcccgcgacaaacagcaacgagtcacccggcaggaagggcgtcaccaccagaccggtttcgcagaacaaaatcaggaacaaaatagcgtaaatccagataccgtactgtgcaaccagttcggcaagatgcacatcaatgtgcagaataaaatcaaccagaaaatggagaaactccatggcgcgcccttttaagtcctgaaagtgaattaatccgcgaggaacaacggtcccatcgacggctgtggtaacgcaaagtgggatgggtaatccaccgccaccagatacaacccctctgcccgggctgtggctgcggctaatgtccgatccttcgccgccagcagcgttgccatccatgactccggcttattgccgcagcctatctccatcaggctgcccacgatattgcgcaccatgtgatgcacaaaggcattggctttgatatccacaatcacgtagggaccctgacgcgtcacgttgaggtgaatcacgttgcgccacggtgtacgcgactggcactgcaccgcgcggaatgaggtgaaatcattctcgcctaacaaacattgcccggctcgctgcattttctctgcatccagaggatggtaaaagtgcgtcacgccctgcgccagcaccgccggacgcagacgctgattgtagatcaggtagcgatagcgtcgggccgtggcgctgaagcgggcatgaaattcatccggcaccgctttcacccagcgcaccgcaatatccggcggcagattagcgttgacgcccagcgtccaggcgccatcaggccgctgcgaggtggtctcgaaatggaccacctgccccgtcccgtgtacgcctgcatcggtgcggccagcacaaaaaatgctgaccggatgatcggcgactttcgacagcgcgcgttctaccttctcctgcacgctgcggacttcattctgacgctgccagccgtagtaacggctaccgtcatactcgatgccgagcgccagtttttgcgtctgaccatcggacatggttacagatactcctgaaccagtttctcagcggttttcaccgccatcagcgcgccgccaaaacgaatgttgtccgctactgaccagaactgcagcagctccgggataccgtagtcgttgcgcacagcgccgatgctcagttcgccgttgcctgaggcatccgtgaccggcgtcggcacttcatcctcttcgctcagacgaatatctgacgccagcgccagttcggcacgcgcttcttccgcagagagcgggcgcaggttttcgatatgcacaatctgcgcattaccgtagaacaccggagcctgtacgctgctgaccgcaatcggtaagccttcgtcctgcaataccttacgcacctgatcaatcaggcgacgctcactctccacgctgccttctgcgtcggcctgttgtggcatcaggttaaacgccagctgacgaccaaaatggtgttcatcggccggaataccgttcagcaggcgggcactttccccggccagcgcatcgacagccactttgccgtagctggagactgagatcaggttagtcacctgtaaacgactcaatccggccgcatccaccagcggtttaattgcggtcagcagctggcttaccaggttgtccgccacgctgatgatgttgcgattgcgataatctgccagcacctgcggattcacatctggcaccaccagcggcacatcgggttccagcgcaaacagctcgctgctgtcgatcaccagacaaccggcattggccgcttcatcggcaaagcgcgccgaggcgtcacgtcccgccacgaaaaaggccagctgcgcctgtgaccagtcgaacgtctccgcattttcgacccgcaccgagcggccttcgaaacgtttgatttcgcccgcgctgttttcgctggccagcaaatataattcaccaaccgggaactggcgttccgccagcagttccagtacagcgttccctactgcgcctgtcgcgccaagtagcgcaatattccagccgtcagacatgttggtttactccagacaatgacataaaaacagaaggcggtgatattcaccgcccagggattcagatttatccccgtcgtctttcacgttgcatctttgttggctgcgttcactcacccgaatcacttacctgagtaagcgcatcgggattcgttctcttgccgcctcaatgcaacccgaaatccattgggtatatccccccagaaacccgccgtcatgcagacatgccagcagcgcgcgccttccgttcactgattaattcagtgcagaaatcgcgccagggcgcctgacctgcagcgcccgctattccggggagatgattgcgttaaagcccagctggttcagcagctcagcggttgtggcgtcatcgcagttcacctgcagcgatgaccactcgcggcgctcctgatactgcttgcgcaggcgatcaaactcgccgggtttcgccgccactttacgcaggggggcatcatcgcggcgcacatcatacaccagatgcgccaggcgtttcagcgttggctgatccagcgggccattcagggtgatttcactgaattccggcaccggcagtaaggtactgagcggcacctgctgcggctgaccaataaagtcgcaccaggcttcaaacacctgggtggtgccgcgcgctttgccttccagcgtgtagcccgcgatgtgcggcgtggcgatatcgaccttatccagcagcgccagcgacagatccggctccggctcccagacatccagcacgacgctaagatcgtgccgcattttcagcacctccagcagcgcgctgttgtccaccaccgggccgcgacaggcgttgatcaggatagtattaggctttagcgccatcagcagcgccgcatccgccagatgccagcttttatacgggccctctttaaacagcggcgtatggaacgtcagaatatcagcctgctctgtcacggcctccagcgacaggaaatccccctcgtcaccgcgatcggcgcgcggcggatcgcacagcagggttttgatgccccaggcctcaagacgcttttgcagtcgctcaccgacgttaccgacgccaacgatgccgacagtgcggtcacgcagctggaaaccatcgcgttccgccagcagcagcagcgcagaaaaaacatactccaccaccgcaatggcgttacagccgggtgcggcagagaacgcaatgcccgcctgctgcagccagttctcatcgatatggtcggtgcccgccgtggcggttccgacaaatttcaccggctttcctgccagcagggcctcattaacctgggtgactgaacgcaccatcaggccatcggcatcggccagttcagccaccggcagcggacgccccggcaccgcgaccacgtcgccggtacggctgaatagctcacgggcataaggcatattttcatcgaccagaattttcaccacggctttcctgtcagttacatatcaggcaattattctggcacaaagcgacgcgttagcctaaccgcgcacggtagcgttcgggcgtggttcccgcctgttgctggaacatcacaatcagcgccgaagctgaactgtaccccagctcatgggcgatgctctgcacgctttccccctgctccagcagcacaatggcgcgcagaaaccgcagccgctgccgccactcgccaaaggtcatatgaagctgctgctggcagcgccgcgccagcgtccgttcggtggtaaagacccgcgccgcccagcctgccagcgtggtgttatcgcccggatgcgcttccagcgcatgtaacaccggcgccagaaatttatcgtcagaggtgggcagataactctcctgtacctgcgccagctgcaggcgatcgcgcagcacctcgcacagccgccactgcgcatccgtttcgggttgctcgatttgctgctcagcaaactcatccataatggcatgtgcaatgggatcgaccagcagcaggcaggcgcgccggggcagatcggcgcataacggagccgccagattaaaagtacggaactgtgcctgacgatggttatagctactgtgaagctgacccggtgggatccagaccggaatatctgccggtgtcagcaatcgctcaccctcgacctgcatctccagtacgtggcttttcaccataatgagctgaccccaggcatgcgcatgcggcagatattcggtgcgggcattggcctgctcataacgcataaagtagcgcagctgcggcgcgtcaaggggcggctggtagatcactttcagggtcattatgtccgctccacaactaattttgtccgatattaactatctgaataaatccggacaagcgtacactgcgcctcattatggcgtgtggagagtcagcatgtttttcctgtacccgctctttgcggtaataatctggtcgatcaactcaattgtcagcaaactctcggcggatgcgatcgatccggcggcaatctcattctaccgatggttactggcgctgctggtgctgacgccttttgtgctgcccggcgtgtggcgcacgcgtcaggtcattaaaccgcacctctggcggctggcgatccttggcctgctcggcatggtgctctatcagagtctcgcctactacgcagcacaaagtgtcagcgcactctttatgggcattatcggcgccctcatccccctgctcaccgtgctgctgagcgtggtgatcctacggattgcgccgacgctgggcatcctgctcggcagcatcatctcctttaccggtctggtgtggctggtcagtgagggcaacgtgatgcagctgctgaatcacggtctgggcaaaggtgaactgctgatgctggccgcctctgccgcctatgcgctgtatggcgtgctgacacgccgctgggcgctgccgctgccgatctggcaaagcctgtatgtgcagattttatttggtgtcgtactgctgttgcctggttttctgctggcccccgaggtggcgcttaaccggcacaacctgccgctggtggcctttgccggtctgtttgcttcgatcatcgcgccgttcctgtggatccacggtgtgcagcgtctgggtgccagcaccaccagtatctttatgaatctgatcccggtatttaccgcggtgatcgcggtgatttttctgcatgagcaactacacagttaccactggattggcggcggtctgacgcttggcggtgtgatactggcgcagcggctgcgtacccccttaacccgccgtaaaccggtgagtcacccgctgccctgaatagcgcggccggcagattacgggtagcggctgtggcgagtgagggtactgttgaggatggcagtgaagagagtctacagctgaagcgtaaatctcgcgccgaaacgcatgtcccccgtgggatttcccgggggcttttgctatcatggcctattcattttccggcgcaccccacgctgttctgttttcccaaggaatccgccatgcaaccactcagcggccccggtgtgccggtcggcgatcgttcatctgtcaatccgcaaactggcgtaacgcgtcacggttcagtggccggtgaacagcccctctcccctgcgcagcgcacaacgttagaacgcctgatcgtgcgtatctcatcgctcagtaatcttaaagcgcctgaactgtgggcgggcgtacgccatgaagtgggcgtaaagagtgaagcggaattacagtcgcgtcattttccggcagcggaacagtaccttaatggccgccttacgcagacgcaaaatgggcatgccacacgccagctgatgacccagctcaccgatctgctgccgaaagggaataaccgtcaggccgtcagcgactttatccgtcagcaatttggtcagaccgtactgagcgcgctgagccaggatcagctgcgccaggtgctgacgatgctgcagaatgggcagatgacgattcctcagccgcagcagatccgcgtcagcgatcgcacgctgctgcctgccgagcaccatacgctgaatcagcaggtggtacgcctggccgctgccactggcgaatccaccggtaagctgtggacggctgcgctgaaactggtcaacctcaccagcggtgatcccatcccgtcgcgccacttcccgctgctgacccagtatctgcaggtgcgccagacgttgagtcagcacagtgcaccgacgctgcaattgctggaagcgtccctgaaacagccgcttgatcagcaggagcggcagcaactggaggattacagccagcagcgtttccaggcgacaccgcagacggtgctcaccgtaacgcagacccaggatctgctgaacttcctgttcagccggcgcgccgaccgggcagaaaaacttctcgaacagccgctggctgccagcgagataaaaccccagccgatctggtcaccctttgttgcgtcgctgccgcccgcgattcagcctctggcagagcgccccctgctgggcttctttgtcgcactggtcgtcatcacccttttactctgggtggtcctctgagttaacagccacagaatgctttgggcgcggcgactggccattcgcccggtgcatcaccccaggtcagcggatgaccgtcacgtttccagaaatccagcccgccaatcaactccttcacctgaaatcccagcgaggccagtttccaggccgctttcgtcgagccgttacagccaatgccgtcacaatacgtgacataaactttgctgcgatcgagccgggccgtcgtagtggcatccatctcgcgatgcggaaagttgatcgcgccgcaaatatgcccggcgcgataagcctccggcgcgcgagcatcgattaccacgatatccgggatttgccgttccagatcttccgccagatcccaggcgtcggtgtaaaaagcgagttttgcctgcagatagtcgaggctttgctgcggggtggcggccggaattcgtaaaaccgatgacatagcgattctcctgttgtggtgagtctgcagtttacggcaaagtggactgcttactgatacccattccccatcaggtataagacccatatgtcttcaccgttattacaactttttcagcatcagaccagtggcggcgtgcgcgagcggctctgctctaccctgcgactggcgatcaaccggcaccatctgcatgctggtcagcagttgccgtccagtcggcagctggcgcaggatctgcgtctgtcacgtgtgacggtggaagcggcctacggacagctggaaagtgaaggctatctgcgacgcgagaccggtcgcggtacttttgttgccatcatcatccccacccaatcatcatcatttccggcccggcctcagcccgtccgtttctcggcgcggggccagcaggtactggcaaccggtggctgtcaggatcccccttttccccatgcattcgccgccggttcaccggagttacgcgcttttccccatgacacgtggcgacgcctcggcagcagcgtgcagcgtttcactgggcagcgccgcaatgggatatggcgatccctgcggctacctgccgttacgcagcgcactcgcggattatctggcgctttcccggggcgtggcatgccagccggaacaggtgatcattctgaccagttcacaacaggcactgcagttactggcaatgatgttcgtcgatcccggtgatgaggtatggatggaggagccgggctatcctggtgcgcgtaacgcctttctggctgccggcgcacaggtgcgcgggattgaggtcgatgccgaaggtgccatccccgccagcggcagtgcaaaactgatgtatctgacgccatcgcatcattatcctaccggcgtgacgctgagcctgacgcgacgcctggcgtggctggactgggcgcagcgcaaccggtgctggctgatcgaagacgattatgacagcgaatttcactacgacgaacgtcctatccctgcgctacagggactggatcgccatcagcgggtgattacgctgggcaccttctcgaagtcgctgtttccctccctgcggctggcctggatggtggtcccgcccgcgctgattacccccataggccaggcacgcagcgtgctggatggacacagcgccctgctgccgcaggctgtcaccgccgcctttctgcaacagggacatttcgccagccatctgcggctgatgcgtcagctctatcgcagccgtcgcgatctgctgctgacgctaatcgctcagcaactgtcgccgtggatcacgccgattgccagcagcggcggattacagataactgtcagactgcaacaggatgaagcgcgattaaccgcactggcggctcaacagggtttgctgctgccgcgtctgagcccgctctatgccgggccttcgtctcagcaaggctggatgctgggctttgccgcactgacgcctgacgagattgtggcaggatgcgatacattgctgcggctgctgcagcgggagggctaaaacggagggttgaacgaggtaaagcggatgggctgtaaaacaaaaagggccggcaagccggcccttcagagtgctgacgtaataattacgcctgatatttacgcatggtcagcgtggcgttggtgccgccaaaaccaaagctgttagacatcacggtagtcagctctttttccatcggctcagtgacgatgttcataccggttgctgccgcatcaagcgaggtgatgttgatgcttggcgcgataaaaccatgctccagcatcagcagcgagtagatcgcttcctgcacgccagccgcacccagagagtggccggtcatcgctttcgttgctgagatgtatggcgtgttatcgccaaacacttcacgaatcgcacccagctctttcacatcacccaccggggtagaggttccgtggctgttcagatagtcaattggtgtatcgacaccgtgcatcgccatcttcatgcagcgcactgcgccttcacctgatggagcaaccatgtctgcaccgtccgaagtggcaccataaccgacgatttcggcatagatatgcgcaccacgtgccagcgcatgctccagttcttcaacgacgaccatgccaccaccaccggcgataacaaagccgtcgcgctcattgtcataagtgcgtgacgctttttctggcgtgtcgttgtaacgggtagagagcgcgcccatggcgtcgaaactcacaggccatttcccagcacagctcttcgccgccacccgcaaaaacgatatcctgtttgccaagctggatctgctcaacggcgttaccgatacagtgcgcagaggtggcacaggcggagctaatcgagtaatttacgccatgaattttgaatggcgttgcgaggcaggcagagacaccagaggccatcgctttggtgaccacataagggccaaccgctttcaggccgcgtgggctgcgcattgcgtcagcaccaaatacctggaaacgtggggagccgccgcctgaacccgcaatcagacccacacgtgggttgctctgatacgcttcagcgctaaggccagaatctttaatcgcttcttccatggaaagataagcatagatggacgcatcactcataaagcgcacaactttgcgatcgatgaggccggtggtatctaatttaacgttaccccagacgtgactacgcatgccggaatctttcatctcttcagaaaaggtgatgccagagcgtccttcacgcagagatgacagcacctcctgctggttattaccaatactggaaacgatccctaagccagtaatcacagcacgtttcattcaatcttcctcatccacttcttcttaattggcatgcactctagcgtacacttgtacgccgaacaagtccgatcagctatttccttttgtaaatttgcgtcatgtcacgcgggtcgctagaatcgcgccactgcctgaaaaacgagcctttaccgtgaaattgaccccggttgaacatgcaaagctaaactggaatgaacagggtacacctgtttcccgagcgtttggcgatgtctatttctctaatgacaacggtctggaagagacacgctatgtcttccttggcggcaacggttttccccagcgttttactgagcatccgcgcgatctgctgatcgtggcggagagcggttttggcaccggtcttaatttcctgacgctgtggcaggcgttcgatgcgtttcagcgcgaacagcccgacgccactttaaaacgtctgcatttcatcagctttgagaaatttccgttaacccgtgaagatttaactgcggcgcagcagcactggcccgaactggccccctgggcggaggcgctgcaggcgcagtggcccgctgccctgcccggctgtcagcgtctgctgtttgatggcggccgcatcacgctcgacctgtggctgggcgatattaacctgctgatgggccagctggatgagagcctgaatcgtcaggtagatgcctggttcctggatgggttcgcgccctcaaagaacccggatatgtggacgccggagctgttcggcatgatggcaaaactggcgcggccgcaggggaccttcgcgacctttaccgccgcaggtattgtccggcgcggtctgcagcaggcgggctttgcggtcatccgccgcaaaggatttggtccgaagcgcgaaatgctatgcgggccgttgcaggatgcgcctccgctgcccgccgcgcagccctggtatcatcgtcaggctgcggagcagcgtgatgtggcactgattggcggcggcgtcgccagtgccaccctggcgctggcgctgctgcgtcgcggctggcgggtaacgctttattgcgccgatgaggcgcccgcgctgggcgcatccggcaaccgtcagggagcgctctatccgctgctcaatcagcacgacccggcacttgccacttttttcccctcggccttcagctttgcgcggcggctgtatgatcaattaaccgtcacctatgagcatcactggagcggtgtgctgcagctgggctgggatgagaaaagccgtaagaagatcgatcagatgctggcgatggacctgcctgaaatcatcgcctgtggcgtcgatgtggcagaagctgaaaaactggcaaatgttgaacatggctgtggcggcattttctatccgcaaggcggctggctctcaccggcagagctgaccaccgcgatgctggcgcatggcgagacccagggattgcgcattcactggctgcaccgggtgagcgcgctttcccgggaggatgatcactggacgctgacgttcagcgatcgtccggctgtgcgtcatccgaccgtcgtactggcaaacggtcatgcgattgccgactttgcgcaaagcgccccgctgccgacctatccggtggccggtcaggtaagccatgttccctccacgccgggcctcaacgcgctgcaaacggtgctctgttacgacggctatctgacgcctgtcagcccgcagtttggtacgcactgtatcggggccagctatcaccgtggcgataccgcaaccgcgtatcgggaggaggatcagcaggagaaaccgcagccgcctgctgcattgcctgcctgacagcagctgggccgaaacggtggatgtcagtgacggagaggcaagaatgggggtgcgctgcgccacccgggatcacctgccgatggtgggcggcgtgccggattatgctgctacgctggcgcagtatgctgatttaccggcacagcaggcggcaggcagcgatatcgctgacgcacccgatcttgcgggcttgtatctgtttggggcgctgggatcgcgcggcctgtgcagtgcgccgctggcggccgaagtgctggcagctcagctggcgggcgagccgcagcctctggatgccagtaccctggcagcactcaatccgaatcgttactgggtgaggaaattactgaagggaaaagccgtttagcggacgctaagggcggcacgccgccctgcaccactacgcggagagctggcgtgcctgaacaaacaggttatcccacatcccgaccactaatgcctgatcgcgcggcgaaagttctccggcagcaatggcattttgcagactgcgggtcacctgaatctgcagcgcttctggcgtatgttcgcccagttgctccacttcagcgacggccagtgtcagatgcccgcgcagataaccgctggcgaacagctcatcgtcactggcatgctcgaccatgtcgtcaatcagggccagaatacgcgcttcaaattctgcgatcatctcaattcctcttttaataatgcctttctgcatcacagatcgtccggccagggaaactgcgatgctgttaatgaaggcctgccataaaattccgccagggcggtaataaaacgcgcgggacggtcgggaatgcccgacgtcagatagctcatgacctgagcatgcactttacgctggaacgcaatgcgatccggctcacaatccccgtcgagattgtcacaactcacgttgaagggaaagcctgccgccgtacaaaacatccactccagcgcctgtggcttcacttccaccgcttcaaactgactctgggtcagcgcatcgcggccatccggacagtaccagtagccaaaatcgaccagtttgcggcgcgcttcaccggcgatgcaccagtgagagatctcatgcagggcgctggcgtagaagccgtgagcaaagaccacacggttccacggcgattcggcatcagcaggaagatagagcggttcatcatcgcctttaattagacgggtctgaaattcatcgctgaaacagcgatcaaacagcgtgatcagctgttcataatgatgagtcgggttcataacggtatcaggttttaggttacgattgcagcgtggcaagccaggccataacggcgctgccatggctgtcccacagtaatttaatgctcatgacggcagacacaatcaccaccatcgggcggatcagcttctgtccgcggctcagcaccagtcttgcgcccagacgcgcgccgcagaaagcgccgagcatcatgatcaggccggttccccacactactttgccgccgaacataaagaacagcaggctgccgaggttcgaggtgaagttgaggaccttggcatgggcggtcgctttggcaaggttgtagccgcagagcgtgacgaaagccagcgcataaaaagatcctgcacccggtccgaaaaatccgtcatagaatcccactgccccgccgccgaccagtgcaaaggccagaccatgcagacggcgcgcgcgatccacttcgccgaggcgcggcatcagcaggaaaccacagaccgatagcgattaaaaacagcggcagcatctggcgcaggaaatccgcctgcaggcgctgaatcagtatcgcgcccagcacggaacccagcagcgtcatggcaatgttcagccactgttcattcagattgaccgcaccacgccggataaagtagagactggcggaaaacgatccaccgaccgattgcagtttattggtcgccagcgcctgggccggagagaggcccgccgccagcaacgaaggtaccgtaagtaatcccccgccacccgcgattgaatcaataaaaccggcgagcatggcgattaaaaacagcagcccgacgagcagcgggctgaccacaaaccaatccatggaatcccttacagtagatgtttatccagcagggcctgacaggcaggcggtaatggcggcggctcacgtttcaccggcgcgcccgaaccaggctgtttcggcaggaaccagctctgcagctctgcgccacagccatcaccagcaggcggtgcaggctgatcttcacagccaatactgcccgccgggcagcgcaggcgcacatgcatatgggcccggtgagcaaaccacgggcgcactttacgcagccagtcacgatcgttacctgcatcggcacaaagctgctttttaatcgccggattgacgaagatccgtgtcacatcatcatctttggcggccagtttaatcaggctatcaatttctggctgccagtgacgcgcaatcacatttttgtcacccggcccgaccagatcgagcggctgcggcttcagcagttgctgggcgctccagcgggttttcggcagttgcagccagatatcgacatccagcccggtctgatggctggcgtgaccgctgctgaaacgtccgcctgctgccatgcccatgtcaccaatcagcacgttgcccagttgcaggttatgcacctgcgtactgagccgctgaataaactgaatcagatcgggatgaccaaagtagcgccgctgatcctgacgcatcacctgatagtgcggtgaattcagcggcagcgcctcggcgccaacaatacagccgttggcaaagccaccgattgactgcggtgcgccggtgatcggctgctggatgcgttgccacggcgtcgccgccaggctggaggcgctgatcaacagcgcactcagggtaagcagaagagccttcatggtatcaccagcgcggtacggagctgttaacgtcaccgttctgcgcccgctggcgcagcagatgatccatcaggacgatcgccatcatcgcctcggcgatcggcactgcgcggatcccgacgcagggatcgtggcggcctttggtgatcatctccacttcttcgccgtcgcgggtaatggttttacccggcacggtgatgctggaggttggtttcatcgccagattggcgctgatggtctggccgctgctgatgccgcccagaatccccccggcgtggttgctctggaaaccatcgtggcggatctcgtcgcgatgctggctgccgcgctggttaaccaccgcaaagccgtcgccgatttcaacgcctttaacggcattaatactcatcagcgcatgcgccagatcggcatccagtcggtcaaataccggctcgcccaggcctggcggcacgtgatctgccatgaccgtgactttagcgccaatggagtcgccctcttttttcaggccgcgcatcagttcatccagcgcctccagcttgtccgcatccgggcagaagaacggattctcttccacgatgctccagtctttcagctcacaggcgatgtcaccaatctgtgacagatagccgcgcaccacgacaccgtgtttcatctgcaggtatttcttggcaatcgcaccggccgccacgcgcatcgcggtttcgcgcgccgacgagcgtccaccgccacggtagtcgcgctgaccatatttctgctcgtaggtgtaatcagcatggcccggacggaagagatctttgatagcgccgtaatcctgcgaacgctgatcggtattttcaatcagcaggccaatcgaagtaccggtagtcacaccctcaaagacgccggacaaaattttcacctgatccggctcgcggcgctgcgtggtatagcgcgatgtgccaggacggcggcgatcaagatcatgctgaatatccgcttcggtcagcggaatacctggcggcacaccatcaacgatacagcccagcgcaagcccatgggactcgccaaaggtagttactcgaaaaaattgcccgatgctgtttccggccatgctgtttccttctcagggttcggcgggcgatgcttcgccccacttttagtctttgtaaaaagagaaatggtgttttgcgtcgacaatctgctggcgcgtcagcgtaaagacgccatcgccgccgttgtcgaattccagccaggtaaagggcacgtcgggatactgttcgatcatgtgcaccatgctgttgcccacttcgcagaccaggacgccctgctcgctgagataatctggtgcacaggccagaatgcggcgtaccagcttcaggccgtcgctgcctgccgccagccccagctccggttcgtggcgatattcgttcggcagatcatccatatcttccgcatcaacatacggcggattggtgacgatcagatcatatttcagcggtggcaattcgcggaacaggtcagcgcgaatcggcgtaacctgatgaatcagaccatgttcttcaatgttctgctcggcaaccgccagcgcaccggtagagatatccaccgcgtccacttccgcttccgggaaggcataggcgcaggcaatcgcgatgcagccgctgccggtacacatatccagaatatgatgaggtggcgtgctgaccagaccggcaaagcggttctcaatcagttcgccaatcggtgaacgcggcaccagcacgcgctcatcaacaaagaactcgtggccgcagaaccaggctttattggtcagataggcgaccggaatgcgctcgttaacgcgacgaatgacgcgctcaacgatcagaagacgttcgctggcggtcagacgcgcattgcgcatatcttcaggaatatccagcggcagccagagtgacggcaggaccagttgaacggcttcgtcccagggattgtctgtgccatgtccgtaccagattccggcagcggaaaagcggcttaccgcccagcgcagcatgtcctgaatggtgtgcagttcgttcactgcctcatcgacgaaaattttgtccacgtagccctccgcaggccttttgctaaatcggccagtagtgtgccatgaagccggggagaattcagcgcagcgaggtgaaaaagctgacatttaatgacgcttaacggtaaggtatcggctctgctgtgtgacagccttttctgatatgactgacctgccatgagtaaaaaaacaccactaagcccggatgaccaggcgctgtttcgccagttaatgacgggtacgcgccagttaaaacaggacacgtttgtccacaaagcgccggttaaaacccgccacatcccggtaaagcgtctgctttcagagcaggcggacaacagtcattacttttcggatgagttccagccgctgctctcaacggaaggtgccacccgttacgtgcgcgccgatgtcagccattttgagctgaagaaattacgccgtggcgactatacgccggagattttcctcgatctgcacggcttaacgcagcagcaggccaagcaggaaactgggggcactgatcgccgcctgccgccgtgaacatctgttctgcgccagcgtcatgaccggtcatggaaagcatattctgaagcagcagacgccgctgtggctggcccagcatccgtgggtgatggcttttcatcaggcacccaaaatgttcggcggtgacgccgcgctgctggttttgattgagattgaggagtggcaaccgcctgaattgccctgagaggggccggaattatcggcccacagacgtcagattgctttagccagctttttgggactgacctgccacagcagtttaccggcactcgctgcgggatcgaattccacgcaggcaatagcggaagtggcgaacattggcggtgcttcctgcgggcacagttcagagactaaataccccaccaacggtaaatgtgaaatcaccagagccgatttcacgccttcattcgccagggcctgcagatagcacccgaccatctccggatcgccgcccggcgttaattccggcagaacgtcctggctttccggcaggggaaaggcttcacgcacggtcgcgagcgtttgctgcgcgcgtaaatagggactcaccaggacacgctcaatgtccggcgtctggctgttaagccagttggccatctgacgtgattcattgcagccacataaggttaaaggcctgactgaatcactggctgcttccagagccgcatcgccgtgacgcatgataaaaacttgcataaagcaccgctgttgtttgtcgacatcgcccgacgcgtagcgcctgactcttcactctgcgaatgaacgctgtgttttaccctaatggctttagtatagtcaaccggttgtttattaaataagcacttctcagaatcatgctgcgccgcacactctggcggcgcttttctaagccgctgaatcggattagttattccattttcagcagaaatgtaaaatttcgtctattttgcagccgcctgaatcagcgcctcacagggtgtgaatcgttcgccatgctgctgcgcaagccgggttaatctgttgaccacttccgccgcgcccagtttgtccatgtagtggaacgggccgcctaagaaaggcggaaagccgatgccaaacaccgcaccgatattcccatcgcgggcgcagcgaaccacctgctcatcaagacagcgagccgcttcgttcagcatcatcatcacgcagcgttcagcaatctgcgcttcactctgcctggcctgcggcgagactttcagcaacgtatacagcgaagcgtccggttttttacgctgccagcgcggctggtcatagcgataaaagcctttgctgtttttacgtcccttgcggccatctttcagcaccgcatcaaaagcggctggcgcggcaaagcgttcaccataagcctgatacaggatgggactgattttgctgccaacgtcgataccgacctcatccagcagctgaatcgggccgaccgggaaaccaaacttcaccagcgcccgatcaatatggtcaatcggctcgccctccagcaggcagcgtatcgcttcatttatatagggcgtcaggatgcggttaacatagaagcccggcttgtccgccaccacaatcggagttttaccctggctgcgcgccagcgccacaatcgtcaccagcgtcgcggtagaggtattcagatgaggaatcacctccaccagcggcattttctctaccggactgaaatagtgcagcccgatgacgtttctcaggacgctgggcgccggcggcgatcgcctcaatcggcagcgaagaggtatttgaggcaaacagcgtatgcggctgacagtgtgcctccacttcgctgaccatctgctgcttcagggctaaatcttcgaatacggcttcaattaccacgtcgcgctgtgagaagccctgataatcgatgccgcccgtgatacgtgccatctgctgctgacgctgtgccggagtgagctggcggcgtttaacctttttgctcagcagttcccagctggttttcagcgcatggttcaccccttccaggctgatatctttaatgcgtaccggcaacccggcgttgattgcggtgacgctggcgatgccgccgcccatcaggccgccgccgaggataccaacacgcttaacggtgccgggttccgcttcaccgccccgctcctttttcatagccgtagtcgcaaaaaagatcccgcgcagcgcaacagattctggcgtcatcgccagctcaccaaaagcgcgtgcttcagcctcatgtccggcccgactgccctgctccagcccgatgcgcaccacctcaataatgcgttttgctgccggatagttaccctgcgttttggctgcggtctgtcgggtcgccagcgcaaacagcgcctgacggccaaccggaccatgtagcagacgatcgcgcagcggcagcgttcgtccactaaccttgccctttttcacccgggcaatggcggtctccagcagaatcgcctgcggcaccgcgtcatcgaccacgcccagcttacgggcctgtttcgcccgcagggctttgccagtaagaatcagtggcagcgcctgctgcacgccgattaagcgtggcagccgctgagtgccgccagagcctggcagtaagccgagttgcacttccggcaaaccgaggcgggttttatcatccagcgagcagatacgggcatcacaggccagcgccagttccagtccgccgccgaggcaggcgccgtggatcgccgcgaccaccgggaaacggcagtgcgtcgagcgcagccattacttcctggccctgttttgccagcgcttcggcttcctgcgcgctcttacagcggtcaatcatgctgatgtctgcgcccgcgatgaagttgtccgctttgccggaaatcagcaccaggccagccagttgcggatcgcgtcgcgcttccgcaatgatggcggtgatctgcccggcaaattccgatttcagggtgttcatcttctcaccagggacatcgatcgtaatgatgccgacgtgatccagtcgcatcttcagatgaaacgcattctgctccattattcggcctccagaatcattgccgcacccaggccgcctgccgcgcaggccgtgaccagtcctaacccgccaccgcgacggcgtaattcattcagcgtctgggtgatcatgcgcgcacccgtggcggcaaaaggatgaccataggcgatcgatccgcccagcacgttaaagcgctcttcattcacttcgcccagcgcgtgtgggcgattcagcacctcacgggcaaagcgctcgtcgcgaaacatgtgcaggttgctcagcgtctgggcagcaaaagcttcatgcatatcgatcagcgtcagatcggccagggttatgccggcgcgatccagtgccagtggtgaagcgtacgccgggcccagcagcatatcctgctgcacaccaatggcggtaaaggcgtagctgcgcagatagcccagcggcctgatgcccagttcacgggcgcggccctcgcgcatcagaatcactgccgccgcgccgtcggtgagaggcgtgctgttggccgcggtgacgctgccgtgctggcgatcaaatgccggacgcagtcgggcgtaatcctccgctttggcgttcatccgcacgttattgtcctgatcgatggcgcttttccacggcggcacaaaggctgccatgacttcctgattcagtaccccggattgccaggcccttgcggcatgctgatgggatcgcagcgccagcgcatcctgtgcttcgcgcgtgatgccgtgactcttagccatctgctccgcagtgtcgcccatgcgcaggccggtcgaatactccgccactgcgggcgggaccggcagcagatcacgcggacgcagacgccgcaggatgtgcagtttttgaccgaagctgcgggctttattgagatccaccagcgcgcgggccagcgttttactgaccccaatcggcaacaccgacgaagagtctgcgccaccggcgataccagcagagatggtgcccgccagcagactttctgccacattcgctaccgcctgaaagctggtggcgcaggcacggctgacgctgtaggcatcggtatgcacactcagcccgctgcttaatacaatttcacgcgcaatgttcggcgcttccggcatctgcaccacctgcccaaagaccagttgctcgatcacctcagccggcagttcactgcgcgccattaattcgctgaccaccatgcgtcccagctcaatggcgggaatgccatggaagccggtcgcctggcgtaagaaaggggtgcgtaatccgtgggttattgcgatgcgttcaccatcacgcgtcagcagcggctgcgctttgctcattgttctcacctgtggctgggactgtggcatcattgcctgaagaggtctgacctgatcagtgttaaccacaagcgggtgagccgccaatatcggaagggaaaaagtgcgaagagaaacacgaaaatgaaaaacgccgcagtgacgcggcgtaatgggacttaacgcaaaccgagctgaaaaatcatggtttcagcctggcaactgaaggtgaaatcgatatccagctgcactccctgatccacttcgctgaagcgcgattcaatcagacagggttctgattcaacctcgcgggcacgtttcggtcagttgcgctaatttcgcttccgcatcggcacgctgagcaaaccattctgaccagctggcggtgcaatcagtgttatccattaccgtgccgacatcaacacaacaacaggctgcggtttcggtcgcactgcattttttaatggcatcagtcatttcattctccagaccagcaattgcataggttgagcgattttatggacgaaatcttacctgctcgctgaaagatgcgccacgcacctgttgctaagtgacgaatatcacaataaaaattgatccagaacaaactggaatggttatgctgtccaggatcaggggctttttgttatgcagatcgaattttaagcgatcaaacctgaaatattttaaaaacaatattgcaacatgcacacaggtcggacctatactctccgcactggtctgatatgtgcgctttacatcagtccctacaatccgccgtcctttgttacgcgacgttatagcgttaaataataattcacatgaggttgtggtcatgaaccataaaaacctgtttgcaaagtcagccgtggcggctgcagtggcgcttgtctcttcccacgtttacgctgctgggtttcagttaaatgaattctcttcgattggtttaggtcgcgcatattcaggcgaaggggcaatgggtgataccgcggcgtctgccagccgtaacccggcgacaatggcgttaatggatcgcccggaattttctatcggggctgtctatattgcgccggatgtaaatatcagtggtcgcagtcccagtggccgcagcctggatgcgaataatattgcccctaatcagtgggtacccaatattcactacgtccagcccatcaacgatcagtggtggattggcgcctctgcaacctcaaactacggcttagcaacagagtttaataatggctacaccgctggcggttacggcggtaaaactgacctgatgaccggcaatttaaatctcagcaccgcttatcggtttaatgaacattttagtgcaggcatcggttttgatgcggtttacgctaaagccaaaattgagcgttatgccggtgagtcaggcgcgcggctgggggttccggctgatacgcaggttgcccatctgaaaggcgatgagtggggctacggctggaatgctggcatcctgtatgaagtggatgaaaataaccgcttcggctttacctatcgttcagaagtgaaagttgattttgatggcgattacaaaagtaatctctcatcccggctgaatgcggtgaataatccggaagtgtcaggcgtaccttttggcaccaacggcaccaccgttcctggcgcgttaacgctgaatctgccagagatgtgggaagtgtcaggctggcataaagtggccccgcagtgggcggttcactacagcatggcttacaccagctggagccagttccaggagctgaaagccactggctctaacggccagacgctgttctataaagatgaaagcttccacgatgcctaccgcattgcactgggcacaacctattcctacgacaagaactggacgttccgtaccggtattgcgtttgatgacagcccggttccggccgataagcgctctatctccatcccagaccaggatcgtttatggctgagtgccggtacatcctatgcctttaatgatgatgcctcggttgatttaggcatctcttatatgcacggacagaaagtgacggtgaaagaaggtccttatacctttacctctgaaggcaaggcctggctctacggcgcgaactttaactacaagttctgattggatagcacgattaaaaagggcgactctggtgagtcgcccttttttgtggacgtggatcgcttaatggctcagggagcatacgccctgcgcaaagaggcaaaaaccgccatctctggcggcgcatcgcgggcgattactcggcgtcaatatccttaaggtcatcctgaatcgcggctgcgttaggattatcttccggcttgagcttgccgccgcgcgccaggaagtcgtgacgctggaagtaagcgttacggatgaaggcgtacggatcgctctgctgtttcaggattgcatcagagtccagcagctgcgcgcgggtctcaatcccttcaagcgtccatttaccaatcgacattggccaggtcagccagccaagtatcggataaagcgtatcaacgtagtcgccgccatcctgacgcaccgtgaagctgccgtaagcaggcaactcaacgtaaggcccgtagccgacgccatagtgaccgagcgtggtaccgaatcggtgcggctcttcacgcgccagttccggattcgccttaccggcaacgtcaatgaaaccgcccagtcccagcacgctgttcaggaagaaacgggtgaagtgaatacctgcatcacgtccgttaccgatcaggatggcgttgaccatgctggcaggttcttccaggttgccgaggaaattgctcaggccggtacgtgccggcaccggcacataatcacgccaggccacagcgaccggacgcaatacatacggatccagcacgttgtagttaaagttaaacatcgtgcggttaaagccttcgaacggatcgctgcgctgagcaggatcgctattcgccggctttgaactggcacaacctaccagaaggacgctggcgacagccaggctggtcaggcgataattcattccaatctccctgtgcggatgaaaaaggtctacccatcgttcaggtcacagcccggtatcgtatcgacttacccgatgagcatagctgactttgtgccagaggcagcaggcaatggcacgcatcatcctgaacgcggtcagttgatgcgttcagggaagctgctgattaatctctaccgcgatcggctgatgcccatcccagggcgtcactgcgctcaggcccagccagtcacccggccggggattggcgctgccgtcgcgggagatacgcacccggacctcgacctgatgctgcgccgaaagcaggcgatccggcatcatggcgttgctgtcatccagcgtcagcgacagcgggaagtgactgagcggcatccgcttaacagccaccggcatcggtgaagcaccgtcagaaaccgaaatatacaacactccgtcctgcggtaacattttttctgccttaggtgccagcgtcacggtcagtgccagttgacgactctgttgcccggcggcacttctggccttttcgatgctgcgggcgatcatcgcgtgtcgcgaatcaccggccggcaacagacccagcagggtctgccatgcgtcgatagcctgaccatattgctgctgtccgtaagcattaaatgccagcaggctcagcgtacgcaggttttgcggatccgcttttagcaatgcctgcagcagcagtgacgcctgacggttatcctgcgggtcgggggatcgcgtcaggacttcggcataatcctgttttagcgccagatcgttgggagcaagctgtagcgcatgctcaaatgcctggctggccgtatcggtattattcagcaccatgccgagccgtcccagcatcgtccagtcagccagattatccggttccgtttgcaacgcggtacgcaatccgagctgtaaacgcgccagctcctccatgctcagcggtttagcgccagggtccatcagtcgggcacgcagctcaggatacgcctgctgcacctgcttccagcccgtgagctgtgccaggccaccggttttcaggtaagttcccagcgataccccaatcagcacgatcaggcccggcagcaaaatccagcggctgctgctgtgtgatttcatcgtctgtgccggtggaatatccgccagcagtgtctgctgtaactcccgctccatcagcggacgctcagcgacgacgccctgatcttcatcctgtgccagctcatctattcgctgatggtagaagcgctgattaaggcgatcgcgatcgcctgtgctggcctgacgttgccgccagcccgccgccaggaacagcgtacaggccgccagcagtaacagaaaaagggtgatccaaaatgcactcattacggcttcctgtctgacttcagtagcgcattaagacgctgttgctcatcttcatccagctcactgcgggttttgcgctgacggctgcgcaggataatcaccgcgccgcccagcagcgcaaacagcgccggaccagcccacaaaaccaaagttgagggcgtgaccggtggcgaatagctgacaaagttgccatagcgcgccaccatgtagtcgatgatctgctggcgactctggccctgcttcatcagctgatagactttcagccgcatatcggcggcaatcatggcgtttgagtcggcgatgctgttgtttctgacacttcggacagcgcagtgaagcggtcaggtcgcggtattgttcttcctgggccaccgagtcaaattgcagcgtgtcgatgcttgcccacaggttgatgctgaacagcaggccgcacagcagtaacagcgttctcatgatcccgcctccacgctgtatttcacccacaagggtttcacttcctgatcccagacgcgcgcattgagatcgcccgcgtggcgataacggatgatccccttaccgtcgatcagaaaggtttccggcgcgccatagacgccgagatccagtcccagcatgccgttgccatcatagaggctcagcgcgtaggggttgcccagcgtattcagccagttaaccgccttgtgacgatcgtctttgtagttcagcccgacgacgcgtatgccctgctccgccagcgtattaagatactgatgctcggcgcgacaggtcggacaccaggtcgcccagacgttcagcaatatcggtttaccatctgtcagcacgcgctggtcgtaggttttgcctggctgatcgagtgcttccagccggaacagcggcaccggcttgccgattagagcggattcgagacgggtcggatcgtcgccatcggcattacgtgtcagctgccacagcagcgccgctgccagcaacagaaacagcatcaggggaataaacaggattttcttgttcatgtccgctcctcaattcccgcttttttgcgcgaacgataacggggatcaaacaggcagaacagcccacccagcgccatcagcgcgccaccgaaccagatccagcggacaaagggtttgtagtagatgcgcacggcccagccgccatcctccagctcttcgcccagcgccgcatagagatcgcggctgaaacccccatcaatcgccgcttcggtcatcatggtgcgggcggccgtataaaagcgtttctctgcctgcagcgtcgcttcatgtttgccgttgcgcgtgacatcgatgatgcccatgccaccgctgtagttaggcccctgcagattctgcacgccgcggaagacaaagtgatagtgatgaatatcgatgctatcacccgccttcatccgcacatcgcgttccacgctgtactgggtgctgaatgcaataccgatcaccgtcacccctaccccaagatggcccagtaccatgccccagtgactgcgcgacaggtgacgtaaaccggcaaagaacggatgacggtgagtggcgcgctcatgcagttccagcagcgtcagcacgataatccagagtgacatcagcaggccaaccacggtcatcgcctcaatgcgatcctgcagccaccagggaatgatgacggaacaggccagggtcacgatcagcgccagcgccagccgctttgccagcttctgcggctcatcgcgacgccagcgcaccagcggtccgatccccatcagcaaagcaaacggcgccatcagccagctgaacatagtattgaagaacggctcaccgaccgaaatgctgcccaggcccagttgcttgtgcaccagcggcaacaacgtgccgagcagaaaccaccagcatcgcggcaatcagcagcacgttattacccagcaaaaacgattcgcgcgaccaggtttcattctgcacccggccacgtacctgcccgcctttaatcgcgtagagcaggagcgaactgccgataacaatcaccagaaacgcgaggataaacatcccgcgtgccggatccgaggcgaaggaatgcaccgacaccagtaccccggatcgcaccaggaacgtccccagcaggctcagcgaaaacgcggtaatcgccagcagcacggtccaggccttaaaggtgcctcgcttttcagtgaccgccagcgagtgcatcagggcggtgcctgccagccacggcataaacgacgcattttcaaccgggtcccagaaccaccagccgccccagcccagttcgtaataggcccaggccgagccaaggacaataccaatcgtcagaaagacccaggccgccgtggtccagggacgcgaccagcgcgcccaggccgtatccagccgtccggccatcagcgaggcgatagcaaaggcaaacgccaccgaaaagccgacatagcccatatagagcagcggcggatggaagatcaggccgatatcctgcagcatcggattcaggtcatgcccgtctatcggaaagtccggcagcgtgcggccaaatggattcgaggtcagcaggataaacagcaggaagccgagattgatcatgcccatgaccgccagcacgcgtgccagcgcatcctgcggcattccgcgactgaatatcgccaccgctaatgtccaggtgctgagcagcaacacccacagcagcagcgatccttcatgcgcgccccaggtggcagcaatgcgatagtaaaccggcagcaggctgttggagtttgtaacgacataggcaacggtgaaatcgttgctgataaaggcccagaccagcagcgcaaaagccgccgcgatgcagataaacagaccgcaggccagcggacgcgccatcgccatcaggcgggcatcctggcgcactgcgccccacagtggatagctgctcagcagtagggagagtcccagtgccaggcagagcagaaaagtaccaatctcgggcatcatgatgatttatttcccgcctgatacagcgactgcgggccggtgtgattactcttcatcgcgtcttcaatctccggcggcgtatatttctcatcatgtttcgccaggacttctttggcgaccacctggttgcccgccgccagcacgccctgtgcgacgacgccctgcccttcacggaacagatccggcaggatgccttcaaaactgacgctgaccacgccgcgggcatcataaagtttgaacgacacggcaagcgtattcggatcgcgccggacgctgccgggcatcaccatgccgccgacgcgcagccgctggcccgcttcgggcttctcgtgcgcctcgcctttgccgtaaaggatttcacctggggtatagaacagatcgatgtttgagcgcagcgcatacatcaccagcgcggtagccaggccgaggccgagcagaatcgccactgccgcatagaggcggttgcgtcgacgggtattcacaatgtctctcctgccgcttcagccgcggcttttttagatttcgctgcccggatgcggcgttcccgcgcgtcgcgctggcggatctcagccagcaggcggcggcgcagcaacagggtatgcagcgtcagcccgacaagcggaatcagcgtgcaggcaactgccagccagacatagaaggcgtagccccccatctcaaagaaggcgtgccaggaggaaaaggcgggtgtcatgcctgctctccccgcttcgccacatcaatcgcccagggacggtgacgttcggttaacagaatcaggttgcgcagccgcatcagggtcagcgtgataaacaccagcagataaccgatgattgcccagcgcagcggcgttcgcatcactggcgcaatcgcctgctggagaatgcccgacgaaccctgatgcagggtattccaccactgcactgagaagtgaatgatcggcagattaactacgccgaccagaatgagaacacccgcggcccgccctgcggtgcggcggtcatcaaaagcgtgccagagcgcaatcacgcccatatagaggaacagcagcaccagctccgaagtgaggcgcgcatcccagatccaccaggtcccccacatcggcttgccccatgcggatccggtgaccagcgcaataaaggtaaagaccgcgcccaccggtgccatggcggcggaaaccagatcggccattttcatctgccacaccaggccgataaaggcggcgatggccatcgaggcataaatgcccatcgaccacatcgcggcgggcacatgaatgtacatgatgcggaaactgtcgccctgctgatagtcagcgggagcaaatccaaagccccaggcccagcccagcagcaacgccgccagccctgagatggcgaaccacggcaccagtcgccccgaaaactgatagagccgttcgggcctggccagctgatgtaacgctttccacatatcaaatgctcacattaacgataaaagagtgttgccgcgtcttttacgcgcggttatttcaacggctgttattgcaaagtaattcttagcgctgccgccgtggcaaacggggagagcgtggcgctgcccagcagcatcgcgccgagaatcgccagatagccattaatcggcaacccctgactggccgcctccatcgccgcactggcgaagatcaagaccggaatggccagcggcagcaccagcaggctaagcattacgccaccgcgccgtaaacccaccgtgagacctacaccaatggcgccgagaaaactcagggttggcgtgccgagcagcagcgtcagggccatcgcccgccagccattaaaatccagtgacagcagcagcgcggccagcggcgacaggattatcagcggcacgcctgtgaccagccagtgcgccactactttgccgataaccgttaccgggagcggcgtcggcagcagtaccagttgctccagcgaaaccgtcgctgaagtcatcgcgaaacagccgctccagcgccagcagcgacgccagcagcgcggcaacccaggctacgcccggtgcaatgcgcgccagctgttgcgggtcaggtccgatgcccagcggaaacagggtaataacaatcaggaaaaaccagagcggattaaccacatccgccccgctgcgaaaggcgatgcgtaattcacgctggatgaggcgaaacagcatcagcctgcctccccgtcgccgaggcgaattttgcgcacccgcgcagcatccgcgggcaaatcctgatgggttgtcaggatcactgcgccaccgttatcggcatgccgggcgaatttcgccattaattttttaacacccgctttgtcgatggcggtcagcggctcgtcgagaatccatatgcgggcctgactgagccatagccgcgccagcgctacccgacgctgctggcccgccgataaccggctaaccggcacctcttcgtcgcccgtgagatcgacgctttccagcgcagcaaagatctgcgcatcactgcaatcaggatggtagaaacgcagattttccagcggtgtaagcacgcctttgacaccgggatgatggcccagatagagcatcgcctgatgccaggcttcgcgctgccgcaggattggctgctgctgccagcgtatttcaccctgttcaggacggctcaggccagccagcaggcgtaagagtgaggtcttaccggcaccattggggccttcaatctgcacaatgtcgcctgcagagacgcgaaatgagagctgccggaacagcgcacgttcgtcgtatgcacaagtgagcgtaatgatttccaacatcgaggggggaatcgcaccagctaaaagtggccgggatattaccacaatgttgctgtgggccgaagtgtgagccaccgctcagtttcgatgccatgggtttattcgtgcggtatcgcccgcagtctgaataaaaatgcagttccgaaaaacgttgttacgcttattcgcatcgatcgttacattatcggcaaataaaaaacggctacgcttattacgcgacagcactatcaccaggagaaaatatgaagccttcatcaggtaatgaacagggtcctaacgacgtcgagagtgaagagaaggataagggcactgacatcgaagtcgatgaggaggctttaccctcccgcgccgccgccatccatgaagagatccgccaggatggggagaaggagctggagcgcgatggtatggcgctgctctggtcagccattgcggcgggcttatccatgggcgcctcgctgatggcgaaggggatatttcaggtgcatctggatggcgtaccaggggcgtttctgcttgaaaacctgggttatacctttggttttgttatcgtcatcatggcgcgccagcagctgtttaccgaaaataccgtcacggcagtcctgccggtgatgcacaaaccaacctggagtaatggcgctctgctattacgtttatggggcatcgtcttgctgggtaacctgatcgggacggcgctgggtgcgctggcgtttaatgagatgccgatatttgacgaagctacccgtcaggcgtttaccaacatcagtatgaaggtaatggaaaatacgcccggcgagatgtttgccaatgcggtgatctccggctggattatcgccaccatggtctggatgttcccctcggcggggggtgccaaactgctggtgattgtgatgatgacctggctggttgcgctgggtgatctggcgcatatcgtggtgggatcggtggaagtgctctatctggtctttaatggcagcatcagctggtatgaattcttctggccgtttgccctgccgacgctgctcggcaacattaccggcggcacgctgatttttgccctgatcagccacgcgcagatccgcaacgacatgagcgaagcggccgtggctaaagccaaggctgagaagaagaagcaggagaaacgtcgccagcgcgaagagcaggaaaaggctgagtaaatccagggcaggcagagcagattgaaccgctctgtctgcctttctggtctgtttgctgaaggcgatttgccaggcgggcgtctgaaaaacgtttactggaagtggctgctgtaaagagggagtgaagatttaagagtcggggtgccgcttcagtctggatgacatcccggacttcagtacagctgtttccgctttctgcacgtaacgttagcgcgtgcagaaaaccggaattgctggcggaatgagcaaacggacggcgacgtagtgaatctcacggcctgtttgcgctatactgcgcgccgctgtcctcttagttaaatggactaaaagaataatcttatcaatccattgattccattcaagaagaacctctaaatcataaaaaaaatgtacactattatgtactcattcattttctgatttgttgctcaaaatccaatgcaccctgtaggaattttattaagattaaaggtaaattgattttgaccgataagtattaccaattagatcccgcatgcaacttgctgtagagtcgcgtgaccttgacaatggacgaagtcaattaatgacaacaacagtttatgacagaatggcaaaagctgtcacaagtgattcaagatggtcatgtagacttgatcacttaggatatgagggtcatatcctttatgtcgacgatgttggattcggaaagcttgctctccgtgaagacacagtcatggtgttagcaggcaacggttatctgattgagttgtggaagaaatggcttctcgtctcagaacttgaccctgaagcagaaatgccaccgactgagattccaggtcagatgccttttgccatttacatcattgagatgtctacgaacgatgttctctttgatgaaggtcacaaacatactattttcgatccagacgcaaatgaggttcttgcagctttctcaggtttcaggcagtgcatttgctgctgacaactggattgattcgacgtgtgcaagaacagcaatagactatgctatatgcatggaccctttttcaggcggtactgtaaggtttgttgattttccaagcctaaaaaacgacattgaaaccagcctagaaaccattcaggaagttgtgaacatcatgttagataggggatttattatggacactaaaaagccaggtgctaccccagtatcaatcagtgcgcaggaagtagctgaagtacgtcagttgctcgctaatggcgcgctaaccccatcagcccctgttggaaagggtgctaaaccttgggatgatgcttctaaggaaaagttgaaaaaagctattcagcatattcgtgatgctgaagctaagcgaaaagaagaagcagaagcctaaaaaaaacccggcactcgccgggttttttacgagctcaataagatttcattcgtaggtaactgtaacgtctaaataatcggtcttagtggctcgtaaacggagacaatctcagcggtcaccttccccagcacgatgatcccgtccatgccctctccgtcgattgtctcaccttccaaagtaatgatacccgttcggaacagccttcccagttgcgggaaactcgcctatctggaatgcgaccttatctcccggcactggcttcacagacttgtcagccagcacgaatccgtccggcgtctcaatcaggatcatgttattacggtgaggcatcagtacatcgttcaggtcgatgcggcgctcagtgtagtctgacgctggtgatggaaatcccatagctacctcacgtatcccatgttgcgtaacgaccaggtcttattctcggtctcctcggtaaccagctcgaagaagaaattctggtaacgcctaatccaccggttgcactctgccagcgtccacacgtgattcaggtcatccagccgcttctggaacgccgcagtggtgacaatctgccgccctctgccgtccttcgttatcgctccagtgaacgccgcaagtatgtcactctctctcgccatgataaattctcctctgataaatactgtatagataaacagtaatatcgatcgttagatttgatcaaggcggagcggcgcacagatttgtaaaggggttgatggcgaaggatttttagttggcggacacttcgggtgactactaatctcaaattacacctgcagcccgctgagactggcgcggtacactctgccccgtcgccggggcttttttattctaagcgattgtgggggaagggttattatcatcattttaaaggcttttctattcctgcggctgctcatgagatatgattacccataagcacaggttaacattcaattaatacaagcggagcttttaggtgtccaatcctagtaaaatatttgccctggatggcttacggggtgtggcagcaatcttcgtaatcttttcccacattactcttctgatatgcccataccttcaccttggtgcttcatttgacgcgaacccaaaaagctgggcaacgcatctattcaatagcccttttacctttttctttaagggcacgtcagcggttatgctgttttttgtaatgagtggatttgtgctctcttattcgatgataagaagaggcgcccgtaaaggattcttactccgagcagttataaagcgatacttcagattaaacatccccgttgcatcatctattattttatgtgtgattttgatggggcttggagcgtttccagcaagtctggttggaccgcgatatgatttatacaatgcctataccgcttcattcgaggcgcttacgccagttaaagatgctatttacggctctatatttcttggtaatggcacgttcaattacgtttctctggacgattaacatagagttttttggctcaatcatggtttatgcattattggcgttaatgagctcacggttaacgatgctgcggattgtttgccttgtcatttctgtttgtggaattcatagcggcgtgccatttgtatgggggattggtctgtttgcggtgggagtatttctggcgacatttgatgtcgttcataagggggctaccataagaaaggctgggtcatacattctgctaatcgcaggtgtttacctctacgggtttaactcggaaagtgcttcctacgcgctcgtaaatcatgtgcttgattatgcaaacgagaaagggcttcagcttacaaaaggtttcattgtgagcataataggaacgatcatgataatgacctgcttcgtaatcagcatgcagccattaaagtttcttgagcttaggtttttccagtggcttggacgcctgtcattttctgtttatttaatccacactattatattggctattatagctccattggtcataacgcgatttagttttagcctgacatccataatgatttgcgctatcgcggtagtacccataacactcgcagtgtcctgtcttttctcgagatacatagacgaggtagctatcagtaaatcaggtccgatagctaccagcatcttggcaatattcaaaaagaatacagagttaacttagagcgataaggtaagttattgttcaggtgatttggggagtgaaacttttccatcccccttggaaatgtatgctcttaatgcctttctataggatgtccatgttgcaagctcttcccgagcatcctcctctgcagtggaggaataatcttcgtcctcaataatctggttaagagatgttatttttactgaggcgcgatcgtatgatgacgatgcatcctgaatgtttttgttagcctgctcttcaggggttagctggactaccggagccgaaaatgtccatttaccttttgcgtctttctttgccgaataccctggaccaacaatctctccctcgccgatttcataggtttcaaattcctgaaaaatgtcaccctctccattccataacactgcattgacgacaagtccgtctttaatcaaagcgtaagctgacattatgcatactcccaaataataaccacgccattggcgccacttccacctgaaaagccagcccggttaaatgcatatgaaccgccaccacctgctccataaccgaaagcagcatagattggagctccgttgttagctgggcttaaaaccggcaaacccagcatggcggccccgccgatccccggtaatacactccccgtactcagtgcggcaccgttagctgatgcccctccgcgcatattgacaatattgccaccagtagcgatgccacccaatgatccagtcaccgaatatggaggtgttgtttgattctgacccagacctcccgcccctccatttgcgataattgttgaaccaaatgaagatagcccgccatcagtcccgttagttggagccagatttccccctggcccgcccgtgccaacagtgatggatattccacctgagaagccagaagttaatcgagatttagcgtatccacccgctgcaccaccgttaccgatagcaacggtgcctgtgccagcgccaccaatcccgcctgctccgccgcccgcgccctgcacctcaacaactattgatttggttccaggtgtcggcgtgtaggtgccggatgcagtgaatagctggacattcaggagacgtccaggcccaaccaaagtattcattgctgcgagcaactgtgctttgttagttttattgagcgtcaggcccgccgcttctataactcgggcgatttcttcctgaactgcatcaaagaagtccgcgtccagggctgtaggtaattctccggtttgagggttaccgccggtaaagccatttttacccgcgccaaatttatccacctgcgcggtagatgtgtcaatacgatgcatgtttactccgggtatctgaaaataacgtaagtgtgtgagggggccagcttgttaaggacgcactccgcaacggtgtcaccccacattctcaggctgtccgtacagttgctgatggccgtcatcggcgttatctgcgtgtaggcgggcatattcacctgccagtagtagcgccattcatcgctgtaaagtgagtcggtgcaaacggacaggcagttaaactggcttttgttgtagcgggtgatagtgacgcccgtgtaacccagcgcctcaagctgggccaagtagaacgcctcattgatgccgcccgccagatttatcttcgcatccaaccgctggcgtctctgctgcagggtctgcacgcctgcaggtgcgcagctgtccggcagcccactgatgctttcataacggtcaatcagctctgtcactgatcgtgggtcagtctccagcatgagcgaatcgccgcggctgtgtactgcagaaagtgaaggtgccataccggtcagtagcaggtcgtcactgtcccacgccgggccacgcggcagcagagcgccaagcatctgccggtactgcgccgttaagtccatgagattgcccccaccacacccaactcgcctttcccgatggtgatatcagcaacagggctgaccagcgtatgactgtactcacccgttgcgatgctaatagcttcgctgatgcgggacggcttcagcacgttttcaggaccgccatcgcgcagcatcattgagcgcaactcagcctctacggcatagcgcactgctgcggtgttcgggttgagtcgaatctggaaattaacgatgtgaggcgtgggagcaaaaacgtagatatcggctccggccaccggtgcaagcggttcgatgtatgcctttacagctgcgacggtagcagcgtcagggatcggattaatgaggtcgctgttcgccaccataacgcctaccgttccccgaccgctccagtgcctgtatgtccatgcgcgtgttacgccagccacttctttagcccagacttcataatcaccgtcagcgccgccctgcggggtccagtaccaccgctcaatgacgcgggcacgccagacttctaaatcttcaatgtcagcgccaccctgaatgctgtccgccacaccagctgaggtcagtccggtaatcgggctaaccaggcgcattgccagcccgtcatcagtgttacctgctttacctgccgtatcgcagacaactggcacgcgcagaaacgccacccgccgaggtcgctttagctgtcgtggtgaatgaaacgagatcatcacgctgaattgtgacaccggcaggaacagggatgccgctcgttgccacgtcccagcgcacataaccggttgctgctgtagccgcttttcgcgggcatctcttcatgttggcgtggcgtgtcagccagtcctcatccgcaaggtccggcaaaaggttgcgcgccagatagtcgatgtagccatacacggtatgcaccgccgccgcctggacccgtccataaacttctgcatcggtacggcgcaatgcggccagtgtggtatctgcagccaagcgggtgagaatatcgttgcggacggtggtgattaactgagggagtgtcgggcgggtaaatccactgtcagccattaagttcactccataaatcgtcaaaggaaaatgccgtgcggttaccgtctttctggctgataactactgaagcactgagtgtattaatcccggtccgctcggccttcacgtccacccgaaccgcaacgccgtcatccaccagccactgaagcgcctggctaatatattcgcgggctttgagcggcgttttattggtgagcgtctgccgactgagaagatatagacgtgagccgatgcggtcattttgcacggtcgggaagctgtcaccccaccagccgttttcctgttccgggctgtcgtcaggctcagcctttcgccaggagaacagtgagataattaccgcgcgtgtaagaggatcgggcggccacgtcacgtcacgcggcactccattaattacaataatcatgacgccaccattttctgcgtgggcgcgtcggtagtgccgccgcccgatccgttctctttatgtgtgtgaccgttataggagacgcgcatggctgacatggtcaggccggaagaatcacacttatctttgatctcgcctgtcgattcgatgtccatttcgaaccgggcttttggcgcattggtaaacgtgattggcttgcctgcgccattaacaactatcccagcacgggtcagcgtgaccgactgtccctgatcgtcatataccgccacttcaccaagcttcagacctttaatgcggtaacgccggtcagagacaaccagcactaccccgtgtgacctgtcaccgtcaaagtaagcggccacggcctcagccccgatgagcggcgcagccgtaaatccgtaaggctccatatgctcaatatcgcttttgccctcgccacccgccatttcaacctgcagcatctggcatttcgttgctgtattcagtccgcgaacgacagcacgcgccaataggttcgacaacgcacgccccatacctgaaatcgggttagccatcagaaatcatcctcttctttctttttctgccgcttgccgggtttcgccggctcaggaagataagcatcaggcggcccgacgcggatttcggtcacggtgccgttttcatcctgttggtaggtcacctcagcgatcaccatctgacggttgttaaaacccagaacgggatcaaagacgatcacctgcaggtttggcagccagagtgagccgtcaccctgccgccagccctgtacggtataggtcacctcatcggtgcgtgcagcacgctggcgcatctcaaattctgcgcgtgcgctgcaggttgccgtggtggcgttgccggtctggcggataatcatcgggcggtagcgcttcaggccgccatcgatggtctttgagcggatagccgtagttgtggcctcgccaaagtcgtcgtcgttacccttgcgctgaccggacacctgatagtcgctgaaccggtcccggatgctcttttccgtgtcgcaggaaagaatattttcacccagcaccagtgcggtgtgtgcctgctgactgccgatgccgccgattaccagattgccctgcgcgttgtcatatgccagcgcctgctgcagtccgagcattttgttcagtacgtccatgaccgtttcaccctggtcggcctgaattccctgaagtgcaccggatgcgccgcccgcatccaccaccataatgctgaacggcttcgccagctctgcagccacctgcgccagagaacgcccggcatactgtgacggcgtggctgagcaatcgataaggtcagccgttttgctgcgccctgaaatcccggtgctgatgctacgtgcgtcgtaccggaccggcgtagcctcaacgtagccggtcagcaccttatcggtgcctatcagcacctcaaccagatcgccgtttttaatgcgggtactgcgcaccgcctgatcggtatcgccgggccagctgcgggtaatctcaacggcgaagtcgcgggcaatacgctcaatccctgcggcgatcctgaccgaagtccagcctccccactcctgaccgttcacacgtaaaataactgtgttgttcatcgtaccggcaccctcagtgactgaaccggcacgaagccgggatggcgaatgccgttacgagcggtgatgtcaccggcacgggatgcagagtcgtaccagtcggcggccagcaccagcgcgggcataacctgcgaaggtgtgcgctccgtcatgcgctcgacctgctccagccgtgcagagatatcgcggttaacgtctgtacgcacggtgaccagcgcctgataaaggccgtcatctgaaacgcgctccatctcaaggtcaatcgcttcattaaggctgtcgcgaacctgtgcaaggtcatcccatgaaattacggtgccgttatccagagaggtggtaacgccggaagaagcagaaacggccgctgtcgctgtggtgcctgaatcagaagccgcattaccggaatcaggccgtatgttgctgacggcaggatgtgataccacgactggctgctgcgagtcctgctggcgcgtaatggtacgatttgcaggctgcggcaggctggtaaccgttgcggccgcctcgctaatggccgtggtgcgtaccgcctgcgcaacgtaattgcgctgcgtggtctgcgcctgtgctgtcttgctttcggttttccagacgccgcgcggagccagaccggaatcaaccgtgacaccggtcagccctttaatcatcgacatcagatcggaagcgttaccattaaggcgagaacctgcccgccacatgatctgaagccggttaacaaaattcataccgctggacggcgggcttagcagcaccgacaaatcaccctgcatcagacgtgatgcggcgctgataccagaatcaacatactgaaaggcactggttacggtattgaacataccggttgcctcatccagcacaccgtcctgcaggaagtcaggcatgccatccataccaaaggcaccgaatgccgatgaaattgcatcgtccaggaatgaaactgacgatgtgagtttctgtccggttgccagtccagcggtgggaaacgataattcaccggactcaacgaagctgaagctgacgcggcacatacgcccttcgctctgtgaatggctgacgcgaacggcatcatctactaccacggtcatctcgccgtagtaaggatgaaccagcgtgcatgatcccggcttttcaatggcttgaatcaggcggttacgctgctcaaagaaatcatcgccaatcagataagcctgaacgctgaagcggcgcgtcgcgcggcccaaatcttccgcccacggtttgtcgcgattggggtactcatgcacctgcacgcgacgcccaaaggttgcttcgtcgctgtccaccttaaacgcgatgccacgcagtgaggcatcctgcagattatctttccaggtcatggcttactccgggcataaaaaaacccgccggagcgggttggtgtttatttcaggtgtatctgtatcgaataggagtcgccagttctaacgaataaagaatcagctttttgatcgtaagactcaaaccgctgaacactcttaagcttctccagcttatttccgaaaattgtaatgctggttcctgtcagatattcaaaagccttaccagccagcgcaacgttaacctgattcatcgacttatcttcgtttgcgaagaagtgaatttttaccctgttagggcatggcggctcataaacggtaatgtaaagttgaggttcatactcagctttgatgttatcaccgaacgcctcttcatccgtctgatcctttcggaatgaatactgatgccttagcgtgccgccatctttgaacacttgcaccttctcaggttttttcccgattgccttaatgaaatctttctcattaaaagcggggtaacactcactggcagataccccactgacaaaaaataatgccattaaaagcggaaaaaaacgcatgaaggctactcctcaattcgaattagaaaaccgattataacccacatcaagatcaaaccatggaagagcgccacctactggctcaacgcgcattccgggaggagcgttttcgaaagaaactttaagctctcccttttgtgatgttgcatcgtcacgcattaatggaccgctcatgctttccggatttagcggaacgctaccacccttcaactgctgctcattgttataccagccgccagccttccacctcttcttaagtgactcccagaatgattccgtgccatctttctgggtagtcgcatcagagatttcttccagctttttaaacatgtaaagtgcgaccgctattgaaaccgtcagagcgctcaactttcctattttggtaagaacagcgagtagcccacttgctttagttgtggctgtggtgagcgatccaataacctgaagcgtgaataacccggccatcaccccaccaatcccggtgatgattccgttcatgccacccagcgcctctgccaggccgtcgattttagtccagactttctctacaacaggaccgaacttatcccaatcagaaatcaagagaccaattcccagcgctgcaagtctaaggaatatgcccatcggagaaagcttcagtccctgccccagaatacccagcgcaaagttaattcccagcagccccaacttcattccgacaaaaccggctgcgatgccaaatgcacctcgaataaccttcgggtttttgtcagcaaactcagtaaagcgctctgacatgtcacccagccagcccaccagccttttagcatcaccagcaaaagccccgccgattgccgcaagaccattgaccgctgtaccggtcaatgactcccagatattggaaagtgtgcttagctgagcattaacacgcttattaaggtccgcctgctttcccattttctcctgaatctggtcatagccggttttacctttatcgattagcgcatttaacacctgaagtgtttccgcatcatcgccaaatatctgtttgatgatggtggtcttttgcttggtagttaatgactgaagcttattcagttgcttgaaaagattatccaagccgccgaactcacccttgccatcggtaaaatctaactgaataccttttcgacttagcagcttgttggctgccttcatctttttaccatcaaagcccgcctggaatacttttcggagggcgttaccggaagcctccccctccatccccatctgatccatcatcactgaaatgggggccaaagcacgagccgctgtgaggccatctttgctaaccatcttcagaattgagctggtcttagaaaagaaagagagcatgttggtatcatcgacgcccaggtaaaaagctttttggatcgtgtcgaataatcccatcatgtcttctgaagccgtgccggtagcatcctgcatttttgcagcaaattctgccgcggcttcaggtgttttctttagctgaaccgccagataagcggaagcctcaccaacaccactcaggatgttctgagccggaataccctgcctgacaagcatctgcatcatgttctggaaatcagcagtagtgccgggcagtttattacccaggccaatggccagcttattaattttttcgaagtcagagccaaccgcgccgctggcgtccatcatggcaactttcaggcctgtcgcggcgtcttcctgtttggcaaaggcaaccagcgaacctgtcagcccggcagcaagaccgccggccatagccatgccgcccctgcccgcttcctctgcatctttacggaaccggcgcaggttcttttgcatgcggccaagcgcaggcgaaagtctgtcaacgccggtaatgagcgccttcagttcaaattcagccattggcttttcgctcccgtttctatccggttcgcctggtcgataagcaattgcaggctttttaagtcctcgctcaggacttccagaggatttatgcgccaataactggcgcaatcgaagtacagattaagcagctctttagctgtcaggcctgaaggaaaaaaccggcaactacccagccagcagcattcaggtctgatggcgacatgtcatcaactgagctgggtggaatgccgcccagctggctgatgtatttagcgacgacatgagccagcagcttcactgactcatcctgattcatctgatacggatagcccagctcacgcacatccttaccggttggatcgcgtagttccagcacatgaatagtctcaccatgtgccgtaataggttttgaaagctgaagttcactcactggaagaatccttctgtgccgtggaattcgaggtcaaccgtaccctcttccgggttgtaattggcctcaccaaacagaaaagcttcagacagcacgtacaccatgccgttagccatttccgaagtaatggtcatttggtctgagtcagtcagtttgctgatcgggaagtttttaggcactttaaaagtgccttttgtgtacggcgctcggtgcgtctctttgtaatccacgtcaccggccaggccgatcacgtcatcacgcaccttggtgttcatcggcacctcaatgccgccggtcagcgacaactgctggccatccaccttgaaatacgttgtacccgcaatctttgccattacgcggtctcctcgctgtattgcagacggaactgattaagcagcgcaaagacgcgcagctggttgacgtaatccggtgggaacagtacatccacgcgagtcgggtcgctgacgttgcgctctaccaccagatgctgcttgaagagttcgaagttctccacgatccccgcccgttccatcgtgcgatagctggcgcacatctcacccttcagcactgcaggcgtcacaatggcctgccccggaccgaagcgcgttccgtcattcgccagcttatgacgcggatacttgctggtaatgatgcttttcagctgacggataacgtaggcgctggtatgcagcgtctcgctgtccaggtagctgttatccgccacgccataggcgtttttctgataggtagtaatgtcgcgctgaatgcgcagcacaccgctctcagcgtaagccgtagcgataccgtgcttcagaagcgactgctgctcggtcagggtaaagcggcttcctgccggtgccggtaatgcgccggtcagctcaccggtctgcgtagggcgggccgggtcagtgcggataaacacggcgttgcgtgcggtgcgcagtgcgaccagctcatcagcagcggtctgaacggcaggctcataaccggctacggtaatgtgctggttgttcatggtgtcgccaaatgcaaccaggtctgacagcgtgccgattttcgccgtgtaaacatgaccgtaaagcccacgtgcatagccccagcgaccggaagaatcgttcatctccagcgccagtgtcgccagggaggcggaatcactgaacggcgtgccgatgaagtcaaacggctcatcgcccatcgcggccacggtcgcagccagtgacggtgaacccgtaccgcccgccatggcggcaatcgcaacgttaacgccgtcaggtgtggtttcacttcccacggtgccgtggtagttcagcgccagaggaatgctgttgccggtaatgcctttgtgacgtgcagtaagtgtcacggctccagccgcagcagcggcgatcaccggcaggtcggcgctgccgttaatggcagcggccagcgttgcagccacggctgcaggagcgtcgccggtcactacagcggcctgaacacgatctgcgccgatatacaggctgagtgaacctgatgcctgcgcattgccggtcagcgtcacggtgcctttggcagtttcgccttccggctcggttaccgcgataacccacagctcaccaaatggatcaacagcacgataacgcgccaccatgcgggccagctggctgccacgccctgcaaccttacccgcaagcgccgctgacggcatgatggtcagtttgtttttaacgatggtgctgtcggctgaagcgaggccgatcagcagtgacgggccgatgctctgcgtggtattcgcttcgctgttgtccatctccgcccagaacagcggcacacggaggtctgacggaatagtggggaacgataacgacattattcaccgccctttttcttggcgtcagcggcgggcttttcttcttccgcgctgacttcttcgacatcaccatccgcaatgcggcggtgccagtagctgctctcttcgacgttccggccttctgaaggcagcagatcgccccggacagggtcaggaaactgaccgtccgcgcttgggtctgagttgcatgatttactcgctgaggttgattttggtgtggtgttcgataatgccgtcaggaccattgcccggattgatgtagtcaacgtcgatttcgaccgttttcagctcgtccagggcgtcgagatcatcctgctgacgcgtgtcctcttcggtgatttcccgcgtcagcatgaattcaaactggtaataaaggcggccccggtccatatccagaagctgaccgccggaatacgccaccggccctgcgtctggatcaggctcccagcccagcagcgccttccagatttgctgccgcacgtcatgcacggcgtcataccctgccgcctgaccgcgctcgtcgcgcgtattgtccagcaccacgacaaccgcaaagccttcagttacgttctgccagtagtcagtcagggacttctgctcagcggtgacttcttcggtcggcaccacatacgccgcaggcagcttcatcttcccggtttcggggatagacttaaattcagccgccccggctacgttgcccgcgaacatcggacatcgcgcccggagagcggcgatcaccagtgatagcttcatttctttttcctttcaggacgcagggaggtacgcagcgcacgggtcagcacatagcgcgtccacgttttgcgcgcctcaagcacttcggtcatgtagtttttacgcggagcaacgcgccagccattaccgccggatttccctttgtgatggctctttttgcgcttagacccacgcttcacgccgtagaacagaaacgccgggtaaaagtcaccctcgataaggcggttaccctcaccacgcttctggtttggcgcaatgcgcaccatcaagcccggacggctttttgatgcgcggggaacgtaatagccaatggaccgcgccagcctgccgcttctgaatcccggatactcatccggcgcagagcgaccgcgacgcataaccagacggcgggcatcgcgcatatgcacctgaccaatctgaataaaggcgcggcgcatttttgcacggttaaaagtgaggtcttttggctgctgaaaatcaacgtgcagaagcggcttagccatacatctctccgtcgctttccacagccctcagctcctcgcactccatcagcaggtaacgaccggcagagttgaggtcgcgaaggcgcttgacgcgatacacataaccatcgtaaaccacctcaaaatctgacgtgatgccacgacggtaacggatggtcatgtagtgggttatggtgtcatcagcctgaacagattcgtgataggtagtggcacccacctgccggactttcgcccacacgtccttttcattctgatagaccggctctgtgccgtagtccgccgccgcctggtcgatgcgctggcgcaggtgaatgcgcttatttagctcaccgggatcgggcagcgtgtaaacagcgctggtatttgatgagcgtcgctgcatgctaataccccgacaccggcagacgccgcgaatagagcaggaaactcaaacgcctgcggcgtctccgtcatctccagctctgacactgaactgcgatgctcataccagtgactgaccagcatcagcagcgcaaggcggatatcttcggttatcaccatgccgtccgtatcaagaggcgcaacgtctgccaccgttttataaagattgcgattgaggtaagtcaccgcctttgcctcggctgccagcgcaaaaagctcaagcagccgatcctcttccgtgaagtcgctatcaagacggcactgctgttttatttcttcaagtgtcagcagcatgacaacgccttattttttggctttttccttcgcctcagctgccgctttcgcgctggcttcagcatccgctttttcctgcgcttcagcagcggcctttgctttggcctcttcttcagccttcgctaacgcttcagcttcggcttttttcttcgcctcagctgccgctttctccgctgcactgtcatccacctcactggcatagcccagcttaatcagctcacgaccatgctgctcggtggtctcaatggtgttaccttcagaaacgactgtaccgccaaaatagtttggtttaatcagaagcagtttcatgcttttctccttcaaagcggctcgaaagccgcccggtgacgtttagcttgctgccggcactgtaaagctgccgtagatgaatgcttcagggcgtttgacagccagcgccagacgctcttcacagcggattgagatcatgttcttctcaaagtcgtctgagttttcggtggaaatgaccacgttggcatcttcgcgatcaaacaactgcgccgcagcattaaacgcacccgttaggaatttaccctggaacgctgctgtttcagtggccacgacaggcaggccccacagagtcggaccggtcagcgcggaagggttagccaggatgtaacggcccagcgtatctttggtcagctcgatcttcgcccaatcaatgaagtgaagaacgtggccagatgccgggaaccgtgccagctgcgcctgcagcattgccagacgcagatcatcaatgccgttctgcttttcaactgcaaatgcagcagcaaatttggacgcctgcggcacgatgcctttcaggtgcgcaccggtgccatcgccaaacagaatctcctgctcttcgacatacttcaggccgtagcgcatctctgcatcaatagtcgattgcaactgagcgaaatcatccagaatctgcttggatgctttgaacatgtgcgcgatcgtagtgaccggcgtaatctgagtcgcaaacgttatatcgctgtaaggcttagcagtaccttctgccacagctttggcggcattggtaaagccggtctgctgaacccagaaaattgcaggtgaagatgtgcggcccggcgcaatcagatcgcggataaacaggcgctgtttgggcgcagtgtcgataccgggaatgcgctgaggttcaactacgccggttgccacgtcagttgacagcagcgctgcattaacaggaacgctgacacgcttaccaccttcaacgctggccgagaacgctttaagcgcttcgctgctgatcacggtctggcctacggtttcgatggtctttttcgcgttagccaggggcatctgcgcaacgtgctgctccagctcgcccactgatgccttgagagctttgttcgcttcattcagcgcattgaactcagtcgcgattttgtctaccgcttccttggtctgcgctgacagttgaccagagtttcttagcttctttcagtgcgtcttcagctttctgactgaaggtgccggacacctcttccagctttgcagatacttttttcagtaactcatttacatctgacatggtgattccttattagccgaacgcggccagcgcgtttttaagttgagcaatattttcggggttgatttcgtcggtagcgcccggcataccttcaggggtggcagcagcgcctgacttgctgccagttaatgctttgagaagttttcgacgctcagagcgaggagcatcggtttttgccagcatcgcgtccagcttgcgcagcgcagctgcagggctgtcatcgtcatcagcaatctcatctgccgccagcaggcgatcggcaaaacctttttcaaccgcatcactgccgccgatataggtttccgcattcatcattgcctcaatggcttcggcgtccagacctgttcgcgcgccataaatatcgttcatggccttatcgaagggctccatgtcagaagccacctgtgcaagatcgtgacggtttcctaccgcgtacacccagcagttatgaatcatgatgaaagcgccgcggccaatctgaacctcgtccccagccatcgcgataatggaggcagcagaagcagccaggcccagcaccttaacagtgactttcccttcgtactcacggagcaggttgtaaatcgccaggccttcaaacatgtcaccgcccggcgaattgatgttcaccgtcacgtcagcaccaccaatggcacgcagcgctgccgcgatgcggctggcggtaacgccatcgccgtaccagtcagcgccaatcacatcgaaaacagagatgctgttgtcatcactttttgcggctttaatgccgccgttccagcgctccatggcagatgacggcatatcgcgtttttcgcgcgcagaaggccgcccctccggcgctcgcggaaggcttttcagggtcattgattaatcctgtgtgtcggagggtgatggcacctgagtgccagaagtgttttgcggcgtcactgagcgatccgggaaaagccagctttcaagcgctgcccttgccttctctccgcccgagtcgccatctttacccagcatttcaagcggcgtgaggttaagctggacggtatagatatcacctccatcaatcggaggaagattctccaggcggcgcacgtcattgcgcgacatccatccgttttgcaacgcggtggtgtaataagctgagcgtccagcgctgtcagcacgcagcaggccttcaacggcaaattctgcaaagtaatcttcatcgccattgagaagacagcgtgagatttcctgctcaatatttatcagctgaggtcgcagggtgttggttaggaactgcatattcatcccttcaacacttgacgaccagctgctctgtttcgtcgtgtgtccgaccataaaaggcggaacgcggaaccagcgacagatttcttcaatactgaacgagcgtgactcaagcatctgagccgcttcagggtccatggtgatgccgttaaatttcagatcgttttcaaggatcatcatttttccggcgtttttcgagccctgaaacattgtcaggttgtcccgcagacgtttgcgctgctccggcgtcagggttttatcagttgaaaagaagccagcagactgaatgccgttgtcaaaaatttttccggcagcctgttctaccgccattgctgagccaaaaacttcacgaccggtcataattggcatcagaccacagactccatcaagcccgaagccacgtatgtgcatcatgcttttaaccgggatgatgcgtttaacgccattctcggtgtaggtgtactgaagtttcgccactgtccaggcgcttaaccaccatgcactgaggcaggagtgggatgagggaaaccagcttattccctatcattttcttttcaacgaaagcatttccgcgaaggcagatgctcgctaccaccataagcataaagcgtgatggcgtcatttcgctgttcgggcgacggcataaaacctgataagcggggtgatccttcgccagctttctggagccatcggactcgcgcagataaaccttcatcggcagagttgaaactgactcgcttaacaggcgaacacaggcccatgcagctgacaggccgattgctttttctgctgtcactgtttgtccgctgctacttttaccaagccagtcagcgaaaaactctccggttgtgaggcttattggtacgcccagccagttgagtaatgcgcttttcacccggccaggctgcttattttccttcatcagatacctaccatgatcgggtcatcaaaaaagtcatcaggattaccgctctccaccagcaccgcatcctctgctgcaccgattgccatagcggaagccaccacgccatcaatacggccggtgcttttctttttggcaaatatgcggttgtccttctggtcagcctcgagcaccgcagaggctgcattccagcgcaggcagggattaggccggatgatgagcacccggttattcaggtgctcttcgaaaagctcaattgatcgtggcatccacagcccggactcctgcgccttgtaaaagccctgaccatgcggaacaaggtcaacgctcacagactcgctttcgagttcaggctccagatacttgatgcggtactggtcaaacgcgatgcactttatatcgtatctggccgccagctcaccgatgcgcaccgccacaaaaccgtagttgaccgccttacccggcggcgcgtgaataaagccgttacgcagccaggcgtcataggggacgtggtcagttttcgcccgctcaagcaaagaatctttcggcgtccagaactcaaccaaaagctttttagattttggaaagtaaagcgccagcgccgtcaggtcacgggagccggacaggtccaaaccgccataacactcttcacccgctaaatcctccgggtcaaaatcctgttcgcagttcatccaggtgtcgctgtcaatccacggatcggacgcttctacccactggcagaagttcaggcggcgaacgatgctctcttttgacggcatgccgcgcgcctgtgtcacctgctctcgcaggtacttatccgtgaaggtctgacccagagacggattagctttgccccagcaggtttcatccttaaacgggtcgtcaccctcatccagtgaacagatgaagctgaaaaaactgtcatcaaccaggtcaccggcagcaaccttgcgcccgtactcgtgatactcataacaaacgctggttttatcgtggccgctgttggtgatcaggaacatcagcgcctgacggcggccttttgtaccggcacgcatcatctccacaacggcatttgttttgtgctcatgcacttcgtcaatcagtgcgccgtgcggacgcggccctgactgaccatcatcggaactgatcggcttgaagaatgagcccgtctgcaggaacgcaaggttccacacgttcaggccggtgccggatttggtaatgcgctgtgccagcgcgggcgactgatcgaccatcgtcaccgcatcgcggaacaggatcatcgcctggtctttttttgttgccgccgcgtaaacttccgcgcggggctctttgtctgccatcagcaggtaaagaccaactccgcccgccagtggcgatttacccgagcccttaccggactcgatatagctcatgcgaaagcgtcgcgttccgtcttctgccttccagccgaacagggagccaacaatgaaacactgccacggcagcaggatgaaaggtttaccctcatgctcaccgccattcagcttcagaacctgagcaaaaaagttaataacgcgcgttacagcttccacatcccagaacagaccacgccccggaccctcttccagatcgcgaaggtgacgggcgcatgccgcgcggatgtctggtccggcaataaccgcaccgctggtaacgtccattgcatactgcgttgccgggtcaaccgaagaactggttgagcgggtcttcttctttttctccaccattcacgttcacctttgaccgggcagccggtgtcaggccgaactctaccaggtagcttttaaatcgccggtctgcatcagccagcattgaaacagccgggttggctttaatcagaaatccgccttcggtctggaccgtgtaggttctgccctcttcagcaattgtgatccgaagctgaagaatgtcggcgtaaatatcacagagcctttccagcgccagcacatcggcaacggtcagcacgcccatcccgtcgagcaggacagtcagctttccccacgcaacctttccccaatcagtgaggtgtgacggcgggctggggatttctctcgcaggtgcaggctctttgtcgttgagttttcgcttacccggattgccggtaacgaccttaaggtgggtcggttttggtcgtcttccggccataaaaacctcccagaaaaaaacttttcatttcgcggttgtgcataaaaaggggggcgggcggtcaggaggtcgctaccccctgaactctgctcccgccctccccgatggtgatgataatcgttctcatctggcctgatgacccacctgaacacaatgataaatgatattcattctcatttgtgccaatgggatgacgggtcgagcggcatgccgtttctcatcgcatccgatgacgtgaccgcgcttctcttcacgctgtttggtcgagtcgtgatgctgcttgcagaggggttgccagttggccttgtcccagaagagcttctgagctttcgctatctcgtcctgtttgccaccattaatcgcttccttcagtcgatgtggcttgatgtggtcaacgaccgaagctgcgactgctctgccctggcgatggcacatgacgcagagaggatgagatttaaggaaggataaccgtgacttttcccaccggctggaatagattcgtgggttattcatctctaaccacctgatgatttaaaattttggaaagtgttttaattaactcatttatgtcttctatttttacaacggtggaacatatgcaaagctcaataggtagaaggttagaacattctttccaaagttttatttcaaaggattatgagagtgctttagttcattttttccctgctttagataaaaccgccaaaatcagaagaccaaaagaaggcgtcggatcaaggataaaatcttttctttcagacgaagaagaatttatctccttcgtcgctataggtgcattaatgaaaaactgcgctgctttcggagtgactttcccaacagcaatttataagtttggccgaacgtcagttatgcatgaaggggagctagatccccgcctgcaaattaccactggttcaaccttgagtattggtgaggtttggtcattgcctgaatcttatattagcgccatgataattgccgtaatggcagcaaaagaaaacgcaaatgagcgatttgagcgcaacggtttggtaaatattcatggtgtagaattcaacacgtctgatatttggggaaataaaaatctcatcaaaagtaaaacaaatatgccagacttatgagttcacattaaataaatcttacctacagtatttcattatcaggcgcactcgcaaatgcgccttgtgatgaactcagcaatctgagtctggacgggctacagcacgacacgcagccatgcaggcacgctgcatatccttatgtgcttcccgcaaccattcatgcgcttcccagttttcctgtgaattctgtaggcttgggtcgctctgcatatcgttacgatgctccatcaacagagcaataaactggcggctcaggtctttgaactgattcatcttgccgatttcgccataagagagcgttcgatagcccttaacggtgctgccgtcctgcggttttgcttcgctcatgtatttacctatctggttgactcgattttacgaatggcggcgcgatcaatgttgcattgccccagagcgccatataactcagcgttgaggcttacgctgtcaccgaacgtcatatcctgtgatggcgctggcacgtcaatctggctggtaagctcagccgggaggtttagctgaggttgttttactgtccggtactccaccagcggcttttgctgcgtcacgcaaccggtcagcagcatcagggggaacaggagcaacagcacacttatccgccgcaaggtaacgcttaatttcattctgtagtttccggttctgctgggctgttacggcacgctgctctgtgacctgactcattacatcgttttgctgcttaacggctgttaccagctcagtgacacttgatgccaggccatcgttcttggagcgcagatcgttaatctgctcgtctttgctgtttgccagcttctcaagcctgtcgttcgttgctttcagctgtgagttactggcgtttagtccccacagcgcgacgcagataagaccaatgatgaccaggcctgaattgtttcggataaagccgattacgttgaacatagaatccccttagattttgataagcgggatttccggtcgtccagaccattggtgccaccgttaatgattctggtgatgcggataacatcatcagaatcagccagctcgtttaatccgtgattcttccaccatgccgccgcagacattgcagcaaatcgatagcccagcaataaatcagggtttgccactacatcagcgcccagctgtttcaccagtgcctcatagttcgctttgccggtaatctgaatcagtccccgaccgcgatagcggtaaccatcacctgaatcaacatcaccattaccgttaaggtttgcgtaaatgatgctggcgatcatcttctgattagccacatgcatcgcattacgaccataggcgcgggcctgttctgcagtgatgcgcttaccaaacattgcggtcagcgcgttctcgctgtagttcagcccctcttccaccttcaggaacccggctgactcatgccctgtctgtgccagaaagtgagcctgccgtaagggcgtgcttatctggaaggctgagaggcttgccgctatatggggataccatgcatcacgcagcgcattactcacgccggtcgcaagctgaaaactattggctgtcagcattactgtctcccaatcgcttatctatctggcggcgtatcttcgtagacacgtagtccacaccgaggaagccaaggaagaccgcagcaacccgcgtaatgtcttcactgaaatgccagttgaacaccgaaccgattacctgaagacttggctgcaggaagaaggcgaagacgctgcacatcgctgcatcaagcagacggcgtgaccatgcgtctttaccaacgtaagttgctctcagaatcgccatgactccggcaagacccgcatagccggtttcgtttttgtgggcgtaaagccaggcaatcaggcttgcccagaacccaacgtctttgtccggcatgcgtttcatcctcacctccgttaattggcaggtgctgtcagtagtcagaagaaaaatgcgcaacaccacggcgtcagaagtgtgtgtggagactgattggtgtgcgcaaaaacgaaaaaaggccgctctgtggcgacctctttgtgtgggaaccctgacgcgaaagcggtaaaagccttgcccgtcggcaacagggttaattcttttatcccataaaggggataatgttttcgccatcccttgcaggggataaggcaataaaaaagccccatcagctggtgaggctgcggggctttcggacatccacttaatatgcaactgacccgctaaaggcgaaccagataaatctttttagtgcggaagactcataaaattcccactatgaggagatattaatccattcccggacaaaagcaacagttatctttggctggggaatctttcatttcctgttattttctgaaaggtctggtcagcgtgagactcttcctgctctaacttagccaccagcgcatcaaagaacggccgccagttgcggttccacgtcctttcctgcaggtcagggatgagtacgctgatcgccctgaaggcctttgtacccggtgaacgggtaaatcccctgccaccgcagcgctcacaattcttttcgacaatggtgttggtgagcctggacttttcaatgtcacgcacacggcctgtaccattgcaccggcatcgctctgtcacggctcccttgccgtgacatgtcacgcacatcttttccagcgtctccagccggtattttggcggaacgtaattatcgttgtcaggtgttgaacagccaggatggatcataacgtgttcaatgctgttggtgatgccacgaccgtcacagtcagggcatgagtgggtgcttgatgctgagcggacataatcttcatatgccagcttggacaggactcttatacacgatggcagctttgacccagcggctttaagaacgagttttggggtaatgcgtcgtgcatggaccatcagcaggccgattacacgatccttatcttcttcactgacgccggacttagccagaaacggcggcaattcccattggtgactttgactgacacatcccgatagcggccatcaggtctgtacctgtaagcccttcactgcccgttgcacgggaagagtcactgatctgcagactcttcggattgaaatgcttcagcgccgattctattttcatgctcaccttctccacacactttattttttatctgtcccaataacgccgactgcaatcgcgaaatccaggaacctgaatagcagctcaacctgactgccgtatttcgactcaaaaagttttgggtcgcgatgtaactcgtcgtgatgcgccctgcaaagcggtatcacgaataaatcatgggcctttgtccccattcccccctgaccgtgcccgatgatgtgatgaggatcgtccgcctgtctgccgcaacaagcgcagctctgtgacttaacccatcgtgtgtacttctcactctcccagcgcttacgcttggggcgcttcatgaatgattctggtgattccgggtccgcacggaggctgattatctttttgacgacctgtgcagcatcctgaattacctcgcgtgccggacgcgccggaataattctggcctctttgagttcgccagcctgaataacctcttttggcatacgcagaacgcgcctggccggtgcctccggtatgagatcaatcaggtcattcagtgaggcccaccaacacagttccggtaatgtcagctggtggtaaccgctgagcgccatctggctgcatgcagccctgattatccagagggcggtattgcctttggcgatgttctccaggctaccgggaacgccgttttccctgaattcattatcgtggctgtagcaaagtgacaccaggccgttttcgatttctgacactgtgaactcatggtgatgccatgcttcgggctggtcccactgacagcagccaaatgactggacgaaagatgccagcgcaataggcccaccagccgccgctatcacacgctcgtgaccgaagaagggaatcagcgagggttcatcaagtagcggctgtgtgccgtcattcagccgccctgatggcaggtctgccatgtccattgtcggagtactgatcacaacgcgagacttaaacagcttcatcagttccggtcccggcctgaatagcacaatccctgtgcgcggcgctatttcaggtgtaagtaatgccctcactcagcaccgcctgcagccttatacgccgtccatagcccgccaatccactgaatgcccttcgcggtgaagcgggattggctaaatgcatagtttgaatcgttggtggttccggttcttacctcaaaccgacccgcttcgatatgctggctgtagggtgttagcacgccgctgagccggtacataatccgactctcaatcaggaacaggcgtaattcaggctctttggcttcaagaagttttgccaactggcggaatgtcattgaacctgaagccgtaacataacggtcaacgaaacgcgacctttggcgcggcctcagtcagctggatttgcaggcgctctttctcttcctccatctcagcggctaagcggagtgcttcggcaaatgtctgtggaatcttagcgggctggcctttctccagctcctgccagcggtcaacgaggcgggccgtgaactctggtgagagctgagcaaccacaacaatactgtctcgtttgccgtcttcaccttcaaaattgtaagtctcaactttaacagcgtggcctaagttattgattctttcgacaaacgccattggcggtcttcggataacgtcgcggtcagccaatctttcaatgctgcgcttaacgtcgctgtgacggctgctgacaagttcggctatttcgatgctggtaatgccgggaatggcattgaaaggacgtgatggcacgaggccaccagaaatctggttaagcatgtttctctccacacactggaacaacatttttaaatggccccgccccatcacctgcaagtgagcgggaccaaccttggcacggcgactgcaatcaccagtacagcactcactatacccaattttactggtcatgtaaccagttgcggacctatgccgctaccggctgaaactcactgattaccacctcagatttaccgcccttggttaccggcccccactctaccgagaatcgttttatctggctgtcatcgccccatataccggcatgtgtgaggctatcgaacaaggctttgaggtagttatctaggtcgcgctggcgcttgtctggcgggaacagcagcacggtaacctgcacgttcactgtaatcggctgtggtcggcgcttaagctgctgaagaacggcggcaaatgcgttggagcggaaacagcgcccggaggcgctgatcaatactccctttctggtgttacgccagtacgtgttaacgcttggcgggaacgggaggattaacttcatgcggcactctctcccacatcagggatagtcatctgaccaaccacctcgcggactgcctgacgcagcatgcggatgtttgaccagcagtcgcggtcggtttgctttaccagcgcgataaactcctgaaccgtgcacggctggtcctggcgaatctctgacaataccgctgagaagcgcatcagttgctcagtggcaacgtctgaatcatcgtgctgctctgacagccacaacttcagttcaagatcgtcctgatgctgcttgatgaggcgcactgcactggcaatagtctctgccggaactgttacgcaggtaggattctcaacggagtctgcagcccaggtgtgcgcccacttggattcactgtaggtgtactcagctttcattttgaacgcggcaataacgcaggcccaaacctcaacaccgctttgctcaaggatttcgtgcttcagcagtggcagatcatcgccatagtctttttcagactgaacaccttcttcgctatcggccttcaggtgctcacgctgctcaccgtcttgaggttcgggccacttgcgggccttgttgacgctgagcttcagttccatcgcggcgttaagctcttcctcggtaataccagcgcggcgcattgcatcccacagcagaaactgaaggtcagcccattcggacaggtcatcgggcgcttcagctgcttccatcgcttcttttgccaggtgcttcaggggtccgaccggcccaacgtcgccgaaagtttcctgtgaccatgccgcgtgctctgcacggattttttcgcgcagttttaccggcgatacgatagctgctgagcgagtcagtttctttttgccagccgcttttgccttctgcatctgctcctgagctaccgaagatgctttcacgccatgctcacgctgcagggctactgctgtggtagcggccacttcgccagacttcaccatctcaatcagcggctcgccaacagtcagcaactggagatgctgttcaacgtcggtgatagaacgcttaaccttggcggcaatctccgctggctctaagccctgattaacgagtcgctgataggctgctgctcgctccagcggcaaaagggcgcggccctgactgctggtgaccatgaatgccacgctgtcagcttcactacccacgaaatccttacactcaaggcgcagcgtatagcctgcttcctgtgccagtttcgcaccgtagtagcggtgatggccgtcgataatcttgatgcccttctccgtgaccttaacagccagcggaggcacatgctcaccagcgataaaggcgtcccggaattcctcgacatgggtctgatcgatatcacggatgttgtaattagtttcgacatatagctcatcaacgcccagcaggtaggttttacgggtggtgatgtcggtatcgctgtttttcttgtcgtcgtaaatgcgcgctaaagtactcatgctgtggtcatctcccatgtcaggacaaaaatcagtgcggcaatcatcactactgctgtgcggatggcctgatagaaaatctcgttgcgctcgtagtggctcttcaggtgcgctctcataacaaatccctgttcacactggctgaaatgatgcggccggtatcaagtccgccatagctgccgcagttgagtgagcccttcacagcgcagcggtcgcagttctctttggcttcgttgcgtgaggcgtcgaacttcgccaccagcattgcttcacgccatacctgagctgcacgcagccagaaccctttactctccagttcggcggccagcttcgccttgtgactgtatctctcgctctcaaccggcaacgggtcggtgttgatcgagtagctccagtcgctggcacgctttagcagacccttagtgaacagcggtttgataaagcgcttaactgacgtctcatgcaggccggtaagcttgcagaggtcgcggaccttcagcgggccgttacgggtaatcagttcaagaatttttgattcgtggttgatcatgatttgtcccccgttaaccgcgaaagccgtgaggcactgagctatcaggctgaggaatcacagtgatatcccgctgcatgttgcgcttcagggcattccactcagagcgtggcgggcgaccggctttgtcccatttggtcgctgactggagatagccaggcaggttgccggggatgaacagcgtcttgggccgcatgtactggtattcctcggtgccttcccagtgggcgtgtttgtaatccacaaccagacaaagctcctccaccgtgaatttgtctttcagccgggatttgatgtgacccatcgacgactgcgcctcggtatgctttgcgccggtaattttgttgaggtgacgtaaaacctgacgtgatcgattgataattgaccactcatcgtctggttgcgacgcaacctgacaaaagggttttttatctgatggatcatgttttgaatttactgacggatcgtcgccagattctggcgggtcaaaactgttatttttgctggattctgacgggtgaaaatttgatgcgtcaaaattcggtgcatcagattttgatgcgtcatattttgatgtgtcagattctgacgcctcagattctgacaggtgagcagcagctgattcacgaagctttttaatgttcagctgatacatgttggagttattacgattacccttgcggcgtgacgtgctggtcagccagccttcactttccagcttgcggatcgaggtacgaacggtgctcggaccagcgccaatctgacgggcaatggtagcgattgacggccagcaaacaccttcatcgcttgagaagtcagccaggcgtgccatgatggcaaccatagtgatcttcatgccggatgatgcgcagccgtcccagacgaatgctgataatttaacgctcatgatttaccccaacctctctgaaatattgcctgaaccgttcgagagagctgaagcactcgccatgttcgtagttgtcacgcaggtagataacccggtcgttctctggctccaagcgaatgacccgcacagggatgccgcgcttgtcgcggaagattcggtcgagctctcgcatttggtcgccttcattcgctggttagcatcgcccacagcccagctcacaaagctgtggttaacttcttcgctgacgccgggtacattaagtacataccgcagcggctcactgctgaagcggccaccagctgagggaaggcaacggaattgcggtaatcctgattttctggttaaattgatcacgcgattagttctccacacacgttgatttagtcgcatcgaacgccgcggactgcaatcctgcggcgttcaccttttctggcgggcaaaatacgcgatacagcagcgtcagatgctcctgccacttagccatgacctgatagctgttctcttcaatctgctcacgctccgccgcatcaatcacaccgtcagctgttgctttgcgaatgtaagcagagtgcttaccgatccactcaactgactccatcaggcgctgattgatatccgcgttatcaacatcctcaatgtccaccagcggaacgttgacgctgtttgactgacgggataccgcattagcgatgtgcttggtgccgcttgcctgttgcaggaccattgcccaacccattgggaaaatctgatctccattagtgcgcaggcggttgaacagcgcatcctcggtcacgcccagccattcggcagcttctgcatatccacccggaagacttgagatagtcttttttattgctgtcaccagccatgccggttgtttttctacttgccagtgcttctgatccacgattaagcccttttgactgtggttaaaattagaaagctgtcggtatagacttgtgatcacacttacgatttgcagggaacggcttcacctcttccgctgaaatcgtcccgtcttcatggaggatcacggtgatgtcacgcttgagtgaaatcgctttaaaaatcgcgctctggtaaacgcctaaatcggttgctgcttttgtctggccaaactgttctacataatctttgagttttattctctggctcataatcatctcctaatggacaggcttaattatcaccgctagaggtaaaatagtcaacacgcgcggtgttagtgatttatcccgtgcggtgataaatttcacatatgaatgctaagaaaaagccgctcactaacgagcaaatcgaagacgcgcagagattgaaatcaatctatgagcgcaaaaaagctgagttgggtatttcccaagagtcagtggcggacgctttgggcgtaggtcaatcagctgtcgcatctttgctaaatggcgtaaacgctttgaatcccagcaatgcctcagcattagccaaatttttgaaggtgagtgttggcgagttcagtcctaaaattgctgctgagatcgctgatatgtatcagtcgataggtgaagaaagcattaggtcgaatcactatgaatatcccctgttcacttatgtccaggcaggtgatttttctgaggttggtagctttacttccagagatgcaaaggcatgggttccaacaacgaagaaggccagcgataaagcgtttctggcttgaagttaaaggtcactcaatgactgcgccgcagggtgttcgtccaagcttcccggaaggtatgctgattcttattgacccggcagaaccggttgagacaggcgatttctgtgtggcatctgctaatgcagactcagaagtaactttcaagaagtatgagaaggatgctggggtgagctatctggtaccgcttaatccttcctacagaatactggattgcgaccacagctgccgcatcataggcaaagtggttaaggctcagtggcccgaagagacgtttgagtgaagattttgcggcatttgccaatatgatgtggtaccagtaacaacattccaacaagccgcttgacccggcaaccgtgccgggtttttatgcatacagcacctgcaacttttttctaatcatgcccctcccagccaatcctgcagcccgccactgagcggtttttttgcccggaatattagaaaccatcccgccctgatgactaaagttttcactaactttgacgatgatctgactgagcaaatcgatgctcaaatgcttctctattgaattctttgtaatgattagcccgcgtccggcgggctttttttatgtctgcaataaaaagcctgccgcttacgcttgtcatacatttgttggcttctaacctttagcgtgttgtgagacggctagtgctcctaccactggctgatgagatgcacggctggctcgtcaggcatcttgtttacaacgtttagaggccgtttaagagtttcacaatctccaccgcaacttatgcctgctacccgcctcgggtgcaggtattttttttgctcgtgacaatgcttaccggcactccccatggcaatttaagctttcatctctaatcggggtttcctgcaaaaggtgctgtgcgtaacaaattattgaacatctatttcctaaatatcagaatatgagtactctctctggcgtcagctagcgctgacagatggtttgccccatttgaacgaattgacgcccgtgtaacgcgggtttttttgtgcctaacgatccagcactttcgcagcaacttccattgctttgacaagcaactcagagcgggccgggttctttgatgccagcgccgtttctgagagcatctgctatcactatctgcttcgactcaaccccataatcgtgaagtgtgaacactacgccaccgacaaccctgcacatctcgtcatagagctcatctgattgcttagtcataaagcctccgctcacaaaacacccaaaagccacattagcacacaccaaaattgattattttgcgttcaaaaaaattttaatagcaggccaatcaacaacataaacaccgctagaaatataatatctctagcggtgttgactgatttatcacttccggcaataatgagtccatcaacagcgaacaggcaggacgcccacgaagtagccgcccgaggcgtaagaagatcgggatgattcgctaagcaagttgcagtggtgtgagggcggtgctgtgaaaatgattaagaacatgtcgaatacaacggttcgggacctgattacctttctgcgtctcttcccggatgctgatgtgatctgctgtggtgatgcaggtgtggtgagtgtgcagtgtgatgttgaaaacgtagttcgcggtccagcgttttaagagtactgaattgctgtgttggcggttactcatgagggtttgtttaaccgccctttttcacaacgataagggcatttgcaaagcgggtgttttcgaacgctttagagacgtggagtaagtgtccttttcgttgtggtgaatgcggctagcgcacgcggaagactgactacgaacgcgtacagtctaagagtttccgctttggtgtttgtcagtctgaccagagcaccgggaggcacccggcaccgcagcaacctttcaagtgtgtggagtaatcgggctgtgggttattgcagtagctcaccagccaacttaaacgaatcccaaaagttttttattgccatcactggcaagggattcatgcaaccaaaaatcgtgtgtggagacagaaatgagtaacgaaaacaatatagctaacagtctggcaacagcaattgcagctcactgctcagagtttgaaaaatcacctgaattcgctgacatggtgcgcaagcacgtcaccagcctgtatgaagaagccattaaagacacgttccgctggggcgagttcccgaaggcggtgaagaaggctctggaaggcgcgttacctgccaacatcagcgagctggtcgatctgccgcgttacaacctcctgatggcaaaagagctggctgcgacgtgggaaggtaacgccgtttctgagcgactggttacttcgatgcgcgagcatgtggtgggatttgtgaagtcgcacgaggtgccgaaattcatcaaggcatcacagctatggcaagcctactgcgatcagcacgaggaagaggctgcccaatacggctgggagagtccgcaggttgtcattgatgacgaacgggatggcttcttttacatcggctttgagaaggagcctacgaccgaaggctcatcattccgaagcaaccgcaagaccagcgcttaccagtgcgaggtgttccttgggttccatcttcgggttgatcgaagtgaacgcccaccagtcccgttggaagaagatggtcaccctctttacagcctattcgctggcaatctggacggcgacgcgctcggcaaaaggcctgttcagttccgaactgaattcgaaaagttggtagcggcgctttattacggagacagcctgctcgtgctcgacactgatgatgcagacgaaatttgttatccaggagtctactgagatgcaaaagcctgatgatcatatcaccgttggcatcattaccctgccctacagccatatcctcaacggctgggtcatgcctgacggttcagtaatcactaatcctattaaggcgcagaacgaagcagagcgccttaacagcaccatcaccattcactgagggcgatgacatgcatcacttcaaatcgaataaagaagtcgtcgctgccggtcaccagttcgctaaaaacatcgggatggatacacctctgatcgaaatggcaaagatggtgaccgagctttcatcgcgtctcgatgttgccaccgttcgcgccaatctgatggctgcagaagttctgcgcatcaatagcgtgctgcctgacaccattaccgcgcttcaggctgcaggtgcagacctgacgctgattgatgacctgaacgcagcgctggccaccccagcatgtgatcagtggattcgcacactgcgcggtgaaactctcggcgaagcccgccgtgctgtaactacgttgggtaaccaccagcagcctggcatttcacacgcgatcaacattatttcccaaatggaaatggatttgattcgcacacgtactgtaacgctgagggtggtgtcatgaaaaaggtcgcacaattccggcgcagcagcggggctaatgccggattcagtgaaaagttagcctggcagttatcaaaaggcccggcaactggccgcgagctggcagaacgtctcggtatgaccctgagtgagttcaaccgtttagttcttcacataatgcgcagaggtggcgaaacgctgcaggttgaagccactaatcaaatctgtctgggcggtggctctattgaccgtacttacaccttggtcagaaatccgcgccgtgttgctcgaccgccacgcaagccaatggtgatcaaccacaggaatgactcctctgaagaggcaaggaagcgccacagtgaagcagctaaacgccgcgcccgcctgattgccagcgggctttatctggaatgcatgggttaaggagacgattcaatgagcattaaccccttagaagttcaacgcgaccaatatggctattggtctcaccctgattacctagcattttgtgatggtcgtgaattcatttctaccgcagagtttaatcagtggatgtctgagcatggcttgcagtggaaagttgagtatcgtgatgaagacatgatcgatcccaccgtagatggttgcgatatctctgcatggcaacctgaaagccctgaaggtgaaggctggtttgttggctccatccatgacactgaagacggtgcagtatgcatttggctccgcgccgttaaggatggtgagtgatgaaaaccattatccgcatcgaccagatgaagctggttactgcaatcagctttgaagtttctcgccaatatcccggtgtgacagtagatgctgaccagttcaatgccattatcgcggcagccaatagcgtgaaggctgcttacgatggcactgaagttgaagctgtggaagaggatgaagaagatgcgtgagcgcccaatcatctttaacgccgacatggttcgtgcagtttctcgacggcagaaagacgcagacgcgccggatcgtaaacggtgtgccatccagtcacgatttccacggctgggttttaagtagtaccagcacgaaagacgaaggcaaagcctgctgggctattggaaagtcaccgctgctgaaccagccaatccgtgttcgttgtccgttcggtgaagttggtgaccgcctgtgggtaaaagaaacgtggtctgttgtgagccacgcattcgatgatgatggcctgatgattgattacgttcctgaccgcccggcaaaggcggtacatgagaagccattcggcagaggttattactctggtcacgctatttacgctgctgacggcggttttacgtggggtgacgatgatggctgcgttgatggccgatcatgttggaagccatcaatccacatgccgcgctgggcttcccgcataacgctggagattaccggcgttcgtgtggagcggttgaacagtatcaatgagcatgacgctatcgctgaaggtttggctgaaataagcaaagacgggcgaacctataaatacggcgttcctgatcgtgacggctaccccggcactgatgattttggctggccgtggcatgagtgggagcgttacccaattagcgcttacagcaagctatggaaatccatctatggcgatgaaagttggcaggctaacccgtgggtgtgggtcattgagtttaagcgcgtggaggtggagtgatggcgctgactcacggagaaatcaactcgattgcggcaaaatggctaaaacgcccactgagtaacaacgggccaggttgtcaggttgcactgactgaggttggtggtcttttcggaggagagcgtgcggatgctttcggctaccgctggggatatgacggcggctcagttgttgttgagagcaaagtaagccgctctgacttccttgctgaccgtgccaaaccccacagaaacggcaccagccctggcatggggacataccgctattacatttgcccggaaggtctgattaatatccctgacctgccccacggatgggggcttttgtgggtaaatcagcgtgggcacgtaaaattgaaggctggccatgtgtgctgtcacaaggtcggaggttacggaccggcgcgtgatatggcgctgtttctggcagcacccggctgatttacgctttgagttagacatgatggctcactcactggtcaggtttggcgatccagaagaggccaaagagatggtgcgcagtgctaatcgggaatacaaccgggccgctgcggaagtaaataggctacgggaagagatcaaacagtaccggacggatgcttaccgcctgaaactgtatgaatctcaatatggggacttgtccaatgcctaaatcccccgccgaacgcaaagccgcgcagcgtgccagacaggccgctgccggtggtaaaaagctggagctgacgctggatagtcaggaactggagatgctggcgcataactgcgccgcacgccgccccggtcgtgaaccgtatgagctgaacgagtacatagcgctgttaatccggaaggatgccgctgagctggagcagcaacttgaggtgctggcccgccagcagtgcggaaagtgcaaagagcacctgccggtgcagtcatgtccctgccagggtgaagcagcatgctgggccaccagcggctggcacgaattgaaactgaagatcggcacaccgtgacttgtcacgaccagaaacctgatgcaggaatgcatgcggcaacaaggatggctattattctgtgacactttcaacgatgaaatggaaggatattaatattcacatcataggaaatcatcattttttataaatctgattctgtcgggattagtgcgtcaatgatagcaatcatctataatcgctaattatcggagtcttaatgttgatagacacagttaatatcaagggcgggggtataaagaaatgactatcatagtggcattatgcagtttaattttagcctgtgcatcgcttaagtttaattatgacttgcaaactaggcaaacgctgaacctttatattcaaaggtgcaacgatgccacaaaggataacgtattaaagtcatcaagggaaagccttggaacagtaataacaagctgttgcaaagcacatgaatacataaaaagctactcaccgccactatttttgagatacgtatctcttaaaaaattagaaactcaaaagaccgagctgaagaattacatgtgggatttacttccattcgctgtttgggaagaaattatccacaaagaaaaattagccgagttcttggaaaataatgggaattcggttagagataagcgtgttcttgtaaatcaatacaaagatctttctagggatttttcagatcagataaaatctgctggctagcagattgttagccacccagtggattttgtatggctaaaataaatccaaaatttattaattttgaaaatcctgatgcagcaggaatgtgtggagaacaatatgcaccacgactttatgagtgaaaaagaagttatggccgaaattggtaaggcgagaacagcactctggcggctgcgtaagcagcatggctttcctgcgccagtgctaacgcatccggcgcgttatagccgcagagcggtggagaaatggatttgtgatggcgggattaaccgagctgtttgacgtgccagaatattttatctgcgtacgcctcatatgcctttctttgatcttccagccagtcgtgtttgttgtacacagccatgacaccgccaagttcatgccccagcattttctcagtgacatggggcatgatcccttcacttgataagttagtcaccaaagaaacggcggaagtcgtgggtgcgccattcaggaatatcaatcgtctctctcagcttacgcatatacagattcgatgaagagcggtcgatggctttatcaagctcctgccccggaaacaaaaccttattgccactgttaagaaggcgctcaaccataggcttcatttgttcgaagatcggacgcctgatgatgttccccatctttgaatgttcggacggcgtggtccatatccaatctgtggtgttaaattcagcagcattagccaggcgaagctcagacaaacgagcaccccaaagcaacagcatctgatgcagtagcctgttggatgtaacgatcttgctgttctcaagcgccagccagatttttgccagctcgctgtaggtcagaacgcgatcaccaacatcaggcttcttaccgatatttttgacactgagttttgtaatttcacatgagggtatcagctgtcggctgatgcaccagtgaatgacggagcggagttgaagcaacagaaacgcgggcttttttcttgttcagcttttcttgtttatcaaaaaactgcacccaggctgatacagggatgttagcaacgggcacatcctcaaactcgttgtacatggtgttgtacacaaccgatttgtacagcacctgggtattgtgtttgaggcctttaacgtatttttcccaccagttatcgagacactctttcagagtcagctcaccagtacttacggcaaaataggtttttgggttgacccccttcgtgtacaatccacgcatctcaccaacggcaatgcgggcatctttcaatgatgttgaagggtagcgaccgacagtgagacgcacaggctttccattccagcggtagcggtgctgaaatgtaatcgtgccagatggagtgatgcgaacgctcagaccgtcaccatcggtgagttccgctggtccgttgtaagctttgccattgatgcttcttaatttggtgtcactcagcgccacaataatttcctgtacacaattcctaaaggcattctgtactcaatgtgtactcattggcaagtgaacgaagcaatgttaaagatgaatagcgggaaaccgagcgaaacaaaatagagcataaggcttgtaaaaaactgaggttttacgataggatgcgaaccgtcggaacaacttcaaaacttccgcgaacaacgtcctcttagttaaatggatataacgagcccctcctaagggctagttgcaggttcgattcctgcaggggacaccagacctgccctgtacttaaacccgccctatcaattaaaactcttaataatcaatatcaagccattactgacggctatccccctttgccctttttcttctcagaatcaataatcatttgccggccctggctatgttctttaggcaaatccatcaacaccagtgaatgagttgtgattatgacctgccaggtctgggttattagctggatacctgtgctttaaatatcttttttattttaatgaatcctgttttatttctgcataacgggcaatcagttgcttcagatgcatctccagctgagctctgacagccgcaggcaaaggttcgcctgctggattttgtgacaatacccttagctgctcttcagccggtatggattgattaaaggactgcatagcggaaaaaacgactgacttcagctcactgaccgtcaggtattttcctttctgcacatccagtttcgttcagcctgtcactcagtttttgtagtgtcgccattccctgagaccagccattcagctgttctgttggcaatgcggcagcattaagttgttgctgccactgttggattagtggcttagcctgctccggccaaagtacccggacctgttccagcaactgtcgactgtattcaatattccagtcaggaggcaatttacccagccgggcaagctgctgctgtgtttgtgttattaaaacctgtggtaacggagcttgctgacgccacatatccagttgttcaggcgtgagagatgcaggcaatggagccagtgaggctgcaagctgagtctgcaacgggactggccgattaagaaactgccagctccatagtgtgactgtgcttaccaccagcatggtacacatcccggcagcgaagaatttccatttttttacctgattgggcattgccgccattgcttctgcattcgcctggtgttccggcagtgccgcataaacccacttcactacgcttgctgacgtatcttcaggcggactaccagcaaggtccctcgtggatgctgcggcactattcatcgcggtggcaggcaacctgatacctggctgaatgtccggcctggtgctggttatgccatcgctgtgttccagcctggcagcactgttgtgcatcaaggtacgtaacgtatcgagctggctcagatgcttaagctccaggccctgcagcacctcacccagagcggtaagctgttgctccgcccgatacagctggctgaggtcgctgtgatttagcgggagcgagcgaatcagttgctgtaaacgctgactcagactgctgaggattttcatgcgggcatggacaggctgcggccagagtgcgccccactgatggcttatcagtgcctcgagtatcgccagaccttcattgagccccaataaaccagccagttgcgttcgggccagcgtgtaccaggacagcgtctgtagctccacaccattctgctcaaacagtgagagacagcgtttttcggcataacgccagttcacatccgggcgagccggatgtgtcagcttactcagttcatcacgcagggcggcataatccggtagcgtgcgcgggtcaccaccggttttgattttatgtggggggatgtgattcatgaccagttgtccattttgacgcgtacggaaatatggaggattaacgcttatgcgggcatattcagaggaacgggtactgcaataccagcagttatggcagaagcgccagaatcagactaaaaaaggtgctttcatcaaaactctgtccgggacgggataatgctcccggcggagtaaaggaccagtcactgaaatgacctgcccgcatgaaaaggcgccccacagacgtcacactgccttctgcatgaagagtcacttccacgcatcctgtcacgccctgaccgtacaaaaataccggtgtaaattttacagagcgatcgtcgtaacgcagggtgatagcggcaatctcaaaagtcctgtcctccaccagcagatccgtaacagcaacggtaaatgtttccacattcaatccggtacccacccagccacgcatccatctgctcctgaagctgcaccattcgcaggcgaaactctgcaatatcggcctgagtcttgctggtagataagatcggggctggctctctggcctgtagtttttcgaggaactgtgattttactgacatggtattaactggccttacagccgggttgctgtgtcgagatactgctgttgcttcaggtgtcgcaggagaacccgcccttctggcataaactctgtgccatagcgtacgaggccaacaccgttaagttccgcatcaatggcgtagcgcaactcaccggggatgttctgttccagcaggacaacggctatttttctcaggcgtggctcatatctgagcagaacagccgacagagcacccatcagttcatgggcagtccccggcatgccctgcaggattttggtcatatccggcaggccatagtccggcagatgcgccagcgtgccagcacggcagttaaggatccgttgcatgttatcgagcacggacaaaatcacctgattttgttcactgaactgatggagatcgaggccgccggtgaagttgccgtagagtgtttcatacaatgaaggacgggataactcactcatctttcagcgcctgaagtgtcagccggttgttccccgcctcaatgacgcgtgctttatccggatcgagatcgtcacgactcagcaccacacgccaggtgttgttctcctggtccggtgacataaacatcccggccaccgccacatactgcgcactctcttccatcggcatatcaaccgtcactgccccacccggctgcaggcggatgtctttctccgccaccaggtctgctttgatggcctgactgtcagccttaaacagtgacggatagtccgtcatgtcgaatgttttccggtctttgagctggtaaatacgcaccaccgtcgacagcgccaccccgcctgcattgctgttaacggcctcgcgggcgcggatatccagatgcagggtttttacctgcttgtaaaaaatcgatttggtcacggcaacggtgccgtccgtcactttctgggtcagcccacagccagcgagcatcagtgtgatgcccgcggccagtgcaaccagaggaaatttaccagcggtaatcgccatcttcatcggtctccctgcggtgaatattttcctgtacccgctcatagcggccaagattgatggttatggttttggggtgcatgacggtgttcgctgcattcagcggccgcatcacggcggtacggcccagttgcacggcacctgcctgcggtttactgctgatggtcgcgtcaggcagcagacttcggtcgacacacagctgtaaccgcacatcgaggcgggagccaagatagacatgcagcagcgccattaaatccgtgtgaagctccccgcccggtaaccagccctgtacttcagccgggtcagaggtagtcaggcgcatcagcacccggctgttcacgtcggtggcatagctgcccatcaccggacggtttgtcagggtgacgggctggctgacgctcatggtcaggggctttttcagcggcgcgcggcgtttatcgtggtgccagattttcgcctgtgtgttgggtgccagcaggcgcaccagcgaggccatgccttctgcggtacgccccggcagcaacatgaccggcagcagtgccagaaagcgtgaagccggagtcgcgatactgtccgtgcagccgttaatcccgagcccggcaagtcccagcaggtactgcgaggtgttgtccttaccgccttcttcgaaagtcgccgggtatgagtatttacgccagatacggtagtactgggcaatcagccggtggttgaagatatcgaggaaatccgcggtggcctcatacccttcccgtcgctgggtaatgtcatcgatatagtgcgtcggcagcggggactccacgccgtagagtcccataaaggtgatgcgcacagtcggcggcagatgcgaatgctcagactgctcaatacctttaatttctgaagccggaaaacccatccccgggtgtggccgaaaacgtaccggttcatgacgtacctgccaggtactgcccgtaaccggtttgtccggctggttctgctccagcaactggcagaagcggtaaaagttgatatatggcagccggtcccccagttgcgctatcagccgggcaggcgcggactgtgattctctttccaccggatgcattttccttctggctgaacaatgagggtgagctggttaaactggttcatatcggcatacagagcaaagaaccggtttagcatttcaccgaacaggtgaatatcgccctcgccggtgaagccgttgctgtcgagggtcacttcgatatccagcccccgcagcaggtagccctgctcaaaacgttgcaggcggtggtgctccacctgctgaatcgcctccagacgccgggtattcagttcatctccctgccagttatagagtgccagcgtcccgcgcagcacttcggcagtactcatcatattcagaaacccggagccgaggtggctcaatacccgccagtggaaacggtcttccgcaggcgggtaaaccggcagcgtgggcttacagaggttgcgtactgaaagcggtgtactgaccacctgctcactgcggtcgagcagcgtgctctgaagtgcccggcgcggtaactgaccgttggtgccggtgatttgcagcgacacggcttcacgctcaaacaggcggtcatcttcccactggtgcccgcccagaatcagccaggtgtcatacagcccggtgacaccccgcttaacgcgggtgtggtaatagcggggtggcgcatgacggcgcatcatcccgcccttgtggcggaagctgctgaacggcacgtattcggcatcactggtgcggtttgaaccggtaaccgaatccaccgaataaatctcagtatgcccgtcctggagccgcttaggacgcagcaggtactcactttcaagcccggtgatggtgagagggtcagcctccagcgtaaacaggttaatcaccggcacgcagtggaggcgaaccgcatcatcggtgaccggcaggtctgatcgccacggcgtgctgaagaccacttcgatgtcgaagtactcagccccggcaggcggcgtaatgtcgtccagaccgttgaggtggacaaacataaacttgttgcggaaggtgaaatactccagcagcagctggtagccactgaatgcggtgtcgcctttcggccacagcccatcctcttcggcaaacccgcccggtgagaaatacccgtcaagccggatacggtcgatctgcccgggcaggcgcatatacagagcggcctgccttctggtcagcatcaggtgcagctggctgctgacgggcgcgtcagccccaagatagaggctcaggtgactgaggtcagcatgggaccagtctgcctgggtgctgcaggcaaagcgcatccgcagcagcgaacgcccgtcaggctcagtggtcatagtcacccctgagatgttcagcgggttgagcatcacatcccgggtagtacggtagcgacagaccgtatttttaggccccaccgggcgggaatacacttccagacccgctggcatcacttccgccatcttcacggcctgaagcgcaggtgtgaacgccactactgagagtgaaggaatggtgcgcaggtagtgtggccagagcatgctgaccagcccttcggtcagttccggcaggtcgtcgtcaatcttctcgcgcagccgccccatcgaaaaagcaaaaccttcaaatagacgttcgacatagggatcaggtgtgccggccttatccagatccagcatcgcggcccgatccggatgggtctgagcaaattctttggccgcttcacggaggtagcgcatttccgcgtcgtaataacgcagggtcaaatcttccatttatttctgttcctgtggatttaaccgcaaagcacggcggcacgggcgggatcgacggcgatcagcccggcaagtaactggtctattaccgacgtaaggcgggtcttatcagcctcactgcgaccggctttcaggcgcaggagtttcagatgacgggcctgtacctcaaacagcagctctggctcccagtcattgagggtcacttctctggcgcgctcacccagttctgcaaacaggtgcaccgccaggtcattcttaccgtactgctcagcaatgcggcccattagcagtcgcaacagccattgctggcgcgcggtggcgatgccgggccgggtctgcaaccagcccagcgccgcatccgggccttcactgtcggccagcgctacggcttccggctccagcgacagaatgtcatcgttaccggcggtgaccggggctgatggcgtgtcattaccccaaccgccgacggtgtccagcacgctctgctggatccagttcagcgtcacttcgtccgcaaacggcgtgccgtcactgaacgccagcgtctccagcccggacaggcgcgacagcagccctttcagatcagccgtgacaatgtcggccagcgtttccttgccggatttcgtcagcgcctggtggatgtaccactgtaaatccagccacaggtggttggcaccgcgggaaaacgtgctgtctgctgtatccagcatttcagcccagttctgctgcaggtagaggcgtttgagtaacgcgcgctgatccgcccttggtggctcgatgcgtgtacgcccctgcgcatccggggccgggatagcccgcagggtgtcatgacgcagacttttcatcagatggtgtgctgacagccagccgtccggctgctcacgcagatattcggtgagggtgcgggcctgggccagcaaatcctggccggaagtgatacgcccgatagccggtgcatcgttgtgactggcaggtgaaggggtttcgctggtactggcgtttctgcggtaccacggcatccacaccccccgctttgtgcaaacgactttccagggcaccgtacagcgcattgagttcaggacgggtttcatcgggctcattctcaataagctgtgatatcagcagcagcgcaccagtggttcgcatcgcatcgatcctgaccacttccgggtacagggaaagcgagtcggtcatgcgcgaccctgccagccattccagtgccgccttacagctgcggtcacgctgcgggtgcagctgtggtccaaagcgctccagcaaaccggccagcagttcgagcccttccgccagcccctgctcaccttcgcggtgcagcttcgcccagcagtagtacgtcgccacacggatatctttggcggtcgtggtcagcagcttctctgccagccggtagatgagctcggtatccgcgccggagagcttgttgacctcctcgcgcatctgctggaagtcgtcgttatagcccggatcctcgcccacgggtgatgaaccggacagcggctgcagccagctgccccactgcgccacacgctcacgggtttctaaaagtaatggttcctgctctgcctggcaggcactgagtaaggcattgagtgtgctcatcagtacgcctccccgtcgtcactggccgtatctgtcgccgggtctgacggtatgacgccggtggtgctgaagatagtttccggcaggcgaaaattacgcagcttcagcagcgccaatggcccctcgcccgcttcggtacgcagggtgtaattgagcatacggccatcctgcgctttccagctcagactgtaactgctgtcgacacccgggtaagcacttacgacggctttatcaagcaggcgtatccagccccatgctcccggaatttcggcatattgacgggtgccagcctggatactaacccagctcaggttcgcgccagggacttcggtatccgcaggccacgaaaagcgcttccacgctggcagttggttcaaataggtcagcttctggctgtcgataatcatatccgtctgcatcacgccagcggcggtgcccgggcgcagctcgaagttcatgccggcattgccttcggtgaaggccacatccgagatatgactcagggtgttgatggcgttgaggaacgccggattaaaggccaggccctgcgagttgatgctgtccggcacccagtggttgccctctttgtgcagcacgcctttgaggcggatttgcaggaactgcgcgatacgcccgaaatctgcgttgaggtatttggccagcagcggcagagaaacatcactgctggagttgttgaacggataacggccaccaaaggcactgttccactcagccaccaccgcctgctgccactgtgcattgaggctgtcggccgccggggtcagcacctgctgccaggcctgctccattgggttcacaaacaccgtgcgcccaaagccgctccactcctgaccgagactcgcggcaatcaggctgccgtagtcgcgggtttcggtcagatccacagccttgccctggaatacggtctgggcaatggtctgggccatagcctgcgggtcagcagcattggtcacctgctgcagtcgcagacgcacctgcgtcacgcgggtcagaaacgactgcagactcaactcctgtgcgcccgtgcggatcttgtccatcagcgccagcaccgggccaaaggtcgcatccagcgggccatgaaccccgacactctggtcaatggcatctttgttgtcaccaccgagcaggttcttcgctgacttcaccagcgagtcggaaatcgcttcgccagtttgacccgtgcgcccctgcacattgagggtgttcatcaacgccaccagaggtgactgacgcacatcagccatcagagtcagctggtcaatagagtccgacagcgtggtggcccggttccagcgcaggctgttgagaaactccagccaggctccgccgaagtcagcgaagtagcgctcggtcagacgttttttcagtgcttccggcgaggtttcgttctgtttattcacctgacgcttactgtcagtcagcacccagtcaagctcgtcccggcgcgccttcaccaccttctcgatggcgggctgcacggcctgctcccaggcctgacgggtgaacatgcccggcacgatttccgtagtgctgaacagacgggatgcatcggtatcgccggtcatgtcttcaaggcgcatatcgacatacagatgcgccacctgggagagcatcttctggtacagggtcgactcactgttacgtaagcccatcaggcgaaccagcagggaacgcgcctggctgaccatgttctcatctgcccgcaatttccactcagggtgcgcaaccagctgcgcaccatagaaacgacagcagtgacggcgccacgccctgccagacaccgtctttcacgccatcgcgttttggccagtcatgcaacagcgtcgggctgaaccaggccgcgtccatatgttccggacgcgccagcatcaggtagagcttgagctggtcataggtggcttttgccatctgctcacgcagtgggctacccggcggcaacgcgttaaaggcgctgacttgcttttgaagatgggttgcggccgcatcccgcaacagcggcagtacactgtcctgatagcgtggccagagtgctgccagcagggcattattctggcttaggccggccttctcgaaccacggcacgccatgctcagagcggtactgcagacgagccagggttttctggagttcagacagcgcgtgcaggcgctgctccagcggctgattctgtcgggcggcaagtgcggtctggatattcgcgccgtcaatctggctgcggttggtgacatacgcgatgctcatccatgcagcccagcccaccatcgccagggcgacaactgacgcaatcactttgcgccatggaatgcccggcttgcgcggacgcagtccggcaggaagcgtgcggacagactcaggcaaaacatcccagcgcttatccatgccccagtgatgtgttacgacacgttcggcaccggcagagggctgactaaacaccacaccagccagcggcagcgggcggtacggattgagcatcaccgacagcggtgcagtcacactttctggttcgcgaatgagctggtcagccagcgtcagtaagaagttatgtttcacctcaccgcaggtctgctgcagaccctgtgaagtcaaatccggcgtcagggcagagagttgttctgccagcccttcggtacgacaaccgacaggtaacaggcagccggtagcctgcgtaatgcgcccttcctgcttatcggcgcgcgggtgcagggaccagacatacagcgggagtttccagccaagcgtttccatacgcgcgctaatggcatgagacagggagtccatggtgctttcagacggtaccggcagcggctgttccagtcccggtgctgagagctggtcaaaggccgaggtgacccacaccagcccatccaccggacggcggcgcagtttgcgcagcgcggtcagccaggcgctgtctgctggcgtattgaggtcaccgccccacagcaatagcgtgccgcgatcttcctgccagagctggctggtgaggccgggtgtgagctgctccacttctgcagcagtaccagttatcagcaggatacgtgttttacggccccagcgccgaccgtagaggttacgcatggcgaggcggatggagtcgacggtgacattgcgtggggcggtctgtttgacacgtccttcatcggcaggcaggacacttttacgctttgcctgaaaacgcgaccactgttgtttaatcgcaagacaaatgattttgccatggcggacaagcagcagaaggattatcaccgccataaataccagcagcttaaggccaatactggtcagtccgaacgaatccccctttttccagatagccaatccgatcgcgacagcaatcagcgcagtaatactgatgcgtccccagttaccacgccacactgagttatccttcgccattcatcagattccctgtagttacggtatttacaaatcgctgctctttgtcacccgaaagcatcaggcaatcttcttttgtgagcatagctatatcactgacgacggcggccataatccacggtgagaaaggaccgctgagcccggcatatttctccagccaatggcactgctggggtttccagcggccttcatattgttttgcactggccagcagagtggaaaaatcatcaccccactccatgctgtcacccactattgcacgcgcagcgatagcctgtgattgggtcgagaaaaaggtatcaagctcttcactcagcatttgggttgattcaagcgacataggccgaagaaggcgagcgtgatggttaagctgatacttcgttgctacatcatcagaggtcagcattaaagccgagagcgaatcactgtactcattccctccctgagtctggtgaactaacagaagctcaacatccagaaccggggatttaagacgtttcgcccacccaatcgaaggttcggtctttaagaattgtcagtaacggtacgggaaacgcctgtccaactaactggagccagcatgctgaaaattctctctgcaatgtcttatcaggatcgtgtgaatccgtcagtaaggttgcgtggaaagggaggtcagttaagcgctgtaattctgatatgtccaggcccccaatcaatgctgaaaaagcatcttcgcccacaggtaacgttattccccgagaaagagagctaccctgctcaagatctttgggggcctgcagaaatgtggatggcgtcaattcatgaggcaggataacccggctatgcagaaccgccagataacgcccggcccaggaaatccattgctgctgtgcataatctgcttcatcagattcaaactggtgacgatccattgcgtggttatacatccagccgcgaatacaaatcgtcacgaaccagataaaaagagggcttccggcaacaatccagaggttaaatttttgcaattcatccagaaactgattggcgtggagtacaaagagcaacactccagcaataacagcaataaggcctgcaatcagccagatgaccagtgacggctcatcaggttctgcagaaattgtagctttctgacgctcccagctcataacttatcctactgaacaatccggcgcactggagataacatggcaaccacattcacattcgcagccatccacaacaacaggcttcccatcagagatccattctggtgacccttctataatggcattaataccatgcccttcaacagggcaattaatttcatcgccaacgagggctacattctttccgttcacgattatggtcgaagatgcagatataacctcaccgccgtgagtagttttatctcctagcaatacaaatcctttggacatatcacacctaacaaattagtttatatgttttaattgagtcgacggaaatgaatccatccgtttttaatttgaggaacaatatcatcatcgagaaatgcagaacaaacaccgagttcaccgactgcaaaaaccgttgcaggataagataaacctatcccttcccgtccttttggatctggctcttcataatcaggaataccattctccctataagcattaatatccaagtattgattacagtccacattaaaactattgtcatcaattaatgacaacggaaccacttcatcctttttaagccttatccgtttccctaagaattcctcaccaacaaatatatggtctgtggcatcctctgtgaccattcgaatagtgcttgtagaaataatcatatccccctcagtaaatctagcgccagcccatccaaccgtattaagatcagacccaacacttttttgataaaaatatacgattgggataccccccttaactttaatatatatttcattatcatcagtaaacttatgaacaggcgttaatatatattcacccatcaattttctaggttcgttagctaaaacaccatactctttcacggcaccatgatctttataaacccaatatccataatacagaccgtcttttaccttaatagtattgcaaaatgcaaaaaaaggaacgacagcaataaaaaacaatattttattcattgtacaatctccacatggaatgctggctcaccacgattttcaaatggactgatatatttcacttttcctggattatcttttacatattttgtaatagccttatcaaaagcccgctgcaaagtgacaggtaataatcttttacttatatcaaatacatttctctgagcatacgattcaagcgaaacacaatgttttgaaacaagacgtccatctttttgtaaagaattgactttatcaatcatggcttttttaacctgattctccttacttttatctatgccacccacagcgatacctacttgtacaacctcccgacccgcagcagcataataatcaagctgggattgtacacccttgttgcacatattgttgtacattgcttccacttgctcttcgggagtgcgtagggtgctagtgatagtaattttatggacacctgcagatttcattattcctttaataacatcaattgaatgagcagaaaccaatctctgtaatttttcagatatatcagttcgaaacttgactagaggttcaaagtcgttaacaacagaaatttcttttgcctttccctctgaagtagtctgatgcttctctggttcatttttactcctgcgagcaacggacttatccgtcgtcgtcgttttaatatgaattacattatttttcttttccgagtctgctgacttgcttcctttaggtaaaacaatatggcttcttgaatactcaatggctgctttagcattagcattttcaactccgatgcttttgagaatctctttcctggtctgctcagaaacatagcggctaacatatccatggttttgattactatcaggtatttttaatttcgcaccaatgcgcaacatgttgacgttatggatcttattaattcttgccaatttctctactgatacacgatatttcttcgctattgctgataaagtgtcgcctttcttaacggtataagttagagtcttatgcttttcattggtatttttttcaacagttgctttggctaattctttgtaattatcagcaagaatagcaaacacaatttctgaacctgcgatagcattgactgatttagtcatcccgtttgcatcagtcacgcctttgataaaaactagagctttctcatagtctgacactaaatttgggcatgttgaaatgggaaatggaaaaattgcagcaatataatttttgtttttgaatgctgtattatttccggtagacagtttaaatatagtattaacttcagtcttttttagtaacccttccacaactgataaatgcttagttatataaagcgcccacttctcgccatctgcacttttctcacgtgtaccatcgagatattttcctaaactataggcaccatcatgatgcaacaaataaagccattcccagtattcactttgatctgatgtgtaactctccatcaccttcgatttgttaagtaaaaaggaataaataaccgcatagcatcctttttcagcgtcaaaaacttcctcattacgaagatctagctgaaaaccaagaatgtcttcagattgtgtcaatgcatcgttgataaaaccaaccgttccttgtgctaaaccagccgcactagtagtccccgctgccgcatcgggattaaatccagactcaaccttagtagttaataatatataagatatctctttataacttaatccatagcggacagctatggtaattatcatatctataatagtatcctggacatctttattagcatctcctattgtacgactgttacctcttagctttcgggatgtatctatatctggatagattgagattaaagaaaatggtttaatctggtcatcaaaatatgcctttccctttttggcatttaaatactcatataaatcagacataccatacctcagcgattgctaataaagtctatgcttgtattatcgtaggggtttttcatttctcgagatctaagctcagaaagcttgttgcctgtaataaagttccctgaaagatcaataaatggggcatcaatatatgacaacaatgatccctttacgctctcatcttcatccagcccaagatggtatccgatcacaatattttcattgtcatagcatttcatagtggagggagcccaatcaccaggcttaactacattattgaaggaataaccctgtttttccaggagagctttttggctgttcgggatgtatggcaaagaaaactctttattattcgtgccgttctttatttccaagtggtaatttttgcatatattctccgttgggcttttttgattcacctggcattcagcactgacctttaccaaagctgagccacattgcatttgtgctgatttagcattccatgtgccacttgcaaaagaaaaagatggagtcagcaacatacataacaaaattttaaacttaaaagtaatatcacgcacttttatttccctcacaatcactgcattgacagccatcgtcctggaatgacatatctgaaaatgatgtgcaatgtactctgtccacaatattttcactatcgtaccaataatcactttgaatcatttcaagttcaaaagactcattcgggtttgatgagtaaacaggaaatgtttcaccgttctcgtctgttctaccaaataatttctgcccattactcgatgtcaacatgtatgccgcggcagcaactggaactcctgcaacagacgatgcagtaaacttcccactatatcccgatggaaactggggcataacactactcatacttacactgcccattttctgcgcattggcacatttccacaggatattaccttcacagcccagaataatattcttaccctgcaactggatgaacgaaccctccagatttttaagcacgacatctttcgcagccgtgatttctacccgcccatctgtgctggttacggtcacatcctttttggctatcgcctcaagcgcatcatcctgagcctggatttctacttttcccttagtcgcaaagagtttcatcccggccttacgggccagcatactcacggcttcacctgctgctacggtaaatcgtttaagagcgctaatgtctgtattctgttgcgacatgatcccaacactggcactacccgacgccatgcgaaccgcctgtgggctggtgatgctcacgccttctggtgcattcaacaccattcctggctgcacaagatatttgagggcattagtcaacttcacctggctctgaatatccgcgggtagcgcctgcgcagtttcagctgcgtctgacatgcttcgcgcaatactcagtgcattctcgagctgggcaatcgcctcctgcatagagagcatattgtccccggcaaacggctgtttatctgcagtgataaacaccccggcaccaccccggatggacacataccgatcggtacgcaactccgcaccttcaccgcgcagtttcgcgggaagcatccacgttgtgacctaaattaagctgcgtcttacccccgtactctgtactgagcttgatgtgttcctcgccgcgcttatcctccatccgcagcttgttcaggccagctgtgcggataacatttcgggtgctgttggcttcagtgacatggtcaacgtggcgcgagtcatgcagcgcgtgcgcaatatacggacgatctggatcaccttcgtggaacgcaatggcgacttccgtgccctgtatcagcgggaagtggaagccgtacttatcaccaccgtaaggcctggcaaaacgcaccggcatgctttccatgccctgttttttatcatcacggtcggcatcaaacttcacccggtacatgccggatgcatcctgccaggcgtagatgtcgttatctttagcgctggtcactcgtgccgtcagggtgccgctgaccaccgggcgctttttagcagcaggacgccagcagcggttctcgtaatacggcatcccttcccacatcacgatcagggcatctttacggctggctatatagcccgttcgggtgatgattatgccgttgtccgtttctgatggcagtgtaggtgttaccacactttcactgatggtcagcacctgggccggagaaagcagggcatcattgctgcacccgctgataatcgtctgtccggaaagaaaacgctcatgctcaaggcgtgcccagaaattgccggtttccgctgaaggtgtgattttgtcgccacgttcaagatgacgcggtagatagtgataaacctcaccgtaggtaacaccgtcaccgtcgccgcaggtcatgtccgccggtacagaggtcaggacattctgggcttcacggtgattgtaatcactggcggtgacagagcgctcaaccacgtttctgtcggacgttaaccccccagatcgagtccgctgcactgtcactcattcccgatgggctgctgagcggcagagacttaccgaacgtccatgcgctctgcttgtctgcgaaatgcaccacttcggtctgggtatcgggttgcagggtaaagaagtagaaaatccccacttcggccagcagacgctcaatgaacgcgaggtcattttccttgtactggttaatctgttcacgcttcggatagtcggcttttagggtgaactcatactcccagcctttcaggccatgctcctgcaacacttcggcgacaacttccggtaccgacttattgacaaaaaagcggtgggtacggaattgcttgcgcagcaaagacaagaacggctcaataataatctggtacgttgcctggtcacgtgaaccactgatacgcttaaattgcgtcaccacaccatgcaccactttcagcccggtcaaccccatcagagacccggttcccatggtcagcgtggcaggcttagtcagcagttgcgctgagctgatattctggtcactgctggtaaagataacctgatagtagtaaagctcactcatgaactccttaccgctgaaactttccacatccagtgatgctgtacaggatggaatatccaggcggtagcggttcagcccgctttcagttaatgcagacagggtgttcttgagcgtatctgtcagactcatgatattgactccatgggataacctgcagtccatgactttcttgccggcgggcaaattgcaggtttaatcggggtactcagcgagtacgaaaaagcgtgattatggctccggccccgagggcactggcgaaggttttaatcagcaacacggtcatttcaaaattgtttatgccgtattcgccatcgccactaatggggataaagcgcttaacaaacgtgtaaataaaagcatccggaagaaagagtacgcttatcacgaccaacgcaataaaggtgaatgttctcattatcttatattgaccagctactcggaaacttgaattgatccatatggccttgctatttctcgatcggtcagaggaaaattgtatacctgcccattattcacccccacgccaacgacaaatttccgtggctcatcttcatgtttctttgaaatcaatacatactcaaaaataagcttccccttatccggaaaatgataaaaagaaggtggaatgcataattttccattaacgatcgtgaggcctggagagaaattaaaatccttctccttcgaaggtgttcctcgtggatttatccccatgtcagcaggttgataatcctgagcatctggaatatctaaacatacattttccccctgcttgctgacagatgtggtttcatgaggaatcatcctgtctcccgggccaggacatcctgtcagcacggaaaggaaaaagaaggtgaatattcctttcaggcataaatcaaagcatcggattatcatcatatagaaaccgaatgttactattcagtatagtgtttagcgtgccgtcgctggcacatggtattcccgtgtcgtcaacgatacatcccgggccttaccgttgatcatttcaaatccggtgacaaagctccttggatggttacttttactcttagactgcaatacaacctcaacaataaatggggcttttgacgtatcaggaaaatggtaaaacgaaggactaatacataattgaccatcaataattcgtaaattcgggttttcggtaaactgcctttctttaaacgatttattcctgaggttgatagagatgaaaacaggctgataatccttactatctgggacgtaataacaaactgcattattcttcatccagacgctggctgtttcagctgggtaatatttcatcccaccccacgggcatccggttaatgtaaaggcagaagtgacagctaaaataagaaacagtactgaatgccaccactttatttttaccatggaaaccctctcaatgaatttctatacatttctcggatgattgattcagatgcatcaccatcaagagtaacgatctcccagcccctgagacgcaaccaaccatcatagccatgagcctctagtgtaaaattatctgcaataatctgcgcctgctgctccatcggatattcacttaacaggcgaccatcaagagtgtaacgataactcaccatccaactgaccaatcctctcataataatattcatgcctttcattcgttgccagacatgccccatttcatggatgaacatatgttgaagatcgtcagttgtctgggagaaatcgtcgcagtattggtcacgaaaataaatctccccatttggggtcatagccgtattcttatcctgtagattgaaagggagataactctctctgtggatccatactttcgaataatcaatggtggataaaaatacagagtgtgccatctgtatctcacccgtcgtaagtagcctgacaccaccttctttaatcctgtactcatcctgcgtttcatcagtcatgtgtaaattccagtacaatcccttcttcatcatcccatccaagccgcagcgactgcggtttctgcttcgccgccatatgagtcagcaactgctgactcagtaccggcagaatttgttgattgagcagactgtcgacgttacgtgcaccggtgtccggcagcaggcaggcggcgaccagcgcgtcatacaggctctcatcaatctgcgtggtcaggccgtagtgacgatgtaagcgcttgctgacctgtgcgagcttcatttccacgatggtgcgcatggcaggctcactcagcgggcggtaaatcacggtctggaagcgcgccagcagcgcgggctggaagtggttgcgcaggatcgggcgcagcagcgcgtgcaggtcaccttcggtggcgtccggctgctcatccagcagctgcatcaggtgatcgctgccgaggttcgaggtcatcaggataactgtgttacggaagtcgatttcacgcccttcgccatcacgcataaagccgcggtcaaagacctgatagaacaggttcatcacgtcgcggtgcgccttttccacttcatcgagcagcaccacgctgtacggacgcttgcgcacggcttcggtgagaataccgccctggccgtaaccgacatagcccggcggggagcctttcagctgcgacaccgtgtgcggtttcctggtactcggacaggttgatggtgatgagtgacttctcgccaccgtacagcacatccgccagcgccagcgcggtttcggtcttgccgacgccgctcgggccgaccagcagaaagacaccctgcggaccattttctgaggtgaggcctgttttcgccgcacgcaggcgctgagcgatggcggtcagaggaacattctggcctaccactcgctggccaatttcgttttccagggtcagcaggtcggtctgttcgtctttcatcagtgacgacagcggcacgccggtccagtcggcaatcacggtggcaacggtgcgtacgtccacatcaacggaaagcagcgggttgctgtgctgcatgcccttcagctcctgttgcagcgtgcgcgtctcgctacgacgggagatgtcctgccggctttccagcagttgtccggtgagtttcagttcctgaccgtactgggtttgaagctcgtcgagtgcaacgatgagatcgttctcttcctgctcaatggcggtcaggcgttcaccatgactctgagtgccgacggcgatatcttcctgcagcgcctgcttctccatttcaagagaggtaatctgcgagcgaatgcgggtcagctgttccggcacggtgtcgaggctcatgcgcacgcgcgcagcggcggtatccagcaggtcaacggccttgtccggcagctggcgacctgtcaggtagcgacgggacagcgtgaccgcagcgcgcaccgcatcgtcagtgatgtgtacattgtggtgttcggcatagcgggatttgaggccacgcagcatcagacacgccgtctcatcgtccggctcgtccaccaacacccgctggaatcggcgctccagcgcggcatcgcgctcgaagtactgcttgtattcggaccaggttgtcgcagcaatggtgcgcagttcgccgcgagccagcgctggcttcagcaggttggccgcatcggctccgcccacctggttaccggcaccaatgatggtatgcgcttcgtcgataaacagcagaaccggcaccggcgactgctgaaccgcatcgatgacgtttttcaggcgttgttcaaattcacctttcacgcctgcgcccgcctgcaacagaccgaggtcaagggtgcgcaggatgaccggtttgagggattcaggtacgttgccctcggcaatacgcagcgccagaccttcgaccagagccgttttaccgacacccggttcaccgaccagaatcgggttgttcttacgacggcgcgagagaatgtcgaccatctggcggatttcggtatcacggccgaacacggggtcaatcttgccctccttcgctttggcggtgacatccagagtgaatttatccagcgcgttctgcagcgccaggttcagctccccgacgttcagctctgcatcgaccggacggccgacaaattccacgtcaccaccgtggttctgcgccagtccggcttcctgctgcacttccggacgttcatccgactgcccatcaagcagcggacgcatacgttccagctgactctggcccagcgtcagcagcggccacagcccgtcacagcgaaccagtttctgtttgtaaaccagcgccatcagtagatggatgctgcggatttgttcctcgccgttaagggaagcaatcagccaggcttcctgcatcagcgtctgaatggcatcagacaactgtggacgttgacgtactgaacgcggctgtttatccagccaggcaagcaaatcctgccaaagctggtccatatcccactcatagcggcgggccagcaccgtcaggtcaccttccccctgtttcgagcagcttcagcagccagtgctccggcaaaatttccgcatgggcgcgggtctggcagagcgacgccgccccttccatcgcacgggcacagtaagggttcagacgtcgcaacaggatggctgggttttccatgaatctctctctttgtcggttcctggacacgctaccgcccatcgctgttcccgttaaggggaccaaagcgcatacggtcaggctggcagtttgtggttttctttgctgaaagcccgcgagctgcagacgttcagcaaaacagcggaaaggtcatccccctccgcttaaaaacgaggattacgctaaagagttcgtgtcgcaggaaggcggcaagttcgtaagtctccgggaacatagataactatgtgaccggagcgagcgaacgcagccaacgcacctgtggcgcgaaatatgacgcgtaatcaggcggtggcgcgttcgttccagctatcggaatgaatgatgttgccgtctttgtaggtccaggtgattttttcgtaacgcagttcaatgcgctcaaggtggttgtgcttctctttggaaggatccttgatgtcatacatttcaggattcactttcaccactttcacgttttccagtttggtgttgaagtactccacttcctggcccgcgtcgttgattttgtaccacctgaattccgcagacttgagggtctgaccggtggtcacagccttgtacaggtacgggctggacgagtcgatttccttggtgaacaggaacggggtgtggatacgggtaccggtcagcttgccggtgttgttgtcagtcgggatgtacaggttatgctcctgagcgacaacttcgatgctgccttcacgatcctgaacgtccacagaccctttaatgtccgcgccgccgtcgtctttcagccaaagataaacaggaattgccatggaattactctccattgtgttgtgatgcgccatcatcctgcgatgacgcctgggtgtggcccggtatctgacaggcattggcctgcggtaccagactgatttcgacacggcggttgagcgcgcgcccatccggggtgtcattggttgcgatcggacggctctcgccatagccctgcaccgcaaaacagctttccggtacatcaccggtatcacgcatccagttgcgcactgcttcggcacgcttgagtgaaagcgtctggttaagttttggattgccggtgttatcggtatgcccggcgaccacaatcagccagcccggcttcgctttgataccgaccagggagttgaccagcattttggtggagccagccttcagcacggatttgccggagtcgaacagcgacatgctgtcgaggcgaatggttttcggacccttaatgattttcttaatgaccgggggaggcggtggaggtggagcccagtcgctgacggcggcctcaacaggtggaaccaggcgcagcccctgatacagccccaggcgataacgcagtggctccccgcgacgctgccagtcgtccagcaatgcgccatcggctcgcaggcgctgctgcgcacgcagtttcggggcagcaggcttatccgccagttggtgatataacgcaaggtgatcgcccacattacgaatgagacgctggttgttcatccaggacgccagcatggcaagtgccaggaaactcccgcccagtaatccggcatagcgccagaacaccattctgcgactgacaccgcgtcggcgcggtaacgctggcagcagcagctcaggcagcggcagtggctctgtcgtcacaacggcatccggtggcagcgccgtcacggaagtaatgtgctgttgccagagattccccgcgataccgctcaccggcaccatgcacatgccctgtacgcaaggcttaatcaccggcagctcgccctggcgtaccgacagcaggtcattcaccgcactgtttctgccaggcaagcaggctgtccagccacagaccctgactcagacgagaaagtctcccgtcagatccactctcccgggtccactccgtcaatgacacattgccctgaccgggctgatacacctgaataccgcttcgctggcttactgtggtaaaccagacgggttcggcctccgcgcaggccactgggggcgatacccaggtcacggtccacagcggggggatcgtgccaaatgccgcacggcactggacgacagcccgctgccagccccgaagattctgggtaaaatcatccccggagatgtgctgttcaggtaccaccgccagcatgacggaaatttgcgacgccagggccgggcgcaccaggctcaggtgctgtgccaggattggcagctgttctgcatccttcacccacagataccagccctgccgggtttcccggtgacggaaaccggacacaaacagcggggcgttgtcgccgcagacgaggatcaccgccccctgaaaatcttccggcggcaggttttcatccacaatctcccggacagcggtcgcccgcgccccggaggcccgacgctgacgccagaacatcaccccggacaccagaacaaccagcagactgagcgccgcgcggctgcccgtggacagtggccagaatcccagaatgagccacagcgccagtacggcacccagggcagttaacagacttcggtacgcatcccgcatcgcttacaccggcctgacagtctggctcaccagctcggtaagcgaagacgaaaggaagaaccacagcgccactagggcgacagcggccacaacccatgtcagccagtaccagcgacgatcgctgcgcaggcgtgatacccgggcaacaatgggggcgtcctgtgccagcatgaaggccggcacccgttccgcgagcgcacgaacgatatcttcccgacgctcatcatcctgggcgcgatactgacccacaaagcccagctgcaaagtgcggtacatgcaggtcagaacggcggcgtcaggggcggtttctttcaacaggttgcggatccgttcccacagctcctcaccggcattgagggtaccaaagaagtgggcctgcagcggatcacgacgccacgtcaggtaaccatcatcagtggttccgcgattcatcacgctctcatcaagcagtgcacacagggcatacaccatatggtcacggctgatgtcgctgtaacctgcctccgtgagcgccgttttcgcctcctgcaccagacggcaggcacggcgataaagcccttccccgtcccggacttcctgaccgccccgcagctggctggccatcagccagcccgggtagaaaatacgttctatctggctgagttcggatttattcatgagcgcaggaccgcaaagagttccagatttacatcccccagtgagcgcggggtgtagaaggtgcagctgcccatctcaagcattgcccgtgccgcctccgtactcagatccagcgagaaatactggttctcaagacgtaaagggatagcggccggaacatgggccagcggcttgatagccatcccgctcagggccacattcaccacatccgacacatcgtcaaagctgcccgctttacacagctgcgggaatttcgtctgtagttcatgattcggcatggaggatcgaacggagagatagaagtctgccccttcgcgcaggcgcgcatcgtgcagggcacctttccagatctgatcctgatgctccaggtggatactcaccacccgcgacggcaggctcgcttccagaagcttgtcgagcagtgccagcaacggcggaaatatccgttccggtgcatcgtgctgataagcaggaatatccccggcgtcgtgctcaagtgagaaagtcagcaggctgccggccaggcgggtcagttcgcggtacagcagttccgggtgacgagacggggtctgcaacaattccgtcagtacgggttcagcgctattcagggcgttgagcagccagaacagggagacatcggcgaccgcaaagtcggccatccgctcattactttcacggcgcatggccatcaaacgcttcctgcgtgcctgcaggcgcaccagcaggtcattcagttcggtagtaagccacggactggccacaacggacatcatcggcgggataaaagccgggtcccggctccactgcccctgcgcattacgcaccagacgggctaccggacaggtcaggtatgccgtgttttcctggctggacagacgcagggtcagcgcatgacgcaggatcgcgagttccccgctttcatggccggccagttcctgcacgacgatacgctccgctttccagcggcgcggccgctcactgtcctgaccgttatcgaggttgccaccgccggcgctcagcagtggcagcgcgacaaccacgtcaacagcctcactgccggcggcaacagacaaatcacagaccggaggaagcgtgtctgccaggtcggtatcaacaagggtcccgtcctgaaagcgcaccaccagacgtgttgcattcaggcgcgagagcgcaagcactgcatcatcaaattctgccgcaaccacgccccagggatgagaaatacccatccgggcgaccatgtctgcaacacgttcattccaacgggcctgctgctggaattgttgcggggccagagcggccccatcttcccaaagtgggcggtaaattttcatccctgctctccctcgcctcaggatttagctttcggcatctgggaaaccagcgacagattgacgtccatcccttccacctggaagtgcggcacggcatagagcttcacacggaagaaacccgggttgtcctcgatatcctccaccgtcactttcgcgtcgcgcagcgggtgagaagcctgcagctcgtcgcccggatcggtcatttcagtcaccagactacgaacccaggtgttcagctcaagctccagcagacgacggtccttggtggtcccgatattttcccgctgtataagcttcaggtagtgggcaatacgcgacagcaggaagatgtacggcagacgcgcattgatgcggctgttggctgtcgcatctgcggtgtcatacagggctggtttctgggtcgagttcgccgagaagaagcacgcgtagtcgcggtttttgtagtaggagagcggaatgaagccgaggttggcgaattcaaattcgcgggtttccgggatcatcacttcagaggggattttcacctgattgccggtgccgaggtcatacaggtggataggcagatcctgaacggcaccaccggcctgcgggccacggatttgcacacaccagccgttattgataaagctgcgcaccatgttggatgcaaaggcgaaggatgcgttggcccagaggtatttgtcgtgatccgggcctttcacttcttcaacatagttgaagctgcgcacgggtacggtatccgggccatacggcaggcggcccagcacacgcggcatcaccagaccgatatagcgggaatcatccgtctcacgaaacgatttccacttgatgtactcggcacggtcaaagtagttaccgatatcttttatagccgccacttcctccatcgaatccttgaggaaaaatttagggccggcggagccgataaacggcatatgcgcagcagcagagactttagagatgttgcgcagaagcgttacatcctgagcggaagcatcaaactcgtaggcggaaatcagcgcggcaatcggctctccacccggggtgtcatactcatcaatataggtatgtttatacagtccgctctggataatttccgggcagtcttcgaagtcctgtcgcaggtcttctttggacatatccagcagttcaaccttcacgtttctgacggaaatcggttttatcgaccagggatttcacgccgcgccacagactttctaccgcctggaagtcctcatggtgcatgacagcatcaagctgacggctaatctggtagtccagctcagcgatatgatggtcaatcaggtttttgtcgagtttttcaacttttgagcccgcttttgtcaggcactccaggaacacctgcatcccggccgttaaacgctcatccgcagtcgcatccgacatcgcctgcgcatcctgccagatatccagtgcactgagttcggagaccgggttcagattgatttttttaaacagagacgcataaaccccaccagcggccggacgttccagcaccacactctcgccacccgcggcattctcattttttacagacatcaacatcttccttattaatccgttaaaacatcctgaccgttatggctgtttaggggccagagcagacaactcagatctgagttctgcgcttaatgccgggtcgagcagaattttttcaagctctttccggaaagcctgattgtccagcaggttagcttttaaatcgcgaagcagattacgcatggaaagcatcgccttcagctgagggatctgccgggaaacctgctcaggggtgaaatccttcatgctctggaatgtcagattgatattgtcttcgctaccgtcaccggcaagcgtgtttttaacggtgagatttacttttggggaatattcggaaagtactgagtcaaagttatttttgttcagattaacttttttgcgttcagagagtggcgcggactcctgaccattactgaagtcgcccgccaccagtaatttcagggggagttcggttttcttgctcgccccgcccgtatgcaaatcaagttttaaattgatacgtgcctcgggtatttcggactgaaaggaagagttagacatggctgtccctgtttctatggagtgatagaaaccgccacagccagtgtcaaatattaagaatggcttaccctgccataaaacattcctgctattaaacattcaatgaaaagcaggacctgcggtcagaagcgagtacattccatttactggcgatatgacgcgatgaaagagcgtaaatcctgaatttatttttcagataaacacccatggcgcgagtttagaaatagtgggtcagctaaaggaaatgataatatgtaaccatatgtaacaaagtaatcttgccagaaaatatcttatactgatctgatatataagatttttcttaagattgcggctgtagggcgcatgatagctgggactaaaaaatgtttcagtgaatagttcattgcgggattgagcagagaaattacccaatgctaaaaagtgcggttcatgctttttttacaggatagcggcagaaagtgaaaacgagaaccagcccaaacgggttagtttttataataagttatgttaatgatttgtggcactgttatacgctgctaatgtgcctgttgccgctaagaagttcatcgactttcccgacgacacgccgagggcgtcataccataaacctgccggaaacgatggctgaagtgggctgaagagtggtaaccacactgaagggcaatatcggtcagcgtaagatcgggccgctcaagcaacatccttgcacgatccatacgacggcgcatcacgaactggtgtggtgcctcgccagtggtatgacgaaacattctggcaaagtgaaactcactcaatgccgcttcctgcgccagcacagacagggttaaaggctgatcgagatgggtttcaataaattccagaacccgccgtaatacagcgggagccagtccaccccgcacctggggcagttgccacttaacttcgctgtagtgctgcagcagatgggtcagcaagagtgttgatgcgctgctcagcgtcagctggctggcgggctgttgccagtcgctgctcagcagaaagtgtcgatagagctgggtaatgcggtcatcaacagaaaagattttctcatgcaggtttaactgcgccggactgcggtcccagacccgttcggccagttgccgcagctggtttctcgctgcaatagagatgaacaaaggcgagatcggcacgcagatcccaggttgattccgtgcctgccggcatcagacagaagcggtccggtgcgccaccgttacgccagccattcggagttttatgccaggtatcgtagccgcccgccacgtaaaggctcagcgtgtgatggtcgctgaggtttgtcacgcgatcgccactattaaaccaggctgccagctgaatgccgctgtgaagctgcacctgatcgcgcagttgtgctttgtgtcgttgcagcatgtcaaaggtctggaagcgactcatcggggtatcagttcagataaacagagtgccagtttacggattgcgcgggacagaaaacagagcacatcgggacagagagtaaaaatgcgcaagattttgcaaaccctgcgcaatccgctgcaagaccaaagagcgttgcgggcgcagactcggcgttttgcggtggagaatctggtaatgaacctgtttttgtatctctcagtcgtgctgatctggggcacgacctggatagcgatttatgcgcaacagtctgcaggcatcagcgccgtaaccgtcgctgtcttctggcgttttttgctggcctcgctggtcatgttattactgcttaagctgataaagcgtctgcacaggctgacgctgcaggatcacctcttctgtgtgctgcagggctgttgcgtttttggcttcaactttgtctgcttctattacgcctctggctatatcagcagcggactggagtcggtcattttctctatggcggtgatgtataacgccattaatagctggatatttttccgtcagcgcccttccgcacgtcttattccggcgatagtgctcggcatggcgggcattgttgcgttgttctggcacgatctgcgcagcactcaggcctcggccggcttgatgtggggcattgggttaagtgcgctgggcacactgggattttcattcggcaatatgatcagtcagcggcatcagcgtctgcaacgtgacgtgctgacaaccaacagttacggcatgttatacggtgcgctgatcatggcactggtctcgctgctgcagggtgtttcgctgcagccgacatggaatacacagtggtttggggcattgatctatctggctatcgtgggatcggtgatgggattcggggcctattttacgctggtgggacgcatcggagccagtcgggctgcctatacaaccgttctgtttccgctggtggcgctggcactctctacccgttatgaaggatatgagtggcatgccagcgccatccctggccttgtcatgattttactgggcaatatcgtgatgtttgcccgttggccggcaagtcgtcgccggataatcatctgacgcggaggcgggctgaggcccgcgtccggatgggcgttatgcccactgctgctgaaggagtttctgtggtttattgatcgctttacgcgcaatccagtagagcagaacacgctcatcgtcactatcacgatcggccatcgacagcagttttaatgccagtgtcgatttggtcacaggctgttgttctgtactgagttcaatcaccgcctgaccgataatgcagcaaacttcatcctcactggtgctggattcatatgtccggtctttcatatttcctcctgataagtgaactcttagcctggcaaataatctgtaaacctgctcacagaatcatctgattgaaacattatcttacggctaattacgcttacttattaagttgccgctttgcttacttttgacgcgacgttgccaaccccctccgatgccattcataccgcctgaatggcatttcattccccgatccgttccgttcatgcctttactgcccacgcgcgcgaatcactgctttattctgaccgcagtttccagattcccggacgggagagataaattatgaaccagactcaacaggcttcttaccagcgtgctcgctggcttacattgttcggaaacggtaatcactcagttcgcactggggtcagtctacacgtggagtttgttcaacggtcagctgtcacagaagctggatgcaacagtcagtcaggtcgctttttcgtttggtctgctgagtctggggctggctattgcctcctcgctggccggtaaattacaggaacgttttggcgtacgccgcgtcactatcggggcgggtgtgctgatggcgctgggtttctggcttaccgcgcatgctaataacctgatgatgctctatttcagcgccgggctgctggtgggtctggcggatggcgcaggttacctgatgacgctctcaaactgcgtgaagtggtttccggagcgcaaagggatgatctctgcctgtgcgattggcgcttacggtctgggcagtctgggattcaaatttatctgcggggcgctgctggcgacggtgggtctggagcagacctttatgatctggggcgtgctcgcgatgtcgatgattatcctcggtgcactgctgatgcgtgatgccccccttcaggataccgggagcagcacgaatggtcagcaacatgcgcgggattacacgctggcacagtcggtgcgtctgcctcagtactggatgctggcgctgatgttcctgacagcctgcatgagcggtctctatgtgataggcgttgccaaagatatcggcgaagggctggtgcatctgactacgcagactgctgccagtgcagtaacggtgattgcgattgccaacctgagtggtcgtctggtgctgggcatactgtctgacaaaatgatgcgcatccgggttatttcactggcgcaaatcgtgtcgctgatcgggatgagcgtgctgctgtttacccgaatgaatgagatcactttcttcctgtcactcgcctgtgtagccttcagctttggcggtaccatcacggtattcccgtcgctggtcagtgactttttcggcctcaacaacctgacaaaaaactatggtctgctctatctcggatttggtatcggtagtgtgctgggctcactggtcgcctcgctgtttggcgggttcaccgtcaccttcagcctgattatgacgctgctggtcatctccctgttcctgtcactcaccatccgcttaccacagagttctgttacagcaacacctgtattgcaacgtcattaaccatcacgacgggccgcgccagagcggcccgttcacgtttagccgcggaatcgcggctctgccatgcccgccaccgagacgtccaccgcaaagatatcgcctgactgcggatagcgtgccagctcctcttcggtgcgatcttcccgtgaactggtaataaacagcgttttaagatcggcgccaccaaaggccaccatggttggccacttcaccggcagcaggatctcatcgacgatttcgctgctctggggatcgatgcgtactacgcgtccgccatcaaactgtgcggaccagtaaaatccttcgctatccactgcggcaccatccggcaatccacctttagcgtcgaaacggcggaacagagtgcgttcgcccggttcgccctgcgcatttaatggatagcgatagagcgcttcattcggcgtgtcactgtgatacatccagcgctggtcgggagagaaggccagcccgttggaaattttaatgtctcgcgctttgacctccagcttcaggtcaggcgtcacgcggcacagcagcccgccatttttgtcctgcggttcccacaggctgccgcaccagaaattcccccagggatcgacgcggccatcattaaatcggctttgcgcagcctcaccgggattttctgcgatctttttctctggcttaccctgcgcatccagcagccagacaccgccacgcaatgcagctatcagaccgccctgctcacgcagaccgatgcatcccacctcttccgcctgcgggaaggtttgcagttcaccgctgaccggatcaaaacggtgaatggcgggtgccagaatatcgacacagtacagcacctgttcttccactgaccagagcgggcattcgcccagttcagcctgtaaagccagaatatttttaacgtcatgcgccatgtttctctcccattgaactgacatgctaataatgtagttgtaaaaactttcaaatgagaattattttcgcttgattttgagactattctctttgatagtatttactattcagttcattcttatttctttattattctccgctgcaaaacgcagcactctgaaatattccgtcataccttcttaaataactctacaaagcctgcatcttcactccacttttccagcgtagtgtcatagtcattggaaaagaggagaagcttccgatgaagagattaattaaagtcgcttcggtggttgcgctgatgaccttattaagtggttgtatcatcagccccagacacgacaatggctggcaccgcggggggtggcggcggatatcatggaggctactatggaggttatcacggtgggtatcatggcggtcaccatcgccgctaacgggcaaagatgtcacacagcataaaataaaagcattaaactttaagggcgggataattatcccgcccgttttatttagctttttacagcataattacactggaaccacgctttctgcagtcccggaatatgactctcctgcgcaggtaacgcctcgactttatcaaagcctttattactgcagtaattcgccagatcaatattcattgcatcacgattgacctttaccgggtcaaaacggtactgcacggtatttgagcctggatcttcatctacacgttcaaatgccccgggtttgctggcagtacatccactcagcaaaatcagcgccagtgcgccggttattagttttttcattaagttatcctcacgttgccgcgcagtttatgacgcagcatgccgcgcatccataggattaatgcgcgaaagttcaaaacttgagaagcttttaccgattaatgtaatacgattaaacggctatcactatcatgcacggcgtgacaagatgcattcagacaaaacgaagactgcaccacaccaggaaatgccaaaaataaaaatctgttcctctcttccctgcccgcgcttagcgggctttttttcgcccgccattccgctgctccgctgccgcttactggccagtcagtgcaatcattctacgtaacaggttagcagcgcgcttgtcaggtaatgccagaatcgcgctgtagagatcaatcgacatggcacacagcgatgagcgatcaaccgccgtgtcggcaggcatattcagctgctgcagcttatccccccactgctgatagagccgggcgacaattttttgcagatcatcctgcgccagcgccttatccagtggctgatcgggcagtggactgttcagcagcaactgctccatggcatccgcctctttgcgattcagcgacggcggcagcgtggtcagcagattgatgccgccactcacctgcggatagagataacggaagcagaggcccggatcgatttggttcagcgcccgcatctcttcaactgagacgctgatatagttgaccaccgccgcgtcagttccgcgcatcagccgctgattaatcacctcaatcagccagccacgtagctcgcccgtcgccttctcagccggctcccccgcacggatgcgccgggtcagctcctgggtcagcaacagccataacgccggtttcctgagtctgcagcacccgataaccgggcatctttgccagttgatttaccgcctgctcacgctgactggcctgcaactgatgcggcgcaacccagctgaaccagagcagattcgccagtatcaggggcagcagaaagatgatcagcccctgccacaaacgcagccgggtggttttgatcagcacaataacaatcagcgccagcagcgcaaacgcggccagcgtaataaaaagcagagcattcatgcggcgggattaatccttacgcacatcgatcagcacaggacagtgagcgcgctcaataaccgatgcgctgaccgagccttttaacagccgattcaaagaggagagatggcgacgtcccatgataatcatgctggccttgagctgttgcgactgggcaacgatagtatctgccgcgtcacccgccagaatcatgccccgcgcattaatccccgcgcgcaataacggagccagtgcatggcgcaccaccatttctgccgtattctgctcatcctgcgcggccacaaaatcggccggatcttcacccgcatcgatttccattggctgattacaggaggagtaagcgggatcgacgcagcacagcacgaccacatcggcgcgatgcgccagcgcttcttcaatggttaaggcgaccactttttccgctaccggagagtgatcaatggccatcagcagggttttcatcgaatgcttatccttctatcgcggcgactttgccgatttcacgcaccagtgcctctttacacttcagcatctcgtcacgaaaacgggcttcgtgtcgcagaaaacgtgcagagggcaccagcaaagagacagaaaagcgaccaaacagcgtatccagcgcaaacgccatggtagagataccttccagcgtttcaccgcgatccacggcgataccggtttcgcgcacttccctgataagttgcagcaactgaggcagcgttttcaccgtcatatcggttaactcctgccaggcgtcgccaacgatcgtccgtacatctttttcacactccagcgccagcaacgcccgtccaccggaggtgctgtagagcggcagattgagtcccatatgcggaaccacccgaagctcacgcgacgccaccacgtggtgaataatcgccagctgactgccgctggcgcgcgccagcgagacggtttcattggtgtcggaagagagtttttccagcagcggactgaccagatcaaccacatcggtatgtacgctggagatcagttttaacagcgccggccccagacgcaatccgcccgccccgctgctgcgcaccagctctgcgctgtcgagcgcggcaacaatacgctgcaccgttgagcgcggcagttcgaccgcctgagcgatctcaccgaggctcatgccgccgggctgttcgccaagcgcattaagaatttttgccgcacgggcgatgacctgtataccgcccgttttttcatcctcgcggctggagggttgatgtgccatagcgtcgtcctgtttgagctgccttactgtagcgcgaatgccgcactttttacagcctgtaccacattgcaatacagtataccgggatgtaatattacgacctgtatcacatcgcagtacactgcatcataataacgagatcgcctgcaatgaacgctaagcctgccaccgcgccggcccctcatccttttacactgcgactggcactgggattagtcggcgtgctcatcgccgccctgacctccgggctgaacgatcgcgtcagtgatatcgcgctggccgatatccgtgccgcgattggcatcagttacgatcagggtagctggattatctctggctatcaggcggcagaagtagccgccatgatgattgcgccctggtttgccgtcaccctgtcgctgcggcgttttacgttaggcgtgtcggcgggatttatgctgactggcattctgctgccgctggtgcgggatccgacgctgtttatcagcctgcgcgtattgcagggcctgtttggcggcgccttaccgccaatgctgatgacggtcgccctgcgctttctgccgccgccctttaaactttttggcctggcgggctatgccctgaccgcgacgtttggccccaatatggcggcctcgctggcctcgttgtggaccgatcacgtcagctggatgatggtgttctggcaggtcgtgccgttgatgctgatcgctatgctgctgacaggatggggattgccccaggatccgctgcgaccggaacgctttcagcagatcgatctgttcggcatggtgactggctgcagtggtgttgcgctgctgattctggtgctgacccagggtgagcgcctcgactggctgaactcgccactgattaccggtatgttgctcaccgcgctgccgctgctgctggttttcctgattaatgagtggtttcacccgctgccgctgtttaaattgcagatgctccgacggccaaatctggcgcatggcttgctgggcctggcctgcgtgctcatccttgggctttctggctccgcgctgccttcggcctattttgctcaggtcagcggctttcgcacccttgagtttgccccgctggcgctggcggtgggcctgccgcagctgctgatcgcaccgctgattgcggccctgctgaatatccgctggatcgactgccgctggatgctgacggcgggcgtcggcctgctgctgacctcctgtctgctgggcacacagatcaccagtgactgggcgagacagaacttctggctgctgcagatcctgcaggcgttcggacaaccgatgatcattttgccgatactgatgagcgccaccagcgttgtggccccgccagaaggcccgtttgcctcggcgatgtttaatacggtgcgcggcttttccagcatcgctgcctctacgctggttgaggttttcctttcgcatcgtgagcagtttcactccagtgtgctgattaatcaggcggccagtcgcagctggctgatgacagcgccgacggccagtcaggccagcagcagcttgccgctgttgccggatggcagcatcagcgccgccgataatctcagcggattcgctaccctggtcaggcatcaggccacgatccttggtctgagcgacagctggctgatgctgaccggctttgccgcctgcctgttattgcttaccgccatcctgccaaaacgggtgtggccgcctcaaactttgattcaaaacccttcccggaataactgaatatgcgtgctttcgaaatgaaaagaaccctgctgctgagtctgttgctgctggtgttactggccatcgcttttgtggtctggtcactgatgaccggcaacgatcaccgcaccaacgacgcttacgtcaatgcggactacaccctggtggcaccgaaagtctcgggctacatcagccacgtgcaggtgcaggataatcagcaggtcaaagcgggtcagctgctggcgacgctggacgatcgtgactatcgtgtggcactggaaagtgcggaggctgacctgcaggtgagccaggcgaaactgctgagcagccaggcacagctggagcagcagcagtcggtgattgatcagcagaaagccagcgtggcggccagtgaagcctctgcacagtatgccggtcagagcgccgatcgttataaccgcctctataaaagcggtaccgtggcagccgacgatcagcagaaagccagctcaaaccagcgctcggcgctggcagccgtgcatcagagtcaggccgcgctggcgtcagcagtaaaacaggtgggagtgctacaggcggcggtgcgttcagcagaagcagacgttgcagcggcgaaggccagcgtcgatcaggccaggctgaatctctcctacacccgcattactgcgcccgttgacggcatggtaggtcagcgctcggtgcggaccggcgcgtacgtatcagccggcacccgtctgctggcggtggtgccactgcagcaaacctacataaccgctaactatcttgagacgcagttaagcgatgtgcgtcccggccagcgggtgcggatccgggtggacgccctgccgggcgagacctttaccggtcatgtggacagcatcgcaccggccaccggcgcaactttttcggcgatctctcccgataacgccaccggcaactacactaaagtcgttcaacgtctgccggtgaaaattgtgctggatggcgaccaacagcatctggctcagttacgtgtaggcatgtcggcgatccctgaaatcgaagtgccttaaaattgtgagcaatatctcagaacggacctatttcatttggggaggattacgcgtaaattagcgctcgatcctgttctgagttattcagatcaacccggaagagagcagaccatgactgtaaatggcgatctcttttccacatctgttcgcgttgcactggtttgggatcgccatcatcgtaaccgctcagaggagttgctttgtgaaatatgccttgatgggaatatcttttttcgcgttactttggttcggaacctttgttctgctgctgaagtaatggcgtgacagtgcagccacggggcgacccctgagtcgcccctgctggctgtcagcgttcttcttccatttttatgctgcctggcaatatgccatcggcacgaaacatcgctttaattccccgtaccgcctgacgaatacgatcgctgtttctctatcagcgcaaaacgcacgtgcgtgtcgccatagtcgccaaaaccaataccgggcgagacacagactttcgcctcctgcagcagttgcttagcgaactccagcgacccaagatgtgcgtaatgatccggtatttttgcccagacgtacattgaggctttcgggttatccaccatccagcccgcttcatgcaatcctttgaccagcacatcacggcggcgtttgtactgctctgcgatgtcgcgcacgcactgttgatccccttccagcgccgcaatcgccgccacctgcagtggcgtaaaggtgccgtagtcatgataacttttgattcgcgccagcgcggcgaccagctctttgttgcccaccatgaaaccgatacgccagcccgccatgttgtagctttttgacagggtaaagaattcgacggcgacatcacgcgcgcccggcacctgcataatcgatggcgctttccagccatcgtaaacgatgtcggcataggccagatcgtggatcaccagcacgttgtactgcttcgccagcgcaatcacccgttcgaaaaagtcgagctccacacactgtgcggtggggttggacgggaagccaaggatcatcatttttggcttgggatagctctcgcgaatggcgcgttccagctcattgaagaagtcgacacccgccaccagcggcaccgagcgtacctgcgccccggcaatcaccgcaccgtagatatggatcggatagctgggattgggcaccagcacggtatcaccgtgatccagcgtcgccagcatcaggtgcgccagcccctctttggaaccgatggtgacaatcgcctctgattcaggatcgatctcaacctgatagcgatcggtgtaccagcgcgagatcgcccggcgcaggcgcggaataccgcgagaagtggaataaccgtgggtatcgtcacgctgcgccacctggcataatttttcgacgatgtgcggcggagtcgggccatccgggttgcccattgaaaagtcgatgatatcttcgccgcgccgacgcgcagccatcttcagttcagcggtgatgttgaaaacgtaagggggtaaacgttcgatacgcgagaaacgacggggtgtgctgttatcagccatgatgtcctctggattacgtaagcgcccggaccgtccgagcgacgcgggtcactgtggtgacccgttacgaacataacgtggcgaggatcattttgtcgagggtggcggaaaatatttttatttttgcggattcagccgccccagcagccaatcgttcacccagcagccgttcagcagataattatcccgtagcgtgccctcaagctgaaagccgtttttctccagaatacggcgtgacgcccagtttcccttcaatcaccatcgctttgagtttgtggaaatcggcttcaagcaaaaactgacacagcgccgccagggcttcgctgccatatccctgaccgcagtggcgatgcagcagcatatagcccacctccgcctgacggtatggctcccattcggggctgcagccaaacaggccaatcggctcaccgttgtcacgacgtcgcgcaaccaggcagagcatatgaaaactgctcgcctgccagggggccagacgctcggtgaagcgctggcggatatccgcttcatcggggatttcgctcacccaggtcatggtgttgcgatcttcatggacggcacgaaacagttgccagtcttctggctgtaatttactcagggttaatctggcggtgacaagttgcatctgatgctcccgatgggcgcggttttccagcggtcactggcgcacctcatcgcgcaacatagcaaaacggcaccttagcgaccagcctctgcagggcgaaaaaactgttcccctttaatgcactcaacctttcctctttttgcagatatgccgtaaaaattgatctgaaacactaactcccgccgtgattgatcgggacgctagcggttcgcgatcacattttttatcatagaggcactttccattgccgacgagtcgcctgtgtcctcccacttcacgatgttactggcagtatttgaccgcgccgccctgatgctgatctgcctgttctttctgacacgcacccgcccgtttcgtcagctgctgcaaaaagatgaacacacccgtgcggagaaagtggcggttactgccatcttttccctgtttgcgctgttcagtacctggtcgggtgtcgatgtcgatggttcactgctgaatgtgcgggtcatcgccgtgatggcgggtggcattctctttggcccctgggtcgggatcgccaccggggttattgccggtctgcaccgttttctgatcgatattcacggcgtaacctccgtgccctgcctgattacaagcatcattgccggtatcgttgcgggcggtattaatcgccgggtactgaaagagcaccgctggcgtgccggtatcgtcggcggcatgctctgtgaagccctgacgatgttgttgattgttgtgtgggcgcgccccacctcactcgggctggcgattgtgtcggaaattgccctgccgatgatcctcggtgcctccagtatcggtatcattgtgctgctggtgcagagcgttgagggtgagaaagaggcgattgctgcccgccaggccaagctggcgctggagatcgccaataaaaccctgccgctgttccgtcaggtgaacagcgactcgctgcgcaacatctgtgacattatccgacgggagatcaaagccgatgcggtggcgatgaccgataaaaaacagattctggcctacgtcggctatggcgaacacaattataaacatggggatgatggcatcagccccaccacggcgcagtcgatcgccagcggtaaaattatcattaagaacaacgatgaagcgcatcgcaccaaagatattcactccatgatcgtgatcccgctgtgggagaaaggcaaagtcaccggcacgctgaaaatctactatcgccgcgcacaccgtattaccggctcgctgaaggagatggcgatcggcctgtcacaaatcatctcaacccagcttgaagtatcgcgtgccgagcagttgcgcgagatggctaataaagcggaacttcgtgcgctgcaaagtaaaataaatcctcatttcctgttcaacgccctgaatgctatctcctcttctatccggctcaatcccgataccgcccgccagctggtgatcaacctgtcacgctatctgcgctacaacctggaactgaacgacgatgagctaatcgacatccgtaaagagctgtggcaggtgaaagattacatcgccatcgagcaggcccggtttggcgataagctgacgatgatctatgacgtcgatgaggatctccattttctgctgccgagtctgctgatccagcctctggtggagaatgccattgtccatggcatccagccctgtaaaggcaaaggcgtggtgacgctgagcgtccgggatctgggcgatcaggtgcggatctcggtgcgggataccggccagggcatcagtgacgaagtgatagcacgggtggcacgcaacgagatgcccggtaataaaatcggcctgctcaatgtgcatcatcgggtaaaacttttgtcgggtcagggattgaatatcgtgcggcatcagccgggcaccgagatttcctttacgctgagtaagaatggccagcgcctggcggagaatctgttatgaaagccattattgtggaagatgaattcctggcgcagcaggagctgagctggatgattcagcatcacagcaaaatcgagatcgaagcctgttttgacgatggtctggacgtgctgaagtacctgcaacagcatcgggttgatgtgattttcctcgatatcaacatcccctcactggatggcatgctgctggcacagaatatccatcagtttgcccacaagccactgattgtctttattaccgcgtggaaagagcatgcggtagaagcgtttgagctggaggcgtttgactacattctcaagccctatcaggagtcgcggattgttaccatgctgaacaagctcgaagccacagcgcaggcgcagcaggcggtcagccatctcagcgccacgcccgcgccgcagacagtcaacctgatcaaagatgagcgcattatcgtcactgccgtgaatgatatttactacgttgaggcgcatgagaagctgacctttgtttatacccggcgcgaatcctacgtgatgtcgatgaatattaccgagttctgttcacgcctgccggaacagcaatttttccgctgccaccgctctttctgcgtcagcctcagcaagattcgtgaaatcgagccgtggtttaacaacacctatctgctgaagctgcgcgatctggagtttcaggtgccggtcagccgcagtaaggtgaagcagtttcgacagctgatgcgcctgtagcgcaggagggttaaaggcctgttcagaaaggggggtggcgaagcaggagagcagcagcaaaaaatccgggggttttcccgatcctgccccgctgaagcaggcgatcgggaaaatcgctcgcgcgcagaatggcagtgcgcgcgaggtaaagcagaatcagatttcgcgacccagcgtctggcgcagatgcgcgcccgcgcccagcaggccaggctggtcgtgcgtaatcatataaaccgggatgctggcaacatagtcgcggaagcggcctttatcttcaaacgccgcacggaaacccgacgacttaaagaaactccaggaagcgtggcacgatgccaccggcaatatagacaccaccaaaggtgccaagattcagcgccaggttgccgccgaaacggcccatgatgacgcagaacattgacagcgcgcgacggcagtcggtgcagctgtcatccagcgcacgctggctgacatctttcggcttcaggttttccggcacgcgattatccactttaacaatcgcacgatagaggttaaccagaccggcacctgacagcacacgttccgctgaaacatggcccagctcttcgcgcagcacttccaggatctgatcttcttcttcgctgttggcagcgaagtcgacatgaccgccctcacctggcaggctgacccagcgcttgtccacatgcaccagatggctgacgcctaatccggtgccggcaccataaatcgcgataggtttatctttgactggctctgtaccgccaaactgaatcacgttttcggcggtcagcatcgggatcgccatagataccgcagtgaagtcgttaatgatttccaggtgttcaaaaccgatgttctctttgagcttgcgcgtggaaaacgcccagtcatggttggtcatttcaacccagtcatcggtaatcgggcaggcaatggcaatacagccatctttaacgtcctgctgttgttcatcaagatagtggcggatgacggcttcgaggctgtcgtattctgatgttgagaatgttttggcctgggtgatgctgccgctttccacctcacacagggcgaggcgtgcgttagtaccgccgacatcgccgaccaaggcataggttgtcattcttctgttgctccgcttggggtcttaagagttggaggacactataaaattctgcccataaaacaacaacgctcaccggtgcgattggtgagcgtcttactcaggtgtgctacagcctaaccgcgatagtccaccctgcacagcggcaactatctgaatcttagccgccgttgcgttgattcaggcaggcggtgacttttcgtagcagtggcggcaaatcctctttctgcatgacgacttcaaccagagagagccacttcggctctgagagtcgcgccatcacttcctctaactgcaccgtttcactgatacgccagctctgcgcctggccctgcaggctaagggcgtgcggtaaggccgtccagttccactgggcaatatcattgtaacgttgtgttgcgccgtgaatcgcccgttcgacggtatagccttcattattcagcaaaaagagtatcagtcgctgctggtcacgcagcatcgaacccagttcctgaattgtcagctgcgccgaaccgtctccgatgatcaggataacccggcgatcaggatcggcagtctgcgcgccaaatgctgccggaagagtatagccgattgatccccataatggctgaaccaccagctgcgcctgcgagggcaatcttaacgcggcggccccaaaggcggctgtcccctgctcggccagaataaggtcgccgggttgcaggaatgcctgcatagcctgccagaaacgcctgctggctgatcaccgccgccggttctgcaggctgcgcggcgggcggcgtggcgccgggttgccactgctggccatagcgttcaaacagcggcagcagctcgctcagcgcatccgccatcgacagcggcgcaaaattttcaccgcccacgctggcgctgaggggctgcagatcaatcagtcgctcagggttaaactgctgcgtgaagccagcagtaatggtgtcggtaaatcgcaccccgacgcagatcgccacatccacctgctcgatctgttcgcacacctgccctgcgctggcctcaccggcataggtaccgacgtaacccggctgctgttcatccagaacccccttgcccatcagcaggctggcacagggaatcgtacgctgttcacgcagcgcggccagtgcggactgctgctgccagcgcagcgcaagaaaatcggccagcagtgaaacccgctgcgccggtgccagcaaacgttccgccgcgtcgctgaaagcgcgacgcgcagcgggcgaagaggattgatgactgttcaggggctgcgcgggtggctgcacctccatggctgccacgtcgacggccatcgacaaatagccgggacgacgggcctgcagcgcactgacgatcacccgatcaatctcagccgtggcgttgtcggcggtaagctgtgccgttgccgcactgacttctgtggccatgcgaataaaatgctggaaatcgccatcgcccagcgaatgatgaacacaatccccctgcaactgggcctgcgtcgcaggcgcgccaacgatatggatcaccggcagatactcggcataactgcccgcaatgccattaatcgcgctgagctcgcccacaccaaacgtggtcaatagcgctcccgcgccgttgcagcgtgcataaccgtctgccgcataggctgcgttaagctcattagcgcagcctacccagctgatggccggatgggcgatgacgtggtcaagaaattgcaggttatagtcgcccggcacgccaaacagatgctttacaccaatctcctgcagacgggtcagcaggtaatctccaacagtaaaagtggacattgcgcattcctttcagggatgagtcgggttaagtatctgacagaggatgaaattagcgaggcgtgccgctattttagccagccgcaatggctggaaaggcgacgttacgctggcggaatattctgtaaaaatgcgaattgcagcgcgctgtcactgagtgtaaccgtatacactgatagacttttggcacatatccccgtttttacccaggagcgctgaatgtcccttttccctcatcccgatcgctatcaacagatggaatatcgccgcagcggccgcagcggaatcaaactgcccgccatttcgctgggactgtggcataactttggtgacagtacccgggtcgataacagccgtgagctgctgcgtcatgcgtttgaccttggcatcacgcacttcgacttagccaacaattacggtcccccccctggctcagcagaagagaacttcgggcgtattctgcgggaagattttcgtgcccatcgtgatgagctgatcatctccactaaagcgggctataccatgtggcaggggccttatggggattggggttcgcgtaaatatctggtcgccagtctggatcagagcctgaagcgaatggggctggagtatgtggatattttctatcatcaccgtcccgatccggaaaccccgctggaagagacgatgcgcgcgctggatcatgtggtgcgccagggcaaagcgctttacgctgccctttcaaactatccggccgatctcgccgccgaagcgatagctatcctgcgcgatctcggcaccccttgtctgattcaccagccgcgctattcgatgtttgaacgcacacctgagcaaggattgattcagacgctgggcgatgcgggcgtcggctgtatcgccttctctccgctggcaggcggcgtgctcaccgatcgctatctgcagggcattccggaagattcgcgcgcggccagcggcagcaagtttcctgaatgagaaccagctgacggatgagaagatggagaaggtccgcaagcttaatgctattgcgcagcagcgcgaacagaagctggcgcagatggcgctggcgtgggtgctgcgcgatgagcgtgtgacttcagtactgatcggagccagcaaaacagcccagatcgatgacgcggtggcgatgctcgctcgccgtcagttcagcgacagcgagttagctgcgattgacgcggcactactgtaacggttttagcgcccggctgacgccgggcgttttctgcgccagaatagtctcaaacccctttctctccccaatttcctcacaatcttccgacacaatgatgcggtaacaacagcaatacgcaggcataatcgctgcgccgcaacagcgtcagactgttgatgaggagaagaaaatgaaaagagcccttatttttgctgccctgctggccctgttgtcgccgctggcacaccacacagcccaggcctccagtgcctctattactctggcccccggcgtcaccctgaatcttggcgatcgcgatcgccgtggctattactgggatggtggtcgctggcgtgaaccgcgctggtggaacgaccgctattcttacaacgaacgccgctggtggcgacacgaagagtggcgtcgtcagcagcagtgggagcgcgaacgccgctggcatgagcgcgaccgtgagcgtcgctggcatgagcgcgaccgtgagcgtcgctgggaacatcagtatcgccgcgatcgtgatcgtggctgggatcatcatgaccgtcgtgggcctgaccatcgcggtccagaccatcacggacacgatcgccattaataaaaacgcccggcagaaccgggcgcttttatttattgattaggtcaggcctgattgctgccagacggagccagcacaggaaacccggtcagatcggaaagacgcaaaagatgtcatccctgacatgctcggcccgcgcgattacgcacctcatccctgaggtgcgcccgtagccgggccaacgcgttgcgttgttcaaaaacgctcccggcgtttttgtccctggcgcgggacgctttcctcctctgaccggattccctgtgctttaagctaattcgcggctgaaagatatctgacttgagtttgtcagttgtctgcaatgcccggcatagccgggcgttttcttgtttaccataaccgctacagccccagcgcttcacccaccagcaggtaaagattcagcgtaatcaccagcagcacgatcagtcgcccggtattctgcatcagacgcgagttaaccatatcatcgcccatcagctcgcggttgccggtaaaggagagcagcggaatcaacgccagcgcaataccgaaactcagcagcacctgactcatcaccagcacccttgtcgggtcccagcctgcccagatgacaataaaggagggcagcatggtgacggtttcggcgcacccacaggggaatatggaagtggataaagccctgcatcaccacctgccccgccagcgtaccgaccaccgttgaagataatccggcggccaccaggctcagaccaaacaccgtcgccgccgcctgacctaacagcggttgcagcgtcagataggcctgatcgagttcagcgattttactgtgcccgctgaagtgaaacgccgctgcggcagtcgccatcattgccaggttaacaaatccggcgatggtcatggcaatcgccacatccagtttagttgaggagtaccgctgacctttgctgtcctcacttttgccctgcgtcagcgcggagtgcaggtaaatcacgtgcggcataatggtcgcacccagcacacccgccgccaggaatacagcatccgacgttggtaacgcgggcagcgccataccgatcaccagctctttgacactgggctgggagaaaaagagttcgacgatataggccgccgccacaaacagcagaagtccgccaatcaccagctccagcggcttttgcccccggctctgtaacatcaatatcaggaacgtggcgatgcctgtcagcaccgcgccctgcatcaatgaaatgccgagcagcagtttgaaccccagcgcggcaccgataaattccgccaggtcagtggccatggcgataatttccgcctgcacccagtaaaaccagacggcaggccggggaaaacgatcgcggatgtgttcagcgaggtttttgccggtagcgatacccagcttggctgacatcagctgaatcagcatggccatgatgttggcccataccaccacccacagcaatttgtagccgtaagcagcgcccgcctgaatgttggtcgcaaagttgcccggatcgatatagccgatagcggcgataaaagcgggccccagtagtgcgagtttgacttttctgactccgcgagcggcgcgctcggcggtacgactttcaaacatatccggtaccctgtctgaacatttgcctgccccggcagcttaggggttagcaggtgcaagtgaaattcgtttattgttatcggtgtaatagatgctgctataaagtatagccattgctatacattacagtaaaggatgtgattgctaaaaatgtgagcaatagtgtcactttacgcccggtgtaaaattcagacaataattatgtggttatctgaagtgaagtatttgtaaacaggacgtgatctctggaacttttctggaaaatataacgatagcgaatacttatattgtggttcagatctcgtttttaagtaacgcgttacatagaatacgcaacaaaatacaaccctcctcaaatttggagcaaccatgtcccatattttgcaatttcttttagcactggtggtggtcgggatactcgccttgctggttagtcacgatcgtaaaagcattcgcattcgctacattatacagctactggtgattgaaattgtgctcgcctggttcttcctgaactcagaagcgggactcggtttcgtcaaaggattcgcgggcttctttgaccatctgctgaagtatgccgctgagggtactaacttcgtctttggcaacatgagcgacaaaggtctggccttcttcttccttaacgtattgtgccctatcgtctttatctctgcgctgatcggtattctgcagcatttccgtatcctgccatgggtgattcgcggtatcggtaccgtactgtcgaaagtgaatggcatgggaaaactggaatctttcaacgccgtgagttctctgatactgggacaatcagaaaacttcatcgcctataaagatatcctgggccaaatgtcacagcgccgcatgtacaccatggccgcgaccgcgatgtcgaccgtatcgatgtcgatcgtcggcgcctacatgaccatgctgcagccgaagtatgtggtcgccgcgctggtactcaacatgttcagcacctttatcgtgctgtcgctgatcaacccttatcgcgttgagaacgaagaagatctgcagttgcaggatctgcacaaaggccagagcttctttgagatgctgggcgagtatatcctggccggtttccgcgtcgcgattatcgttgccgccatgctgattggttttatcgcgctgatttcaggtctgaatgcgctgtttgatctgatcttcggcatctccttccagggcgttctcggctttgtcttctatccgtttgcctgggtgatgggcgtgcctgctggtgaagcgttgcaggtcggcagtattatggcgaccaagctggtatcgaatgagtttgttgccatgatggatctgcagaaaatcgcgggtcagctgtcgccacattcagaaggtattctttctgtgttcctggtctcgttcgctaacttctcttctatcggcatcgtggccggtgcgattaaaggtctgaacgaagaacagggcaacgtggtttcccgctttggtctgaagctgctgtacggctctacgctggtgagcgtgctttccgccgctatcgccggtctggttctggcgttctaagcacggttctgcgcactactctaagcatcaaagggcgagcaggtctcgcccttctctttctgctctatccttgctctgcttcccgctgatttccctttcccgcgttaactctttcattgcacatgtcacagctgcattcagatagtgcacaacaggcggcacagcgtcccgcaaacagcatcggatgtcatagcaggttatgccggttgataacgcaattaagcgtgcgcagcagcgcgtatggcaaagcaatagcgttgggatccgcagaaactggcgaataagagattaatcagaaaggattttgacaacggcgtgtcagaaaatggtggagataagcgggatcgaaccgctgacctcttgcatgccatgcaagcgctctcccagctgagctatacccccacatctggaatcgtttttcagtgccaaacttttgggaagaagtttggtggagctaagcgggatcgaaccgctgacctcctgcatgccatgcaggcgctctcccagctgagctatagccccgaaccgaaaaactgtcgcgttaagcgacggacggcataatatgaaaccccctccggggtgtcaacggcaaaatgacattctctgtttgatcgctgaaaaaggcggcaacctgcgaagtttcagcagcatgctgcaggggaaaatcgtgtctgttcacacaggaccgttttttaactgttattcagtctgccgtcaggttaattcacggttaaatatgttataggaattttcttgtcttcggctttttcgcatgcaaaacttagcccgctaatttagtggtacccgggaccctctcccgcgcaccacgcgtccaccaggcgttatcgtcccattaatcataaaaaaactactgagatactatgtcgctgcatacacctaaagaaatcgcacaactggcgatccagtcaggcgtggctaaaagccgtgcacctgtcagcatccttctgattctcggctttatggcgggcgcatttattgcgaccggcttcctgctggatcttcacgtgatcaacacccttcccgctgaatggggctcttttggtggcctgttaggtgccgcggtcttcccggtggggatcatcatgaccgtgctggcgggtggtgaactgctgaccggtaatatgatgaccttaccggtggcctggttcgcccgtcgcatcagctttatgagcgtggcgcgcaactggttctgggttaccttggctaactttctcggcagcgtggctgtcgcctggtttctttggtcacatgctgggtatgaccgagggcgattacctgaagaagaccgttgctatcgcttctgcaaaagtccacgctgatttcctgcacgcctttatttccggtatcggctgtaactggctggtttgcctggcggtatggctggcctttgccagtaaagatgtggtcggcaagatcttcggcatgtggttcccggtgatggcatttgtggccattggcttccagcacgttgtcgctaacatgtttattattccggccgccatttttgccggtcagatgagctgggcagagtacttccctaattttattgccgtcttctcaggcaatgccgtgggtggtgccgtgttcgttggtctggcctatttccttgcattccgccctgccgctgaacccgccagtaatcctcagtaatgatgttttgccttttgtcgagagacaaaaggcaatttcagcttcagttactttcacccgttacgttttgctgtaatatgtcctgctaatgtattaatcagggactgcatcgtgaaaaaggaatggcttacccccgaagagctggctgcagagacgggttacagtcggcaaacggtgaataaatggatcaagcgggaaaactggacgaccacgccgaagcccggtgtgcaaggcggtaaagcccgattgattcacattgatgagcgcgtgaaaagttttattcagtcgacccgtaaccttaacgagccgacggcaacttatggcactccgtctaattcattacctgcgttattaataagttccgtccagcaaatgactcaggacgagcaggatcaattcactgcactaatcttacgcgaaggtatcaagggcgttttgcagcgactgggaatcagcgaagagtaaggtgtatttatcagggaaggtatgatgaaaaaggaatggttaacacccgaagaactcgcctcagagacgggcctgagccgacagacagtgaacaaatggattaagcgcgaaaactggaccaccctgcccagacccggcattcagggcggcaaggcgcgattgattcatgtcgatgatcgcgtagaaaaatttatccattcgacgcgtagcctgcacgaacccgccgcaatgtatagggttccggcagattcactgacggcactgttagtaaatgcggttccgcaaatgagtcaggctgaacaggagcagctgtcagcgctgatattacggataggaattaaaggcatgttgcagcgtctggatatcactgaagagtaaaaaccggaagcgcgaagcttccggttctgtttattaagcctgcgcttcccgctcactgataaaggccagcgcctgctcaatacgtgcaatgctgcggctgcggcctatcgcttccacggtcacatccagtccgggtgactgaccggcaccggtcactgcaacgcgcagcggcatgcccactttccccatcccgacttccagctcatctgcggtgctctgaatagcctgatgtacgttttcagccgtccactcttcgatcgcggccagcttatcgcgtaccacttccagcggctgacgtgctaccggacgaagatgtttcttcgcggcatcggcatcaaattctgcaaagtcttcatagaagtagcggcaggatgcagccatctctttcaatgtcttgcagcgctcgcctaacagaccaaccagcttcgccagttccggccccgtgcgggtatcaattttctgctcttcaatatgccactgcagatgtgtcgccacatattctggcggcagcgtattgatgtagtgatggttcagccactgcagtttctcagtgttgaacgcactggcagacttactgaccgcatccagggtaaagagctcagccatttcggccacgctgaagatttcctgatcgccatgtgaccagcccagacgaaccaggtagttgagcagcgcttctggcaggtagccatcatcacgatactgcatcacccctaccgcgccatgacgcttggagagctttttgccgtcatcgcccaggatcattgagacgtgggcatagaccggaacctgcgcgccaattgctttgaggatgttgatctgacgtggcgtgttgttaatgtggtcttcaccgcgaatcacatgggtgatgcccatatcccagtcatccacgacgacgcagaagttgtaggttggcgaaccatcggtgcggcggatgatcagatcatccagctcctggttgctgaactcaatcgggccacggatctggtcgtcaaagatgaccgaaccttcctgcggattgcggaaacgcacaacgcacggctcatcatctgcatgatgttcatggctgtcacggcagcggccgtcgtaacgcggcttttcgttgttggccatctgctcttcacgcagcgcttccagacgttctttagagcagtagcatttataggctgtgcccgcttccagcatttcatcaatgaccgcgttgtaacgatcaaaacgttttgtctggtagtaagggccttcattccagtcgaggctcagccagttcatgccatccatgatggcttcgatagcttccggcgtggagcgctccagatcggtatcttcaatgcgcagcacgaaactcgccctggttgtgacgggcaaagagccaggagtaaagtgcggtacgggcgccacctacatgcagatagccagtcgggctgggcgcgaagcgtgttttgattttcattgagtattgccttagatgcgcgggttctctgtctggatgacaaaaaacaggttagacgcgaaaaaacagtgggcacattctagcatctgacggtgaatcctcaatgcatgcccgccggttgccgcccgggaaaaggggcttttctgccagtaaaaccagcacattggctaaaagcgcgacagggtgtttaaaaataaaccgaacgcacatttatgttttaaaaagcgttgactcaaaatcaactatccctataatgcgactccacacagcgggggtgattagctcagttggtagagcatctcccttacaaggagggggtcggcggttcgaacccgtcatcacccaccactcttaacagcgtggcccgcagtgaacaggtatgaagatatgggtgattagctcagttggtagagcatctcccttacaaggagggggtcggcggttcgaacccgtcatcacccaccatatcttgcctgttagtagtactgaagtacgaagtgggtgattagctcagttggtagagcatctcccttacaaggagggggtcggcggttcgaacccgtcatcacccaccacttcgggtcgttagctcagttggtagagcagttgacttttaatcaattggtcgcaggttcgaatcctgcacgacccaccaattcagaataaagcgcctttaaggcgcttttttcgtttccggggcacggactttaccgtgcaggctgagaacctgctgcaggttcgactgaatcgcagggagcgattcaggctgatgcgacagcatcacccgcagggcgaggcccacgacgggccgaggctatcctgcacgacccaccaattcagaataaagcgccctaaggcgcttttttcgtttctgctattgagagatttcctgtgctacagggtaaaactgctttttccagctatttcagactttaaacaacgtgctggatcaggtagcaagggcgaagctgccctttgctaaggtactggataagctctcaccttttcgcaaccttaacaatttcagctctcaagtcgtttcacagcgtgccgataacgtatctgacaacttacagggagaaaaatgatgtcttcaatttccggaattctaagcagtgcagtcagtggcggtgacagcggtggcggcagtgttgcctcgcaggtcgcggcgctgaataaacagattcagaacgtcttaacgcaagtcaaagagctggccgacaacaaagaaactgactgacgaacagaagtctgaaatgcagcagatgtatcagtcacaaatcaccatgctgcaggcacagattgctcagctggaacagaagcaggccgagcaggatcagccaaagagtgacagctcgtctgtcagtgagagcaaagcagacgggattaaccgccctaccgacaccaacaaaattgatgtctacatctaaaatgcgggcctggcctcgcgttgttgcgccagcagcgtcgcctgctggcgcacctcctgccagattgcttcggcagcaggcgtcagcgaacggtttttacgcttgatcagcgtaaggctgcgattgatttccggatatagacgccgcacggttaatgcgcgatcagccggcaacggtaacgccagcgcgggcagaatactgatgccgatccccacctgcaccatcggaaacagcgtagcgggatgaccaatctcctgaacgacttcagccctgatattctgctgctgcatcgccgcatcaatgaggacccgactgcccgaagcgtagtcctgaagcaccatggtgcggccatccagcattgaccattctgccctttccacctgcgccagcggatcatcatcacggcatagcagcaggaaaggctcatcaagaatcgcgatgctgtcaaaatcgctgtcgctgagtggcccaatcacaatcccgaaatcgacttcggcgttacgcacactttgcagcacccactgctgggcgcgatcgtgcagtatcactttgatgtcaggaaagtgttgctggctggcggccagacattgcggcatcagatgagcggaaatggtctggctggctgccaccctgacggtaccactgcgctgttcgccaaaactgcggatatccagcagcgtggtatgaatctcctccagcaggcgctccatgcgtgacgccagctgttttcccgcttcagtcagcatcacctcccgggtggttcgatccagcaaccgcacgccggtttccgcttccagctctttaatactgtggcttaccgccgactgactcagacctatcgcctgccccgcctggctgaatccgccatagtgtgccaccgcaataaaggttcgtagctgacgcagggtgtaattcatcgattctgctcatagattaattcaataaatcaattttatttctaaacaggtttcacgcacaatcgcgctattgaaaaatttaccggaatttaacaatgggatttttaaaactcgatccgatgatggttaaactcatcatcaccgtgctgctggcctctttcctgccagccagagggatctacgttgatatattcagctatctcgcgacggcagcgatagcactgctgttctttatgcatggtgccaagctgtcgcgtgaaaagatcatctcaggcagcagtcactggcggttgcatctgtggattatgttcagcacctttgtgctgtttccggtgctgggtctgttgctggtctggtggcatccggttaatgtcggcccggaaatttataccggctttatctacctctgtatcctgcctgcgaccgtgcaatccgctatcgcgtttacctccatggcgggcggtaacgttgcggcagcggtatgcagcgcctctgcatcaagcctgctgggtgtgtttatttcgccgttgctggtgaacctggtgatggatattcacagcagcgcgcccagcgatggactggagcagatcgggaagattatgctgcaactgatggtgcctttcgtgctgggacacctctcacggcgctggatcgggggctgggttgaaaagcaccgcagcctgattggcaaaaccgaccagacctccattctgctggtggtctactccgccttcagtgaagcggtggttaatggcatctggcatcgcgttgggttgattacgctgctgtggattgtggcaggctcaatcattctgctgaccgccgtgctgattatcaacctgctggcctcgcgtctgttccgctttaaacgcgccgatgagattgtggtgctgttttgtggttcgaagaagagtctggcgaatggcgtgccgatggcgaatatcctgttcccggccagtaccgtggggattattgtgctgccgctgatgattttccatcaggtacagctgatggtctgctcatttattgccggacgttataagaagaccaatgagaagcagcaggctgtgcaggtcaaagattcggtgatggagtctcagaaatagatcggctgcccgccagtgcgggcagcgttacttgcgggtctgaagcggtttaactaacccttccagaccctcaatttttattgtcagggtgagttgcatgagatcacccagcagaccagacggaaagtccccactgcgggcaaaccacagcagataaggctcaggcagatcgatcagcatccgccccttatatttgccaaacggcataggcgtattggctatcgccaccagctgatgttcatccatctgaggctcccagcaagcggatcatttccgcttcatcaatcacttcaatgccaagctccgctgctttcgccagctttgaaccagccgcttcaccggcaatcagcaaatcagttttctttgagacactgccgctgacttttgcgcccagcgcgatcagctgcgctttggcatcatcgcggttcatctgcgacagtgagccggtcagcaccaccgttttaccggcgaaacggactgtcgatctcttcggctctcaccaccaccacctgcggccagtgaataccgatatcctcgaccagctggcggataacctcacggttgctttcctcttccatgaagttgcgcacgtgtgccgcaacgactttgccgacatccggcaccgcaatcagcgcctcaagatcggcatccatgaccttctgcaactcaccaaaatggttagccagattggcagcggtggcttcacccacttcacgaatgcccagtgcatagaggaaacgcgccagcgtagtcgatttcgctttctccagcgcgtcgacaacgttttgcgccgatttcggccccatgcgatccagtccggtcagtttgcccgccgtgagacggaacagatccgcaggtgtgttgacgtactctttctccaccagctggtcgataatcttatcgcccatgccatcaacatccagtgcccggcgcgagacaaaatgcttcagcgcctctttgcgctgagcaccgcagattaaaccgcccgtgcagcgcgtgaccgattccccttcgacccgttcaacctcggaaccacaaaccggacagtgtgccgggaacaggacttcacgcgtctgttcagggcgctcggccatcaccacgttgaccacctgcgggatcacatcaccggcgcggcgaataacgacccgatccccgatgcgtaatcccagccgctcgatttcatccgcgttatgcagcgtggcattgctgacgataacgcccgcgacctgcaccggctcaaggcgagccaccggtgtgatagccccggtgcggccaacctgaaattcgacgtcccgcacccaggtcagttgttcctgtgccgggaatttaaaggcaatcgcccagcgcggcgcgcgcgccacaaagcccagtttttcctgcagttcctgtgaatcgactttgatcaccacgccatcaatatcaaaacccagattcggacgctgttgctcaatatcacgatagaaggccagggcttcttctgcgttgtgcaccagcttaatgcggtcgctgaccggcaggccccaggctttaaactgttgcagacgccccatgtgactgtgcggcatctcaccgccttccagcaggccaaaaccgtagcagaagaaggtcagcggacgtttggcggtaatgcgcggatccagctgacgcagagaaccggctgctgcattgcgcggattagcaaagactttgccatcagtccggcgtgcttcctcattcagcttttcaaagccgcgctgcgtcataaatatttcgccacgcacttccagccgtgccggaatgttgtcgcctttaagccgcagcgggatagcgcgaatggtgcggacattggcggtaatgttctcgccggttgtgccgtcaccgcgcgttgcggcctggaccagcagaccattttcatacatcaggctgaccgcagcgccatcgagcttgagttcacagcagtaggttatgtcgtcactgcttttcaggcgatcctgcacccgcttgttgaaagccataaacgtggcttcatcaaaggcgttatcaagcgacagcatcgggacttcatggcgcacctgctcgaagaccgtcagcggcgcggcacccacgcgttgtgtcggcgagtctggcgtaatgagatccgggtgttcctcctccagctgacgcaattcgcgcatcagacgatcgtattcagcatccggcacttccggcgcatccataacgtgatagagatattcatgatggcgcaacgtggtgcgcagttcggtgatgtgatcctggacggatttcataaagccccatcagataaaaaacccccgacaggcgggggtttgtttttaacaattcagatagcgtttagcgcaggtctcagacgccaaccacatcgcggatacgcgctttgtaagtttccagcttctgtggtgtcatcatgcgacgctcatcatccagcaccacgccacctacatcatcagcgatacgctgagccgactgcagcatcagcttgaagttctgattcgcatcgccataagaaggcaccatcataaagatagagatgccaggcgtgctgaaatcggtcatcaggtcaggattgaatgagcccggcttaaccatattggccagactgaacaataccgggccgctgccagccgggctgagatgacgatggaaaatgttcatttcaccaaactggaagcccgcctgaagaataccctgcagtagtgcctcaccgttcagttcaccgcccgagtgtgcggcaacatgcagcaccagtaccgcttctttcggtttttccgctggcgctttagcagcaggctgtgctggcgccggtgtcacttcaggctgcggctcaggttctgcctggtactgcggtgctggctgtacagattccagcggatcgagatccagcagcgggtcggcctgaacgggcggcgcgacaaaagtgggtgcgggctgctgacgaaccggttcagggcgcgactgcggagcaggctgcggtgccgtgttaaaaagcgggtcgctttcaggttcgggttgcggtgcgggtcgtggcgcaggctgacgcacaggctcagcgggcgcaggcttacgcggcgcttctggctgtggctcgcgaatctcatcgaaacgcggttcctgatgtacgttgcgatcagaacgaacgcgaacctcgccgacgccatcatcctcgtcgtcaatcaggtcctgctcatcattttcatcacgttgttttagacgtttgtgcgggcgatcgcggaacactgacgaacgctctttacggctggtccacagcccgtgaagaaggagcgctataatggcgatcgcgccaacaacgattaatatcagacgcaaatcctgcatcattgtattctctgttgttccaataccttgccaccgcggcaaactttatcctctaactgtatttgccctgctacacaagtgcaagtctgtgcactattttctgacaaataagataggcaacccacgctttttcgctgtttttttacccaaacggcacctggcctggagaaaaagccaggttatagtgggcgcgccttaacatcttcaggagaactggctttatggcccttgagaattccgtctcaaattttaacggcatgcactactttagccagggctggaaactggtacgtctgcctggcattcgccgctttgtggtgatgccgttgctgatcaatatcgtgatgctgggtggcgctttcatctggttgttctatcgtctcggtgactggatcccgcggctgatggcccatattccggactggctgcagtggctgagctatctgttatggccgctgtcggtgattgcgattgtgctggtgtttagctacttcttttcgaccctggcaaacttaattgccgctccgttttgcggcctgctggccgagcagctggaaggccgcctgacaggcaagcctctgccggacagcggctgggctggaatgatcaaggatgtgccgcgcattatgaagcgcgagatgcaaaaactgggttattacctgccccgcgcgctgggactgctgctgctctactttattcctggctttggccagaccgttgcgccggtgctgtggttcctgttcagcgcctggatgttgtccatccagtattgcgactatccgttcgataaccacaaagtgccgtttcagcagatgcgcaacgccctgcgtcaacacaaaacggccaatatgcagtttggcgcgctaatcagtctgttcaccatgatcccggttctgaacctggtgatcatgccggttgccgtctgcggtgccaccgccatgtgggtcgatcgctaccggtcaacgctggcacgtcatgagttgcgttaaattcatcagcgcgccttatgctctttttagcagggcttattgccgggcgacatatagatatacgatttctttccttccgccaccaggcagaaaaggtatgctcatagggttcccaataattcatacagttaaggacaggctatgagtaagatctatgaagacaactctttgacaattggtcatacgccattggttcgactgaaccgcatcggtaacggccgcatccttgcgaaagttgaatcccgtaacccgagcttcagcgtaaaatgccgtatcggtgccaatatgatttgggacgcagaaaaacgcggtattctgaaaccgggtgttgaactggttgaaccgaccagcggcaacaccggtattgctctggcctatgtcgccgcagcgcgcggttataaattaacgctgacgatgccagaaaccatgtcagtggagcgccgtaagttgctgaaggcgctgggcgcgacgctgatattgaccgaaggcaccaaaggcatgaaaggtgccatcagtaaagctgaagaggttgttgccagcaatccggataaatatgtgctgctgcagcagtttcagcaacccggccaacccggaaatccatgaaaagaccaccggcccggaaatctgggaagacacggacggcgaagtggatgtctttattgccggtgtcggcactggcggtacgctgaccggcgtcagccgctacatcaaaaacaccaaaggcaaaaaagatctgattaccgtcgcggttgagccgaccgattccccggtgattgctcaggcgctggcgggcgatgagatcaagcccggcccacacaaaattcagggtatcggcgcaggctttatcccgggcaaccttgagctgaatctggtggaccgcgtcgtggccatcaccaatgaagaagcgatcagtacggcgcgtcggctgatggaagaggaaggtattctggccggtatctcatccggtgctgccgttgccgcggcgctgaagctgcaggaagatgaagccttcgccaacaaaaatattgtggtgatcctcccctcctccggtgaacgctatctgagtaccgccttgtttgccgatctcttcactgaaaaagagcttcagtagcagaggccgatagtccgaaaatggagaaaaaagcacccaatcgggtgcttttttgtggtgcagatctcactttcatcacccggcagattgatttcagtgacgccgctctggtatttagactgccaattatttcgatgcctgaaattaatccgcgtttgaagtggatcaagctgaatcgatttacggattcagtgaaacggcgaatcacggcataattaaccggtgacgtgtagaatcggttttgagacgcaacggactgtagatttgacgcatgcgcgtctttggtcagcatgaagctatacccgcgcacctacacaggctaaagtaaaggctccaggctagactttagatccataacactcatcctgataacgttggggaaatagaatgttccagcaagaagttaccattactgcaccaaacggtctgcacactcgcccagctgcgcaattcgttaaagaagccaaagctttccagtcagaaattaccgtgacctctaacggtaaatcagcgagcgcgaagagcctgttcaagctgcagacactgggtttaacccagggaaacggttgtgaccctttccgcggaaggtgaagacgagcagaaagcagttgagcatctggtcaaactgatggctgaactggagtaatctccgctcagctctccagcaaatcgactcctctgcgccattgagtgcaaacatcttgatcgcggacaacctgtccgcgttattgctttcgtagagtacgtgtcccgcgacaatggcaccgcacagagtcccatcagccatcgtgattaaaaggtagcgttatgatttcaggcattttagcatcaccaggtatcgctttcggcaaagcactgctgctgaaagaagacgagatcgtcatcaaccgcaagaaaatttctgatgaccaggttgagcaggaagttcagcgcttcctcgatggccgcagcaaagcggcattacaactggaagcgattcgcgtcaaagcgggtgaaaccctcggtgaagagaaagcagcaatcttcgaaggccacattatgttgctggaagatgaagagctggagcaggaaatcatcgacctgatcaaaaaagatcacgcttctgccgatgctgctgcttactcggtcatcgatggccaggcgaaagcactggaggagttagatgacgaatatctgaaagagcgtgcggctgacgtacgtgacatcggtaagcgtctgctgcaaaacatcctcggtctgcatatcgttgacctgagcgctattccggacgaatccattctggtggcaaaagatttaacgccgtcagaaaccgcacagctgaacctgaagaaggtgctgggctttatcaccgatctgggtggccgtacctcacatacctcaatcatggcgcgctcgctggagatcccagccattgtcggtaccggcaatgtgaccgtcacggttaaaaatggcgatttcctgattctggatggcgttaacaatgcgattcacgtcaacccttcagaagcgattcaggaagagctgaaagccgtacagaaccagtatctgtcggaaaaacatgaattagctaagctgaaagatctgccagccgttacgctggatggtcatcaggttgaagtctgcgccaacatcggtactgtgcgcgatatcgccggtgctgaacgtaacggcgctgaaggcgtgggtctctaccgcaccgaattcctgtttatggatcgtgactcactgccaagcgaagaagagcagttccaggcgtacaaagccgtcgctgaagccatgggttcacaggccgttatcgtgcgtaccatggacatcggcggcgacaaagacctgccttacatgaacctgccaaaagaagagaaacccgttcctcggctggcgcgctatccgtatcgccatggaccgcaaagagattctgcatgcgcaactgcgtgccatcctgcgcgcctcctctttcggtaaactgcgcatcatgttcccgatgattatttcggttgaagaagttcgcagcctgaaagcggaactggaactgctgaaagcgcagttgcgtgaagaaggtaaagcctttgatgagagcatcgaagtcggcatcatggtggaaaccccggcttcagccgtgattgctcatcatctggcgaaggaagtcgacttcttcagtattgggacaaacgatctgacgcagtatactctggcggtcgatcgtggtaatgatttgatctcgcacctgtacaacccaatggcgccgtctgtgcttaacttaatcaagcaagtcattgatgcatctcacgctgaaggtaaatggaccggcatgtgtggtgagctggcaggtgatgaacgtgctacactactgttactgggaatggggctggacgagttcagcatgagtgccatttctatccctggcatcaagaaaatcattcgtaatactaattttgaagatgcgaaggcattggcggagcaggcactggctcaaccgacagcggaagatttaatgaacctggtaaacaagttcattaaggaaaaaacgctctgctaatccgcatgatgctggccccaaattactgcttaggagaagatcatgggtttgttttctaaactttttggcgaaaaaacggatagcgctgggacaattgacatcgtagcgcctctgtcaggcgaaatcgtgaacattgaagacgtaccagatgtggtgtttgcagaaaaaatcgtgggcgacgggattgcgatcaagcccagcggcaacaaaatggttgctcctgttgatggcactatcggtaagatttttgaaaccaatcacgctttttcgatcgaatcagacaatggcattgagctgtttgtccacttcggtatcgatacggttgaactgaaaggtgaaggcttcaaacgcatcgctgaagaaggccagaaggtcaaaaaaggcgacgtggttatcgagtttcgacctgccgttgctggaagagaaagcgaaatcaaccctgacaccggttgtcatctccaacatggatgaaatcaaggaattgattaagctgactggccaggtcaccgtcggcgaaacgccggtgattcgcatcagaaagtaagcattcgttcataacataacggcacccgcgggtgccgttatcgtttctgctttctgcctgttcagggctgccagtgcggcagacgcagcgtcagttccagtccgccttctggccggtttcttgcctcgacctcaccatgatgcgccagcaccaccttgcgcacgatagccagtcccagaccataacctttgcccatcagcggcgaattcacccgcacaaacgggtcaaagatgctggagagtttatcctcatcgacacccggcccctgatcgcgcacctgaatcaccagccactgctgttctgtgcgcagatgaacatcaatccgctgccctggctgagagaagcgcagcgcattgcgcaatacattctctgctccgcgccgtatcagctctgcattgccccgcacggtgtaatcggcccgctcgtcgacctgcaactctacctgcacgcctgggatctgcgcttcataacggacatcggtaataaccgcctgcagcaagccggtcagatcaaaatattgctcatccgggatgctttcatgctcagcccgcgacagtgtcagtagttcaccgatcatcttgtccagccgacgcgcctcttcatcaatgcgatcaagcgaactgttcacactctctggcgtctgtctggccagcccggtcgccagctgcagtcgcgccagcggtgaacggagctcatgtgagatatcatgcaacagttcttcacgggcgcgcaccagggtatcgagccgctcgaccatagcgtcaaaggcttcagcgacgtttgagatctcgtcgtggcgcttacgcatgatcggaaacagccgcacgcttaaatcgccctcagccacgcgggaaaatccttcccgcagctgacgcataggtcgcgtcagattccaggccagcagcagactgaacagcaatcccaccgagccggcgaagacaaacatcggctcaggaatattcagaaatttgcgcggcatcatgttcagcgtgctgtctttacgcatgccatccaggtcgtagcgcagctgataggctttgccatccgcgccgcgaacccagcgcaacacctcttcaggaaagcgccctctgatatccaggttgccgctgttttctgattgggacggctttgtctgttgggtgacgtggaagaactgccgatcgctgttatcccagtctgagagcatcgcattcagcgcatcaggcccgccccgctccagcacggacgcggcggaggtcatctgcagatccacaatacgacggatagctacgagttcaggcggttcatgccgtttaccggagagcgtaaagccgagccagataagctggctcataatgacgaaaacgatccagaagccgataaagatcttccagaacatgcgtccacggtaactctgcttcatcgaatacggtagccgatgctgcgaacggtttcgatgttgatgctgtcagcggttaatgcactgagcttctgacgaatgttactgatatgcacatcgacgctgcggtcataggcttcacgcgggcgaccgagtcccttttcggagagctcatcttttgacaccactctgtccggcgcacgcagcagcagatccagcagattaaattccgacgccgtcagatcaaaggttttaccctgccattcgctgatgcgggtggcgggattaagcatcagctctccccagcgcagcggctctctggcgtctggctgtggcgcctgctcttcgaaacggcgcaatacggcgcgcagacgcgccaccagttcacggggatagcagggcttgggcatatagtcatccgcgcccatctcaagaccgatcacgcgatcaatattatcgcctttggcggtcagcataatcactggtatccggctgttctggcgcacctgacgcaacacatcaatgccgctcatgtcaggcagcataatgtccaggatcatggcggtgaactctcccgataacgcgccctgcacgccagcgctgccggtcagaaccagctgggcatcaaacccttccccgatcaggtactgacttaacatcgtgcctaattcaacatcatcatcaacaagcaaaattttcatggttatctctctggagaattgccgctattttgtcctgtgctgaacattcgcgcagcctgatttacgcgatccttacagattcagtctgtctggcactgaaaattggggttaaaaaaaggcctgtgggcagtaaatgcacgcacaggcctgattccgtattggcagaggttactgatgatagagtccggtagagagataacggtcaccgcgatcgcaggcgatcgccaccaccacgctgccaggattggcctgcgcaatgcgcagcgcacccgccaccgcgccgcctgaactgacgccacagaaaatgccttcacggcgtgccagcgcgcgcatcgtctcttccgcttccttttgcgtcatatccatcacatcatccaccagatcgggacggtagatccccggcagataggccagcggccagcgacgaatacccggaatactgctgccttcgctgggctgcaaaccgatcacctgcacgcccgtattaagctctttcagataacgccccacgccggtaatggtgccggtggtgcccatgctggagacaaaatgagtcatgcgctggttcgactgctgccacaattccgggccagtggtctgatagtggcccagcggattatcgggattattaaactggtccagcacccggccttcaccgcgcgccgccatcgcctgcgccagatcgcgtgcgccctccatgccctgttcacgtggcaccaggattaactctgcgccataggcgcgcatcgcgtcctgccgctcctgactcatgttgtcgggcatcagcaggcgaagtcggtagcctttcatcgccgcgatcatcgccagcgcaattccggtgttgccgctggtagcttcaatcagctgatcgccaggtgaaatatcaccacgcagctctgcctgattgatcatcgaccaggccgcgcgatcttttaccgaacctgccggattattgccttccagcttgagccagacctcgctgccgttggcgggcgtcaggcgctgcaacttaatcagcggggtattgccgatggtattttcgagagtcgtcacggtgcggttcctggcatcttacaaaccagatgcgaaaaaaaggcgggaatgacactcccgcccggtgttgaagagaaaatatcaggcgctttgtgcaaaggcaactgcgcgcagtggcgtatcgcccttatagagacgcgcctgctgtaagccaacaaacagacgctcgccgcgaatcggcgctgtctgctcaccttcaaacaccaccgaaaccggctcgctctgccagccggcaggctggacgaccagctgccagaagtgtccacgcgggctcacttccagtacctgtaccggcagcggggtttccagactgctgcggcgtgatacgtcgatttcccacggacgcaggaacagctcaaccgcaccctgatgtgccgaggtatagcccagcggccagtggtacgcgccgacgtggaactgtgatccctgaatctccccatcaaagcggttcacttcacccaggaattccagcacaaaacgggtcgccggatcgcgccacacatcatctggcgtgccgacctgttcaatgttgccctggctcatcaccaccacgcgatccgcgacttccatcgcctcttcctggtcgtgggtgacaaatacactggtgaatttcagctcttcatgcagctgacgcagccagcggcgcagctctttacgcacctgagcatccagcgcgccaaagggttcgtccagcagcagaatctgtggttcaaccgctaacgcacgcgccagcgccacacgctgtttctgaccgcccgacagctgtgccgggaagcgattcgccagatgagccagctgcaccatctccagcagacgggtaacacgctgtttgatctccgccgttgaaggacgctcacgacgtggcagcacggtcaggccaaaggcgatgttgtcgaataccgtcatatgacggaacagcgcgtagtgctggaagacaaaaccgacctgacgatcgcgcgcatgcaggcggctgacatcgttgccatgaaaacggatatgaccgctgttctgatgctccagcccggcaataatgcgcagcagcgtggttttacccgagcctgatgggccaagcagcgccaccatttcacccgaggcaatatccagagagatatcgttcagcaccgatgtgcgaccaaaggatttgttgatcttgttaatctcaatgctcatgatttccctcctgttgcaggcgtttgtgctgttgctctaaacgccactgcacaatgcttttcagaaacagcgtcacaattgccatcagggttaacagggcggccgcggtgaacgcgccaacggtgttgtagtcctgatgcaataattcaacctgaagcggtaacgtgtaggtctcaccgcgaatcgatcccgataccaccgagaccgcaccaaattcaccaatcgcacgggcgttggtcagcacgatgccatacagcagcgcccagcgaatgttcggcagcgttacgcggcggaacatctgccagccagaggcacccagcagcaccgccgcttcatcttcgtgactgccctgactcagcatcaccgggaccagttcgcgcaccacaaacggacaggtcacaaacaccgtcgccagcaccatgccaggccaggcaaacataatctggatgttatgcgcatccagccagccgcctgccgggccattaacgccccagaacagcagatacatcagaccggccacgaccggcgacacggcaaaaggaatatcaaacagggtcagcagcaactgacgacccggaaaggtaaagcgcgtcaccagccaggcgagcagcgtgccgaacaccaggttaaccggtacggtgatcaacgccaccatcacggtcagccagatggcgtgcagcatgtccgggtctgccagattgctgagagcgacaatcagcccctgattcagcgcttcccagaagatggaggccatcggcaccaccagcagcagaatcgagatcagcgcgccgatactaatcagcagccacttaccccagttcactggctgacgtgcagcgtgattaatctgtgaaacctcagccattagtgacctcccagacgacggccaaagcggctctgtaatgtgttaatcgcaaataacagaatcagcgatgccgccaggatcaccgaggcgatggcgctggccgccggatagtcgaactcctgcagccggacaaaaatcatcagcgaggtgacttccgttttccaggcgatgttaccggcaataaagatcaccgcaccaaattcacccaggctgcgggtaaaggagagcgccgttccggccagcagcgccggtgccacttccggcaacacgacgcggcggaagctctgccacggcgtggcacccagcgtttcggccgcctcttcatactccgggcctaactcttccagcaccggctgtacggtacgcaccacaaacggaatgctggtaaaggccatggcgatggcgataccaatccaggtgtaagagattttgatgtcgaactgagcgaaccactgtccataccagccgttgaccgaaaagagtccggccagggtcagacccgccaccgccgtaggcagtgcaaacggcagatccatcaggccatccagcagcgtccgccccggaaaacggtaacgggtcaggatccatgccatcagcatgccgaacaccgcattaaacagtgaggcgacgcctgcagagagcagcgttactttataggcggcaatcagctgcggattggtcaccacatcccagtactgttgcagcgtcatctgcgacagctgcatgatcaccgcgctgataggcagcagcagaatcagacaggtaaagagcagactggtgccaaggctgagaccaaagccgggcaacacgcgtttctggctggctgcaaacattatccgcgccccgccgctaacaacttatcaagctcaccgccgctgacgaagtgcgtcttcatcaccttatcccagccgccaaacgcctcttccacccggaacaggttggtctgcgggaaacgatctttctgctccgccatcagctgtgcattgttcacgcgatagtagtagtgagtaataatattctgcgcttcaggtgtatagagatagttcagataagcgctggccgcatcagcggttttattggtggcgacgtttttatccacccatgccaccggaaactccgccagaatgttggttttcggcaccaccacttcatactcatctttgccgtactggttgcggatgttattcacttcggactcaaagctaattaatacgtcgcccaggccacgctcagcaaaggtcgtggtggcaccgcgaccaccggtgtcgaatacttcaacgtttttcagaaattgcgtcataaaggcacgggttttggcctgatcgcccccgtccgctttctccgctgcgccccaggcggccagataggtgtagcggccattacctgaggttttcggattcgggaaaatcagcttcacatcactgcgggtcaaatctgaccagtcgtgaatctgttttggattccctttgcgcaccagaaacgccatggtggagtagaaaggcgagctgttattcggcagacggcttttccagtctgcggcaatcaggttgcctttatcgtgcagcacctgcacatccgtaacctgattgtatgtgacgacatccgcgcgcagtccctgcaggattgccagcgcctgcttcgatgaaccggcgtgcgacatcttaatggtcagtggatcgccgggatggctggcatcccactgcttaacgaagggagcattcagggcgacaaacagctcccgcgaaacatcgtaagagctattgaggagttcagtggcattggctgcgccggccaggctcagcgacaacgcgataccgctcacgatttttttcatcgcttgtaatgtcatttggcaccctgaaaaagtttgatgcggatctcacccgctgaggcaccagtttatttataactcagtgaaaaccagtaacggttttatatatcgtttgatgatttcaaagtcgaaaaaagcataagacgacggcactgtttatgcaaaaatcagcaaaagccgataggtaggaggaaccccgtgccgtgcgcgccggcaaaggttttgagaggctcagcggccgcctgacgggcggcgcgctgaagacgagggattaacgctgccagacaatcttgctgattttccagcttttcagcgtatcgtccgagggcattaatccctccggtccatgccagtcaccatgataaacataggtcagatgctgactgccaggtgcgcggcacgccacgtcacgcgcatcggtgccgctggctaaggtgcagttgtcgaaggctttgctgaacttattactgaagagatcacccactttgctgccatcgctgctggcgattgcgctgtccatgacctcaatacgttcgacctgcgactgcccgtaaatcaccagcttaacgttgccatcatccagcgcctgccagaaagagaccacctgaccgttctggctgcgcatgccctgacgcaggctatagtcaccgttcagtccggcattaatcgcgtcctctttcatggcggtcgaggcagttaacccacccacaccctgttcagtcgcggtcagcgaggaaccgaaccagttccacggcagcgccgaagaccagtgatacgtcagcggattccaccagcttgcctgctggctgctgtcagcgccggaacccgaactggcacagccgctcagtacaaccgcggcaatcagtagcgtggaacgaacagctttcatgagaactcctgtaaatgcgatgccggaaaggcggaactgattggagtcgcaaagcgacaaaaagtttagtgaagatgatgttcgggcagaaagcagtcgcgacagcggcggctggattgcagccagatcagcgccagcaggtcaaagagcgtcagcaacaatggcagcggtgaggtgagcagatcgccctgcacaaactgcattccctgccagagcagattcaccagcagcgacagcgccagcacgctgcgccagtgctgccagagtcgcagcaggcgggtgcgatacccggtcagcagcaggcccgccagcgccggtaaacccagcgcaaggccgatccagaacgcctgacgatccggatagaacagcgccagcagatcgttgccctgctgccgagacgcaccggccatcaccagcagcagccaggtccgtgcctggagtaacaggatcagccaaaaaagaaacggcagccgcagctgccctctggcgtcatactcgtccggcagatagcccggtgacggcttagtattcacgatcttcgatcagacgtttaccaaacagcagcgcatcgaccggctcataatcgagcttctcatagaacgccactacctgatcattctcttcgcggatcatcagatgcagtttcggacagccgcgcgcgataagcttcttctccagacggttcatcagcgcattcgcaaagccgcgtccctgatagtcgggatgcacggccagatagtaagccgcgccgcgatggccatcatagccgcccatcagtgtgcccacgaccacgccgcccacttcagcgaccagaaagagatcggggtcgtgattcattttgcgttcgatatccagctcaggatcgttccatggccgtaacaaatcgcaacgttcccataaggtgatcacttcttcaaaatcttcctggcggaaggcgcggatttccatcttctttacctgcaaataagcacaatttgctgattatcacgcattctctgccgcacgcaaccctccatgacgggcgacaaataaaaaagcgcaaatttactgttcgcgacctgcaatacaaagtaatgccctgaaatggttctgtgatcgcaggcagcagccccttaggctataacaccggcaagattcctgttatcggacccgcacatgcacctgcttaaacgtttgattcatcgccgtcagttactgctttccgggctggctctggccattttatcgccgcgcgcggttcaggctaaagagcagtctgcgcttactggtgccaatcgtcactcgcgccctgccccgcccgctaagaacgggaaacgtatcgtgatgatcgaccccggtcacggcggcatcgactctggtgccgttggcgaagagggttccgaagagaaacacatcgtgctggagattgccggtaacgtgcaacgtcagctacagagccatccgcgcatagaagtgcgtctgacccgcgacagcgaccactttattccgctctatcagcgggtggagatcgcccaccagcacggcgccgatctctttatgtcgattcatgccgacggttttaccagtcccgatgccagcggtgcctcggtgtttgcgctctctaatcgcggtgccagcagctcgatggcgcgttatctgtcacagcgggagaaacgatgcggataagctgggtggcgtgaaagcgcagcagcaggatcactatctgcagcagatcctgttcgatctggtgcagacagacaccatcaaaaacagcctgacgctgggcaagcatgtactggatcagatccgcccggttcatcatcttcacagccagcacaccgagcaggctgcctttgcggtactcaagtcaccgtcgatcccctcggtgctggtcgaaacctcctttattaccaatccgcgtgaagagcaattgctcggcaccaccgcgtttcgtcagaaaatcgcctcggctattgccagcggcatcgtcaattactttgatgagtttgatcgccgcaacgcctgatgcgtgtcgccggttcaggccgtgcgactcgccgcactcatgcaagcggcgcggttttgcgtataatcgcgtcagactttgacaaaccataagcgaaaaaatggctgatatttcccgcgtaaaagcgttcctgctcgcattgcaggatgagatttgtaaccagctggcggctgaagatggcggcgcagcgtttgccgaagatagctggcagcgtcctggcggcggcggcggtcagagccgcgtgctgcgcaacggcgcggtgtttgagcaggcgggcgtcaacttttcgcacgtgcatggcgatcagatgccggcatccgccactgcacaccggccggagctggcgggtcgcagctttgaagcaatgggcgtgtcgctggtgatccacccgaacaacccttatgtacctaccagccacgccaacgtgcgcttttttatcgcggagaaaccgggtgccgatccggtctggtggtttggtggcggatttgacctgacccctttttatggcttcgaagaagatgcgctgcactggcaccagactgccgctgacctctgccagccttttggcgaggatgtctatccgcgctataaaaagtggtgtgatgactatttctatctgaagcatcgtgatgagcagcgcggcattggcggcctgttttttgacgatctcaatacgcccgactttgagcagagcttcagctttatgcaggcggttggccgcggctttatggatgcctatcggccgattgtggcgcgccgtaaagcgcacccgtggggcgatcgtgagcgtcagttccagctctaccgccgtggccgctatgtggagtttaatctggtgtgggaccgcggcacgctgtttggtctgcagaccggcggtcgcactgaatcgatcctgatgtcgatgcccccgctggtgcgctgggaatatgattatcagcccgatgccgactcacctgaagccgccctctatcgcgatttcctgccggtgaagaactggctgaacctgccagtctgatcgtttctgccgctgcagcgcgggtctcaacccgcgctgcgcttacctctcgcctgatcggcctcttcttttttacagggcacagattgctacagtgtggcctgcgtcattcctcctgactgctatgcttatgggtggaatatggcgcaccccacggttaacaccgcatgacggctccttcgcaccgcctcgcagcgcaacaatcagagaaaccgcatgttcatcagaaactctctgttgcaatgttatgggttcgcgttcccggtagcagaacatgccacagaccggctgcgaggcctgaggtgccccctgttcgctttcatttttcttttcaaggagtttagagatgaaccagctagaagccctaaaacagttcaccaccgtggtggcggacagtggtgatatcgaatcgattcgtaattaccatccggaagacgccaccaccaacccctcactcattctgaaagcgtccggtctcgaagggtataagcacctgatggatgacgcgattgagtacgccaaaaaacagggcggcagcaaagagacgcagattatcaacgccagcgacaaagtggcgatcaaccttggtatggaaatcctgaaaagcataccgggccgtgtttcgaccgaagtggatgcgcgcctctccttcgatcgtggcatgtgtgtgaccaaagcagaaaaactgattcggatgtatgaagagcacggtatcgatcgctcacgcgtactgattaagctggcctcgacctgggaaggcatccgcgcagcggaagagctggaaaaaaacggcattcagtgcaacctgacactgctcttctcctttgctcaggcgcgtgcctgtgccgaagcgggcgtgttcctgatctccccgttcgttggccgcatctacgactggtataactcgcgcaaacccatggacccctacgtggcggatgaagatccgggcgtgaaatccgtgcgtcgcatctacgattactacaaaaagcaccgttacagcaccatcatcatgggtgccagcttccgtaaagtggagcagattatcgcactggcaggctgcgaccgcctgaccctgtcacctaacctgctggaagagttgcagaacagtgatgcgccgcttgagcgcaaactggaaccttcaactgaaggtttccatcagccgtcgccgctctccgaggcggagttccgttgggaacataatcaggatccaatggcagttgaaaaactctctgacggcatccgccagttcgcggttgaccagcagaagctggaagatgtgctcgccgcacgcctgtagtctttattttagtcgggcgggactttcccgccctgatgcataacaagggagaactttatgtcctcacgcagagagttggcaaacgcgattcgtgcactgagcatggatgcggtacagaaggcaaattcaggccaccccggtgcgccaatgggaatggccgatatcgccgaagtgttgtggcgcgacttcctccagcataatccgaccaatcccgcctggcttgatcgcgaccgctttatcctctccaacggccacggctcgatgctgctttatagcctgctgcacctgagcggttatgacctgccgattgaagagctgaaaaatttccgtcagctgcactctaaaacgccaggtcacccggaaatcggctacaccccaggcgttgaaaccaccaccggcccgctgggtcagggactggctaacgccgtgggcttagccattgcagaacgcacgctggccgcgcagtttaaccgtccggatcatgagattgtcgatcaccacacctatgtgtttatgggcgatggctgtctgatggaaggcatctcgcacgaagtctgttcactggcggggaccctgggtctcggcaaactgatcggcttctatgaccataacggtatctcgatcgatggcgagaccgaaggctggtttactgacgacacccataaacgttttgagtcctacaactggcatgtgattggcgatatcgacggccatgacgctgatgccattcgtgaggcgatcaaagaagcgcagagtgtcaccgataagccttcacttattatctgccgcaccattatcggtttcggttcgccgaacaaagccggtaaagaggagtcgcacggcgcggcgctgggtgaggcagaagttgccctgacccgcaaacagctcggctggaactatccggcgtttgagatcccggctgaaatctaccagcagtgggatgctaaagcggcgggtgctgaacgtgaaaaagcctgggatgcaaaatttgcggcttacaaagaagcccatccagagctggcgaaagagtatgagcgccggatgaatggcgaaatgcccgccaactgggaaaccgaagcgacccgtttcattcaggagttgcaggctaacccgcagaaaatcgccagccgtaaagcgtcacaaaactcgctggaagcctatggcaaaatgctgccggagttcctcggcggttctgctgacctggcaccgagtaacctcaccatctggtctggttctaaatcgatcaaagaggatccggccggtaactatattcactacggcgtgcgtgaatttggtatgacggcgattggtaacggtatcgcgcaccatggcggtttcgttccctacaccgcaaccttcctgatgtttgtcgaatatgcgcgtaacgccgcgcgtatggctgcgctgatgaaggcacgacagattctggtctacacccatgactccatcggtctgggcgaagatggcccgacgcaccagccggtagagcagatcgccagcctgcgtctgacaccaaacatgagcgtatggcgtccgtgcgatcaggtcgaaaccgctgtagcgtggaaagccgccgtcgaacgtcatcacggcccgacagcgctgatcctctcgcgtcagaatctgctacagccggaacgtaccccggagcagatcgaaaacatcaaacgcggcggctacgtgctgaaggattgcgacggcacaccagaagtgattctgatcgcaaccggttcagagattgagatcaccctgggtgcagcggataagctcacttcaggcggtcacaaggtgcgggtggtttcactgccttctactgacctgtttgatgcgcaggatgccgcttaccgcgaatccgtactgccgagcggcgtgaaagcgcgtgtggcggtagaagcgggtattgctgactactggttcaagtatgtcggtctggacggtgcgattgtcggtatgaccacctttggtgaatccgccccggccagtcagctgttcccggagtttggcttcacggttgagaatatcgtcagccacgctgaagcattactcaagccagtttaatgcttatgcccttcccggctcaccgggaagggccatttctacttatagcctgatacataaaaaaaactccattcccctcttcccgccctgcgcaaactcattactatagagccgtcatacttaatgctgcctgtgcgctgactgtccgtctgttcctgctgttgttctgccaggataacgcggttctgtcctgatgcatcccgatgagtgaaggcagatttcctccgattttatagcgaagccacttccgttgaacatgcgcacaccctatttactggccctgatggtttcactgcttccattaaaaagcatggcgcaggtcgcgcccgatccgctgctggcctctcagattgttgatcgctatgcggaacatatcttttacggcagcggtgcaaccggcatggcactggtggcgattgatggcaatcagcgggtgttcgccagctttggtgaaacccgtcccggcaacaatatccgtccgcagaaagattcgctgattcgcatcgcctcgctgagtaagctgatgaccagtgaagtgatggtgaagctggctgagcgcggacagattcgcctcgacgatcccctgagtaaatatgcgccgccgggttcacgcgtgcccacctacaatggtcagcccattcgcctgatcaacctctcgacccacaccagcggactgccgcgcgaacagccaggcggcaaagcgcagcgtccggtatttgtctggccgacccgtggtgaacgctgggcgtggctgtcgcgcgctaacctcaaagcggcaccgggcagcagtgccgcctactctaacctgggctacgatctgctgggtgatgcactgtcgcgcgccaccggcaaaccctatccggcgctgtttcagcagctgattacccgcccgctcggcatgaaggacacgacgtttacgccgtcgcctgagcagtgcggacgcctgatggtggcggaaaaaggggccagtccgtgcaataacaccctggcggcgattggcagcggcggcgtttactccacgccggatgatatgggccgctggatgcagcagttccttaactcttcggttaaccaccgcacgccgcagatcgatcgactgcagacgctgatctatcgtcgcgatcagctgagcaaagtagaaggcatggatgtgccaggcaaagcggatgcgctggggatgggctgggtctttatggggccgaaaaatggtcgccctggcattattcagaaaaccggcggcggcggcggtttcatcacctatatggcgatggtgccgcagcataacgtgggggtatttgtggtggtgactcgctcgccgctgacccgctttacgccaatgagcgacggcgtgaataatatgctggccgaaactggtcggtaatcagcttggctcaccgatgatggtgcaggcgattcgttaacgctgctgtacgccaccatcagactggctgacccacagggttggccagtcatcactgctgtgccaggcatcacaggtcgactcttccgcatactccgctaacacaaaacgcgtgccatcaaactgccagcgtgtggcactgccgcagtcacccaatccacgtcctttaccaaaggtgtagagctggccgctggccgcatcatattcggcgttaatcagctcaagctgtcgatcactggcacctggcggggtaaacggcagagttaaggtgatgccgcgcgcgacatacggctggctgcgcgtcacttcaaacgccagatcgatcacgttataagcccccatttcacaactcaccagcagcagcgcgcgctgatcggtgagtggcgccacgctgacttcacggcgcagtggatcgagtgagcaggagtcggtattgacccgccaggtgccgtaatcaattaatccgctggtctcatcgcgcgtcaatgccgcgggtggctccacagcaggcggcagtggcggcagcgcaggcggcggcggaacatcccagctggcgcgatcgccacgtttaacccatgcgctcatgctgttgacccgcccctgggtgtcatccatcagcaacagcgcggccttcatgccgcgcagggagatcagcgcattgggatcgaaagtgagctgaagggttttcgcctccatcaccagatcaagaaactcatcaattgcgatggcattgctggtggcgagatgatgcggttcaaccgtccagtgtttgaggtcgggtttcagacggcgctgatccagtagcaggttatcctgaagcgaaccgccaggcagcgcgccactgtaggcactgccgtagtcgattcgcagcaaggggcgatcgttgacgcccgcatgccgcgaaatcgtcatcactaaccctttgtcgcccggaatattgcgcgccacgcaaaaggcttcattgttgcaggtgatttgccagtcgttgaatgacttttgcaacggttccgcctgaacacaggcaacccacagagacggcaacagccacagcgatttcatccaatacgacattaagaaaatcgatccccgaatacccagagtggagaggatagcgcatcaacgggcctgccagggttcccattctgtgaacctgtgcaaaaagcgcagttaactgcttaaaaagcgtgcatgaaaagtggattatgcttcactttccacgctcaacgccgtcacgctgcaacaggctaactgcatgattttttatggtatcagccagccagcaatctgcgcatgctgcaacagcatgacggttttgccgtcgcgaatgcggccatcggcgaccattgccagtgcatcagggaaaggcagttccagcacgtcgatcgactcatcttcaacgccgccgcccgcattgtcgcgcagcgattcattatattccgctgcgaaaaagtggatcaattcagtgacgccgcccggcgacatatagcaggcatagagtttctccacctcgcccaccgcataaccggtctcttcaatcgcctctttgcgaatgcaatcttccggagagtcgtcgtccagcaagccggcacaggcttcaattaacatgccgccctcgttaccgttgacgtaagtggcgatacggaactggcgcgtcaggaccacgctgttcttttcgcggttatagagcaggatggtcgccccgtttccacgatcgtagacttcacgtttatggcggataacctcgccacggccatcggtgatctcataggtgtagttacgcagcacaaaccagttttcggacaggagcttatctttgatgatgttgatcttaaacgacatgaggactccgctaccgcataaagggagcctttcatcataggggcaagcttgcgggaaaactatcttaattctcgcggtgaatgaggcggtttacgccaaaaaaaagccagcccgaaggctggcctgattgctgcagcgcttatcagcgtgaggtgtcgtcagccagtcgggtcggctgaggctcctcttcgtgatgatcctgttcggtctcagctatggcgtgaacacgcttacgcacgccaaaccatcccagcaccagcagtaccgcgatcagcggaatggaggcgatggtgtaagtcccgttcgggtagtcaaacgccatcagcaccagcacgctgaacaggaacagcagcgtcagccatgaggtaaacggcgcgcctggcagcttgaagctgacatcatccgccttgccctctttaatcgctttgcgcagacgcagctgacaaaccacgataaaggcccaggaggagataatccccagcgaggcgacgttcaggacgatctcaaacacctgagaaggcacatagtagttaagcaccacaccaatcacatagacggcgatggtcaccagaataccggcataaggcacctgctgaccgttcatcttagacatgaatttcggtgcagagccacccatcgacatggagcgcagaatacgcccggttgagtagaggcccgagttcaggctggagagcgcggcactcagcaccacgatattcatgatgctgccaacgtaaggcacgcccagcttcgagaagaaggtaacaaacggactctgacccgcctgataggcgttccacggcagcagcagcaccagcaggaccacggagccaacgtagaacaggccgatacgccagatcacgctattgatcgctttcggcagcatggttttcgggtctttacattcgccggccgccgtacctaccagttcgatagaggcaaaggcgaacaccacaccctgaatcagcaccagcgcaggcagtaagccgtgcgggaacatgccaccgttatcggtgatcagatggaagccggtactgttgccatccagcggtttgccggtgccaaggaataccacgcccaccaccaggaagatcactatcgccagcactttcaccagcgcgaaccagaactccatctcggcaaaccactttacgccgatcatgttcatggtgccgacaatcgccagcgcgcccagggcgaagacccactgtggcacatcaccaaacgcgccccagtagtgcatgtagagcgcgacggcggtgatatcgacgatgccggtcattgcccagttgacgaagtacatccagcccgccacgtaggaggctttctcacccaggaattcacgggcgtaggagacgaagctgccgctgctgggacggtgtaacaccagttcgcccagcgcacgcagaataaagaaggagaagatgccacacaccagatagatgatggctaaggcggggccagcagcctgcaaacggccacctgcgcccaggaacaaaccggtaccgatggcaccgccgatcgcaatcatctgtacgtgacggttacccatcgccttctggtagccggcgtcatgagagttgagccagcgtcgtttcgcagcgcgcatctcgcctggggttttgtttttagatttcatagcattcctgtttgtcctgactatcagtcgtcgcccccatttcaggcgtaatgccctgtgaaatggggtattttcctctgtgcgtttgcctgtgagtgagtgccagacagcgcgggaatttacggcgatgaatcctacccgttctgcaagaacgaagcaaaatataccgggcagatgcacaggctgatttgtaagaatccatcctgatgcacaaaaacaaaaaaaccggccattttcaggccggtaaaagctacagggatggaaacaggagggttgggttagcgataaatctctgcggtgccgctccacaggctggaatcgcctgggttatcgacaccgataacgcggtaatggctggcgcccatctcttccgctttttgcgacagctggcgattcgcatcgtccagcgagccgcgaaacgccggagaccgaaacgctaccgatgctctgcatactctgcgcctgcgactgatcgaccggcgcggcggcgaaagtggcaaatgaggcggtagccagtaatgcgcccgccaggacagcattcagctttttcattggatgctccttaatctgtgatcggggttgagttgatgactgaatgaattattagcgctgcaatgaaaagcaacatcgggacgatgtaaacctgttccttttttaagcgttgaacagcagcacgtcctgggaactgtcagttgcggtcattttatgtgcgatgtgtaacgtcctgtgcgataaacagggaatggatcatttgcgttacgttaatgcgctcttataattcccgcactttcaacagggccattcatgtgattgttaaacgttccgtaactcaaagcatcgctcaggcgctcagcgccattgtcctgctgtcgctgctcaccaccggtctggcattggtcacgctcctgagcagccagcgcgacgcggaggcgatcaatctggcgggttcactgcgcatgcagagctatcgcatggcctgggatgccagccgtcagccgcaaaatctggctcatcatctggcgcgctatcagcaaacgctggatgccccggtgctgcagaaactcgatcggccctgggtaccccgtgaagtaagtgttcgctatcaacggctgcgtgccgcctggccctcgctgcagcaacagttgcaacagggcgataccgtggcttatcagcagcaggtgccgatctacgtcggtgaaatcgatcgctttgtgctgggtctgcagcgctataccgagttgaaaatgcatctggtggccgccagcagcctggtgggggtcattgcgattgtggcgctggcactgatgacgattcgctttacccgactgcaggtggtgcgcccgcttaatgcgctggttaccgccagtcgctatgttgagagcggtaactttgcttttccgccgctgcacgttgagcagcagaatgaactgcgggtgctgtcgcatgccttcagcggcatggcggcacggctgcattcgcactaccagctgctggaaagcacggtgcgcgccaaaacagaagatttaacccaggcgaatcgcacgctgtcgctactctatgacagctcacaaatgctgaccgccagcccgctgcatccggcactgtttgaagccgtgttaaccaatgtactgacgcgcgagaaactgacggcgatccggctcgacagcgaccagtttcagtttcgtgccggtgatgatcaggcagccggtcagtggcaacgtctgccgttacagcaggacgagcagcagattggcgagctgcgctggcagacagctggtgcctcgcctccggatgaactgatgcgcagcctggcggcgatgctgggacgggctatctggatctggcaggcacagcagcagtatcagcagatgctgctgattgaagagcgcacgaccatcgcccgggaattacatgactcgctggcgcagtcgctctcttttttacgcattcagctgaccctgctgcgccgcgccgttgataaagacgatagcgccgcccataccattatcgcggacttcgatcaggcgctggccgaggcctatcgtcagctgcgtgagctgctgaccaccttccgtctgaccattgaacaggcggatctggtggcggccatgcaggcgatgatcgcctcgctgcaggagaagagcagcgcagagatacactttaactatcagaccggcctgcagagtctggaagcacaacagcaggtgcatgtgttgcagatcgtccgtgaggcgctgctgaatgcgattcgtcacgccagtgcgcaggttatccgggtggattatcagcacagtgaaaaaggtgagcacttactgacgattacggatgatggcgtggggatgaacagcactgacgaaccgccgggccattacggcctgactattatggcggagcgcgctcagcgcctgagcggccatctgaccctccacgcacagccacggggtaccagggtggagttgcgctttccaccgcaaccggcgcgcccgctggaatagcaggccagagctaatcttaattcattaaaataatctatcggtttgcgaccgcgggctattcgatacagaaacagggtgttgtccctgaacaataccgtctgatctgccgcagtctgaaacctatgaaacggagaaaatatgcaacagcccgcattaacattgatgattgtggatgaccacccgctgatgcgccgcggtgtccgtcagctgctggcgctggatccccggctggaggtaatcgccgaagccagcaacggcactgaagcgctggcggaggctcgccatcaggaaccggacatcattctgctcgacctgaatatgaaaggcatgtccggattggatacgctgaaggcgctgcgccatgaagggatcagttcgcgcattctggtgctgaccgtttctgacgcccgcagcgatatttttgccatggtggatgccggtgctgacggctatctgctcaaggacagcgagccggagatcctgctggggcatatcctgcaggcatcgcggggcgaaaaggtcttcagcgagggcgtcacccgctatctggctaatcgccagcacagtgccgatcctctgcgtcagctcaccgagcgcgaacgggatgtgctgcaggaggtggcgcgtggcctgtcgaataaagaggttgccgctattctgcatatctctgaagagacggtgaaagtgcacattcgtaacctgctgcggaaactggatgtccgctcacgcgtcgccgccacggtgatgtggcttgaaagccgcaaatagccaacgaatttacattttctcctcaatttctccacgatttcccccgctgccgcacgtagagtaaacggcggcggagaatcatggcaaagacccgccgagtttcctgccagagcgcccgttgctggtgggcctgaccaacgataaaagtagtgaggagtgtcgatttaatgtcgaatttctttatcgaccgccctatctttgcctgggttctggcgattctgctgtgcctgtgtggcacgctttcgattatttcgctgcctattgaacagtaccccgatctggcaccgcccaacgtgcgcatcaccgctaactatccgggcgcatccgcccagacgctggaaaacaccgttacccaggtgatcgagcagaacatgaccggcatcgataatctgatgtacatgtcctctaacagcagcaacaccggccaggcacagatcaccctcacctttaccgccgggaccaatcccgatgaagcccgtcagcaggtacagaaccagctgcaatccgcactgcgcaaattgccacaggcggtgcagtcgcagggtgtgaccgtcaataaaaccggtgacagtaatattctgatggtggcattcgtttcaaccgacggcagcatggataagcaggatatttcagactatgtcgccagtaatattcaggatccgctaagccgtattgatggcgtcggccaggttgacgcttacggctcgcaatatgcgatgcgtatctggctcgatcccaataaactgatcgcctattcgctgaccacggaagatgtggtcagtgcgatccagtcgcagaacacccaggttgccgtgggtcaggtgggtggcctgccgtcggtagagaaacaggcgcttaacgctacggtcaacgcccagtcgatgctgcagacccctgagcagttccgggcgattaccctgaagaacaatcccgatggttcggtggtgacgctgggcgatgtcgccagcgtggcgctgggcgctgagaagtatgattatctgagtcgttacaacggccagcccgcgtcaggcctgggggtgaagctggcgtccggtgccaacgagatgaacaccgataagctggtgcgggcgcgcattgaggagctgtcccactacttcccacacggtctggaagcaaaaatcgcctatgaaacctcccctttcgttaaagcgtcaatcaccgatgtggtgaagacgttgctggaggcgattgtgctggtatttggcgtgatgtacctgtttatgcagaacttccgtgccaccttaattcctactattgcagtgccggtggtgctgttcggcaccttcagcgtgctctatgcctgcgggttcagcatcaataccctgaccatgtttgccatggtgctggcaatcgggctgctggtggatgatgccatcgtggtggtggaaaacgttgaacgtatcatgcatgaagagggactctcgccgcgtgccgccacccgaaaatcgatgggccagattcagggcgcgctggtgggtatcgcgctggtgctctctgcggtgtttgtgccgatggcgtttttcggcggcaccgtcggcgccatctaccgtcagttctcaattaccattgtgtcggcgatggtgctgtcggtgctggtggcgatgatcctgacaccggcgctctgtgccacgctgctcaaacccgtggcgcagggcgagcagcctgagcgtcgcggcttcttcggctggttcaatcgtcactttaatcgcaatgctgaccgctacgagcgcggggtcgcgggtatcctgcgtaagggcggtcgctggttgctgctctatctcggcatcatcggcctgatggcctttctgtttctgcgtctgccgacgtcgtttctgccgctggaagatcgcggcgtattcctgacgcaggttcagcttccggcaggcgcgacgcttgagcaaactgccagcgtcgtcgccaaagttgaaaactattatctcaccgaggagaaggccaacgtgctgtcggtcttctccaccatcggcgcaggtccgggcggcaatggacaaaacgtggcgcgtctgtttgtgcggcttaaagactgggaagcgcggcccggtgccgatcgcacctcgttcgcgattatcgagcgcgcgacgaaggcattccagaagatcaaagagggccgggtgattgccagcagcccgccagccatcaccggcatgggcagcagctccggctttgacctgcaactgcaggatcacgcgggcgtcggtcatacccaactgatggcgatgcgtgacaaactgctggagatggcgggcaatgacaacgcgctgtcgcgggtacggcacaatggactggatgacagcccgcagctgcagatcgatgttgatgcacgtaaagcgcaggcgctgggcgtgtcgctggataccatcaacgacaccctgaccaccgcgtggggttccagctacgtgaatgacttcctggatcgtggccgggtgaagaaggtctatgtgcaggctgccgctgaattccgcatgctgccagacgacatcaacaaatggtacgtgcgcaatagcagcggcaaaatggtgcccttctccgcgtttgccaccagccgctgggagaccggttccccacgtcttgaacgctacaacggctattcatcgctggagattgtcggcgaagcggccagtggcgtcagcagtggcacggcgatggatgagatggaaaaactggttaatgccctgcccctgggcgtcgggtttccagtggaccggtgcctcttatcaggagcggctctccggttcgcaggcgccggcactttatgcgatttcgctgctggtggtctttctctgcctggccgcgctgtatgaaagctggtcgatcccgttctcggtgatgctggtagtgccgctgggcgtggtcggggcgctaatcgccacctggatgcgtgggctggaaaatgacgtctatttccaggttggcctgctgacggtagtggggttatccgccaaaaacgccatcctgattgtagaatttgctaatgagatcaacagccggggacgcgagctggtggaatctacgctggaggcatcgcgtcagcgcctgcggccgattctgatgacctcgctggcctttatctttggtgtactgcccatggcgatcagcagcggtgcaggctccggcagccagcatgccgtgggaaccggtgtgatgggcggaatgatctctgccacactgctggcgatcttttttgtgccgctgttctttgtactggtacgccgccgtttcccgctcaaagagaagccgctcgactaagtagaggcgcaaataaaaagcggtcactgatatcagtggccgccttatttctgtgtgtggtaagaattccagcaagcgggattaacctgctttttcttcgcgcgttacttgttgcgtaacatcgcttcgataaattctttccaggttcccatttcggtgtcaatcataatgccctctcttattgtgctggcaatgttacgctctttttttatacaggtgaatacgtttacacctgttatatctatcggcatacgccataaaaacatgaatgttgctggttttgcaagctgacgcacacttcagcaactccttaaccccgttgaaaataatttattttaaacccagcggtagactattttatcaacatggcgaaattcctaagctcttattgataagcagggtaatggttagctgcgaaattgatagcgtttacccgatgccggacgatgaccttgctgccgtgctctgtggcccgattcccgcgcctgtgcagatgccgcaacggatcacactatggtaaactcgcactttggctgcttttttcagctttcacttctcacaggacaataaggatcgggcaatgagcacgcagtgggtgatgttcgggattaaaaattgcgacaccataaaaaaagcccggcgctttttaacagacgcaggcgttgactatcacttccacgactaccgtgcggatggcctgaacgatgccctgctgcaggagtttatcgattcactgggttatcaggctctgcttaacacccggggcaccacctggcgtaaattgcctgagagtgatcgcgacgcggttaccgatgccagcagcgccaaagcgctgatgctggcgcatcccgccatgattaagcgtccgctgttgcgcgccccggatggcgccctgctcgccggtttcagcgaagccacctatcagaatgctatccaggagaagtcataatatgttttgcccggtcattgagctgacgcagcagcttattcgtcgcccctctctcagccccgatgatgccggatgtcaggctctgctgatcgcccgtcttgaagccattggctttaagattgaaacgatgaacatcgacgacaccctgaatttctgggccacccgtggcgaaggtgaaacgctggcgtttgccggtcacaccgatgtggtgccgcctggcgatgccagccgctggattaatccgccatttgaacccaccatccgcgacggcatgctgtttggccgcggcgcggccgacatgaaaggatcgctggcggcaatggtggtggctgccgaacgttttgttgcagtgcgtcccaatcaccgagggcgactcgcctttatgattacctctgatgaagaggccagcggggccaacggcacggttaaagtggttgagcggctgatggcccgccgcgaaacggctcgactattgcctggtcggcgagccctccagcacggaagtggtgggtgatgtggtgaaaaatggccgtcgcggctcaatcactgctaacctgatggtgcatggcgtgcagggccacgtcgcctatccgcatctggcggataacccggttcaccgggcgatgccagcgctgaacgagctggtcgcgaccgagtgggatcagggaaatgagttcttcccggcgaccagcatgcagattgccaacgtccaggcgggcaccggcagtaacaatgtgatccccggcgagctgtttgtgcagtttaacttccgcttcagcaccgaactcaccgatgagatgattcgtcagcgggtcgcagagctgctggatcgtcaccagttgcgttacaccattgagtggaaactctctggccagcccttcctgaccacgcgcggtaagctggttgatgccgtcgtgaaagctgtagcgcactataatgaaattaagccgcagctgctgaccacgggcggaacctccgatggccgctttattgcccggatgggtgcacaggtggtggaactggggccagtgaatgccaccattcataaaatcaatgagtgtgtgaaagcctccgacctgcagatgctgagccggatgtaccaacgcatcatggaacaactgatcgcctgacggcggttttaaggagcagcaaatggaatttattaaagattactggtggatcctggtgatcctgctgatggttggcgtgctgatgaacgtttataaagatctgaaacgcatcgatcataaaaaatttatggataacaaacctgacctgccgccgcatcgtgattttaacgataaatgggatgacgacgacaactggccgaagaagaagtaaacgaaaaagcccctgctatgcaggggcttttttatggttcttcacaaagtcagctctcatcagcgttaagatcgagcttgcgcaggggcttttttacatcatcacgataacatcatcgtcacccggttttgcgccgcttaacgcctcatcaaagtagcgttttggcaccgtataacgcagatgattcagcgccagctccatgctgcggtgatcgatggcgtgttccagatcgtcaacgatatccagggtaacatcgccaccgcaggcggtcagccgatgctccgcctgctgcgcatggtgcagcgggacctgctcatcataatcaccgtggatcaggtgaatggtagtgcgggtactggccttctccggcagggtaataaaccggccattaaacaccaccgcgcggcccgccagatccggatgcgccttaaccccttccagcaccatactgccgccctgcgaaaagccgattaaggctgtcgcttccggccgcacaccgctctttttttgccagtgacgcacagacccaacaaactgcggcatggccgcatcaacccgctgctggacggtctgatcgtgcaggtcggtttcgccgaaccactgacgactcgcaccaggcgagccgacggacaccaccagcgcgtcgggaaacgttcgggcaaaccagttgccaatctcgcccattgaatccgggttatcgccaacgccatggtagagcagaaacagctgtgctgtggtggcaggctgttgaacgattacatatttcagtgtcatgttgacctcctgtgttcactctacgccgcctggcataaaatcatatgaggataatttgaaccagctggtcgaattatttcaacggcaggtgcagcaaggctgcatcaacgcccagtgtctggagggccgctgccgcctgctgacgcagcgctgcgactagcgctttgcgcccgctcactcccgcctgctgggccagttcgcccagggctgtgggtgtggcaaccgccgcagccagcagcggtaaagaggctgaactggcctgcaccagacgctgcaacaccggcaggctcgcttccagtggccgctgcgcccaggcaaaacccgccgccagacgaatatcctgcgcggtcaatccgtcgtcagtaacctgatcaaactgcagttccagtgcgatatgctggcgcaacagcggccagtctcgcgccagctgttctgccgcgcggtgctgcaatgcctcacccgcagcagaacagggcaacatggccatcgccgcgtagcagccgctgctggcttcgcgctgactgccaatccgcaccaggctaaagccacaggcgcgccagaacgcccagagagattcagtgtagccgaagctgacggagaggtagtcatatccggctgccgcactggccgctgccgcaaccagctgctgtccggttcccagacgacgccgctccgccgccacggcaatacggctgatgcgcagcgagcgcaatgtcgccgcctcagccagaccagcgtgggctgccagcgactgcgccaccagattcccgcggggtcgccgggtacccgcccagaccgcctgtgccagtgcaggttcaagaccgccctcttccaccagccagagcgcgccctgtaacgccgacgcgtcgcctgcccgccacagctgcatgcccggagcatccagcaggcggcgcagatcaagcggtgaggtacgataatgcgcactggtcagcagacgatacgcggcctccagcgcgctgaaatcgtggcgctcaacacgatgaggcgttacaggagaatcgggtgcggtcgcgtcggcatcgtcaaacagtagcgcctggttcagccactgctccagcggatcgaaacgcgaccagcgcagcggctcatcgagcgtaaaatagtgtgcatcaggaagcccggcgcagaacttaaggataaacccgcgcccgcttccttcgtagccctgtacggtggtggtgagcaatacgcggggatatcgactgaccagcgcctgaagcagcggtgccgggatcgccgccgcttcatccacaatcagccattccgcctgcggtggcgtctccagcgccagcagcgcatcgggtgccataaagtgaaaagcgtcagcggcgaaggtgctcagcacctccgttgaggctttggccggagccgtcaccagacaatgtccgttcaatcgcgccagcatacccgccagcgccgatttaccgcgtccgcggggcgcggtcagcacggcaacccccgatggcagcctcatcagctgatcgagtatcgcctgctgctgctgcggtgcctgacagtgccactgcggccagtccggctgcgccggaaaccggcatggctgatgctgccgctccaccagcacctggtcatccgctaatatcagctgttgcaggtggtgaacaaaataaggggtggcgatgggttcagcgacatcggcccagcgcaggctgtcgctgtcaggctgctgcgcccactgttcccagggcggcaccagcagtaacagccagctaccggcggtgagcgtgccagccagcgcagcgaaagcgtcggcatgaaagccctgacgggcgtcaaacagagcatgacgaaattcacggccaagcagcgtgcgcaccgcagcaggctgtttgtgcaggaccggcgttttatactgacccggccctttatccgaagcagagaaacagcggttccgggctcaacgccagccagtcgccggtcagcgtttcacgccacgccgcagcccgtagtaaacaccaggccgggtcgccgctgatcaccgccagacgacgcacaccggcctgctgcataagctgcgtaagaggctgcagactcatcagttgctggcgaaggtgttgcactgtcctggattgccaccatcaaacccgcgcttgaaccaggtgtagcgctgctcagacgtgccgtgggtgaagctgtccggcactacgcggccctgacctttctgctgcaggcggtcatcgccaattgcctcggcggcattcagcgcttcctgcagatcgcccgcttcaaggatattttcctgctgcatatagtgtccccagacaccggcaaaacagtccgcctgcagttccattttgacggagagctgattaacctgcgtctggctggcaccctgctgcatttcacgcactttcggttcaatgcccagtagtttctggacatggtggccaacttcatgcgcgacgacgtagccctgggcgaagtcaccgtccgcgccgagtttggttttcatctcgtcataaaaagagaggtcgatgtagacggtctgatcggcaggacagtagaacggccccatgactgactgtccggtaccacagccggtgcgggttgcgccgcgatacatcaccagcttcggcggcacatactgtttgttcatctgctggaacagtttgccccaggtatcttccgtggtggccagaatcaccttcgtgaatttcgcagcctcatcatcattggcgctgacgctgcgctgttgctgctggctggtcggtgcaacttcgccgcctgtcagcagtgcggtcaggtcgtaaccgtaataacccgcgatggccacgacaatcagcagcacaataccgcctttaccgcgcggcagacgaatctggcggcctccgccgcctaaaccggacgattgatcgcgacggtcttctacattgtcgctttcgcgacgcccttgccagcgcatgctgtgttccctcagtcattttttcagatggcatgattttagttgtgtgaagcagcaatcaccagctttaccctgaaatgaaaaaaggagagccggggctctcctttttctttctgcgcggcaggcaaactcagtcgagcttcacgcccagccgctgtgcaaccgcttcataggcttccaccacgccgccgaggctctggcggaaacggtctttatccattttatccagcgtctctttgtcccacaggcgcgcaccgtctggcgaaaactcatcgcccagcgtcacttcgccgttaaacagaccaaactccagtttgaagtcgaccagaatcagacccgcatcgtcgaatagtttgctcagcacctcgttggctttaaaggtcagctcctgcatccgcgccaggttctgtttgctgacccagccaaaggtttcgcagtaggattcattgaccatcgggtcatgctttgcatcatctttcaggaaaagatcaaacagcggcggattgagcacaatgccctcttccacgcccagacgttttaccagtgagcctgcggcgcggttacgtaccacgcactctaccggcaccatctccagcttcttcaccagcgcttcagtatctgacagcagcgcttccatctgggtcggaatacccgcttcctgcaatttagtcatgataaaatggttaaacttgttgttaaccattcccttgcgatcaaattgctcgattcgggcaccatcacctgctgacgtatcgttgcggaattcgagtatcagcagatccgggttatcggtgctgtatacggttttcgctttaccgcgatacaactcagctcgcttttgcatcttgttcactccagacttgaaataacgggtgttcagcggccagtgccgctgcggcgattgccttgacgcaatcgtttacttcgccgcgcgctattatgccaaaaacaaaataaaaaggccggagaatctccggcctgtggcaactttatttgttcagcgccgcctggaacacggccaccagcgcatcgtttctgcgactgggtcagcacatgccctttcgggtcgatgaattgcagactggtgcggttgtcgagatcgccgacctgcactttgtaatcaccgtttggtaattccggatctttcgcaccgactgaatcccagtcgctgctgctcagtgacttgtaggtcaccttcatgctgccggttgagcgggtcgtgtcggtcacttccatcccgacgcgtttcattgcatcaggcagacgctgccatgccacgttgtatggcgtacgcaggatcagcagtggcaggccggtatcatctgcaccgctctgcacatcaatggccccattcacccgaccagaggccgcgttttcactcgccgtatcaatcttgtccataccggtgctgatgtcattcagcatctgcgcggtgtaacgctggatctgcacaggtgaggtaatggttttaccatcctgctgcagctccagcagacgaacggttaactgctgctgatagctctgcgactgcacgctgatctggtagcgaccacgatactgctgatcttcatcagcacggttccactgcacccagtccgtcgtcagctgctggcctgcgtcattacgtgaggcaatcgggaatttgtatgactgcaccacgttgacgacctgcgaccagactgagccgcggctgttatcaatcatcagcgcgccggtattgttgctgaactgtgcgcgggtgccgttcatcagcgccagcggctgggctggcggacggatgtcgagctgcttgccggtgggtgcctgactggtcgtgcgcggcacgtcgaaatcaccacgctgcaccggcaggatcattccggcaggcgctttcagttcatttaactgactggcttcaagataagattcgtcaccgctgacctggcgcttataacgctgatcgcttgaacaggccgacaacagcatcagggtagaaagccccaccactgtggctactgttgaccgctttactgagtaattcattcaaactccctaaattatcgcaaacccgctttcaccagcgcctgctccactttcggctggccggctgcagtcagtggcgtcattggcagacgcagcgtgtcgttagcgattaatcctagctgtttcgcagcccatttcaccgggataggattgggttcacagaaaagcgtctggtgcagatgcatcagacgctgattcaggcggcgtgcctcgacgaaattgccctgctgtgcgagttgacacagttcgaccatttcgcgcgcagccacgttggccgtcaccgaaataacgcctttgccgcccagttgcataaagtccagcgcagtcgcgtcatcgccactcaccagaatgaaatcttcattaaccagctcttggatctgactaacccgcgataagttcccggttgcctctttgattccgataatatttttgatttcggccaggcgggcaacggtttccggcagcatgtcacaaccggtacgcgagggaacgttatacagcatctgtggcaggctggtgctattcgcaatcgctttaaagtgctggaacagcccttcctgcgtcggacggttgtaatatggggtcacggtcaggcaacccacaacgccggaattttcaaaacgcttagtcagagagatgccttcagcggtggcgtttgccccggttccggcaatcaccggaatacggccatcggccagctccagggtcagcatcaccacatcaccatgttcttcatggctcagggtagcagattcgcctgtggtgccgacggaaacgatcgccgcggtgccgctggcgacgtgataatcaatcagttttttcagactcgaccggcagacattaccgctgtcatccattggcgtaacgagtgcaacaatacttcccgtaaacattggcgatcccctcgacaaacaagtgcttcatggtacgttttacacttagggaaaagcaagccagccacgccattcccgcgcttgtcagcagttttttttatgtttaccttatggttattagcgaaagcagaggaaaagccattttgccgcaatctcagccccatcatctggtgatcaccgcgctcggtgttgaccgtccgggtatcgtcaacaccattacccgacacgtcagcagctgcggttgcaatattgaagatagccgtcttgccatgcttggggatgagttcacctttatcatgctgctgtcgggcagctggaacgcgatcacactgattgaatcgaccctgccactgaaaggggcagagctggaactgctgatcgtcatgaagcgcaccaatgcccggctccgtccgccgatgcccgacaccgcgttcattcaggttgaggtggctgattcgccgcatattattgaacgctttaccgatcttatcgataagcatcagatgaatgtggccgaactggtgtcgcgcattacaccagcgcaacacaatttgccccctacgctctatattcaaatgaccgctcacagtccgacgcgaaccagtggcaccccgtttgagcaggcgtttaataccctgtgtcaggagctgaatgctcagggaaacgctgcgcctttacagtgtgtcagatgccgacagcagcgaatctgtcagcgcggtacgctaagctttggtcaattaaccggagttatttctccacattactgccactgaaaggtgaccggctatgtggtgaaataccccctgatggtaattttccctctggccgtttctgaccggatggtgtattacccacagcctgaataagaaaatggagagatgtaatgaatccactgaaagccggagatactgcacccgcatttagcctgcccgatcaggacggcgaacacgtgaatctgaccgacttccagggacagcgcgttctggtgtacttttacccgaaagcgatgacaccaggctgcaccgtgcaggcgtgcggtctgcgtgacaacatggatgagttgaaaaaagcgggcgtggaagtgctgggcatcagcaccgacaaaccggaaaaactgtcaaagtttgtcgaaaaagagctgctgaactttaccctgctctccgatgaaaaccatgaagtctgccaggcgtttggcgtctggggtgaaaaaacgtttatggggaaaacctatgacggcattcatcgcatcagctttctgatagatgccgagggcaggatcgaaaaagtgtttgataacttcaagacctcgaatcaccacgacatggtgctggattacgtcaagtcagcctgatgttgaggggcgcggtagccttaacgccgcgccctgcttagctgcctcttccccgcccgtttttatcctgccgttgcgaaacactgtgagttaacgcgattacgcggcggccacgataacgcagttgcgcccggcatttttcgcttcatagagcgccgcatccgcctgttttaaactgccttccagcccgacatcctgcgaaccattccaggccgcgacgccgatagacaaggtaatgcgacccacgtcggtgagccaggcttctgcaatgcccagtcgcacgcgctcggcgataatctgcgcctcatccagcgccgttcccggcagcagcatcagaaactcctctccaccgttgcggcacaccacatcagactgacgggcgctggcacgcagcgtgctcgccacctgctgaatcacccggtcgcccacatcgtggccccagctatcgttgacgtttttaaagtgatcgatatccagcgccagcaccgagaaaggctgacgtagcgtgcggtagtactccagtaccgcattaagaccacgccgattcagcaactgagtcagggggtcggtctgggcttccgaactcagacgaccgattttgtcctgcaccagtccgatgccggtgagcagcgcgcgcttgacctgcgccgcctcaaaataccaggcactgatgccgccaatctcttttgatacgccctgcgcatccatccggctggctttgcgggccagctggaacagtggtcgggcaatcagccgtgccagccctaacgcaaccagcagggtcagcagtgcgaacggcaccgagtttttcaggactttcattaacaggcctgaaagcgggttcagcgtgacgttaatcggcttcagcgccaccaccgtccagccggtagtcgggacgacggcatagcccgccagctgcgtcgactcacctgcacccgcaagcatcagcgagccattggtctgctcgtcacgcggactgacgatggcgggcagaactttaccaatcagctgacgattctggtgatacaacacctcattattactgtcgagcacatagaccgtggtgccatcacggtagaattgttcacccagtagcgcattcagaatactttttttcttcagatagatcgtgccgccgatgtagcccagatagtcgccatcgggactccagattggccaggagacaaacaccagcagattattggctgcagaaagggtcggtttactgatgatcggctgccgcagcgtcagcgcttcgcgggaggcgtcgctggtgacacgcatccctttcagcgtcagggattcgggcgagatcgctttgatcgcgccctgctcatccaccacggccaccgagttgaaactggtggtctgctcgcgcagacgattgacttcgctattcagcagcccttcattattaaagtcacggcttagctgattggcgctgtagtgcaactgtgactgcgccagctggaagaaaatttcactggttgaagccagcttggcggcataggcccggttagcctcaagcgtggtgtcaatcagcacctggcgctgcacccgccaggtggcgtagagcgtattcgcgagcgtgataacaatgctgacaatcaccagcagggcgatcagattgcgcaagtcggccttgggccgaaagagctttagcatggcgtcgccgccctggagaagagtgtcatgtcgtgaatgcctgattatttttttaatgtatgccagaagccctgatagccgggcttaagtctacactgtgtcggcatttttgagcagcattaagacaaatatcaccccgcttaatacagatttagctggcactaatcgattaacccctgactatcgtaaaatggccagggtcccgaaaaatggccaatcgcgcactgatgcgtgaccattccctgccctggctgccagcaatgcagcaaaaagccgggcggctccagaataaagtgagccggcccctccggatgcagatccagagccacctgatgcgacacgcctggcgcgacacaggccagggttccggcaaagcgggtctgcaggctgcgatgcagatgaccacagagcacccgctcaacctgcggatggcgggcaatgatcgcctcaagtgcctctggatgacgtaaccgttgccgatccatatgcgcaatgccacaggcaaaagggggatgatgcagcatcaccagcgtgggctgatccgtggcctcgcgcagtgcctgatccagccattgcaactgctgctcatctacctccccccacggctgttgcggtacgctggagtccagggccagcagcctgacgccgcccacgctaagctgccagttcagggtcggtcccgcctgcaggtaggtgtgagcagggaaggcagcacgcagtgcctcgcgatcgtcgtgattgcccgccatcagataaaagggcaactggaggcgctgcagggcttcgcgcagcgtctgatactcttccggcctgccaaaatcgaccaggtcgccggtaatcaccaccacatcggggcgcggctgcagcgcgttaagggtatcgataacctgcagtaaagcggcatgggtatcgacctgtttataagagagacgaccaaaagccttgatatgcagatcgctgatttgcgcgatgactgtgggttgaacagacacaacagactccttagcaactaaattccagcgcggcctggcgggtcagcgaccagctgatgcgctgtcccgcctgccagatttcgcgggcatgacgctcgacctgaatggggttatccagcccgatatcgatcagtaagcgctgcgaggcgccaagaaacgtactgcccaccaccacaccgcgctgggcatagcgggtgtcgtcagccagcagcacatcttccgggcggcaaaaacgcaggggatgaccgtcgggatcgtgcgcaatgcagtttatggcgcccacaaaatccgctacaaagcgggaggccgggcgctgataaattccctgaggagtatcgagctgcaccagacggccctgctccatcaccgcgatgcgatcgcccagcgccatcgcctcctgctgatcgtgggtgacgtaaaccgcagtgatcgccagccgcttgagcagcgcgccgatctccagccgcagccgatcgcgcagcctggcgtcaagcgctgccagcggctcatcgaacaacaggactttgggccgggcggccagcgcacgtgccagcgccacccgctgcttctgcccgccggacaatttatcaatcgcccggtgggacagatgtgtcaggtcaaccagtgccagcatctccgcgacccgcgcatcacgctcggcacgtggcacgccctgcaccttcagaccataggcgacgtttctgcgccacgttgagcgtcgggaacagcgcgtagttctgaaacaccatgccaacgttgcgtttctcaatcggcagcgcggtgacgttacgcttgtcaaaccagatctctcccgggggatcgctgctatccagaccgctgataatacgcagcagcgtggttttgccacagcctgacggccccagcaataccagtgtttcaccggcgtgaacctgcaggtcgagcggatgcagcgcgacctgctgattaaagcgacgcgagcagtggctcagcgtcacgttgacggcctcattcatacggtttcctctctctgctgccgcgaagattgccgttccagccagtgattacaggcgttgagcaacagcagcagcggtaaaatcatcataataaagatcagggtataggcggacccgacttccagccgcatcgaggtgtagctgtcggccagaccgaccggcagggttttggtcagtggcgtgtgcagcatccaggtaatgttgaactcccccaccgacagggtgatcaccataaatgcgcccgccagaatgccgttgcggcagttcgggacgaccacggtaaagaagcggcgccagaagcccgcccccaggctggcggcagcttcttcaaggcgcggcagatcaattgcctgcatcaccgacagcaccggtcggatcataaagggcaaggtaaagagcacatggccgatcaggatgaagagccagctgtcgcgcaacgcgctgaactgaccataaagcagaatgatgcccagtgcggtggccaggcccggcaatgcgactggcagcatcaggcactcctcaatgcggctggcccagcgtgacggtgatttcagtaagccccaggcggccggcacgccagcgataaccgtcaccgccagacaactcagagcgatcagcagcgacagccagaaggtgtcggcatacatctgccacacctgttccacccacttcagcgtcaggccgctgcgcaggccagtgaaatagttctgcgtgacgcccgccagcattgagagcacaaccggcacaatcataaacagcgcggtgaggctggtgatcaccacctgcagccagaacagcccccggcgtttcatgccttttccttacggcgggcagccagtccgttcgccagcatcagcgccagccaggccaccgcccccatcaccaccgaaagcgccgccgcagtggcaaagttggcgtaattagtgaactcaccataaatggtcagcggcagcaccgcgagctctgtgccaagggtaaatgcggtgccaaaggcacccatgctggtggcgaagcagagcgcgccgcaggagagcagcgccggtttcagcccaggaatgatgacgtcaatgatgatgcgccactggctggcacccagcgatcgggcggcctcttccagcgaacggtccagcttttcactggccgccaccagcgtcacgatggcgcgcggcagcgaaaaatagagatagccaataaataagccgctaagcgaataggccaggatccagcgctcatgaaacaggctgagactgagttgcgccagaacaccctgacgccccgccagcatgaccatcagaaaccccaccaccacgcccggaaaggccagcggaaaggtcagcagcgccagcagcgtgcctcgcccggtaaagcgctgccgtgccagaaagcagcccaccaccgcagcaatcagcagcgtcaccagtgtgaccgctgccgagagcagcacggtattcagcaggctttgcagatattgcggctggctgattaccgtccagtagccgctgtggtgagttgtacgatcttccgtcataccgatctgcaacagacgagcaaacggcaacagccagaaggcagcaaagaacagcagcgcaggcagcagcatccacggccagtttgcccccagcggccgaaggcggtggcgaactgagtcgccagcagcaaacggattgatctctgagagtgacatcagcggatctcgctcaggtaacgggcggagaagctcttctgcgcgtcggccatctgctgataatcaaccgtgtgagcgcgcgcatagtcgctgtcaggcagaaaatatttcttcgcttcgggtgacatcgcgcccgcccggaccggacgcagccaggcattagcccagatcgcctgaccggcatctgacagcacgaaatcgatcactttcttaccgttggccggatgcggcgcatttttcaccaggctgatgacgtaaggcaccgtgaccgtcccctcgctggggatcacaaattccacattggcgtgatctttgtagcgggcgcgataggcgttgaagtcgtagtcgatcagaatcgggatttcgcctgaaatcagccgggcataggcggtctgcttaggcacaatcggctggttgcgttgcagcgctttgaaccagttgatagccggggtgaagtcatgaagactgccgcctttcgcctgattcaccgcgacggctgcaacgtagccgacaaaggcgctggccggatcaagataacccaccatgcctttatattccggcttcagcagatcgtcccaggagcgcggcaccggcgcgccacccagcgcatcaacattgaccataaagcccatggtaccggagtgcagcgccacccacttgccagcaggatctttcatgcctgccgggatctgatcccagtttgccggtttgtaagcgctgaccacgtctgcactgactgcctgaatgccgaagctgacgccgtaatagaccacgtcggcgaccggattgcttttctcggcgaccagctgcgccagcgcctgacccgaatttttattgtcctgcggcacatgaatgcccgtcgttttttcgatcgcctggagctgtgtcgcccagtcggcccactctggcgggcagttgtagcagatagcattttcagccgcctgcgcccacgatgaggcaagcgtgcatccggccagcagcgcagcgctggcgataggtttgaagttaacggtgagtgacatgatgttcccctgaaaaagagccatgaaatgccggggcgacactctccccgaaacgtaaatgatgagccagcagatgggttttaccgccgacgggattcagaagcaggtcaatggcgcgcgcgcccattagcgcaatcggctgcaccacgctggccagtgaaggtgaaagctgttcgcccagctcaatgccatcgaagccgaccacggagagctgattcggaacgctgacgccggcacgcgcagcggcgcccagcaggctgatagccagcagatcgttactgcaaatcaccgccgtcagcggcgaaggtgaattaatcagcggcagcaacggatggaaatcggactggatatggctgggcatctcaatcatcgcctgcggcgtcagaccggcctgctgcatggcatcgcagtagccgagatagcgcagacgggcgcggtcagattgctgcataggacccgcagccatcacgatgtggcggtggcccagtgacaccagatgggcggtcgcttcggcaatggctttgcggttatctacgcacagcgcgggccattcgtgctgttgcggtacgttgtgggtcagcacgaagggcatcttcgccgccgccagtgtcggcagcagcgcactgctgtcggcatctgccaccgtcagtaccagaccggcgacacgctggtgcagcatatgttcgacaatggccgcttcccgctcagcctgataatcactggttgctaccagcagcccatatcccgccagacgagcctgctgctccatcgcctgtaattgcatggcaaaaaccggattgagcagtgaaggcaacaggacgccaagcgtggtggagtgctgggtgcggagctgacgggcaatatgattcgggcggaaaccgatctgttccgaggcggcaagcaccttttgcagcgtgcccggttttagcagatgagggtcagaaaaggcgcgcgcagcggttgcgcgggagacccctgccagtctggctacgctgattaaatcggtcatgactgcctcgtgtattgtcgatgagatcgatctcattgcgacaacactagcggcgtttctatgacaggggcatcacagcaatttgacgggcagatgacagcggcagtgacgccgctgtgggggaattaaagcatcaggaaggcgtaaccgctgttttccagggtcgcaacggtggtgccgctggagatggtgtgagtgaccatcgggtcgatccagttgcgctcaagctgatgaaacgccactgactgatcgcagatagtgacctgaacgcccgcttttttcagttcgctgatcagcttcaggttcgggttatcgacgccgtaggctttgctgaactggtcattattcagcgctgatgaaaccgcgtcgccgttaattgacaccacaaatttcagctggtcgagtggcacacctgccgcataatagaggttggtgacgcgcgctacgcgctccagaccgagattcggcttatgaatatccccttcactgcggttgatctgaaatactattttattactcaggcccgctgtcgtgccgggtttaaatgcaggcgtatcgacataatgtatttttccgtagccttcaatcgctggcgtactccagaaatcagcaggttcggatttattatccgccattttcccgctgaccttatcgaataattccggcaactgtaaaacattgcctccgataaatcccgctacggctgccatcaccactaaagctgctggacgcattaactcttctcccgatcgtttaaaacatcaattacattgccagccacgcgtatccctggttttgcagggttgatacggtggtcggactggaaagtgcatggactacagatttatcaatccagttattgggatagtgatggaatgccacggactgatcgcagaccgagactttcactcccgcctgattcagctcattaatcagcttcaggtttggattttcgatgccataaaactttttaaaatgggcattatccagcatggcaggggtcgcgtcgccggtgaccgaaacgacaaacttcagctgatcggccggaatgccggaggcgatatataaattcaccacgcgcgccacacgctccagtcccagattgggcgcggtcatcgcgccatcgcttcgggtaatctggaaaacaattttattgctcaggcccgccaccggtttaaacgcggcgtcgggctcataatgaattttgccgtaaccttcaatcgctggtgtgctccagaatcccggggcttcctgtggctcggttgcaaaatggcgtgtcactttgtcataaatctcgccactctgtgtgacagccgcgccaacgactccgccaataatggcgattaacgcgtatgaaacaactgaacgcataacacttctctccggcaaataatgtctggcagattcaggactgaatcaggtcggctatctatatcacagcgcaggcataattctcgcctgcgtaaattcaggtcagcgcgcggctgataactgctgaaattattcaccttccgtattaatcgaaaagtttcattatgaggaaaaaaaggtcttaatcagaatggacctgactctttgtgctcttttcacttcctgtgacattaacagcaataaataacagccaggcgtagctggaataagcaggataaaggcgggagctacgatttaatttatcaatggcgaagaggagattcacggctcagagagggctattttttcagagtagacctggaaaaactcatgccatagtcagtttttttgagtgaatttacataactttaaaaaaatccgctcacaggctaaatctgcgcggcagcagattctgctttattctgccgaagcgcattgggaataaatgaataaggcgttacttaaccgctcacaaacccggcgatactccgccggtttttattcgtttaaccgcggtttaagttggcaggatgttcagtttttttcgtcaaaatgggtgatcttgcacaaattacgtcggtcgtttgccagaaaacgacatttcattcttttgatgctctggttaagatagtcacgaaccgtcgttatctgcgaaaaatggaacattcccgctgcgcacctgtccattttcagggcctctctacaggattaaggcatgttgaaccggttaaagaaaacgctgatcgccgcgctccttccgacgctcattttcactactctgtcacctgcttatgccgatgtcagtgattcacttcccgatattggcactacggccggttcgacgctgtcgattaatcaggaactgcagatgggcgacttttatgtgcgccagctgcgtgccagtgcgccgctgatcaacgatccgctgcttaatcagtatattaatcagctgggtcagcgactggtgtcgcatgccgactcagtgaaaaccccgttccacttctttctgattcagaacgatgagctcaacgcctttgccttttttggtggcaacgtggtgctgcactcagcgctgttccgctataccgaaaatgaaagccagctggcgtcagtaatggcgcatgagatctcacacgttacccagcgccatctggcgcgcgcaatggaagatcagaagcgcaatgcgccactgacatgggtcggtgcgctgggctctattctgctggcgatggccaatccgcaggcaggcatggcagcactgaccggcaccctggcgggaactcagcagggaattatcagttttacccagggtaatgagcaggaagccgaccgcatcggaattcaggtactgcagcgcgccgggtttgatcctcaggcgatgccgaactttttacagaagctggccgatcagagccgtttctcctcgaagcctcctgaaattctgctgacgcatcccctgcccgacagccgtctggcggatgcccgcaaccgcgctaaccagatgcggccggtggtggtgcaatctacagaagatttctatctggcaaaggtgcgttcactgggcatgtactcaaccgggcgtaatcagctcaccgacgaaactgctgagccagtatgccagcggcaattctcgtgagcagctggcgtcacaatatggcaaagccatacagtttttgcaggcgaaaagctttgccgatgcgaagcggattatgacgccgctgctggcgaaacagccgaataacgtctggttcctggatcttatgtcggacatcgatatcggcctgaatcagccacaacaggcgatcgccctgctcagcgccgccaccagtgcaaaaaacagcccggtggtgcagctcaacctggccaatgcctacgttgaagcgaaacagtatgccaatgccagccgcattctgaatcgctacacctgggctaataaagatgatcccaacggctgggatttgctggcccaggcgtctgcacagcagggactgaatgatgaagagttatcggcgcgggcagagagtctggcgctgaatggccagctcgatcaggcgattaccgcgctaggcagcgccagcgcacaggtgccgctcggcagcctgaaacaggcgcgctacgatgcccgtatcgatcagctgcgccagttacaacagcgctttaagcagtatcagaaaggctgagcattcacgctgcgaatagaggagagtctgagatggtgacgatttaccacaacccgcgctgcagcaagagccgcgagacgctggcgctgctgaacgcccgcgggatagagccggaagtggtgctctatctgcaaatgccgcccgatcgcgagacgctgcaaatcctgttacagaaactgggaatgcagagtgcacagcagttgatgcggactaaagaggcgatctatagcgaactggcactcagcgacaaaagcgaaagtgcgctgctggatgcgctggtggaacatccggtgctgattgaaaggccgatagtgatcaatggcgacaaggcgcggatcgggcgtccgcccgaagcggtgctcgacctgttttaaaggccgagtgtctctttcacaaacggaatggtgagtttacgctgggcgctgatcgaggcgcgatcaagccgatccagcgtatcaaacagggtgcgcatttcacgatccagtcgcttcagcaggaagcgccccacatcttccggcagctcaaatccgcgtaacccggcgcgcagttgcagcgcctgtaatttgtcttcgtcggagagaggctgcaggcgatagatctgcccccagtccagccgcgaggcgagatcgggcagttgcagattaagctggcgtggtggacgatcgccgctaataaacagccgcgtattgccggtttccagaatacggttatagagatcgaagatcgccatttcccattcaggctcgcctgcaatgcactcgatgttatcgatgcagaccagtgacagctgctccatcccttccagtacttccggtacaaaccaggtgcgtttatccagcggaaacgtaaccgaccgcttcgctgcgcgctgacatctcggcgcacgcggcgtgcagcaaatggctccgccctccgccttcgcgtgaccagaagtagagatagctgccatgttgttggttgagagcgcctttcagcgcggcaatcagcgacgggttttcccccggccagaagctggagaaggtttcatcgtcaggtaaatagagtggcaatgacaattgtgccggcgtgttcagaagcacctcagcaagagaacaagcaaaaaatcgggggaagtctaacacagttttcagaaagagatgaatggggcgtccctgccccgatcctgtcaggcttgctgcgatcacggctcgcgcgattcttcagcctccagcaccacttcttccggacgcaacagcgagatcacacggaagatcagcgctaatccaacccctacgattgtcgccagcgccatgcctttcagctccgcagcaccgatatgtaccttcgcaccgctgacgccgatgatcaggatcaccgaggtcaggatcagattttgcgctttgttgtaatcgactttggactcgatcaacacccggataccggatgcgccgatcacgccatacagcagcagcgacacgccgcccattaccggtaccgggatcgcctggatcaccgccgccagtttgccgacacaggagagcaggatcgccagaatcgccgcgccgccaatcacccaggtactgtagacgcgggtaattgccatcacaccgatgttttcgccgtaggtggtgttaggcgttgaaccaaagaagccggagatgaccgttgataagccgttggcgaacatcgaacgatgcaggccagggtcgcgaatcagatctttctttacgatgttggcggtgaccaccagatgaccgatatgctcggcaatcaccaccagcgccgcaggcaggatcgtcagcatcgccacccactcaaagcgcggggtatagaaggttggcagcgcaaaccagggggctttgatcacgccgctccagtcaacaatgcccataaatgcagagagcagataacccgctaccaccccgaccagaatcgggatgatcgccaggaagccacgaaacagcacggaaccgaataccgtcactgccagcgtgaccagcgaaatcagcacggttgtactgtcgggcgcactgccttccgcgggcagcaaacccgccatattagcggctacccctgccagctccagaccgatgacggcgacaatcgcgcccatcgccgccgggggaaacatcacatcgagccagccggtgcccgcgcgtttgacaatcagcgccaccagacagaacagcacgccgcacaggataaatccgcccagcgcgacctcataacccagcggcagcaatagcagtaccggcgagataaaggcaaaactggaaccgaggtaagcgggaattttgcctttacagataaagaggtagatcagcgtgcctacgccgttaaataacagcaccgtcgccgggttgatgtggaacagaatcggtaccagtaccgtggcaccaaacatggcgaacaggtgttgcaggctgagtggaatggtttgcagtaacggcggtcgttcactgacgccaatggcgcgacgagtcatcatttatccccttgtgttatttatcccccagggcgcgcgactctggcacagcagcaggcacgtcggtgagcctcgcagccacaccaaacccgttcggggatcttttttttgccaaaaaaaagccgactctctggtcggctgtgcgattatttggttccgaaaatcttgtccccggcatcgccgagcccgggaatgatgtaacccttctcattcagtccctgatccactgacgcggtgtagagctcaacgtcaggatgcgctttctccagcgcggcaatcccttctggcgcggcaaccagtaccagcactttaatgctggtgcagcccgctttcttcagcaggtcgatggtggcgatcatggaaccgccggtcgccagcataggatcgacgaccagcgccaggcgctcttcgatgttagagaccagcttctggaaataaggaaccggctccagtgtctcttcatcacggtaaacacccaccacgctgatacgggcgctgggaacgtgctccagcaccccttccatcatgcccaggccggcacgcagaatcggcaccaccgtgatttttttgcctttgatctgatcgatctctaccgggccgttccagccctcaatggttacgcgctctgtttccagatcggcggtcgcttcgtaggtcagcaggctgcccacttcagacgccagctcgcgaaaacgctttgtactgatatcatgctcacgcatcaagcccagtttatgtttgaccagcgggtgtctgacttccacgatcttcattggtgttctcccggaatgagttgagctaaaaaaaaatcgcgggattataccgccttttacgctccgcgccacctgctcttgcgcaaagccgcgggttttaacgggacaaatagaggattaatgaaaatcgcccgatgcgcaatcccggactcgcaaacgtttgcctgcactgatagaattgccgcgctttattttaaaccaccaaccgcaactcgcgtggggacctcgcagtgaccgacaaaacctctctcagttacaaagacgccggtgttgatattgatgctggtaacgctctggttgaccgtattaaaggcgtagtgaaaaagacgcgtcgcccggaagtgatgggtggactgggcggttttggtgcgctttgcgcgctgccgcagaaataccgtgaaccggtgctggtctccggcaccgatggcgttggcaccaagctgcgtctggcgatggatctcaaacgtcacgatgccattggtgttgacctggtggcgatgtgcgtcaacgacctggtagtacagggcgccgagcccctcttcttcctcgactactacgctaccggcaaactggatgtggataccgcctctgcggtgatcaccggcatcgccgaaggttgtctgcagtcgggttgtgcgctggtgggcggtgaaaccgctgagatgccaggcatgtatcacggtgaagattacgatgtggccggtttctgtgttggcgtggtggaaaagtcagagatcattgatggcagcaaggtgcaggatggcgacgtacttatcgccctcggctccagcggcccgcactccaacggctattcgctggtgcgtaagattctggaagtcagcaacaccgatccgctggatgaacagctggaaggcaaaccgcttgccgatcatctgctggaaccgacccgcatctacgtgaaaaatatcctgagcctgattgagcaggtcgatgtgcacgctatcgcacacctgaccggcggcggcttctgggagaatattccgcgcgtgctgcccgataacactcaggcggtgatcgacgagaagagctggcagtggccggccgtcttcagctggttacagcaggcgggcaacgtcagccgtttcgagatgtaccgtacctttaactgcggcgtcggcatgatcatcgccctgagtccggcagacgcggacaacgcgattgcgctgatgcaggctgcgggcgagaaagcctggaagcttggcgtgattaaagcgtctgatgccgaagagcgtgtggtcatcaacggatgaaaaagctggttgtactgatttccggcaacggaagtaaccttcagtccatccttgacgcctgtgcaagcgggcggattcacggcagcgtggctgccgtattcagcaaccgcgccgccgcttatggcctgacgcgggcgcaggaggcaggtattcctgcccactcgcttgccgccagcgacttcactgaccgcgaagccttcgatcgccagctcatcgctgaaatcgaagcctacagtccagacctgattgtgctggccggctatatgcgcattctcagcagcgcgtttcgtggcccattttcacgatcgcctgctgaatatccacccttccctgttgccgaaatatccgggtctgcatacgcatcgtcaggcgctggaaaatggcgatagcgaacatggcacctccgtacatttcgtcactgacgagctggatggaggtccggtgatcctgcaggccaaagtcccggtttttcccggcgacagcgaagcggagattacggagcgggtgcagcatcaggagcatgccatctatccgatggtaatcggctggtttgttgagggtcgtctggcgatgcgtgacggcaaggcctggctggatggcgaaccgctgccgccgcagggttatgctaacgactgacccgacaggggaagccggggcttcccctgaagtgctggcggtcggggtaaaggctcagggaaccattgagccgtctgacataacaacctgctctgctcccgttactgacttaaccgtagcgccccgtaatataatcttcggtccgtcgctgttttggcgcggtaaagatacggtcagtctcatcaaactccactaacgcgccctgatgcataaacgcggtgtaatctgacacgcgagaagcctgctgcatgttgtgcgtcaccagcaccagtgtgaaatgctgcttgagcgtagtcatcagctcttcaatcaccagcgttgagatgggatcgagcgcggaggtcggctcatccagcagcagaacttccggttcaatcgcaatggcgcgggcaatcaccagccgctgctgctgtccggtagagagcgtcagcgcattctgtgacagctgatctttgacctcactccacagcgccgccgcgcgcagcgcacgttcacaggcttcgttcagcacccgccgatcgcgtacaccctgtaaacgcagcccgtagaccacattttcatagatcgattttggaaaaggattggggcgctgaaacaccatgccgacccgacgacgcagcgccgagagatcctgctcaggtcgcaggatcggctgcgatcccagcaacacctcaccctcgacccggcaatgatcaatcacatcattcatgcgattaaagcagcgcagcagcgtcgatttgccacagccggagggaccaatcagcgcggtaatcttgtttttcggcacctgcagcgaaatagcctgcagcgcctggcgctcgccataccacagcgatagctggttaacggtcagcgcgatatccgtgtcggacgtcatagtcatagcctgttattgagtcataaggcgatagcgttcacgcagacggtgacgcaggcccatcgccagcagattaagcgacagaataatcagcaccagcagcagcgcggtggcgaacaccagtggccggtcagcttcaatattcggactctgaaacgccagatcgtaaatctggaagcccagatgcataaatttgcgatccagatgcagataaggaaacaccgcgtcgacgggcagttccggcaccatttttaccacgccaaccagcatcagcggcgcggtttcaccagcggcacgcgccaccgccagaatcaggccggtcagcatggcaggcaccgccatcggcagcaccacgttccacagggtttccgcctgagtcgcgcccagcgccagcgacccctgccgcaggctgttgggaatgcgggatagtccctcttcggtcgccacaatcaccaccggcagcgttagtaacgccagagtcagcgacgcccacagcaaaccaggtgtcccgaaggtgggattgggcagcgcgctggcgaagaagagctggtctatcgtgccgcccaccagccagacaaagaagcccagaccaaatacgccatagacgattgaaggaacgcctgccagattgaccaccgcgatgcgcaccagtctggtcagcgcattgcgtccggcatattcatgcagccagatggcggcgatgacacccagcggcatcacgaccaccgacatcagcagcaccatcagcacggtgccaaagatcgccgggaaacgccccggattcactctcgccttcagcgggtgaatcactgacgaaacgccacagctgatgcagaaaatgcagcgttttgccggtcagcgtcatcgcgttcggcttccagctgtcaacgatttcggtcagcgggatcgcatgttcggtgccatgcacatcccgcaggattaacagatcgcgctgactctgctgttgcagcgaagccagtgtctcgctcagctgattaaaccggcgctgcaaagcggcctgattggcctgatattctgactcggcctgcaaatcaaagcgcccggcagcacggtttgtggccgcctgctcatcaagctgctcacgctggctgttgaggcgcgccatatcgacccggcgaatctgattagcctgccgcaccagcatctgcacctgtccgagccgctgatgcagcagtgcatcgggatcctgcgcagtcagctcttcattatcctcacgcaggccgacaaaccagccgtatgcctgaccgtggctgcggcgctgcagcaccatgatgtccgctggctggctgacctgcgccgccgtgcgactgtaaaccacccggaaatcgggtgcgtcccagtcacggttaccggttttaatcagataacgattaacctgtccgccgctgttgccctgctcatctgccggggccggaaagcgccgctgatgttccagagtttcacccagcaggcgcgtctcgcccccttcaggctggctaaacgtgtagagatcgacgcgctgcggccagaaagcgcgccccccctgccaggccagtaacccaatcagcagcgtaaaggccagcaggcagacggctacggcaccggcggttagccagcgccagcgatcgttctgtcgcatcgctttcatgcctgctcctcgtgctggctgtagcgctggcgcagccgctgacggatcagctcggcaaccgtgttgatcaccagcgtaaacagcagcagcatcagggcgctaagaaacagcacgcgataatgggcactccccgccgccgcttccggcatctcaatggcgatattggcggacagcgcgcgcaggccgctgaacaggccaccttcactttgcggcgtgttgccggtcgccatcagcaaaatcatggtttctcctacggcacgccccagaccaatcatcagggcggcaaaaataccggcggaagcacccggcagcacgacgcgggtcagggtttgccacggcgtcgcgcccagtgccagcgagccctgccccagtgcagccggcacgctgaacagcgcatcctcagagagggtaaagatcagcggtaccagcgcaaagcccatcgccagcgcggctaccagcagattgcgctgttcgtaatgcggcagccagtcgcccgcatccggtatcaacagcgtgggcagccacagcgtcagcagcgtgaccagcagcaacagcggcagcagaatcagcacttcacgacccggctgacgccagcgcggcggtaaacgcgcgctgaatacgccgcacagcagcagcgtgcccgccagcgtcagcggcagcagcagcacacccaccagcgcctgaccaatatgcggcgcgagccagatcccggcaaccagccccaccactacgctcggcagcgcgcccatcatttcgattgccggtttaacccagcgtcgcaggcctggcgccataaaccaggcggtgtacatcgccgccgccagcgccagcggtgtggcaaacagcagcgctaaactcgccgctttcagcgtacccatcaccatcggcatcaggctgaacttggcctgataactgtcacccgccgcggtcgattgccagatccagtccggtccgggataattttcataccagattttttgccagaaattgcgccaggtgacgtccggccacggattatcaagccgcagagtctgccagcttcccgcccgttcaatcagcaggctgtcgccacgcggcgaaaactgagcctgcacaatgccaggttccagctgacgctgcagtatcgggccattctgcttgctggcgaacagccttaacagcccctgtttgctgagcgtcgcaaacacgcggcgttgtgattccgtcaccagaatggtctcgccgtcgctgttggcaaaggtacgaatgcgctgcaggcgcggcccctgtttcgctggcgatagcaaaccactgcgtgacgccgctgccatcctggatcagcaggcttctgccgcccaccagcagatgcagactttttggccgctgcggcagggtgtgcgtttcgcgcaatagtgcacggtcatcgtcaagttgccagacccgcagcagattgccttcggtggtgtagagcagatcgccggccggcgagagcgccagcagatccagctggcgttgcggcagcgggataaccgaggcctggcgatcggtgccaagcgtcagcacccggagtccggcctcagtaagtgcggctatacgccactgacccgcatggcgcgtcgccagcgccatcttcgtcactgcgccatcaggcagatgaaacggtttatctcccagcggaaaacgccactgctggtcggcggttggctgcatcagtgtcagcgcaccctgcatattcagcagtagcgtctgctcatcggcactccgcactatttcgccgggcggcggggtcagcgccagtgccggttccgcaggctgaccatccagcggaataaaacgcgccgcaccgcgctcgctgatgcgccagccgaccttcccctgattgccaatcgctaatgctggcgcacgatcccagagttgctggctggccgcaatctgcaggcccggcgcattaaacagcggtaataccacgccaatcagccagcagaagagcagcagcatcaatagcaggatcgccacgccacagcaggtgaccagccggcgtgtcagacggtcaacggcacgacgcttacgatcgctgaattggacaggaatgtggtttgcgctcatgcggttccgctagcaggccaaaataagccgctatgttgcccgtagccgattgataagacaactcctggcgttggacaacgctgccatactctcgccataatgttggtggatactggatcttcagtcctgcaaccgctaaatggagtgagaatgggtcaggtaaagctttatattgaaaaagaattaagctggttatcctttaatgaacgggttttgcaggaagcagcagacaaaagcaatccactgattgagcggatgcgctttctgggtatctactccaataatctcgacgaattctataaagtgcgtttcgccgacctcaaacgccgcattctgattggtgaagagcagggttccgccagtacgccacgccatctgtttaagaaaattcagcagcgggtaatgaagtccgatcaggagtttgatgcgttatataacgatctgctgctggagatggcacgtaaccagatcttcctgatcaatgaacgtcagctctcatccaatcagcaggcgtggctgcgccactacttcaagcacgaactgcgtcagcatatctcgccgattctgatcacccatgaaacggatctgaccgaattccttaaagatgactacacctacctggcggtagaaattatccgcggtgacaatattcagtatgcgctgctggaaattccgtccgacaaagtcccgcgtttcatcaatttaccggctgagccaccgcgccgccgtaaaccgatgatcctgctggataacatcctgcgctactgcctggatgacatttttaaaggcttctacgactacgacgcgctcaacgcctattcaatgaaaatgacgcgtgacgccgagtacgacctggtcacggagatggagtcgagcctgctggagctgatgtcctccagtctgaagcagcgactgacggcggaaccggtgcgtttcgtctaccagcgcgatatgcccgacacgatggtgtcgctgctgtgccacaagctttctatctcaaacctggactccatcctgccaggcggccgctaccacaacttcaaagactttatcggcttcccgaacgtcggcaaaaacaacctggtgaaccgcccgctgccgcagattcgccacatcggctttgatggtttccgcaacggctttgatgcgattcgtaatcgcgacgtgctgctctactacccgtaccacacctttgagcatgtgctggagctgctgcgtcaggcgtcgttcgaccccagcgtgctggcgataaaaatcaacatctaccgcgttgctaaacactcccgcatcatggatgcgatgattcatgccgcctataacggtaaaaaagtcacggtggtggtggagctgcaggcgcgctttgatgaagaagcgaatatttactgggcgaaacgcctgactgaagcgggcgtgcatgtcattttctccgcaccaggcctgaagatccacgccaagctgttcctgatttcacgccgcgaaggcgaagagattgtgcgctacgcgcatatcggtaccggcaactttaacgagaaaaccgcgcgtctctatacggactactcgttgctgaccgcggatgcgcgcatcaccaatgaagtgcgtcgggtgttcaactttattgagaatccctatcggcccgtgacgttcgatcatctgatggtctcgccgcagaactcgcgccggatgctgtatgagctaatcgacaccgaaattgctaatgcgcagcagaataagccctgcggcattactctgaaaatcaacaatctggtggacaaaggtctggttgatcggctttatacagcctccagcgtaggggtgaaggtcaatcttctggtgcgcggaatgtgctcattaatccctgacttgcccgggatcagtgaaaatattcgtgtcatcagtattgttgaccgttatctggaacacgatcgcgtctatatttttgagaatggcggcgaaaagaaggtgttcctctcctccgctgactggatgacacgtaacattgattaccgtatcgaagtggcagtggcgattctcgatccccacatccggcagcgcatactcgacattattgctattcagttgagtgatacggtgaaagcccgcatcgtcgataaagagttgagtaaccattacgttcagcgcggcaatcgtcgtaaagtgcgatcgcagctggccatttatgattacatcaagaaactggaacaacctgaataaatcctatgccaatttctcataaaagtacgccaaaaccccaggagtttgcggcgattgacctgggctcgaacagtttccatatggtgattgcgcgggttgtcgatggtgcgatgcaggtactgggccgccttaagcagcgcgtccatctggctgacgggctggatgcccggcacaacctcagcgaggaagcgatggagcgggggttagcctgcctggccctgttcgccgagcgcctgcaggggttcagtccgagcaacgtgacgattgtcggtacccacacgctgcgcgaggcggtcaacgccgaaaccttcctgcaacgtgcggccgaggtgatcccttatccgatcgaggtgatttcgggccatgaagaggctcgcctgatctttatgggcgttgaacatacccagccggagaaaggccgcaagctggtgatcgatatcggcggcggatcaaccgagctggtcattggcgaggattttgaaccgcaactggttgagagccgacgtatgggttgcgtcagtttcgcccagctctatttcccgaaaggtgaaatcagccgtgaaaacttccgtcgcgcccgtttagcggccgcacagaagctggaaacgctggcgtggcaatatcgtctgcatggctggcaatatgcgctgggcgcgtccggcaccatcaaagccgcctgcgaagtgctgctggcgatggatgaaaaagagaagctgattacgcctgagcgcctcgaaaagctttatgacgaagtgatgaaacacaaatcctttgctgcactcagcctgccgggtctgtcggaagagcgtaaaggtgtgtttgtacccgggctggcgattctttgcggcgtatttgatgcgctggccattcgcgaattgcgcctctccgacggtgcgctgcgtgaaggcgtgctctatgagatggagggccgtttccgccatcaggatattcgcagccgtactgcacagagtctggcgaaccattacgctatcgacagcgatcaggcacgacgcgtgctcgacaccaccgagcagctttatctgcagtggcgcgagcagaatcagaaactggcgaatccacaactggccgcgctgctgaaatgggcagcgatgctgcacgaagtgggcctgaccattaatcacagcggcctgcaacgccattcagcctatattctgcaaaacactaacctgccgggcttcaatcaggatcagcagatgctgctggcggcgctggtcagattccatcgtaaagcgataaagcttgatgaactgccgcgcgtgacgctgttcaagaaaaagcagtttgtgccgctgattttcctgctgcgcctgggtaccctgctgaataatcagcgacaggccaccacgcgtccggaggcgttaaccctgaaatgcgatgacggccactggacgctgaccttcccggcgggctatttcacgcagaacaacctggttcagctcgatcttgaacgggagcaggtttactggaatgacgtcacgggatggaaactgatcctcgaagaagaagtctgacaacacgggcgcctggcgcccgtttaactgaaatgatgaatatgacacaaccaaccgcacccctttcaggcgaaaactattttgccgaaacctatggtttaacgccgccccactccgaagtggttgcggcgctgccccagctcaacgtcggcaaggcgcttgaccttggctgtggcgtgggacgcaatacgctgtttctgaatcagcacggttttgacgtcacggcgtgggatcataatccgcaaagcctggcgcgcctgcaggagattattgcgcaggaaaatctcatcggcatacataccgagcagcgcgacctgaacaacacgcgctttaatggcggctttaactttgtgctgtcgaccgtggtgatgatgttcctgcagccgcagaccattccgcagctgattgccgacatgcaggcctgtacggtcagagacggttttaacctgatcgtggcggcgatgaacacggacgatatgccctgcccggctgatttctcctttgcgtttaaatcaggtgagctcagccactactaccgcaactggcacatcgtgaagtacaacgagcaccccggtcagctgcatcgcacagatgaaaatggcaaccgcatcacctgtcggtttgcgacgctgctggcgcaaaaagcgagttactgatctttatctgctgtttttttcaacagcgattgatttcatcaggcgactgtgactaaatattgcagtcgccccagatggggtcattacaggaaccaccccgcgtgaacagcgctatttctccccgaagacgtcaaaaaaccggcaccatgacccgcattgtgttgctgattagttttatcattctttttagtcgcctgatttttatcctgcctgctgccttcgagcatcatcagcaacagaaagctattcctgaaccggttgccataacatcaggcgatacgcgataacgaataacgaataacgacctttcgcctgaaacgcacctgatacgtaaatgttatccagctaactggactcttttttgcatccctttttcaggcgaaacgctacacttcgtgctggtgctttcagacttaagggatccaatgtgtctgcctctcactctcaacgtttaagtgaaatacgtcatcgcattctgacgctgctgctcagcgagcacgatctggttgatgccctgctggagaaatcgggcgatctcaatcctgaacagcaacgtgaaaatgcggcccagcgtgacgcgctggagcaggacattctgcaactgcatgccgctgacctcgcggatattctcgaagccctgcccgaagaagaacgtcaggcgctgtggcggctggtgccgaacgagcggcgcggccatgtgctggttgaagcgtctgaaacggtctgggccagcctcaccgaagagatgagcgaccgcgatatcctgcgcgctatccagccgctggatatcgacgatcaggtctggctggcgcgttatctgccacgtgacctgaccggacgcctgctggcaacggtggagcccgccctgcgcgcccgcatgctcgatatggtgcagcttgaccgtgaccgcgtaggccgggtgatggatttcaatatcctgacggtgcgtgaagatgtcacgcttgcaacggtgcaacgctttctgcgcaagcgcaaaagcatgccgggcggtaccgataaactctttatcaccaataaagataatcagctgctgggcgaactgctgctgacggacatcctgcttaacaaacccaaaaccctggtgagcgacgtgatgaacgcccgccctaccaccttccagctcaatgataaggccgaagacgctgccagcgcctttgaacgttataacctcatttcagccgccgttaccgacgccaggggcaagctgattggccgcgtgaccattgaagacatcatcgacctggtgaatgccgaaaacgaaagcaacattcgtaaaatggggggtatcagtcaggaagaggatgtgttcgcgccggtgcgtaaatcggtacgtaaacgctgggcctggctggcgattaacctctgtaccgcctttgtcgcctccagggttatcgggctgtttgaagggacgatttcgcaaatcgtggcgctggccacgctgatgccgatcgtcgcgggtatcggcggcaataccggtaatcagactatcaccatgattgtgcgggcgctggccttacatcaggttgaaccgggcaacttttcgtttttgatcgtccgcgaacttggcgtggcgctaatcaacggcctgttctggggcggcatcatgggcggcatcacctggctgatgtatgacaatatggcgctgggcggcgttatgatgctggccatggcgcttaatctgctgctggccgcgctgatgggcgtgctggtgccgctggtcatgactaaaatgaatcgcgatcccgccgtcggctccagcgtattgatcaccgcccttactgacaccggcggcttctttattttcctggggctggcgacgatcttcctgctgccgcactaatcgtcaggcttgcagaccgtaacgttgcagcgacccgttaagattgcgctgccgcgttaccagtgccagctctcgggtcgccgcaggcagcgtatagttaccacgctgactcagccactccagcacatccgctaagtgccagatggcggttttaccgtcatgcaccggcagcggaaacggcgggcggtggctgagcatcagcttacgcatattctgacgcgtcatgccgatgatctccgcaacatccgtcaatcccacaaaatcgggtgcggcttccaccagcgtggcccccggtatagcacgcagcacatcctcttctgcctgcttcaatacatccgttgcagagtcggactcccgggtgaactccagtgcaattctgcccggcatgcccaggccgattagcgcatcatcacagcctgccgctgccagcgtttccagcagttcatccaccggcgcatgcccttccggcaggctgaaccgtaatgtgaaacaatattccatatgcttctccttgtgctgcatcaggacttcagatagtgacagttgtcgaccacgcgtcgcagcgcgcgggcatgctgatgtgcgttttttggtgtgctccagatacaggtcagacaaaactccccacatcggcacatcaacagatttttcggacagtacatttttccccaggcgtgatggcctcccgtgacgaccagccagccatgggattcggcgtaacgtaacgccgtttcgatctctttgttgggatgccgcttccttgccatgtttttccctatcctgacgccgaattgataagttgtcaactgacaacccgataaaattatcttagtgcggctcagcatgcgcagactttttctcgcagtaaaacagtcagggtataaactggaaaacgtcacacaaaaaacgatcagcgccagaagtcatctggcagccgaaacgataatcaacggaggcaatatgtttaaagcagaggattttgttcagtcgaaaaccggcggcccgaaaatgcaggtgctgcgcgtagaaggcgacaccttatggtgtgcacgcgttgatgatgcggcgaaaaaagagatcgaagtgaaagcagagagcgtcaatctctatcacgaagagggtgactttggcgtgtgctgaggtgaaacggcccctgacggggccagactgtcagggcttatcctgctgaaggttgtcatttcccagaccgccaataaacggcagacgcagccggaacggtgtgaaatcgactcccatgttcagacccagcagattgacttcaagtccctcttctgcacccagcgtcacgcccgccacgcccagaatcgacacctgcaggccgcgcccggatggcggcagcccgaccggacgccacagtggccggtaatcttttcccagcgcgttagcgggcagatcaagccttaaagcgggtacttcgcggccaatatgcgccaggaaggtattgctgtttggtccaggccaggcgcgataggttgtcggccacggataggatttaatggcggcttcaatctgcgggatcatcgcttctgcttccggtccgcgatgttccaccagcagccgcggttttgcgccataccagtagccatcaggcaggttggtgttgcgccggactttatcgccgctgccccagctaatcacttcgtagcgagtgaaacgcgtttcacctgcgcgcttgaagatgatccacggatgcaccgccaccgcccctttccagccgtaagtcggcgcagcatagacctgtacgatagccaggctatataaagcgcgcgggtcgggcgctatcccggccgaatcgcggcgggccgaccaccagccgccctgctctgtggtatcgctgtgacgcgtcgcctgcgcgatgctggctcccagcgatagcagcagtacggcaacaaaaaacaggctgaacactttaagtgagagcatgacaacattcctggtgacgtaagaatcgcgaaacgcctgttcagcaggcagtttcagtaagcggcggctttgggatacggatgatcgatgaaagcggcggataaaagcgggacacaaatgacgtcagttgcgggcttttactgcatggaggatagcgtaatttccggcaaagtgaataataaaacgccagcggcgaggcgggatgcgctgaaaagttaaaacggcgagtctgcgcacggtcagagcaataaaaaaagcccgctgaggagcgggctgcagacttatcagggattaactggctgaggccaggttattcccactcaatcgtcgctggtggcttaccgctgatgtcatacaccacgcgggagatgccgtcgacttcattgatgatgcggttagagacacgacccaggaaatcatacggcaggtgcgcccagtgtgcggtcataaagtcgatggtttccaccgcacgcagcgagacaacccagtcatatttacggccatcacccatcacgccgactgaacgtaccggcaggaagacggtgaacgcctggctgactttgttatagagatccgctttatgcagctcttcaatgaagatggcatcggcacggcgcagcaggtcgcaatactctttcttcacttcgcccagcacgcgcacgcccagacctggacccgggaacggatggcggtagagcatgtcgtaaggcaggcccagctccagaccaatcttacgcacttcatctttgaacagctcacgcagcggctcaaccaggcccatcttcatctctttcggcaggccgccgacgttgtgatgcgatttgatgacgtgcgccttaccggttgcagaggccgcagactcaatgacatccggatagatggtgccctgtgccagccacttaacgtcctgcagcttcagcgcttcttcgtcgaagacttccacaaagacgcgaccgataattttacgtttcgcttccggctcattctcacctgccagcgcgtcgaggaagcgcgcttcgccttcaacgtgaataatgttaaggccgaagtggtcgccaaacatatccataacctgttgtgcttcgttcaggcgcagcaggccgttatctacgaacacacaggtcagacggtcgccaatggcgcgatgcagcagcattgccgtcacggaggagtcaacaccacctgacaggccgaggatcactttgtcgttgccgacctgcacacgcaggcgttcaaccgcatcttcaatgattttggctggcgtccacagggcttcacattcacagatgtcgataacgaagcgctcaagcatccgcaggccctggcgggtatgggtcacttccgggtggaactgcacgccgtagaaacgcttctcttcgttagccatgatggcgaacggacaggtttctgtgctggcaacggtcacgaagtcagccgggatcgccgtgactttgtcgccgtggctcatccagacatccagcagcggtttgccggcggcgctgatcgcatcttcaatatcgcgaaccagggcgcttggcgtcgtcacttcaacctgcgcataaccaaactcgcgctcagttgagccagcaacggtgccgcccagctgcatcgccatcgtctgcataccgtagcagacacccagcaccggcacgccagcgctgaagacatattcaggcgcacgcgggctgttcagttcggtggtgctctccgggccaccggaaaggatgatgccgcttgggttgaactggcgaatctgctcttcggtgacatcccatgcccagagttcacagtaaacgcccagctcgcgtacgcgacgtgcaaccagctgagtatattgtgagccgaaatcgagaatcagaatgcgatgcttatggatattttccgtcgtcattgagggttttccagaacggtgacttaatcaataaaagcgcccggctgaagccgggcgggaaatcgggattatgaacccatgcgatagttcggtgactctttggtgatggtcacatcatgcacgtggctctcattgatgccggcgccgctgatgcggacaaactccgccttagtgcgcaggtcatcaatggtcgggcaaccggtcaggcccatgcacgagcgcaggccgcccatctgctgatgcacgatctctttcagacggcctttataggccacgcgaccttcgataccttccggcaccagtttgtcagcggcgttatcggtctggaagtagcggtcagaagagcctttagacatcgcgcccagtgaacccataccgcgataggatttgaacgaacggccctgataaagctcgatctcgcccggtgactcttcggtccccgccagcatcgaaccgaccatgacacaggacgcaccggcggcgatcgctttcgcgatgtcaccggagaaacggataccgccatcggcaatcaccggaataccggtgccttccagcgcggtgactgcgtcagagacggcagtgatctgcggaacgcccacgccggtcacgatacgggtagtacagatagagcccgggccgatacccactttaacggcgctgacgcctgccgcaaccagcgccagtgcgccggcaccggtggctacgttgccgccgacgatttcaaggtccgggtatttggcacgggtttcacggatacgtgacagcacgccttcagagtggccgtgtgaagagtcaatcagcagcacgtcaacgcccgctgcaaccagcgcatcgatacgctcttcgttacctgcacctgcgccaactgccgcaccgacacgcagacggccctgctcatctttacaggcgttaggtttacgttcggctttctggaaatctttaacggtgatcatgcccagcagatggaagctgtcatccaccaccagcgctttctcaacgcgcttttcatgcatcctgtgcagcaccacatcgcgcgcttcgccctctttcaccgtcaccagacgatctttcggggtcatgactgcagagacaggctgtgaaagatcagtgacaaagcgcacgtcacgaccggtgatgatacccaccagttcgttgtcgcggttaaccaccggatagcccgcaaagccgttgcgctcggtcagcgctttaacgtcagccagtggggtggttggcagaacggtctgtggttcagtcaccacgccgctttcatgtttcttcaccttgcgcacttcgtccgcctggcgttcgattgacatatttttatggatgaagccaaggccgccttcctgtgccagcgcaatcgccagacccgactcggtcacggtgtccatggcagcggagagcataggaatatttaaacggatatttttggtcagctgagtgctgagatcggccgtattcggcaggacggtggagtgtgcagggacgagcagaacgtcgtcaaaagtgagtgcttctttagcgattcttaacatggcaatactccacctcgggtgattgagaatagataaaatattgccgcggcattatacaggccgtaatcgattgcctccagcattatttacgaaaaactcttgatccgcactggcagccctgtagtatcgatgaattaacctgctgatttggaatttgatcttcgtcacatgtcgctgccacccatcgccaatatttttaccgtcagccgtctcaatacgacagtgcgtcagctgctggagaaagagatgggcctggtctggatcagcgccgagatctccaacttcacgcaaccggcatccggtcactggtacttcacgctgaaagatgatggcgctcaggttcgctgtgctatgttccgcaacagtaaccgacgcgttacctttcgtccgcagcatggtcagcaggtgctggttcgcgccaacatcactctctatgagccacgcggtgactatcagctgattgccgaaagtatgcatccggcgggtgaaggcttgctgcagcagcagtttgaactgctgaaagcaaaactggccaccgaaggactgtttgatccgcagcataagcaaccgctgccggaaccggcgcgtcaggtcggggtaatcacctcttccaccggcgcggcgctgcacgatgtgttacgcgtgctgcatcgccgtgatccctccctgcccgtggtcatctacccgaccgtggttcagggcgtcgatgcgccagcggctatcgtccgcgcaattgaaatcgccaacctgcgcaacgagtgcgacgtcttaattgtcggacgcggcggcggttcgctggaagatttgtggggctttaacgatgaacgcgtggcgcgcgccatttttgccagccgcattcccatcgtcagcgcggtgggtcatgaaaccgatgtcaccattgccgacttcgttgccgatttacgtgcacccaccccttccgccgcggctgaaattgtcagccgtaaccagctggagttgctgcgtcagttgcagtcacagcaacagcggctggagatggcgatggattactacctggcacgtcagcagcggctttactcccgccttgagcatcgtctgcaacagcagcatccgcagctgcgtctggcccgtcagcagaccgccctgttccgcctgcagcagcgactgggagaagcgatggaaacccgcctgcgtcaggccacgcgtcagcaggatcgcctgtcgcatcgactcaatgcccagcagcctcagcagcggctgttcgatgcgcaaaaacagctgcaaagctggcactaccgcctgcagcagagcatgacaaaacagctgagcaccagcaaacagcactttggtcagttggtggcgcaactggaaggcgtcagcccgctggcgacgctggcgcgcggttttagcgtgaccaccgacactgccggacaggtggtgaggaaaaccgcacagctccagagcggcgacctgctccgtacccgtcttgatgatggctgggttgaaagccaggtgacgcagttactgcctgagaaaaagcgccgccgcaaaaccgtctcctgactctgctcgtcagctcacacttttacacttaacgctggccttactaatgaggtctaacccgcctgacgggtctatactttctggcacattccctgtcgccagggcgtttcagatggcttgccaacgttgttgcctcagaaaagcgccgccgcaaaaccgtctcctgactctgctcgtcagctcacacttttacacttaacgctggccttactaatgaggtctaaccagcctgacgggtctatactttctggcacattccctgtcgccagggcgtttcagatagcttgccaacgttgttgcctcagaaaagcgccgccgcaaaaccgcctcctgactctgcccatcagctcacacttttacacttaacgctggccttactaatgaggtctaaccagcctgacgggtctatactttctggcacattccctgtcgccaaggagtttcagatggcttattgcgttattcctccctatatccttcgcaaaatcatcgcgcacggttccggccaccagcaggagcaggcgcgtcgcaccctgacacacgtccagcacctgatggcggaacactggcaaaagcagccggtggcaaaaaccgcggcaggcggccacgtggatcgtgaaatttatgatgcgcaaagtcagcagaccctgccaggtaagctgattcgtcaggagggccagcccggcaatgacgacgtggcggctgaggaagcctggaactatcttggcgtaacctatgacttcttctggcaggcttatcagcgtaattcgctggataatcaggggctgaaattgctcggtaccgtgcactacggtgataaataccagaacgccttctggaacggtcagcaaatggtatttggtgatggtgacggcgaaatctttaatcgcttcaccattgcgattgacgttgtggcgcacgaaactggcgcatggcgtgacggaaaatgaagctgggttgatctactttgagcaggctggtgcgctgaatgagtcgctgtcagatgtgtttggctcgctggtgaagcagttcagtaaaaaacagcgcgccgatgaggcggactggattatcggcgaaggcctgctggcaagcggcatcaatgggcgtggtctgcgatcgatgtctgaacctggttccgcctatgatgacccgatgctgggcaaagatccgcaaccggcgcacatggatcactacgtgaaaacacgcgaagataatggcggggttcatattaattccggcatccctaaccgggctttttatctggcagcaacagcgctgggtggttatgcgtgggaacaggcgggatatgcctggtacgacacggtgtgtgacgacgaactgccacaggatgctgactttaagacctttgcccgcttcaccgttcagcatggtaaaaaacggttcaacgaatcggtcggcagtgccattgaacaggcgtggaaggaggttggcgtgctatgagtgacctgcccgaactcactgatgacgccaccatcatcgtcgcgcgtgaaggcggcatggcctttattccggggctacgcgccgaacgacgctttatgctgggcgatctgccgccgccagaaagagagcgcgtctgccatgcgctgcagcaggcgatgccgttgggcgaacctgaggagaaagccgcgcaggtgggcagtggcgatcaacgctattttcgcatccagattcagtatgccacccaccgcgaggttgggacgatagtgctgttgattccggaacaggtggcgccacctgagttgcaggcgctgtggcgcgacggtaaataagcaaaaaaaaggccgacaatgtcggccctcagactgctgataatccgatgtacatctgttagcgacaaatgagcttaaagcgaaggtaacacgttcagaagaggaaagcgtcccgcgccatggacggcgcgggccgagcagtcatggatgacgattttgcgactttccgatctgaccgtgttccctgagcatgctcggtcttacagcgaaccaggcaagacttttccgtaaaaaagggccgacaatgtcggcccttttccttaagcgttgttacttgctgtctggcagcgcgtaagcaattacataatcaccacggtccggtgactgacgtgcgccacctgccgagatcaggatgtactgctttccatctttcggtgagacgtagctcatcgggccaccctgactgcccaccggcagacgtgctttccacacctctttcccggttgaagaatcaaaggcgcgcagatagtaatcctgcgtacccgcgatgaacaccaggccgccctgcgtggccagcgtaccgcccagcgttggcatgccaaccggcattttcacgcgcatcttgataccgaatggtccggtatcctgcaccgtgccgaccggcacctgccagacgattttctgcgttttcatgtcaatcgccgacagcgtaccaaatggcggtttctgacatgggatacccagcggtgacataaagcgatttttattcacagcatatggcgtgcctttcagcggaaacggcacccataccggtgttgatcgcttcgccgccgttgctgccacgcgcaatattgctggtatcagccgggatcatctgaacccacagacccagacgcatatcattgacgaacaacaggtggttgttcggatcgaccgacatgctgccccagttcataccgcccagcgaacccgggaagctcagagacttgtcggtgtccggcacggtgaacaggccatcatagcgcatagatttgaagccaatgcggcaggccagctgatcaaacggcgtggcaccccacatgtcagactctttcagcgtctggttgccaatctgcggcatcccggtcgagtgtggctgcgttttggtgtactgctcgttcgggatatgaccctgcggcatcggcagttcttcgactttggtcagcggcttgccggtcatacggtcaagcacgaagatcatgccggttttgccgccaatcactaccgcaggtgtggttgtgccatctttttgcgggaagtcgatcaggcttggctgcatcggcaggtcaaagtcccacagatcgttatgcacggtctgataaacccacttctctttaccggtcgtggcatccagcgccagaaccgatgcgccatatttgtgatccagttcagtacggttcgcaccccagaggtcaaccgacgaactgcccattggaatgaacacggtgttcattgccgggtcataagacatcggtgcccatgagttcggcgtactgcgggtataatctttacccggcatcaatatcgcattcgggtcaacattgcctgggtcaaacgcccagcgcatctggccggtgataacgtcaaagccacgcaacacgccacccggcatatccgtctgtacgttatccgctacgcgaccgccgaccaccacagtggtgccagccagggttggcgctgaggtcagctgatattgcggatccggtgccttgcccatgcccgctttgagatcaacgatgccgtgatcgccaaagttttcacagaactcaccgttgtcagcattgatcgcaatcagacgcgcgtcgatggtgttcatcagaatacgacgctgacagctgtcaccggctggcaacactgcggcagtcacaggtgaagaccccggcttatctggctgctgcagcggtttcgtggcgtcaaagtaagccagaccacggcagcgtggccagacttccgctttggcattgatttcacgtttccagatctgcttaccgctgttggcttcaacggcgatgacgttgttgtgcggtgtgcagagataaagggtgttgccaatctgcaacggtgtctgctgatcttctgcgccgttgccggtcgggctgacaggggtatcaccggtgcggaaagtccaggccacctgcagatctttcacgttgtcgcgggtgatttgatccagcgccacaaagcggctgccctgcggagtattaccgtagttatcccagtctttctgctgtttcgctttatctaccgggatcagcggcagctcttcgcccgtgcctgcaacggtaggatgtggctggaacatctgcaccagcgtaacaaccatgcctgccgccagcagcgcagagaacgcataagagggttttgccagtgagtgcttaccttcatgcttacgcagtgaaggccagatcaggaaggcaagcagcatcagtccggcaggcaccatcaggcgtgataccagcggccagaactccaggcccgcgtcgaacagcgaccagatcagggtgccgacaaagaccagcaggaacagaaccactgccgaggatttgcgacggaagaactgaattgcggagagtacagtgacgatacccgcaattaaaaagtacccgctgccaccaagtgcaaccagtttgccgccgccaattgcaaaaaacagaccggtggcaagtagcaccagtccgagcagcacggatgctattcccagcccctttccggagcgggaggatgtttcagccataatacttactctcctgaataaacagagcgcccggacagatggccttccggacgccggcgcgttaagtcagtccgcgccgggcaccgctcggtttcaaatcgaatataaacagacccgcgtccgtgagatcgaggggccggaagaacacggatgtggcttgcccctcccacgacgcggcaggattgtaccacctggtacattacagagtgaacatctacaacccatttgttacggcgcaatagcatttttgctacaaaatgagccagtcgttgctctgaattctcagacgttttaagcgtagctgaaagcggcgtcagtgacctggcggctggaaaaggacgcgcttgcgggagataaggccatgtccgttccggcaaaaatagtccaccgcgccgcaggctttgagcacctcaagcggctgatgacacgccggacagcagggttgtgcggggtaatgcgtaccgcaggtattacagataaattcaccgtcactgagcgacagcggttgctgacatttttcgcaaataatagtcactattttctccctgctccggtttattcagagcaaaaaaaagagggccagatggccctctattcttaacgcttgttctttttcatatgcgccagcagacgcttacgtttacgctgctgcgttggtgtcagcaggttacgtttgccttcataagggttatcaccctctttgaactgaatacgaattggcgttcccatcacgttgagtgatttacggaaatagttcatcaggtagcgtttgtaagaatctggcagatccttaacctgattaccgtggattaccacgataggcgggttatagccccccgcgtgcgcgtatttgagcttaacgcgacgactgcgtaccagcggtggctggtggtcgtctgccgccatgttcatgatacgggtcagcagcgaggtgtttacacgcttcgtcgaacagtcataggcttcagtgatcgactcaaacagattgccgacgccgctgccgtgcagcgcagagataaagtgaatgcgggcgaaatcgataaagcccagacggtagtccagtgtctctttcacttcatcacgcacttcctgcgacaggccatcccatttgttgaccacaatcaccagcgaaacgaccactgttgagaatgaagccaagcagcgacagatcctgatcggaaataccggcatgggcatcaatcaccagcatcaccacgttggcatcttcaatcgcctgcagcgtcttgatcaccgagaatttctctacggtatcagagattttggcacgcttacgcacgcccgccgtgtcgatcagaacgtattcacgtccatcacgctccatcggaatatagatgctgtcgcgggtagtgcccggcatatcgtagaccaccacgcggtcttcaccgagaatacggttggtaagcgttgacttacctacgttaggacggccaacaatcgccagtttgatcggcaggcccgtcgggtcgaagttttcttcttcctcggcggcttcctgctcagcaatctcgtcagcttcaagcgcagcccagtacgcctggttctcttcttcttccgtgagctcgaccgtctcaactttgtccatccatggcagcagtgcctcttctatcaggctgctcacaccacgaccatgcgatgccgcaatggcgtggatctcgcccaggcccagtgaatagaagtccacaaccgcctgatcaggatccatcccgtcagttttgttggccaccaggaaagtcgctttctggcgggaacggagatgcttagcgatttgctgatcggcggccatcatgcccgcacgcgcatcgaccataaacagcacgacatccgcttcttcaatcgccagcagtgactgctcggccatccgcgtttcaacaccctcttcggtgccgtcgataccaccggtatcaataacaataaattcgcgcccttccacttcggcgcgaccatatttgcgatcgcgagtcagtccaggaaaatccgctaccagcgcatcacgtgtgcgggttaagcggttaaatagcgtagattttcccacattgggacgcccaaccagcgcgaccacaggtaccataacaaaatgcctcaataaataattaatcgcccgaatggcgtgattataacggctctggccgtcaagttcaggcttaaggcgcaaagaataccatgcctgactaaaaacgaaacggcccctgattaaatcaggagccgtcggaacggaggatctcacctgccagacgtgtacccgttaacgggtaatcgcataaacctcaccatctttcgactggatcagcagcttatcgctggcgaccaccggctcggtctggaagcctgagctatccagtttctgctgcgcaacaaaacgaccatccgtggtgttcagccagtgcagataaccttcactgtcgccgacaaccagatagccgttgtagagcaccggcgaagtcaggttgcgatgcagcagatcgctttgacgccagatggcgacgccgccgtcagcgttaagcgcaatcacacgatcgtcctgatcgaccagatagatgcggccggcatccacaatcagatctttcacaccgccaatttcgcgtttccacaaaatctggccggaacgcagatccagtgctgtcagattgccgttatacgccagcgcgtaaaccacgccattgacgataaccggagtggtatcgacatcgttcagacgatcgatctcagtggcaccgctgacctgggaaatacgctgctgccagaccagttgtccctggttcagcaccacggcactgacacgaccattgtcgccaccgacaatcgcgccaccaaaagcgacagccggagcagattcaccgcgcagagacaacgctggcatatccaggttgacgctccactttacggcaccgctgctctgatccaggccctgcaacatgccgttgctggtatgaaccagcaccagaccatcgctgactaccggacgtgacagggcttcaccggcgactttcgtctgccacgccaggctaccatcactgctgttgagggcataaacctggccgcgctcgctgccaacatagacccgatcgccatcagccgtcaggccacctgataacatggctgagcgatttttagagaagaagccggttttctcagagagatcgactttccatttttctttaccgtctgcggcatcgagcgctttgacgataccaaagcggtcggcagcataaaccgtattatcctgccaggcaggatgcagatttgagtagaaatcaccgacaccatcgcctaccgaggtgctccacactttctgtggcgtgaactgattttccaccttcggcaacggggccatttttactacatcttcttcgccgctaaacagcgaacaaccgctgagcaaagtgactgaaatcagtcccggcagcaggtatttacgtaattccatgcgctctctcttgactggcttagcttaagttattcatcttcatctgcatcatttgcttcaatgccggagaggcgtcagattcaacccctttactccaggcatcgcgcgcgccctgcttgtcgcctttggtcagcagcgcttcgccgcgaatatcggccacaatggctgtccagccatcacccttcacaccgtcaagggttttaagcgccgcatccgcttgattctgttgcagttgaatgcgtgccaggcgcaggttaatcaccgcctgcagattggcatctttggtatctttcagtccgttttgcagcagcgtcgcggctttatcaagctgaccggcgtcaacatactgcttcgccagatccatcgcagccagcgcaccgtaggtgttgctgttttcactggcaaaacggtttaccgcttccagcgtctccggtttgcccgcctgcatggcgctggtgagctgctgatactgcgctgatactgtcttcgccgtatcgtcctgatgactgctccagtaacgccagccgcccagcgcagcaatgccgatcactacgccaatagctaacgctttgccattgttggcaaaaaagttgcgcagcgcgtcggtctgctcgttctcattgctatacacttccacgcaatccctctcctttctatggttggtgctgtgtcacgcttactgtaacagcgagcgcaagacagcagcagcctctgcctgatccagcgtttgctgctcgccacggcgcagatctttaatcacgacctgaccggctttgacctcgtcctcgcctaacaccagtgcgacgcgagcgccccacttgtcagcacgggcaaactgtttcttgaagttgccgccgccaaagttggtcatcagcctcagtttctggcgcttcatcacgcaatttctcagccagctgcatcgcagcagactgcacgccctgacctgaagcgataacatagacatccacattgctcgtcggttcaaattcaggattaaccgcctgaaccagcagcaccagacgctccatgcccatggcaaagccaacggcaggtgttgcgcgcccaccgagctgctcaaccaggccatcatagcgaccgccaccacataccgtgccctgtgaacccaggctatcggtgacccactcaatcacggtgcgattgtaataatcaagaccgcgtaccagacgctgattgacggtgtagctgatcccggcgtcatccagcagggcacacaggccgctgaaatgttcgcgtgattcgtcatcaagatagtcgccaagctgtggcgcatcattcagtagctgctgaatatcgggatttttagtgtcgagaacgcgcatcggattggtgtacatgcggcgtttacaatcctcatccagcacctctttatgctgttcaaggaaggcgaccagcgcgtcgcggtaatgcgcgcgtgcttccagcgaaccgatagagttgagttccagacgaacgtgctcagagatacccagggctttccaccagcgggcgttcagcatgatcagttcagcatcgatgtccggtccctgcagaccaaacacttcaacgccaatctggtagaactgacgatagcggcctttctgcggacgctcatagcggaacatcgggcccatataccacaggcgctgctcctggttgtagagtaaaccgtgttcaataccggctcgcacgcaacctgcagtgccttccggacgcagcgtcaggctttcaccgttgcggtcttcgaaggtatacatctctttttcaaccacgtcggtgacttcaccgatggcgcgtttaaacagtggggtttgttccaccagcggtaagcgaatttcgctgtaaccgtagctcgccagcgtctgcttgagaacgccttcaatccgttgccagagggcggtatccgcaggcaggtagtcgttcatcccgcgaatcgcctgaatattcttcgccacgttagaatctcttaatgcaaaaaaacctgtccggcatcataccttatgaggatgaaaccgcacaggttcagtcaaaaaagtcacgcacgcaaaccgcgtacgccattatttttccagatgctgcacatcaatacggcgactggcatccagcatcgacgctttagcacgaatgcgcgcttccagctgatcgatcatgtcattgttgtcgagacgatcgcgctgacgcacaccatcctcatagaaaccactcttcttgctgccgccggtcacgcccagcgtagagagggtcgcctcgccgggtccgttgaccacgcagccgataatggagacatccatcggagtgatgaggtcttccagacgctgctccagcgcgttgaccgtgccgataacgtcgaactcctgacgtgagcaggtcggacaggcgatgaagttgatgccacgagaaacggatgcgcagtgacttgaggatatcgaaaccgactttgacttcttctaccggatcggcggccagcgagatacgcagcgtatcgccgatcccttctgacagcagcagacccagtccaatcgccgatttcactgcgccagcccgcgcgccgcccgcttcggtgataccgagatgcagtggctgttcaatctgtttcgccagcagacgataagattcaaccgcgaggaaaacgtcagaggctttaacgctgactttgaattgatcgaagttaagacggtcgagatgatcgacatggcgcatggcagattccagcaacgcctgcggcgtcggctcgccatacttttcctgcagatctttttccagcgaaccggcgttcacgccgattcgaatcggaatattgttgtcgcgcgcgcagtcgaccaccatacggatgcgctcattgttcccgatattaccgggattgatgcgcaggcagtcgacgccatactcggcgactttcagggcgatgcggtagtcaaaatgaatatctgcaaccagcgggacgtttacctgctgtttgatcagtctgaatgcttctgcggcatccatggtaggcaccgagatacgaacgatgtcgacaccgactcgctcaagggctttgatctgatttaccgtcgcctccacgtcagtggtgcgggtgttggtcatcgactggacagcgatgggtgcgccgtcaccgaccggcaccttgccgacgtaaatgcgtttggatttacgacggataatgggtgcttcgttatgcatatttcttctccacaattgcccggtacgcgatacgctgttattgcgcacccaacgtcaggcgagcaacctggttattacggataaaacgacttaaatcaacgggctgattctgatattgcacctgaacagcggaaggcgcgccaattttcagacgatacggaggcgttcctgcgaggctgagtttaccaccactgcgctgaatgccgctgaacagttttttgccggtggcatcgctcacttccagccagcagtcggcgttaaaggtcatcaccaccgcattagggtcagcagccggttcactgaccgccgctgcacctactggcatctgaggtgccgtgctggtattggtattcgtgttcgcggccgcaggtgcagccgctgagttgtccacgggcgcctggctcggtgaaaccacggcattgctggtggtatccggctgtgcggtggtcgcgctattgctgccagtggcggccggagccgcactcgctggcgcactggctgcgctgttgtcactggcggtattgctttcgtcaggcgcggcaggtgccgcgctgtcaccactggattcacccagcggaatcgactgaccgctatcaccgctgctgctgttctgatcggtcatcggcaccagatcatcctgtgactctttatgattctgccaccaccaggcaccggtcagacccaccaccacaaacaccaccagccaggtgaaaatcatcaaccagccgtcgcgtttcttgcggcgtttgcccagcgagaaactttgcatcggctcgatctttgaagcccgaatcggtgtctgtttcgccatcatcggcagcagttcctcttcaggaatgtgcaccagacgcgcgtaggagcgaatgtatccgcgcaggaacgtggaggccagatcggcaggcgatttgtcttcctcgatatcacgcacggtagaaagtttcaggcacaggcgttcagcgacgtttctgctgcgtcagccccatctgctcacgggccagacgcaggcgttcacctgttgaatgtaatgcagagttttcttgagtggcttcagtattcattagctaaataacgctggtactgtatcgattgcggaaaacgtcgcgctaactggtcgccataacgtgaaacgtcagcggcatctccctgtagcgcggcgaaacgtaagtgtaacgccagacttcgtgccgttgcgggcagctgttgctggtaaatatcaagcaaaacctgcaccttcgccagatggttatctgccatctgcttttcagcttccgacagcagcgaatcagctttgcgtctgtcagcctcaatggcctggcgtagtgtcctgcgggcagcggcaatatcgccagcctgcagataacaaaatcctgccagttcaagcgcgtcattgcgtgcatcaaactgcggtgctgcgcttgcccgactaaactgttgatgcgcttcgccatactgccttaaagcgcagagaaacgcaccgtaattgttagcaacaaaaccattatccggggcctgctgctgtgccagtataaaccgtgcctgcgccgctgtctgattaccctgcttctgcgccagtcgagccagcgcaagcgagacccggtaatcctctggcgcggcggcctgtgcccgcagaaagtttcgctcagctgcggcatagtcgccacccgccagatagtgcatccctaactgcagacgcacctcttctgctccgggttcgtgatgctggctgacacacccgcttacaacaaacagcgccagtaaaactgcaggtaatccgttacgcataatcgtttccatccgcttgacgttgacaggctgcagcctgccacgcgtcatcacttcaggaaacgctctgagtcactcttctagagagccttcacagagatggcttcacccgccatttttttacgcatcgtacgcttggtacggtcgatcacctcaccggctaactgaccacaggcggcatcgatatcgtcgccacgggttttacgcacgatggtcgtaaaaccatagtccatcaggactttggagaaacgatcgatgcggctgttggagctacggccataaggcgcgcccgggaaggggttccaggggatcaggttgattttacacggtgtttctttcagtaatgcggcgagttcatgcgcatcatctgtgctgtcattgacgtgatccagcaacacgtactcgatggtcacacgtccctgattggcgttagatttgccaatgtagcgtttcaccgccgccaggaaggtttcgatattgtactttttgttgatcgggacaatatcatcacgcaacttatcgttaggcgcgtgcagggaaatcgccagcgcgacgtcgatcatatcgcccagtttatccagcgcaggcaccacacccgaggtagagagggtcacgcgacgcttcgacagaccaaaaccgaagtcatccagcatgatctccatcgccgggaccacgttattgaggttgagcagcggctcgcccatgcccatcatcaccacgttggtgataggacgctggccggtgattttggctgcgccgacaattttcgccgcgcgccacacctgaccaataatttctgacacccgcaggttacggttaaagccctgctgtgcggtcgaacagaatttacactccagcgcacaacccacctgtgaagagacacagagcgtggcgcggtccccttccgggatatagaccgtttccaccagctggtcgcccacgcgaatggcccatttgatggtgccgtcggtagagcgcatctcttctgccacttctggcgcacggatctccgtcagctccatcagccggttacgcagctttttgttgatgtcggtcatctgctcgaagtcatcgcagcagtagtgataaatccacttcatgacctgatcggcgcggaaaggcttttcgcccagcgacaggaagaattcgcgcatctgctgacggttgagatccagcaggtttattttctggcttttgggggagacgacaataggggatgcggacgcggacgtcacaatctgttcggacataatattctctggcctcgttgttacacgttatggcgctgttcagggataggtgaaaaaaattgcgccttcattaagctgagtcaatgaaggcgcaatattgtacaacatctgcagcctgataacaggcgggagtgacctcccctacgcagatttttgtaaagcctacgtaacgtttatcgccaggcgattaacgggtacgtgggcagatttcgttttcgccaaagaaataagcgatttcgcgggcagcggattcagcagaatctgaaccgtgcgtggcgttttcggtgaagctgtcagcgtagtcagcacgcagtgtgccagccagtgcgtttgccgggttagtggcacccatcaggtcacggtgacgctgaacggcattttcaccttccagcacggaaacaacaaccgggccagaggtcatgaattcaaccagaccatcgaagaatggcttgccctggtgctcagcgtaaaaaccttcagcctgctctttgctcagctgcagcatttttgcgccaacgattttgaagccagcgctttcaaaacggttgtagatagcaccaatcacatttttagcgacggcgtttggcttgatgatagaaaaagtacgttcgattgccatgatgacctctgtcttaacgttctgaagaaaccggtggcgtccgccccggttaagaaacggcgccgattataggggctgagtccggcattgcctatcagagatccctaatttgatgaaaaatcttgatctgagtcgaagcagacgcgccatagttatgatttagcgcaaaaaagcgtcagccccggctgaaggtgaccgagacaagttgcccctcttcatccatcaccaccagctgatactcgcccggatgatcgagctgcagcgacaggctgtctgcggcgtttctgcgtcatcagaggctcaccattcaggaaccaccagcgctgtgtgccctgccctccctgcaccgcgaccggcattgtcagcgcgctcctgcccggcagcggtctgacaatttgcccctcaatcacgccggtaacgatcagcggtgcgctgctgccctgctgtaacggcggacaccgggcatcgacagggggcagacgttgcgcccgccgctcctgaggcggcagccaggcctccagcggcagcggccagaccagccgttcatggcgggtggcgtcggggcagtctgctgcgacgcgcagtccctgcgcattctgccagtagcccaggcgtaatccgctgaggctctcctgaccgggagccagcaatgtaggcggcagcgtgtcggcggcaacccagctttgccgccgctggcgacagttttcgtctccggcgggcaacggctgaccgccaggccagcaaatggtcgccaccgtcaccgaggccggccgcggatcgcccggaacgtcacgtctgccgaggcgactcatcagcaggctgttgatctgattcatgacgggcacggcagaggcaaaaccaaactgcccggcaaccggcgtcgcatccggtcttccgacccagacgccaatcagataacggggattgatccccaccgaccaggcgtcgcggtagccataactggtgccggttttccaggccagtggcaccacatcgggtacgctgccattgcccgcgggctgcgcttccccggccaggatacgccggatgatccacgccgactcaggcgaaagcagcggccgctgctgtaagggttgatcgggcatccagcgcagctggccggcgttgccgtggcgggcaaaggcgctgtaggcagccacgatctcatccatgcgcgctccggtgccgccgagaatcagggaaagattaggttcagcgccggggggaaaacgcaagttcagaccgacattgcgcaggcgcgctgcaacgtttttcggccccagcgcctccagaagctgcaccgcaggcagattcagcgaccgcaccagtgcgtcactggcgctgaccggcccgtgaaatccggtatcgaagttgcctggccggtaatcaccaaagcgacgcggcacatcctgcagcagtgattcagcatgaatcagcccctcatccagcgccatgccgtaaataaagggttttaacaccgagcctggtgaacgcacgctggcgatcatatccacatggccaaaacggctgtcatcggtaaagtcagccgagccgacatagccgcgaaccgccatggtggtgtgatccaccaccagcatcgccagcgaggtgcgtggaggaagctgatttttaacattcagcgccaggctttccagttcgcgctgcagtgaggggtcaagcgtagagacaatcttatcgctgtggctgatcgacagcagtcgccgggccagcagcggcgccatctgtggcatctggcgcggcggcagccacaccggctcctgacggatttccgccacctgttcagcggaccagatgcggtattccgccagccgatccagcactttgttgcgtgcggcttctgcccgctccggccagcgatcgggccgcagacggctgggtgcctgcggcaaaacggccagcagcgccgcctcgcccggcgtcagctgtgacggggcttttcccagccagctccagctggccgcgcccaccccttccagcgtgccgccaaagggcgcacggttaaggtagagcgtcaggatgtcacgtttggaaagatgccactccagctgcagcgcccgccacgcctgaatcagcttgccgcgcagcgttcggggttgcgggtcgataaggcgtgccacctgcatggtcagcgtgctgcctccggaaatcacgctctgatggcgcagatcctgccaggcggcgcgcagcagagccaggggattgatgccgggatgataccagaaccagcgatcttcataggtcagcagcgcctgcagataggccggagccacctcctctggcgtgaccggatagcgccagatccccttgctgtcagcaaagcgccacaatggtgtaccgtcgctggcaacaaccacccgcgcaggctgcacctgtttaagcggcaacgggaaaagccgatccagcccccatatcgccagccacagcgccagaaaaaaaagcggcagcgcgagccaccactttttgatgctgctgacgtttaccacgcgtcgcgtcacttactgaatatgcagctgtgacggcgtgctgccggtggcgcgccactccggcacatacatcgactcgacctgcggtggtggcatcagatagcgacccggtgtgaccgcccgcgccaggtagaccagcgtcgcgggacgataagtatccaccgccagtgccgccacaaagcgatcgtcacggaactcaatgtgtctgatgtcagcctgctgcatgtcacccatgctctccttcagcgcatccgcactgtcgccgaggctggcgctgctgtcagccaggttctggttttccagctccagaccggcaggcagcagatccaccaccagcgcatcggtgatgctgcgcttcgacgaaacggtcagacgtaccaccagcaactcgccgctgcgcagattactgagatcggcggctttgccatccagcgtaaagtattcacgctttatcccgagcacattgctctccggctgtggcgcggccagcggataaccggtgacatccagacgaccatacagcggcgcactgcccggattactgatggctaagccctgcaacagtcgttcagcccccagccctttattcagtggcgcatcaccctgcagaggctgtgcattgcccgacagttgcgcctgccagcttccgccctgcgcacgctgcagcgtatgcgccgctaaatagagcgcgttattctcctgagtcgagaaccagcgcttgccgttgacctcttttgacaacgacagcagcagactattctgcaaatcaggctgcagcttattctctgctaacagggctatcatcatcccctcatcgcgcaccgtgctgccatagtcgccataccactctttatctgagcgcgtcagactggcaccctgcatgatcgcaagcgatgcgcgctgcccgtcacccatcagcttcagcgccacgccaagctgcatcagcgccaggccggagcgggccttctcacgcttttcatacaaggcgcgcagcgcacccagcggcgcacgctgctgacgcgccagcaccagtccggcgtaagcctgcacgctgaactgcagcgcggcgttgttatcactgccgccgccgctgatctgcgcgggatcctgcagatagcgcagcagccgtgcgttagcgcggtcaactacattatccggcagcgcatagcccgcctcgctggcgcgaagcaggaaatcggtcacgtaaggcgtcagccagaactcctcctcactctgcttgtcccacagcccgaagctgccgttggcccgctgcatgcccgccagacgggcaatgccggtgtcgacggcggcccggcgcgcctcgtcactgctggtttttatccccatcgcggtcagctcggcatggctggtgtagagcgacggccagaggccgctggtggtctgttccagacagccgtagggataggcgtaaagcgcactgatataactggcgatattgagcggcggacgattgctcagcgtcagctgtccactcagggtctgagcatccagcccggtaaacgcggttgccgcgacctgccagggctgatcggaattgatgacggcatcgaaattcagtgtccgggccggataaggtggtctgacgccgattttccactgctgtttgctgggcttcacctgctcgcccggcaggttcagaccggaaatctgcacggcgacctcaccatcaccaaagtcggttttcgccgtgaccggaatctgaagtgtggtacgtgcgcctttggccagcgtcacactctggctggcagccccggccagatccactaagccactgctgctcagatccaccttcagagtttgcggcagatcggtcaggttagtgagatccagcgccagtgaggctgtatcgccgctggcaaggaagcgcggggtggccagttcgctgatcagcggcgccgcgaccaccagtttacgttcggccgcgccgaagctgtcgtcgctccatgcctgggtcatcagccgcagttcaccgttaaaggccgggatcggcagcgtaatcgatccgttgccctctttatccagcgtcaccgcctgtaactgctgcgccacgatattgacatgcgtcaccggctttttgccgccgcgcgtcatcgattcatcttcgccatcaccaccaaaacgcagcgccgcgagccggccaccgccttcgatcagctggccaaagacgtcgtactgatcgacgttgtagcgtttacggccaaagaaagcctgccacggatcgggcgttttaaaatccgtcacgctcagaacgccgctgtccaccgctgacagcagtacattcactttttcaggcagcgggccgccatcacgactggcgtggacttttaccgtcaggcgttgctcaggacggattttatcgggcgcatccagcgtcagatttaagcggcgcgcctccgtcgccatcggcagatgcaacagccccaccgcgcgttttggcgttgcgccactgaccttatcgccgtcacgcaccacgatggcgctgaagtagagatcgtgacgctgccagctctcagcaacagggacatccaccgttgtgccgccctttggtacggtcagtggctgccaccagagcgtgccgctgctcgactccaccatcaggtaacctttaccggccgccggtgactcaacctgcagatgcacggtatcgcccggctggtaagccgctttatccagcttcagtctgacctgatccgggcgcaatgcacccgtgccgttggtgttatcctgccagtcataacccgcctggaaccggacgctgctgacgatcttctcgcccgcctgcacttccagccggtagtggccccactcgaccgggaagctgactttggtgctgccatcagccgggacagagatggcgcgttcatcttcctgcagatccttgtcgctatactgcgactgccagccttcgctgtcagagaagctccagtagtaatcatggcgttcacggatcaggcgaacatccagcttctctgccgccagttttttgccctgactgttggcatagacaatgtcgaattcggccaggctctgttccggcacggtcggctcatcgtgatagctgtcactgcggtagtcataaaccgccttgttaccaaacagcggccggatacctggcagcgcttcagcgggccagatggcctgggtggcacgacgggtgaccggacgtccgccggtctccagcaggctggcctgcaggatcagattgagcggagagtggagctgatcccactgattttctaccgtgagttgtgctttaccgctggcgtcgagcttgagatccacctcatccagcgtgcgctttaacccctcttcggtgatgtcaccaaactggtagcctggcagtgcagtcaccgcctcgcgtgccggtcgcagatagagttgaccctgtagcgtgttacctgctgctggggcgccatagagatagcgcccctcaataccgaactcaacactggcatcagcggcctgtggctgagggtcatttttcagggttaacgccatacgctccggcagaaaatcttcgacgtgaaacttccactctcgcttgaggttatcgccggtattcagtcgcaacatccagtcgccggtcatggccgacgcgggcagcgccagtcgctgctggtagaatcccgcttcaggctgccagacaaaagtccgcatcacctggccatcgggctgcaccagctccgctttgatcggctgcgcgggcaaggggtgtccgtcggcatcgcgaagcagcgcattcacgatgaccgtttcgccaggacgatagatatcgcgcggaccaaaaacaaacagctgtttgtcatagccctgcggccccgcgaccgggaattcagcgagatccagcgccggacgcgccaggtcgatcattgaggtctgttctccctgaattgccagcaggagcttgcctttttcatccgccttgaggctcagatgaccggtgctgtcactggtaccgctttgcagcacctgccccttctcatccagcaacctgacgctgaccccggaaagcggctgaccgtctgccagactctgggcgaacagttcgaaccgggtcgggaagcgatgcagtgacaggccaatatcgctgagggtgaaaagcgtggcgggctggctgtagcgataagtaccggcctgcttcatcaccgccagatagacgcccggctgctgaagtgcggtaatgtcacgcatcggcagctgcaatttttcacgcgtgttacgcgccgggttgagctcaaagcgtccgctataaaccagctggctgcttttcagcagttcctgcgactgccagcttgagaggttgttgccgtaattccactgcgagagaaattccgccaggccggcattctttatccggaagaaatcgacatcgacctggtcaacattcagcgccagcaccggcagtccctgggtgatacgcagcggcagcagtgaaccgcgactggcaaagcccaccatcggctggatatcacgggtggcgattttctgactgtaatcggcggcaagcgtctctccgctggccgcgcgcagtcccgcatccaccgtgacggtgaagtgacgcgacggctcgggatggcggaagcgcaacgttttgcggttagcagaaagctcccagccgccatccacccggccctgtttatcgtcggtcagcctgactttttgcgcgatatcctgtttatcatcaagcggctgactgaaggttaagaccagcgcagcggcattatcgatctgcagttccgagagatcgataatcgtcagcggtttgctgacctgggaggttgcgggtgcttctgccgcctggagaggcaaaacaggtaacaggttcgctgacagcagcgagccaccgatcagcatgctgagcagcagccgggtattgcgtttcttcatggtagttccttcaccgggacgcagggagtgtcgtttgattacgcagcgcaatttcatatcaatgctcgcatttaatcaacgcttctcttgagatggtgcgcacattccctgacactggtatgacagattgctgagatgaggttgttatgacgacgccactgtttgtgtccgccgactggttacaagagcactacaacgatgagcggcttcaggtgctggatgcacggttgttgccacccggtatggaagcggttcgcgatatccaggccgaatatctggcgggtcatttacccgacgccccttactacgatattgaagcgctttccgatcacaccagcccttacccccatatgctgccgcgcgccgaaagttttgccgtcgcgatgcgtgaactgggtgtcagcagtgataagcacctggtggtgtatgacgagggtaatctcttttctgcgccacgcgcctggtggatgctgaaaacctttggtgtggctcaggtgtcgattctggccgggggcttgcagggctggaaagaagctggttttgcgctggcaaccggcgaagtgaatctgccggaaggtgagtttgaggcccacgcagatgaaagccgggtgaagcgcctgacggacgtactgctgatcagccatgaaggcggcgcacagattattgatgcgcgtcctgccaatcgctttaacgccgaagtggatgaaccacgtcccggattgcatcgtggccatattcccaacagcctgaacgtgccgtggaacagcctggttgaacagggaaaactcaagccggaggcggaacttcagacgctgtttgccgatgcgggcgtcgatattacccaaccggtggtcgccagctgtggctcaggcgtgacggcggtggtggtgattctggcgctgacggcgctgggcgcacgggatgtcacgctgtatgacggatcctggggcgaatggggcagtcgcgacgacttacctatcgcgaaataaaaaacaggcggcccatgagccgcctgtttactttgttgtctcagataatccgctcactgcccttgaagtcccgcaggaaactgccccagcgacgctcatagaatggcgtgatgtgggcggtaaagaagtggctgatgccgcgatcgttcagcgtcacctcacagatatcaaccggcgcatcgtccggcagcgtatcggttgcaacgctgcccgccgcctgaatgatcgtctcaatattgctgtccgcttcaatgccaatcagcagattgggcgcttcgtcagcccgctcacggatactggcgataaacgcgcgacgcacctgcttatgcttgctgaagagctgagtcagtgagtcgatcatctgcgcagggggttcagccacctcagacagcaatagtgactgtccgccttccagcacggtttgctggcttagtgcactgccctcttcagccagcagatgggtgatctcggccgcagtaaactctttaccggaaggcagtttgggattgagaaacagcgtctcgccgcgcgtaatctcaaacagcgtccgtaccggcagacgtagccaggactgctcaccgctcaccgcttcactcatcgcctcttctgacgtgaaaaaaggaatgatgctgctgccatcctctttttcccagtgctgcagatcaacgggcgtgctggcatcaagctgttgcgtggtgctttcacctggcacccacgcatcagattccagcagcagctgaaaaaattcgggccgatgggcaggctcagtggccgccagcttcagcacctcttcaagacgattcatagtttccctctgaacagcggcggcatcagccaccgctgagatcggcttatttcagtaacagattggcgagggtaagcacgccaagacctgttgcacccgccgcccactggtcaactgcgcctttgcgataggtcgcggagcagtcgatgtgcagccagccctgctgatagttactgacgaagtgtgacaggaacgctgccgcgctactggcacccgccgcatgtgacgggctggcgatattattgagatcggcgaagttagacggcagatggctgcgatggaattcggccagcggcagacgccagaaaggttcgttctcactcaccgcgctgcccatcagcgactgtgccatcacatcatcaaaggtaaacagcgcatggtaatcgttgcccagcgccgtcttagccgcaccggtcagcgtcgcagcatcgatgatcatcgtcgggtttctgctcgctggcgtcgattaaaccgtcggccaggaccagacgcccttccgcatcggtgttcatcacttccaccgatttaccgttgcgatagcgaatgatgtcgcccagtttaaaggcgttgctgctgaccatgttatcggcacagcagaggtagagtttgacgcgcttgttaagaccgcgcgaaatcgccatggccagcgcgccggtgacggtcgccgcgccgcccatgtcagatttcattgagtccatgaagctgctctgcttcaggctgtagccaccggtatcaaaggtaatgcctttaccgaccagacaggcgtagaccggggcattgtcgtcgccggtcgggttgtaatcgagcgccagaaataccggcggacgatttgaaccgcgtccaacggtgtgcaggcccatatacccctgtacccgcagatcgtcgcctttggtgatgcgatagctgacggcgctgccgcccacttcactgatcagatcgactgcattgtgcgccagctgttccggccccagatcttccgcgggcaggttaataacgttgcgaacccagtcgataattttcagacggcgatcaaactccgcctgctcatgttcgcccagcgccggccactcaacctgacgctggcctttcggaccacggaagccctgccagaatgcccagcactgctcaaggtgccagccttcgccggtcagcgccacatggcggatcccctggctgtcgattttgtgagccgcacgctgaatgatattcagcgcatccgcgccggtcagatgcagtgtcatgccgctgtcgttgctgctgagaatcgctttttcgccccagcgcgcatcggcgggctggctgctaagcgtaatattcatgggttgtgtggtcatcgaaaagctccataatcgttatctgtttcatccagcctgattgttataacggctttaataagatgttaaatataattcgcagagagacctgataacagattccgtcaggtgttgccagcgaagtgcaaatataggcgcaatttccggactatgaccggatatcaggatttcattaaggcccgcagacgggtcactgatttctgcaccagggcaatggcgtagtcgatctcttcctcggtagtgaagcgtcccagcgagaagcgcagcgaactgtgcgccagctcttcactcaggcccagcgcccgcaatacataggaaggctccaggctggcggaggtgcaggccgagccggaagagagcgccagatctttcagcgccatgatcagtgattcaccctcaacgtcagcaaaactgaggttaagaatgttcggtgcgctctgctgcagatcgccattgagggtgacgtcgggcagtgtgctgatgccctgccacaggcgatcgcgcagagtctgcagtcgcgccatctcggtttcgcgctcttctgctgcgatacgatacgcctcgcccatgccgacaatctgatgcaccggcaatgtcccggatcgcataccgcgttcatgtccgccgccgtggatctgcgcagcaatctgcacacgcggtttacgccggacatagagtgcgccgatgcctttcgggccatagagtttatgggcagaaaaggacatcaaatcaaccggtaactggctgagatcgacaggcagcttgccgacgctctgggtcgcatccacatgaaacagaatctcacgtttcgcggcagagttcgccaaaggcggcgatatcctgaatcactccggtttcattattaacgtgcatcagggtgactaaaatcgtgtcgtcgcgcagcgccgcacgcagctggtcaggcgagataatgccgttagccgccggggtgagataagtgacagcaaagccttcacgctcaagctgctggcagctatcaagcaccgctttatgttctgtctggctggtgatgatatgtttgccgcgcgcctgatgggcgtgagctgcacctttaatcgcgaggttatcggattcagtggcgccagaggtaaagatgatttcacgcggatcggcattgaccagttcggcgatctgattacgcgcaacatcaaccgcttcttcagactgccagccaaaacggtgcgatcgcgaggccggattaccgaacgtgccatccagcgtcagaaactgcatcattttgctggccacacgcggatcggccggcgtggtggcggcgtaatccaggtaaatcggtaatttcattgcgctacagctccgtataaaaaatcatacgtctttatagcagattcggccctgaccgcgttagcagtaagggccgcaacagcggggattacgaggcgcgttggttgacgttaatttcctgcgtgcgcgggctctggaagcgacgattatcaatcgcattctgacgatcggctacatccaggatctcctgattattcaccagctcagccagtgtaatattgttcaggaagtcactgatacgcacgctcagatcgcgccacagcacgtgagtcaggcaacgctcgccgccctggcagccttctttaccttgacatttggtggcatcaacagactcatcaacggcggtgatcacttcaccgacagagatggtattagacgctttgcccaacagataaccgccgcccggaccacgtacgctggacaccagctcatttttacgcaatcgggagaataactgctccagataggagagcgaaatgccctgacgctctgaaatatcagccagcgggaccgggccttcatgggagtgaagggcaacgtccagcattgcagtaacggcataacgtcctttggatgtcagtctcatagcgtacgacctcaatagcgtccggttatcggaggattagcaacagatgctctgaagtctgccattcccgagtaaattggtcaactatttaacctggtaaattagtcaggtatttaacctggtaattcactcaactattatctgcttcttttttatcgttttttcgcttttcaaacgacgaaagcatgccgcgcaggatgttcagttcatcgcgttccgggcgggcacgggtgtaaagacgacgcagtttgctcatcacctggccaggattggcttcacggataaagccgctgttcagcatcatctgttccatatgctgatagaagcgctccaggtcatccaccagcggataaggtgactcttcatactgcggcggcgggctgccatgctcctgcgcctgtaaccatgccatgcgcacttcataggcaataatctgtacggccatcgccaggttcagcgagctgtattccgggtttgcctgaatcgcgacgtgatagtggcacttctgcaactcgtcattggtcaggccgacacgttcacgaccaaataccagcgcaaccggtgcctgctggccctcttccacgcttttcacgccacattcgcgcgcatccagcatcggccagggcagcgagcgggaaacgtgcgctggtgccgaccaccagactgcatccggcaatggcctcatccagcgagtcgacaattttggcgtcgccgataacgtcgctggcaccggccgcgagtgagatagcctgtgagtcaggcttgaccagcggattaaccagatagaggttggttaagcccatcgttttcatggcgcgcgcaacggagcccatgttaccggtgtgagaagtctcgaccagcacgatacgaatattttgcaacatgattagggatactcagaaacgggtcagtaaaatcagtagagagaatattaacataaagcaggacatttaccgaacacgctgctatactccgcgccgttttccccgttctttaacatccagcgagagataccgatgcatccaatgctcaacattgccgtgcgcgcagcgcgcaaggccggaaatttaattgccaaatattatgaaaccccggacgccgtcgaagccagccagaaaggcagcaacgacttcgtaacgaatgttgaccgcgaagcagaacgcctgattatcgaaattattcgtaaatcttacccgaaacataccatcatcaccgaagaaagcggtgaactggcgggcgaagatcaggatgttcaatgggttatcgatccgctggatggcacatcaaacttcatcaaacgtttaccccactttgctgtttctatcgctgtgcgcattaaaggccgcaccgaagtcgctgtcgtttacgatccaatgcgcaatgaactcttcacctcttcacgcggtcagggcgctcagctgaatggctatcgtctgcgtggcagcacggcccgcgatctggatggcaccgttctggcgaccggcttcccgttcaaaatgaagcagcacgcgccggcttacatgaatatcatgaccaaactctttacccagtgtgctgacttccgccgcaccggttctgctgcgctggatctggcctatgtggctgccggtcgcgtagatggctattttgagattggcctgaagccgtgggattttgcggcgggtgaactgctggtccgtgaagcgggcggtctggtgaccgacttcaccggcaaccacggctatctgctgtcagggaaaacctggtcgcgggtaacccacgtgtggtgaaatcgatgctgtcgaacatgcgtgatgagctgagcgaagcgttaaaacgctaagtctcagtacagaaaaaggcggcttctcagccgccttttttattgcctgttactcagtgatgcttaacgacgttcgtgtgacagcacctgacgaggctgagtacgacgacctaccatacccatcacgcctgccagcaccgcttcgatgatcagcagaatcagggcataccagctcgctttcgcagtcgcggcagcggctttttcaccggcttcacgcgctttctgttcagcctgctgtttcagttcctgatacttctgaaccgcctgctgatagctctgttcagttttggccacgatctgatccacttcctgatcgcttttgccggtgcgcgctttgataatatttttcagcgcatcacgatcggctgcctgcagggtatctgaatgacgatccatcaccccttttaaccagttagccagatcagtatccgctgtctgtggatggtttgcggtgttgttagcctggttttcagcattctgcgcttctttatttgcatcctgctttaagttctctggctgtaattccggtttcccggtctggcgtaaagtcgtttccagttcgttctgcaggttatctaaattaatattactctcctgcagtttgtcttttgccatttgggtaacggatggcgcagcggcggaaataccactacccagcgcctggaagcctgagcccacaatattcatcgcgccgcctaatacactggtcgccagcgcaatagccaggtaaatagtgaaaattgtgctaaggccaaacatcagtaaaccgtgcagtgcgccttcgcgctgagccagtcggcctgcaacataactacctgcagccatcgcgaccagcatttcaatggcagtccagaccagcgcgcctgtgcccaggccgtcgagtggattctgttctttcatcggatcaatggttgttgcaccaatggcggttcccagcagcgtcagaataatgtgaacgatcaacgcacaaatgacaccggcaaagacggcgctccaggaaatacgttttaacggcaatccagcaggcccggtcgccagcgtttcggtgtagccattattaatacgggtatcagccatgaaatatactcctcgcaataaacagaaagcggtcttgatcttttatcatcccgacggcggaatgccgttttggtattatcagcgtagacagggaatagtcatttcaccactaaaccagccagagaaaaaaataaagagatgaattcagagataattaacgaagagaagagcgcagcggcaattttatttccgctgcgcttttattcagaaaggtcgaattccgccacccagcgtcatctgcgctgactgccatagcgcgatacccgctacgattaaaatcaggctgccggttaaggccagcgcggggatcagcagtcgcgtcatgcctgcggtaacgccaggctgtgccagccgttgcgccaccgtgcgcgcctgctgaaccagcaggccaatcgccgaaatggtcagtgccgtgcccagcgccatcactgcagcagagatcaccccccagccatagacaccaatcactttggcaaacagcagcatcataatcgcgccggaacagggacgtaatcccatcgacaccaccaccagcagctgggttttcacgctgagattgccgctcatctgctgcggtgtcggaagatgcgcgtgtccacatccgcactgatcgtcatgctgatggtgaggtttgaaggtgcgaaataccggggccggacgcggacgcaatgtccgccacagcgaacgcagcgcccgataaccgatcatcacgcccagcccgatcaccaacagataactgcccttctccagccagaaactgctgagatgcagctgtcgcgatgacgttttcagcagcaccagcatcaccgtcaccagggcaatcgccaccgaaaccctgcagcagtgaggcgagcagcgtcagcctgatactggttttcactctggtgggatgggtcgccagaaaggtcgcgatcaccactttgccatggcccggccccagcgcgtgcagtacgccatacagcaggctgaatatcaccagagaaatgcctgtttggtggggctgctccgcaacctgctgtagcagctgagtcatctgctgatgcagatctttttgccacagtacgctctgcatcagaatctgcggccagtagagccagaccagcaatgcgctgctcagcagcacgcccgccatcagccacagcggccagaggcgggaagcccgtaacggtgtggagattactgacatgtcagtatcaccgtctgggcaaactgccggcctaaatccatctcctctgcaggcgcgtcggctttatccagcgacagcgcatactgcttcagtgaatcattgggctttggcgtgttcagcgcgaacttgcagcgcgcctgcagcgccgtcggcagcgttaacgcaccgggattgtcatagaacatatcgacgaaataggtgggatcaaaagtcaggatctcaaagcgctgcccggtcagcttcgggggttccgccagcggcagaataaattccagcaccgctttatggccgttacgtgacaggttgtattcggttggcagattcaaaaactttacccgctgttggttgtgccagatttcagaaaagtagtgctggcccagcacgttcgccatcacgcctgccgccagcttcttccacaccacgctgcctggtttcgcctcgcgcgcgtcgtaaagcagatcggcggaggtaatctcatccatggtccaggtcatctttaatccggtaaaggtgtcatcctgcgccaccagttcggttttcatatcgatgaagctgtgaggatgtgccattacagccggacttaataccatcaagagggtaaagagtgtgcgtttcataatgttataaagtaacgttcccgatgaaaagaatctataagtaacaaaattttgtgacccgccttaaacctccggcaaataaaccgcgtaaaccgcgcaggcgctgacggggttgactattcttagctcaaaatagcctgctggaaacctgattgatgagtttctgctacccctttggcaccactcttcacccgctcacagcgtcagtgccatcttttattgctgctgtttctgccgacacccgtgcttacgcttgaaaaagtctgccagctgaatggcgtcgatcctgctgttgcccgacaggatatcgcggatgtgggccttgagatacagcgatatcaccagctggaattgcatcagatggtggatggcagctttcgtcttcatggcacagagttggatcggcgcctctgtctgctgcacaacctgcgacgcagtttgcgtttatcgcaggatttcgtctgcgatcattttgcagcccccctgcgtcagcgcctgaaggtgatgaagattgagaaggcgctgtgggatgagaccaatttacaggcgctgatccagcactgtagcctgcgtctgaagcgcgatttcagcgaacgcgaccggctttttctgcagattttcatgaagtatggattgtgccagcgccagccggtgctgttcagtgaagcgcagtgtcactggctgcagcagaaggctgagcggcaggccgccgaggatgtgattcaccactggcgtaaacgctgccaccttgcaccgcccgtcagtgaaaccgacttctggacactgctgttcagccagatccatacgcctgtcgtggatgcgatcgcgcatcctgctgagcagcggttaatggctgcggcccagcagttgattaatgactttgaacggtgtgccgacatcacatttgctgatcgcgacgagctgcttaaccagctctatcctcatctggcgcaggcgctggatcgcacccacttcactatcggcatcgacaacagcgtggcgctggatgtcagccgcctctatccccgcctgttgcgcaccactcagcaggcgctgcaggcgtttgagcagcaatatgggattgcgttcagcccggaagaggtgagcttaatcaccgttatttttggtgcctggctgatgcaggagaatgcgttgcaggagaagcaggtgctgattctgacgggtgacgataccgatctggagcaggatgtggagcagcagatccgggagatcacgctgctgccgatcaatattacctatcaggacgtgaaacagtttcagcgggatggcgcaccgcgggatgtggacatcatcatttcgccctaccccacctcgctgccactcttctctccgccgctggtgcatgcggaactgccgctgacgttacaccatcagcagcggattcgttatttactggagtcgtagccgggacgcagaaacagcgcgggcagcgccaccagcgccatcacccagaacagatgcccctgcagatgagcgaacagcacgccgcagatcatggtcattatcgcaatgccaccccccatcgccagcgcggaatagagcgactgcagacggatcacttccgctccctgacgcgccgcaataaaacgcatcgccgccagatgacagacggtgaagctgccacagtgaaggatttgcgccacaatcagcagcggcagcgcggtagtagcacccatcagactccagcggatcagcgcacaaatgcccgaaagcagcagcagatcgcgcgcgctccagcggcggaacaaccggttgctcagggcaaacacgacgatttcagccaccacgcccagcgaccagagataacccaccgtggaggcggaatagccactctcctgccaccagatagcactgaagccgtaataggcggcgtgcgccccctgcagcagtgttacgcagagcataaatcgccataccgcattctcacgcagcaattcacgccacacctgccagccgccgcccgccgcgccctgccgttcattaccctgtggctgggtggcgggtgacagcatcatgcctgccagcatagagatgacgccgacggaaagcagcagcagaatggcgtttgaagagtaagcactgaccagcacgccggttaacgccgagctgattacaaaggccagcgaaaccccacagcctgaccggcccatacgccagccctatctgctgtgtccaggtggcggccagcgcatcgctgagcgggaccagcggcgagaaaaagaggttaaagccgatcatgaccgtcagcagccacatccactgctcacccacccagaaaccggcagcgaacaggcaggtcatcagcgccagcagacgcagcgccgtaatcaaccgtgaaggatttttcacctgagaagcgataagcagactgccaacaaagcgtgccaccatgccacagccgagcagcaggccaatcttttcagcatcgagaccggtgcctttcagccacacgccccagaatggaagatagatgccgtaacagaagaagtaagtgaagtagcccaatccgagccatctggcggagccgattgccatattccctccagcaagtgtgctgcctggcagcatgagtgggcgctactctggcagagcgccgcaggacaggcaataaaaaaggatggctgatgccatcctttgtatgctgtctcacaacaggttaacgattaagcgtagaccggcagacggctgcagatttccagcactttctttttggtgcgctcaatggtcgcttcgtcattgacgttatccagtacatccgcgatccagccagccagctcacgcacgtccgcttcgttgaagccacgacgggtaacagctggtgtaccgatacggataccggaagtcacaaacgggcttttcggatcgttaggcacgctgtttttgttaaccgtgatgttggcacggcccagcgccgcatccgcttctttaccagtcaggtttttgctcaccagatcgatcaggaacagatggttatacgtgccgccagaaacgatgtcatagccacgctcaatcagcacctcaaccatcgctttggcgttttttgccacctgctgctggtaggttttgaattccggctccatcgcctctttgaacgcaaccgctttaccagcgataacgtgcatcagaggaccgccctgaccgccagggaagacagcagagttcagtttcttatagaaatcttcgtcgccgtttttcgccagaatgataccaccgcgcggacccgccagcgttttgtgagtggtagaggtcacgatgtgcgcatgcgggatcggactcgggtaaacgtctgcagcaatcaggccggcaacgtgtgccatgtccacaaacagccatgcacctacgctatccgcgatttcgcgcattttcgcccagtcgcaaacgccggagtaagctgagaatccgccaacgatcatttttggcttgtgggttttcgccagttcagccagttcgtcgtagtcaattttaccggtctcatcgataccgtaagccacaacgttatagagtttgcccgacaggttaaccggtgagccgtgagtcaggtgcccaccgtgcgccaggttcatccccagaatagtatcgcccggctgcagcagcgcggtgtaaaccgcaaagttagcctgtgaacctgagtgtggctgcacgttagcgtaatcggcaccaaacagtttttttgcacgatcgatcgccagctgctcaacgatatcaacgtactcacagccgccgtagtagcgtttgcccggatagccttcagcgtatttattggtgagctgagaaccttgtgcctgcataacacgcgggctggtgtagttttcagaagcaatcagttcaatgtgctcttcctgacgcactgtctcctgctccatcgcctgccacaactcggcatcgtaatcggcaatgttcatatcacgctttaacatccggatctcctgactcagctaactttctgacggtatttaccccccttcaggggcgaaggcccacagtgtaaaccgttttaacaggtgaaggtagggtgaacctcctctttttacgcaaacgattggctggctactggcagggcttttttacaccttttcaccctgttcagacgccacgatttttcttcaggatgtgacggcggcttctcaggatgcaccaaaaagttgccactttgacaaccgggaaatttatcgggttatttacaccacaggcgagacggctataagatgcatttaaaatacatctttaaatgagaggccgtttttatgcttgatgcacacactatcgccacggttaaatcgaccctgcctgccatcgccgcctgtggtcctgcgcttaccgcacacttctatgaccgcatgctgtcgcaccatccggaactcaaaaatgttttcaatatgaacaaccagcgcaatggcgatcagcgtgaagcgctgttcaacgccatttgcgcctatggcgcgaatctggagaaacctggccgtgctgctgcccgcagtggaaaagattgcgcagaaacataccagcctgaatattcagcctgcgcaatacgccattgtcggtgaaaatctgctggcaaccattaaagagctgctgaatccgggtgaagaggcgctggcagcctggggccgggcctatggcgtactggcggatgtgttcattaatcgcgaagaggagatttatcaggcgacggagcagcaaaccggtggctggcgcggcactcgtgcgtttcgcatcagtgctattgagcagcagagcgaggtgattaaaagctttaccttcagtccggcagatggcggcccggtagcggcctttaaaccgggtcagtatctgacggtgcatctgcagcccgtcagtttcgaacatcaccagattcgtcagtactcgcttactcacctcagtaatggcaaagattatcggattgcggtgaaacgtgaagcgcagggcaccgtctccggctggctgcatcagaatggcaaagtgggtgatgagctgatgctggccgcaccgcatggcgacttcttccttgaggtcgatgctgcaaccccggtcgcgctgatttccgcgggcgtgggtcagacgccgatgctggccatgctgcatgccctggcggcccgtcagcaccgcgcgccggtcagctggctgcacgcagccgagaacggcaatcagcatgcatttggcccggaagtgatagccacgggcgcgcagctcaccgatttcgtcagtcaggtctggtatcgcgatcccgccgctgaagatgctggtcgctatgacgcacagggtctgatggatatcaccgcgatctccgcacgtctcgcctcacccgacacccacttctacctctgcggtccgctgccctttatgcagcatgtggtggcgcaactgcgcgatgccagcgtggcagacacacgcattcattacgaactctttggcccgcacaaagggatgtaattgagcaataaaaaaagcccgcagcgcgggcttttttatgctgataaagagacaatcagatcgcctcttcatcctcttcgccagtacggatgcgcaccacgcgcgccacgtcgaagacaaagattttaccgtcaccgattttgccggtctgcgcagtacgcataatggtctcgacgcaggtatcaacgatatcgtcgcccaccaccatctcgattttcactttaggcaaaaagtcgaccatatactctgcgccgcggtaaagctcggtgtgccctttctggcggccaaaacccttcacttcactcacggtcatcccggtgatgccgacttccgctaaggcttcacggacatcatcgagtttgaatggtttgataatcgcatcaatctttttcatgtcagaccctttttcactccctccatggtcagagggtttatcaagtataaatgttgctggcgctgtcgggcggtaatatccgggattcttcaggttgccgcaagcgctgccagattatgctgaccgcacccattctgattcgggcctgagcaggcaacctgccggtatcactccgcagcctccgctactctttgaaatcactggcatccagctcatgacgagacagcagcttatagaactccgtgcggttgcgtccagccagacgtgcggcattggtcacattgcctttggtcatctgcaacagcttacgcagatagttcagctcaaactgattgcgcgcctcagcaaaggtcggcaaagcgctgttctcaccgcttaacgcctgctccaccagcgcatcgctgatgaccggcgatgaactcagcgccacacactgctcaatcacgttaaccagctgacgcacattgcccggccagctggccgccatcaaccgcttcatcgcatcaacggaaaaactgcggatctgcggtttatgccgttccgccgcctgacgcaacagatgattagccagcagcggaatatcttcagtgcgctgatgcagcgccggaatcttcaggttcaccacattaagacgatagaagagatcctcgcgaaactcctttttctccatcgccttcggcagatcgcgatgcgtggctgaaataatgcgcacgtcaatctcaatatcatgatcgctgcccagcggcctgaccttacgctcctgcaacacccgcagcaacttaacctgtagcggttgcggcatatcgccaatctcatccaggaaacagcgtgccgccacctgcggttttaaacagaccgtcacgggcactgactgcgccggtaaaggcccctttggcatgcccgaacagctctgactccagtaactgctccggcagtgcgccgcagttaatggcgacaaagggcttgccgtttcgcgggctggcggcgtgaatcgcctgtgccagcatctctttaccagtaccgctctgcccgttaatcagcacgctgacgtccgactgcgccaccatgtgcgcctgctccagcagccgcaacatcagcgggctgcgggtgacgatcgcttcccgccagcggtcatcgctgaccggcgcctgctgagccagtgcttcatcgatcgctttgtaaagcgcatctttatccaccggtttagtcaggaagctgaagacgccctgctgcgtggcggaaactgcgtccgggatagaaccgtgcgccgtcaggataatcactggcagaccggtgtggcgtttctggatctcgccaaacagcgcaagaccatccatctcatccatccgcagatcgctgatcaccagctcgattttttctttctgcagcagacgcaacgcttcgggtccgctggccgcggtggtgacctgataaccttcgctgcgaagacgcatgcccagcagcttcagcaggctgggatcgtcatccaccagcagcagttttgccgcttgtctgaccattattgctcctcatcctgcggcagcgcagtgccatggccgctgtcagaaacatccggggctttccgcgatgaaagctggcgctcaatatcagtaagtcgctccagcttatgctgcgtgtcgctgagctgctgctgctgtttaaccatctgctggcgtatcgcctccagttgggtatcgctgctctgttgcagatgaacataacgggtgcgcgcttcactcaggtcgagctgcgcggcctgattactgcgccacaactggagcagcggacgcacagactgcgggaaatcgctgctgtagcgatcaagggtttcaacataacgacgacgctccactggcgtcacgttgccgttcgacatcagcacgccctgcttgaaagcgcgcgaccagctctcaaccggccagcggtgggcttcggctcgggcctcggcgggggaaaggcgttcagcgcaatcgatggctcgcatccagtagagaggattactcagtgccgcactattctctatcgtccacaggtcattgcagcgggtcgccaggtaatcagccacgctgacctcgggttccgctacctgatggcctgacggcagggatgaggtggccggggaggtcgtacatccgctgagcagcagcgtggtcagtgtgctcaacagcaaagcgggtaaatatttcatcagtcagactttcccggctgtggtgttcagttcaattcgaaaacagacgtcagcctgctcgcaggagaccagcgtcaggtcgccatgcatccggcgcaggcaatctttggcaatactcaatcccagcccgctgccttttaccggccctttgcgctgctggctaccctggaaaaaaggttcgaaaatcattgcctgctcttccagcgggatcggcgtgccgctgttcgcgacatcaatccagacccgctcgccctgctgctgactgcgcagccagatggtaccggattcgctgccgtagttcacggcgttcgaatagagattatcgatgacccgcatcagtaacatcggttcggcaaggcagtgactgacctccagatcgacaaccgtctgcatgagtttggcacgcgccgagagtgcatgtgcattcacgaccccctccacaatttccgccacgctgaccggttccagctggatcgggccatctgccagtttacggttgtaatcaagcagctgttcaatcagccgctgtagatgacggctgctgccgtcgaggatagtgaccacctctttttgatcggcgttcagcgacccggctacctcgtccgccagcagttcggtgccttcacgcaggctggccagcggcgttttcagttcgtgagaaagatggcgcaggaattcatggcgctgcgattccagccactgaagccgttcgctgagccagacgatgcgctgtcccagcgagcgtaactcgcgcgggccgcgaaatgtcacgctgttacccagtttcccggccttcgccaagccggttgatcatccgctcaatacgcttgaccggcccgataatcatgccggtaaacagcgtcatcaacgccagactgatgataaacagaatcagcgcctgccagccaaaaaactggccgcgatcggcaatttcgcgctgcagctgaaggccgcgtgaaaacaccacttcgcgcgtgtcctgcaccatttgcgcattggtggcagaaaaacgatccagctcctctgcggcaggtgtaaccggattgccgttttcgcactttaacggtgtcagcagcggcaacgtcgcctgtaaagtctggaatgcgggcagctcgggcaggctggcgctgtgcgaactcagcatctggctgtagcgggtgtgctgggtctgataaaggcgcgccagcgaggcatcatccagcacgcagtactggcgatagctgcgctccagctcaaccgccgtgcgcgccatcgcctcacttctgcgaacgtcggtgaaggtattgcggttggtatccgctgcctgttcgcttaacgcagagagactttcccacgcctgccaggccagcaccagcaacggcagcagcaccagtacaaacgccatcagcaccagctgacgcagagaacggggaaataaacgccattttttcacgcagccgcttccttaagatttgctgtctggatgctaacggactctgtcagcggaagaaaggtgtcgtcggaagaaaggggaacaaaagaaaacggcaggctcaatggcctgccgctggcacgacgcgtgatgcatcgcgtaaaaatgggtggagccttactcaacgttacgtccggtgtttgataacgcaagcgattatcggtcagttggacggcaggctccgtttggtgcgtcattcggactttatgagctcttctccgctaagcggggcaatcataaacaggtgaatgagcagctgcatgagtatagcaagttccatgccaggaaataaatcattatatttttcagcagattgaataagcttaccggacaactgttgcgcaaaatctgattacagtaagtgaaaactgtctccgctgagcgacatgaaatcgcgccggacaggcgcccattaaaaatcaacgagatagatgtcgccaaaaagagacagtacgacatgctcattgtcgccatttgccaacagagccacaaaaaagagcaggaggcacactggcctcctgctcttttcagcggattaaattaacccagctgtctgcgcgcattgcggaaaatacgcatccacgggctgtcttcgccccactctgccggatgccaggagttgctgacggtgcggaatacccgctccggatgcggcatcatgatagtgacgcgaccactttcattagtcacggcagtgatgccgtttggtgagccattcgggttagccggataggtttctgtcaccttgccgaagttatcgacaaagcgcagtgccaccagccctttcgactccagcgccgccagatgcgtagcatcacgcacttcaacaaagccttcaccgtgcgaaacggcgataggcatatgcgaaaccggccatgccgtccagcaacagcgagggactggcggccacttctaccagactgaaacgcgcttcaaagcgctcagactggttacgcacaaagcgcggccagagatcgctgcctgggatcagttcacgcagattagacatcatctggcagccgttgcagacgcccagcgccagggtttgcggacggtggaagaaggtttcgaactcgtcacgcacgcgcggattaaacagaatcgatttcgcccagccttcaccggcacccagcacatcgccgtaggagaagccgccacatgcgaccagcgcctggaactcttccagaccgcgacgtccggccagcagatcgctcatatgaacgtcaatggcggtgaagccagcccgatcaaaggcggcggccatctctacatgggagttcacgccctgctcacgcagcaccgccacccttggacgtgcgccagtggcgatcatcggggcagcaacatcttcctgcggattaaaggtcagattaacgttcaggccaggatcgctgtcgtttttcttcgcttcatgttcctgatcggcacacgccgggttgtcgcgcagacgctgcatctgccaggtggtttccgcccaccaggtacgcaacgtattgcggctttcactgtagaccgcgctgtcaccagaacggatcacaaagcgatcgcccggctgcgcgctgcccagcagatgcgtcgagtcggcaaggctgtgatccgccaggatctgctcaaccacggcgcgatcggcggcgttgatctgaatcaccgcgcccagctcctcggtaaacagggcggccagcgcatcgttacccagcgaggcgatgtcaacgtcgatgccgcagtgaccagcaaacgccatctcggccagcgtcaccagcagaccaccgtcggagcgatcgtggtaagccagcagtttctgctcagccaccagcgcctggatggcattgaagaagcctgccagctgagcggcatcgcgcacgtcggcaggtttgtcgccaagctgacgataaacctgtgacagcgccgttgcgcccagcgtattcgcgccgttgcccagatcgatcagcagcagcaggttatcctgatcggcctgcagctgtggcgtgacggtgcgacggacatcttcgacgcgggcaaaagcggtaatcaccagcgacagcggtgaggtcatttcgcgctgttcgctgccttcctgccagcgtgttttcatcgacatcgaatctttaccgaccgggatggtgatccccagcgccgggcaaagctcctcgccgactgccttcaccgccgcatataaaccggcatcttcacccggatgaccggctgcggacatccagtttgcggaaagcttcacacgcttcagcgaaccaatatgggtagccgccaggttggtcagtgcttcaccgacggccagacgacccgacgccgcgaagtccagcagcgcaaccggtgaacgttcgcccagggcaaacgcttcgccgtgatagctgtcgaggctggcggtagtcactgcacagttggcaaccgggatctgccacggtcccaccatctggtcgcgcgcaaccatgccggtcacgctgcggtcaccgatggtgatcaggaaggttttttccgccacggcaggcagatgcagcacgcggtttaccgcatcgaccagcgtaatgccgtcacgctgcagggcagtgccctgcgtctgctgcgtcaccacatcccgcgtcatcttcggcgttttgcccagcaggacatcaagtggcatatcgatcggcttattaccgaaatgactatcttccaggctcaggtgcagctcttcggtggcttcaccaatgaccgcgaacggtgcgcgttcacgctggcaaattgcctcaaactgcgccagctgatcgggtgccactgccatcacataacgttcctgtgattcgttacaccagacctccagcggactcatgccaggctcatcactcaggatgtcacgcaggttaaaccggccgccacgaccaccatcgctgaccagctccggcatcgcattggagagaccgccagcgcccacgtcgtggataaacagaatcgggttctcatcgcccagttgccagcagcggtcgatcacttcctgacaacggcgctccatctccgggttatcacgctgtaccgaggcaaagtcgaggtcggcatcagactgacccgaggccatcgatgacgccgcgccgccgcccaggccgatgttcattgccggaccgcccagcaccaccagcttcgcgcctacggtgatttcacctttctgcacgtgatcggcacggatattcccgatgccgcccgccagcataatcggcttatggtagccacggagctcagtgccgttgtggctggtgacctgctcttcataagtacggaagtaaccattcagagccggacgaccaaattcattgttaaatgcagcaccgcccagcgggccatcggtcatgatttccagcgcgctgacgatgcgggccggtttgccgaagtcctcttcccacggctgttcaaagccagggatacgcaggttcgatacggagaaaccgacgaggcccgcttttggctttgaaccccttccggttgcgccttcatcacggatctcaccaccggaaccggtcgcagcaccaggccacggcgagatggccgttgggtggttatgggtttccaccttcatcaggatgtgtgcggcttcctgatgccagcggtattcgctctctccggcgtcagcaaagaagcggccaacctctgagccttccatcacagcggcgttatctttgtaagcagagagcacgtagtccggcgtctgctccatggtgtttttgatcatcttaaacagcgactttggctgtttctcgccgtcgataatccagtcggcgttgaagatcttgtgacgacagtgctcagagtttcgcctgcgcaaacatatagagttcaatgtcgttgggattgcggcccaatgcggtaaacgccgccaccagatagtcgatttcatcgtcagccagcgccagacccagtgagatattcgcctgaaccagcgcctgacggccctcccccagcagatcgacacttttcaccggctgtggcgtgtgatgcgcgaacagctgttcagcctgcgccagatcgccgaagaccgtttccatcatccgatcgtgcagcagtgtgcccagcgtttgccactgcgcttccgtcagttgtggggcctgtacataaaaggccaggccgcgctccaggcgacggacctgcggcagaccgcagttgtgggcaatgtcagtggctttggatgaccagggcgaaatggtgccgggacgaggcgtcaccagcagcagacgcccctgtggggcatgttcagcgagagagggaccatatttcagcaggcgctgcagacggctctgttcgtcagcgcttaagggcgtgctgacatcagcaaaatggatgtactcagcgtaaatatcactcaccggcagatgagcgtcctgaaagcgggtcagcagtttgtttacacgaaatgccgacagggcgggcgaaccacgcagaatttccattaataaatctctcgtcagggcgccgggcgacgcttcattgggcgcaacagggaaaacggggcgtattatagagaaagcgacctcgcgacgaaaccgtttgcgcacaatttttggcgacccggatttgcctgaattttgcgcaaaagctgctataaaagttgctcagcgtgattttgttgcgcaaaatgcccctcgctctgggagttcaaagaagacaaatactgcctttaaaagacagaggccttagagccagcgagagataactatttgaaacgcctaaaatttaattatctgtttatcggtctggttgccgtgctgttagcgttagcgctatggccatccattccctggtatgggggtgggcaggaccagatttcacagattaaatcacggggagtactgcgtgtcagtaccatcaattccccgttgacttactacacagtgaaccaatctccggccggtatggattatgagctggcaaaacgcttcgccgattatctgggcgtcaaactcaaggtgacagtacgtcccaacctgagcgatctgtttgacgatttagatgatggcaaagccgatttgctggccgcgggtctgaactacaacagcgaaacgcctgacccgctatcagaccgggccaggctactacaacgtttcgcagcagctggtctatcgcgttgataagccgcgccctaaaaacctcggtgacttaaaggggcggctgactgttgcgtctggatcggcgtatctgtcaacgctgaagagcgcgcggtcaaatcagtaccccgatctggactgggcgatctccaccgatcaaagtcctaaagccctgctggaagcggtggcagacggcaagctcgactatacgattggcgactccgtgaccatcgctctgctgcagcgcatctatccgcagctggcggtggcgtttgacgtcactgatgaagagccggtcacctggtatgtgcggcacagcgatgacgacagcctgaatgccgcgatgctcgacttctttaacggtatgggtgaagaaggggcgatggcgcgactggaggagaaatatctcggccacgtcggcacctttgattatgtcgatacccgcactttcctgcgcgccatcgacaacacgctgcctgacatcaaaccgctgtttgagaagtacgccaccagcattgactggcgactgctggcggcaatctcctatcaggagtcgcactggaacccgcaggccacctcccctaccggcgtgcgcggcatgatgatgctgacccgtaacaccgctgagagcctggatgtgggcgaccggacggatcccgaacagagcattcgcggcggcagtcagtatctgcaggatatgatggcgaaggtgccgcagaccatcccggaagatgagcgcatctggtttgcgctggcggcctataacatgggctatgcccatatgctggatgtccgtaaactcactgcccgccaggggggtaatccggatagctgggcggatgtgaagctgcgtctgcccatgctgagccagaagcgttactacacccagacggcttatggctatgcccgtgggcatgaagcctataactatgtggagaacatccgcaaatatcagttaagcctggtgggttatctgcaggagcaggaaaagcgcctggcgcagcaggctgaagcacaagaagcacaggccgaactggccaaaggctatccggcggtcgaaccgaagatcgccatgaactaatcctggcgttgcgcctgccgcagcgcttttttctgctcgcgacgcatacggaagaagtcgctcagcatagcggcacactcttcagccagcacgccgctctgtaattcaacctgatgattcatgccggggtgtcccagcacatcgagcagcgatcctgccgccccacttttgatgtcgtgcgcaccgtagaccagccggctgatgcggctgtgaaccatagcgccggcgcacatcacgcacggctccagcgtcacgtagagcgtggtgtccagcagacgataattttccagtactttaccgccctgccgcaacgccataatctccgcatgcgccgtcggatcgtgctggccgatgggccggttccagccttcaccgatcacccggtcattctgaaccagcaccgcacccaccggcacttcgccctgctcccacgcccggcgcgccaggtcaagcgcatggcgcatccagtattcatcttgttgtttcatgctgaccactccgggcgacagaaaagcggcgcattatagcggtctcaccgatcctttagaaacttattccagctgttgcagctcacctgcgggtgttacgcgccagcgatgttgacagaaaaacagcagcgggttgtcctgtttgctgtcgctatagccgctgtagagctgtagcggcgtgccgattttctcttccagctgtgccactttctcatggccgaggcagcgcattgccagtacccggccgccccagccgcgctgcatctgactggcaatcaacttcacgcgtggcagaaacgcggagtcgtaatagacctgctccaccagagactgtggcgatccggtgatgagccagacgtcagcatcatcactgccgagataatcggtcaggcgctgctgaaccaccggaaaggctttaacgcgcaggcggaaccactgcgcaaattcggcttcgagttgcagcagcgtccgctcagaaacgaccaaaagtaatagaccagagcagcaggctcatgggccagcgtgccgcccggcctttaaacaacaagccgatacccactaccggcaacaacggcaccaccagcagcagattaagcgggcggcgacgcagcagatagcgcataaaagtgccgaacatgtcctgctggtgcaaagtgccatccaggtcaaaaaatacgacgcgacgttgtgttcccctggtcaaacaactctccttcaggctgattctggaatgataaagagtagtgtagccatcatcaggcgctacggcgatgactgtcatttttaattccgatgactacaatgcctgatgaatagtttattcttcacagattatccctgaattacgaggattgggcatgagttcattgctgcgcattcgccagctttatccacgtctggcattgaacgagcgtcggctggctgattttttactgtcgcaacccgatcgggcgcgccacctgagttcgcaaaagctggcggaagagtctggcgtcagccagtcgagcgtggtgaagtttgctcagaaactgggatacaaaggttttccggcgcttaagctggccctgagtgagtcactggcggacaaagatgccattaccgtacataaccatatcctcagcgacgatccccttaaaatggtgggtgagaagctgctgacggagaaactctcggcgatccgcgccacgctggatatcaacagcgaagagaagctcaacgatgtgttacagctgctgaaaaatgcccggcgtattttactggtaggcattggcgcttcgggtctggtggcgaaggacttctcctggaagctgatgaagatcggcattaatgcggtggcagagcaggatatgcacgccctgctggccagcgtgcaggcgatggggccaggcgatgtgctgctcgccatctcttacaccggtgaacggcgggagatcaatctggccgcgcaggaggcggttcaggtaggcgcagatgtggtggcctttaccggctttacgccgaatacgctgcagcagagcgccagttactgtctctatacggtggcggaggagcagagtacccgcagcgcggccatctcctcgaccacggcgcagctggccctgaccgatctgctgtttatggcgctggtgcaaaacgatccggaacgcgcgtccagtcatattcgccacagcgaagcgctggtgaaaaagctggtctgatcagcggcagcgcgtataatacccgcgctttttctgttgttatcaggtgggtaaaatggcgctgttgattacgtccagatgcattaactgcgatatgtgtgaaccggagtgcccgaaccaggccatttcactgggcgatgcgatctatgagattgatgtcagccgctgcacggaatgcgtcgggcactatgagacgccaacctgtcagcaggtatgccccatcgacaacaccatcatcattgacccacagcacaccgaatcacgcgatgcgctgtgggagaagttcgtgctgctgcacggctagctttcaatgatcaccgtggcgcaggcgtagtgacgctcatcggccagcgtcacgtgaacgtgtttaacgcccagcctctccgccacttcagcggcatgctgaaagaagcgtaatcccggttttcccagcgcatcgttgtaaacttcaaactgattaaacgccagaccaccgcgaatcccggtgccaaaggcttttgccgccgcctcttttaccgcaaagcgtttagagagaaagcgcaccggctgcttgtgcgcctgatactgttgccattcggcttcgctcagcacccgccgcgccagccggtcgccggagcgctctatcaccccggcgatacgttcaatctcaacgatgtccgtacccagtcccagaatagccatcagcgacgggcttcacgcagcagctgcttcatctctttcaccgcatccggcaggccactcatcaccgcacgaccaataatcgcatggccgatattcagctcatgcatttccggcagcgccgcaatcggcagcacgttgtgataggtcagaccgtgaccggcattgaccttcagtcccaggctggcggcaaaggtcgcggcgtggcggatacgcgccagctcagcgtcacgcgccagtccctctggtgcttcggcgtaagcgccggtatggatttcgatgtaaggcgcgccgctggccacggccgcttcaatctgacggtgatcggcatcgataaacagcgaaaccagaatgcccgcgtcactcagcagtcgtacggccgcgttcatcttctcctgctgccccgccacatccagcccgccttcagtggtcacttcctgacgcttttccggcaccaggcagcagaagtggggctggatatcacaggcgatgccgatcatctcatcggtgaccgccatctccagattcatacgcgtctggatggtgtcacgcaggatacgcacgtcgcggtcagtgatgtgacggcgatcttcgcgcaggtgcacggtaatgccgtctgcgcccgcctgctcggcgataaacgctgcctgcaccggatcgggatagtttgtcccacgggcgttacgcaccgtagcaatgtgatcgatattgacgcctaacagcaactcagccatgaccatcctcacttctttttcatcgtgatgttgagtgtaccgcgcaaagtgaaacaggcggtacgacccgcgctattcttctgcctgttcaggctttttcttcgggataaactggcggaacagctcctgactcttcagcggcttgccaccaagatagggcttcagggcgatgcgggtaaaccgcttcgcggcgcgcagagtgtcggcatcgggaaactctcgctcgcacagggcgcgcaattcgcggccggtaaagctgcgctgattgaccaccaggctggcaataaagccgcgctcttcgcggtagctgtacgtcatgttgtcgctgaccggctcgccgctgccggcgcagtgaaggaaatcgacgccataacccaggtgaccgagcagcgccagttcaaaacgccgcagtgccggtttcgggcttgccgtgcgttgaggctaatgcctgaaggcagttgagatagtcgaagaagagttctgagaaggggaattcctgctgcaatacgcgagagaccagctcattaacgtagagaccgcagtagagcgtgatgccgctgagcggtaaggccagcgacaccgcttcggcattgcgcagagttttgacttccccgcgcccgctccagcgaaccagcagcggggtaaaaggctgtaacgcccccttcagctgcgagcgccgcgaacgtgcgcccttggccagaacccgcacccgcccttcactttcgctgaacaggtcgagcagcagactggtttcgctgaaggggcgactatgcagcacaaaggcgcgttgccagccttccattgaatcagagatcgtctgtataacccaggctgcgcagcgcacgttcgtcatctgcccagccggatttcactttcacccacagttcgagatgcactttcgcttcgaacatctcttccatgtctctgcgcgcttctgtgccgatgactttgattttggcgcctttgttgccaatcaccatcttcttctgcccttcgcgctcaaccagaatcagaccgtgaatgtcgtaaccgccacgttcgttagtcacgaagcgctcgatctcaaccgtaacggagtaaggcagttcagcacccaggaagcgcatcagtttttcacggatcatctctgacgccatgaaacgctgtgagcggtcggtgatgtaatcttccgggaagtgatgatcggcctgcggcagatgcttgcgggtaatcgccgcaatggtatcgacgtttttgccgctctcagcagaaataggtacgatatcgaggaagttcatctgctggctcaggaactgcagatgcggcagcagaatgcttttgtcctggatgttatcgaccttattgatcgccagcaccaccggcactttattgtcgcgcagtttgcccaacaccatctcatcatcgggcgtccagcgggtgccttcaaccacgaagatcaccagtttctacgtcgccaatggaactgctggctgcgcggttcatcagacggttaatagcgcgcttctcttccatgtgcagacccggggtatcgacgtagatcgcctgatattcgccttcggtatgaatgcccatgatgcggtggcgcgtggtttgcggcttacgcgaggtgatcgacaccttctgccccagcaactggttcagtaaggtggatttaccgacgtttggtcggccaacaatcgcgacaaagccgcaataagtaacgttttcgctcattcgagtcctgaattgttcagcgcctgatgcggcgccgaaagagtgctatttgagtcatgtgtcattcagcgtcttctgacgccgggatagagtgtcaggttaatggtcagtgccggttccggcactgtcaccccgacagatctattcaagacctaattttatcagtgcctgttcagccgctgcctgctcagctttacgacggctggagccgacgccgacaaccggctcggccatgccactcacctgacagtgaatggtgaattcctgatcgtgggcttcgccacgtacctgtactaccagataacttggcagcggcagatgacgtccctgcagatactcctgcaggcgcgttttcggatctttttgtttgtcgccaggactgatttcgtcgaggcgggtctgataccagtcgaggatcagctgctctacccgctcaatactgctgtcgaggaagataccgccaatcagcgcttccaccgtatccgccaggatcgattcacgacggaaaccgccgcttttcagctcaccgggtcccaggcgcaggcactcgccaagatcaaattcgcgagccatttcagccagcgtgttgccccgcaccagcgtggcgcgcatgcggctcatgtcaccttcatcaacccgcgggaagcggtgataaagggcattagcaatcacatagctaagaatagaatcgccaagaaattccaggcgttcgttgtgcttactgctggcgctgcggtgagtcagggcctgctgtaacagttccgaatgagtaaaagtgtagcccagtttgcgctgaagcttgttaatcaggatggggttcatgcgattccagttctttgttgcgtctgtgactctgcataccaaacggggctggtaatccaacacgttccgtttggtgtgcagtggcctccctgaggaggccacccgatttgcctgttaatcagacaataatgttagtggataccaccgatgcgactgaatcgcacgccggttggccactggccttcttgtttctcaaagctcatccagattgcgaccgctttaccgaccagattacgctccgggacaaagccccagtagcggctgtcggcgctgttatcacggttatcgcccatcatgaagtattgccctttcggcacgacccagctcgcctgcggctgacccggctgctgataatacatgcctgcctgactctgcgcttcgtttaccagcagaatgtcatgcgtcacgttaccgattgtctctttgcgggtttcccaggcgcaaaccaccgcgcagggtatcgccctgcggcacctgataaaaaccgttgccggtttcgttgccatcaaagccgctaaaggtctgaacaaagttgcttggctcaacgtcggtgtaagttaccgctaacgctgtgtcacaggctttatcatcggagcaggtcggtttcaccgtcagcgttttgctgtaaggatcataaatgactttgtcgcccggcaggccgatcacgcgcttaatgtaatccaggctcggatctttcgggtatttaaataccgcgatatcgccgcgcttcggctgaccggttgggatcagcgtcgtctgggtgatcggatccttgatgccgtaagcaaacttctccaccaggataaagtcaccaatcagcagtgtcggcatcatcgagccagagggaatctggaatggttcgtagataaacgaacgcacgatgaaaaccacggccagcaccgggaacacagatgcggtcgtttcaacccagcctggctttgcagcgaccttcgccagcgttttgctgtcgagcgcgttaccggtctgggcctgagcctcagcctgtttcgcgcgacgcgcgggtgcccatttaaaacgatcaattacccatacgatgccagtaatcagcgtcgctatcgccagaatcagggcgaacatattagccattggaaatccttatttgctgtccttaccgacatgcagaatggcgaggaacgcttcctgtggcagctcaacgttaccaacctgcttcattcgcttcttaccatctttctgcttctgcaacagtttcttcttacggctgacgtcaccgccataacacttggcgagaacgtttttacgcagctgtttcaccgttgaacgcgcgataatgtggttgccgatggcagcctgaatcgcaatatcaaactgctgacgcgggatgagctctttcattttctcaaccagatcgcgtccgcgataaggcgcgttgtcacggtgggtaatcagcgccagcgcatccacacgctcagagttaatcagtacgtcgacgcgtaccatgtctgaaggctggaaacgtttaaagttgtaatccagcgaggcataaccgcgcgaggttgatttcagacggtcaaagaagtcgagtaccacttcagccatcggaatttcgtaagtcagtgccacctgattgccgtggtaaaccatgttggtctgcacgccacgcttctcaatacagagcgtgatgacgttgcccagatactcttgcggcagcagcatgtgacattcggcaatcggttcacgcagctcttcgatattgttcagtgccggcagcttggatgggctgtcgacatgaacgatttcgccgctggtggtcacgacttcatacaccaccgtcggtgcggtagtgatcagatcgagatcgtattcgcgctccagacgctcctggatgatctccatgtgcagcagaccgaggaagccgcagcggaaaccaaagcccagcgccgttgagctttctggctcatagaacagcgaggcgtcgttcaggctcagcttaccgagcgcatcacggaacgcttcatagtcgtcagagctgatagggaacagaccggcgtaaacctgtggcttcacttttttaaagcctggcagcgctttgtcagccgggttacgtgcggtagtcagcgtatcgcccacgggtgcgccgaggatatctttaatggcgcagaccagccagcctacttcaccgcagttcagctcattacgatcaacccgtttcggggtgaagatacccaggcggtcagcgttataaacctggccggtgctcaggactttgatcttgtcgcctttgcgcatggtgccgtttttcacgcgcaccagggaaacaacacccagataattatcgaaccaggagtcgataatcagtgcctgcagcggcgcttccggatcgccttctggcggcggaatgtcgcgcactaagcgttccagcacttccggaacgccgacgccggttttggctgagcagcgcaccgcgtcagttgcatcaatgccgacgatatcttcaatttcctgcgcggcgcgatcgggatcggcagcgggcaggtcaattttgttcagaaccggcaccacttccagatccatctccatcgcggtgtagcagttcgccagtgtctgcgcttcaacaccctgaccggcatccaccaccagcagcgcgccttcgcaggcggccagtgagcgggaaacttcataagagaagtctacgtggcctggggtatcgatgaaattgagctggtaagtttggccgtctttcgcgtggtaatcgagtgtgacgctctgtgctttgatagtgatgccacgctcgcgctccagatccatagagtcaagaacctgcgcagccatttcacgagcggtgaggccgccgcaaatctgaatcaggcggtcagagagcgtagatttgccatggtcgatatgagcgatgatggagaaatttcttatgtgcttcatttattgggatatcttcgcttaaaattcagttgaaaacctgagcacagacacattcaggaagatcgctctttacccacaatcctgtcagcctcattaatgacgacgcatattacactgttaacgccgcgcataaaagaatggaacgtggtggaagcgaaacagatatctgcgcgaggcagaacagacaaaggccgcgggatgcgcggcctggacgtgcgttacgcttcgctttcaacacgcagcgcatcgggaggcaaggcgatgttcagaatgaccggctgaaaggcttctcgatcgccgaatttcattgaaacgcctttggcgacaataaaacccccgataccgcccagcagcgcaccgcaggcggcggccagatcgctgctgaacagcgcctgaaacagcccggaaaccaggaacaggccaaacagcggcgtcatgtagaccagcagcgctgaacccagcaggctgctctctttgataccgagttcgatccgctgccccggctgcagcggcttgctgctggcgatttgcatcacgtgggcattcttcggaccgagcttattcagcatatggctgccacagcctttacgcgcctggcagctgttgcaggaggtttttgcttcggtgtgcagcgtggcgatgccatcctgccatgccaccacggtggcccattctctcatcatttttgtgaccccaggtcgatgctgtccgcaatacgttttgcggtagagggcggtaattcgccgatcaccgctatttcgttattattgcgcacaacggtctggaccgtacgacgcccagtgcgcaatgtctgcgttgtgctggttttatcgcccggcgtcacgttgatcgcgaaactaaacaggccatcgctgtagagcttcgattccatatttttattcagcccgggtagcgtgcggcgattctgcgacaccagcgacataccggcaggtatccagccaggctgccaggtgagcgtgaccgcatcccctttcggcaccgaaagcgacggaggcagattggctttctccagcccctgcatcagattacgcaccccttcgtccaccgcaaagctgatgacgcggaactgctccagcgtttcgccatcacgatcgagcaggtcgatgcgcagcggcagcttggtgtccacatccagccagaccacatagctgtaacgggtgccatcgcgtgaaacgatgcgcaacacatcacacatctgatcggcaatgcgcgagcggcctacggtaataaaatcataggctgtggcgagcttggtgaagtcagcaaaaatcaccgacggcaaagcatcgataatgtgattgccggggagtgaaaagggatcgaggccgggttcgaagtaactgatatcgttgccgcgctggatcacttcccgacgtggcccgtccatctgcaacagctgcgcgaatatccggttatcgattacagcatgacgataacgcagcgattcgatgccgatgcgggagacgttgatataggcgaattcgtagttgaggttctgacttgcctgctccatctgctgcaatagcgccccggacgcagaaggttgcgccggggcggcagatgaccacaacaggctgcctgtcagcaggctaacagcataccaaagcggcttcattactgctgttgctgtcctaatgattgatttccgggaacatcaacctgcgcctgttttggcgcagtggtttcaaactgcagctggtcagcgtgcaggcgacgttgcagtttcgtaatcctgcagcatggcatttacgcgacgacgctggtcctgaacctgctggttagaactgttggtgtcaaatgcatcagacggcacgcccaggctcaccggagacgctttgcccatcatcggcatcgtattgaacaccggagagtcagaggtctgcgtggcgctgccctctggctggttatagtgctgaacacctacgatcacggccagtgaaacacaggcagcgacaccgacctgggtcagttgcgcagcccacgggcgcgcttttttccagaacggcattttttcccagcgggaaggttctggctgagcttcagggatcagcgttgtaaccgtacgcaacggttctttttcgatggcagcagcgacgcgcgcagaaatatcaaaatgcaggacatcgcccacatcaccgcgcatggtatcgcgaatgagatgatagcttgcccagcttttctgtaattctgcgtccttagacaaggcggaaaacagctcgttatctaaggtctcaccatccattaaagcggaaagtttttctttctgcatgcctatgtacccttccagtagccgttatcactgacgttggataagcggttgaactttgttatcaatggcctctcgcgcacgaaagatacgtgatcgaacagtgcctaccgggcaatccataatgacggcgatctcttcataactcagaccgtccagttccctgagggtgattgccatacgcaaatcctcgggtagcgcctcgatggtacgaaagacaatttgtttcaattcttctgacaacattaagttctcagggttcgaaatttcttttaatgcacccgcactttcgaaattttctgcgtcaatagcatccacatcgctggatggcggacgacgcccctgagcaaccaggtaatttttcgctgtatttaccgcaatgcggtacagccaggtataaaacgcgctatcgccccggaatgaatccagcgcgcgatacgctttaataaacgattcctgtactacatcaggtacgtcgcccgagggaacatagcgtgaaaccaggctcgccactttatgctggtaacgaatcaccagtaagttgaaagctttttgatctcccttctgtacgcgctcgacaaggacctggtccgtcaactgctcgctcatccgaggtaatgtctccccaaatttttcatacgcataaagtaactgccagcacatctcatggttctgagcaagcatgcgcttagagttgtgatgtggtgcgaagttcacttctcgccctgatatttaccgctccgatggacattacacaggttcttcgttttcgttcagtgtaaggagcgtaaatcgcaggcagagtaacctatgacaacagctttttcatcattaaatcctttaggtttaataagtttgctataaaaaaccgcgccaaaagcagtccggttttaactcactgatattaagtaactttgggaaatcatcagacaaaaacctgcgccagatgtttaaaatacttcacagcaacccccattgcgcttatgctcagccctattcttgtttagtaaattaaacattatgatgaatgcgaacccggattatcagtgtgatgtactcattgtgggcagcggtgctgctggcctgtcgctggcgttgcggctggcaaaacagtatcaggtgacagttctcagtaaagcgcaggtcaatgaggggtcaaccctttacgcccagggcggtattgctgcggtatttgatgagactgacagcatcgagtcgcacatcgaagatacgctgattgccggagcaggattatgcgaccgtgaagccgtctcgtttatcgccagtaatgcccggcattgcgtgcagtggctgatcgacaacggtgtcgcctttgatctcgatccgcaggcggccggcgacatgcgttatcacctgacgcgggaaggcggccacagtcatcgccgtatcctgcacagcgctgacgctaccggccatgcggttgaaacgacgctggtaagccaggcgttgagccatcccaacatccggattctggaacgcaccaacgcggtcgatctgattctttcagataaaatcggcctgccaggcccacgccgtgtagtaggcgcgtggatctggaaccgtaatcgcgaaacaggtggaaacctgtcgggcacgggccgtggtggttgcaaccggtggtgccgccaaggtctatcaatatacgactaatcccgacatcgcctccggtgacggcatcgcgatggcctggcgtgccggctgccgggttgccaatctggaatttaatcagttccacccgacctgcctgtttcatccgcaggcgcagaatttcctgttaaccgaagcgttacgcggagaaggtgcctggctgttgcgtcccgatggcagccgtttaatgcccgattttgatgagcgcgccgaactcgccccgcgcgatatcgtcgcccgggccatcgatcatgagatgaagcgactgggcgttgactgtatgtatctggatatcagccaccagcctgaggaatttgttcgcgcgcacttcccgatgatctatgagaagttgctgacctttggctttgacctcaccaaagaacccatcccgattgtgcctgccgcgcactatacctgtggcggcgtagtcgttgatcagcatggccagaccgacgtaagtggcctctatgccatcggtgaggtgagttataccggcctgcatggcgctaaccgcatggcatccaattcgctgctggagtgtctggtttatggctggtccgccgcagaggagctgattcgcaccctgcccgccatcgaagccgttactgcgctacccgcatgggatgaaagtcaggtcgatgacgccgatgagcgcgtggtgatccagcataactggcacgagctgcgattattcatgtgggattacatgggaatcgtccgcacgacccggcggctggagcgggcgctgcgtcgcatcaacctgcttcagcaggagatcgatgaatattatcgtcatttccgcctctccaataatctgctggagctacggaatctggtgcaggtcgctgacctgatggtgcgctgtgcgctggagcgaaaagagagtcgcggcctgcactatatccgcgactacccggatttactgcccgaggcgcggccaaccatcctgacgccgccggactacataaaaaggtagaactcccgcgtcaggctacaccactcatcagaatagcgggtgtccggcgtgcggatggcaaggcgctccagcagggtttcaccggcctgcggcgacagccccagcaggacacggtgtggcggacgatgggcatattccgccacgtccagccggaaacgcagatgccagccatccgcctgcgccagggcgatgaattcctggccggtcgcggtgggcagcaccacgcagaacatcccctcttcttcaatcagtaatgcagcactgcgcaacagtgtctgatgatcgagcgaggccgtggcacgggcgctgtcccgtgccgcagtcgaacaggccacacctggcgcaaaataaggcggattgctgacgattagcgagtaacgtttatcgcactgttcggcccagtcggcgatatcacgctgatgaatctgaatacgttcaggccacggcgactgctgcacattctcctgcgcctgaagcgcggcttgcggttctaactcaaccgcatcgatgttgaccagcgacggcgtacgctgcgccagcatcagcgcgataagcccgctgccgctgccaatatccagaatacgttttacttcggcaaccggcgcccaggccccaagcagaatggcatcggtgcccactttcatcgcacagcgatcgtgcgcgacaaaaaattgtttaaaggtaaaaccgttcttgtttaactgtggccgttcacgcggcttatcctgcatcattcgtcactaccatcgtttttttcctgccgtacggcagcgcatgagtgtaacgtgacgacagagggaattcacgcggcagacaaccccaggcgcagccgaaacggattaacagatgaagattcagtctgatctgtctataatcagcgccccaaactgaggtagaccatgacagtaaccacattttccgaactcgaactcgacgaaagcctgctacaagcgttgcaggaaaaaggctttacgcgcccaacagtgatccaggctgctgcaattccgcccgcgctggagggccgtgacgttctgggttcggcacctacagggaccgggaaaaccgccgcgtatctgttaccggcgttgcagcacctccttgattttccgcgtaagaaatctggcccgccacgcatcctgattgtgaccccgacccgcgaaactggcgatgcaggtcgccgatcatgcgcgtgagctggcgaaacatactcatctggacatcgccaccatcactggcggcgtggcttatatgaaccatgccgaagtgttcagcgaaaaccaggacatcgtggtcgccaccaccggccgtctgctgcagtacatcaaagaagagaactttgactgccgcgcagttgaaaccctggtgctggatgaagcggaccgcatgctcgatatgggctttgcccaggatatcgaaaccatcgcggctgaaacgcgctggcgcaagcaaaccctgctgttctccgccacgctggaaggcgacaatatccgtgacttcgccgagcgtctgctgaacgatccggttgagctggaagcggacccaagccgccgtgagcgcaaaaagatccagcagtggtactaccgcgctgacgatctgcagcacaaaaccaaattactgatccatctgctgaaacagccggatgtgacgcgcagcatcgtgttcgtgcgtaagcgtgaacgtctgcatgagctggtgagctggctgcacgaagcggggattcgtagcagctatcttgaaggcgaaatggtgcaggcaaagcgtaacgaagcgattaaacgtctgagtgaaggccgcgttaacgtgctggttgcgacggatatcgccgcgcgcggcattgacgttgaagatgtcagtcacgtcttcaactatgacatgacgcgcaccgctgatacctatctgcaccgcatcgggcgtaccggtcgtgcgggccgtaaaggcatcgccatctcactggttgaagcgcacgatttcgtgctgctgggcaaaatcacccgctatgtgaacgagccgatcaaagcgcgcgtgattgatgagctgcgtcctgagacgcgggcgccaagtgccaaaacgaccggcaaaccgtcgaaaaaggttctggcgaagcgtgcagagcagaaagccagtgaaacagaaaaaccgcgagtgaaaaaacgccatcgtgatgccaaaaatgtcggcaaacgccgcaaggcaagcggcagtacgccagctaacgagaatgcggaataaatcatcgcagctataaaaaaatcgcctcacaggaggcgattttttttatctgataatcagtaacagccctttcacaatcttttgtctgccagagcgctttcttcacgacactgtcatcagcgtgccaggcagttaactgtttatcttattcataatattaataaaaattgctgtgtgcgctttgcgctaattttcagcagccgctaactcaggctgctcaaagactttcagtaaaggtacgggtaatcacatcgcgctgctgctcaggtgtcagtgagttaaaacgcacggcatagcctgaaacgcggatggtcagctgcggatagttttcaggatgtttaactgcatcttccagcgtttcgcgacgcagaacgttgacgttcagatgctgtccaccttcaacacgtacctgaggtttgatttcaaccggcacttcgcggtaagcgaattcgcccagtttcgctgatggcgacaacctgatcttcttcgtagcccgcttttgcacacaggcaacgcgcttcggctttctcttcgtccagcagccagaaggagttcagtaattgtgaattgtttgattgagtgatctggataccagtgatcatgattgcgtctcccgggtaatacgtggataaatcaaatttgaggccccggtatatcacctttgatttcggacagctttgacctgtatcaatattaatcaggcattccgaccgcttttaagctaacccgttgatctcaatacccctgccacctaaacttaatttttattattcaaattatttttgccttcaggtcagcggcaggaaccgctaagcttatggcactaacgttaagggagttaaacatggctgaaaagctgacctggcacgacgtgctggctgaagagaaagagaaaccctattttatcgagacgctgaagcaggtcgccgatcaacgcgccgcaggtgtcacggtctatccgccgcagaaagatgtcttcaacgcctttcgcctgacggagctgggcgacgtcaacgtcgtgatactcggtcaggatccctatcacgggcctcatcaggcgcacggcctggccttctcggtactgcctggcgtccaggtgccgccctctctgcagaatatctataaagagctgatgcaggatattccaggctttcagaagcccaatcacggctttcttgagagctgggcaaaacagggcgtgatgttgctgaacaccgtgttgacggttgaggcgggcaaagcgcattcccatgcgcgatttggctgggagacctttacggataatgtgattgcggcgattaaccagcactgtcagggggtgatttttctgctgtggggttcacatgcgcagaagaaaggcagcattatcgatcgccagcgccatcacgtgttgcaggcaccgcatccctcgccgctctccgcgcaccgtggctttttcggctgcaaacacttttcaacaaccaatgagctgctgagcgctgccggtaaaaagccggtggactggacgccggttttaccggactaacgccagaaagcacacggccgcgtcagtgcgcggccgtgtaacgggattcaggcgttgaatcagcttttagctttggaaaccgcaaccatcgccgggcgcagcaggcgaccattcagcgtatagccacgctgcatgaccagcatgacatggtttggctcaaactcttcagactccatcatcgacatcgcctgatgcacttccgggttaaacggcacgccggtttcgccgaccacttcaacaccgaatttacgcacggcgcccagcaggcctttcagggtcagttcaatcccttcaatcatcgaggccagctgtggatcctctttgttcgccacttccagcgcacgtttccagactgtcgattaccggcagcagttcgttggcaaacttctccagcgcaaatttgtgcgccttctcaacatccatctcggcacgacgacgaatgttctcaatctctgcctgcgcacgcagctgggcatcgcgcacaccggtctgcgactgcgctaattcagcttcgagctgagcaatacgctcatcacgcggatccacctctgccgctgtctccgcttcctgaggttgctgctgatcctgctgaatttcgtctgagacttgctcgtttggggtgttctgttctttactactcatgaatttctccgcgttttgcacattcatttcgctggttggcttattatggggattggtatgacggattcaagggaacctatcacattgccttaccgttttggcttataaggaacaccgaccagatgaacaaacactttaactgcattggtattgtgggtcatccgcgccatcccaccgcgttaaccacgcatgagatgctctggcgctggctgacagccaaaggttatcaagtgatcgttgagaagcaaattgcgcaggagctgtcgcttcacgacgtgcagacgggcacgctggcggagattggtcagcaagccgatttagcggtcgtggtgggcggtgatggcaatatgctgggcgcagcgcgggtgctggcgcgctacgacattaaagtgattgggattaaccgcggtaatctcggctttctcaccgatcttgatccagacaatgcgcagcagcagctggatgaggtgctacagggcaactatttcgtcgaaagccgctttctgcttgaagcgcaggtgtgcaaatctgactgctcgccgcgcattggctccgctatcaacgaagtggtgctgcatcccggcaaagtcgcgcacatgatcgaatttgaagtctacatcgatgaagtgttcgccttctcccagcgatcagatgggctgattatctcgacacccaccggctcgaccgcctattcactctctgcgggcggcccgattctgacgccgtcacttgaagcgattgtgctggtgccgatgttcccgcatacgctgtcagcgcggccactggtcatcaacagcagcagtaccatccgtttgcgcttttcctcacgccgcagcgacctggaaatcagctgtgacagccagattgcgctgccgattcaggaaggcgaggatgtactgatacgacgcagcgccaaccacctgaacctgattcatcctaaaaactacagctatttcaatacgctgagttcaaaactgggctggtcaaaaaaattgttctgaaatgcggcatcacctctttactggataaaaaaccagtttatactgtatgaaaaaccatatgtgtttattcatacaggtgaacctatgctggcccaactgaccatcagtaatttcgctatcgttcgtgagctcgacattgattttcaacgcggcatgacagcaatcactggtgagaccggtgccggtaagtctatcgcgattgatgcgctgggattatgtctgggcggtcgtgctgatgccgacatggtgcgtcagggtgccagccgggccgacctctgcgcccgcttccagcttaagtcctccccttctgctcagcgctggctgatagataatcatctggacgatggcaacgaatgtctgctgcgccgggttatcagcgctgacggacgttcccgcggctttatcaatggcacggcggtgccgctctctcagctgcgcgatctcggccagttactgattcagatccacggccagcatgcccatcagcttctgctcaaaccagaccatcagaaacatctgctggatgcctatgccggtcacgacgagctgctgcagcaaatgcgcgccagctatcagacctggcatcagagctgccgcactctggcgctgcatcagcagcaggcacaggagcgcgaatcccgtcgcgagctgttgcagtatcagctaaaagagctgaacgacttcgctccgcagcagggtgaatatgagcagatcgacgaagagtacaagcgtctggccaacagcggacagctgctgtcgaccagccagcaggcactgcaactgttagcagacagcgatgacaataatctcaacagcctgctctacagcgcacgtgagatgatttcagaattgacctcactggatgagaagctgaatggcgttcacaacctgctggaagaggcggcgattcagctgagcgaagccagcgatgagctgcgccactactgcgacagcctcgatctggaccctaaccgcctgtacgaactggaacagcgtatttcgcgccagatcgccttagcccgtaagcatcacgttactcctgaagggctgcctgaactgcatcagcaactgctggcagaagcggaactgctgtctcagcatgagagcgatcaggagagcctgcaatcactggtgggtgaacactatcaggcagcgttgcaaagcgcagagcagctgcaccagcagcgcagccactatgccgatgagttgcagctgctgattacccagagtatgcatctgctctcaatgccgcatggccagtttaaaatcgcgctgacctttaatccggatcagctgaccgcagacggtgcgagccgcgttgatttccaggtgacgactaacccaggtcagccactgcagccgctgggcaaagttgcttcgggcggtgaactgtcacgtatcgccctggcgattcaggtcatcaccgcgaagaaaatggaaacgccagcgatgattttcgatgaagtggatgtcggcatcagcggcccgaccgccgccgtggtaggtaagctgttgcgtcagctgggcgaatcaacccaggtaatgtgcgtaacccacctgccgcaggttgccggttgtggtcatcagcatttttatgtcagcaaagagactgatggtgcgatgaccgagacccatatgcagccgctggacaagcgtgcacgtctgcaggaaactggcgcgactgctgggtggcagcgaggtcacacgtaacaccctggccaacgcaaaagaacttttagccgcatagcagcgcacttttttaaccggctggggtcataagcttgctctgtagaggtttccaatagcgaaaaggtttattatcatcggcacttatgtcgccaaagtaataaagcctgccgcaggcagagttcagattttgatggcaagaaaaaccgcctgtaaaaggcgtttggccccggaaaaggaatgtatagatgcgctgtaaaacgctgactgccgcggcagtagtaatgttgatgatgaccgccggatgttccaccttagagcgcgtggtctatcgtcctgatatcaaccagggtaactatctggtagctaacgacgtagccaagatccataccggtatgacacagcaacaggtggcttacaccctcggtacgccgatgatgaaagacccgtttggcagcaacgtatggtattacgtgttccgccaggagccaggtcatgagcgcgtgaagcagcagacgctgacgctgaactttgatggtaacggtgttctgactaacatcgacaataagcagaatctggccaaaaacagcgactgattgaacgtaagaccgtttaaacgacagacagcaaaaaggcgcactgagcgcctttttttatgcccgctatccactgagcctgaagggatagcgacttattttttgctttctgccgctcgctctgcgcgctgacggcgcagctctttgggatcggcaatcagcggacgatagatctcaatacgatcgccctcattaacctcatcacccagcttcactggccgactgtagatgccgactttgttactggtgaggtcaatctcccgacgcagttccagtagccctgacttttcgatggcctgctctaccgtgctgccctgctccactttcacgtagagctgatactgtttttcaggtaaggcgtagaccacctcaacggagatctcaggcactgtagacctctttagcacgctgagtgaaagcctgcaccatgctgttggcaagctctttgaagatacgtccaaaggccatctctaccagcatgttggtgaattcaaactccaggcttaattcaaccttgcaggcgtcatcgcccagcgagacgaacttccagccgccggtcagcttgcggaacggtccatcaaccagttgcatatggatgctctggttatctgtcagggtattgcgggtggtaaatgtcttgctgatgcccgctttcgacacatccacggacgcagtcatctgattatctgacgcatccagcacgcggcttccggtgcaacccggcaggaattgcggataggcatccacatcatttacaagtttgtacatctgcccggcactaaacgggaccagcgccgaacgactaatctgagccataatggttcctgttcatcacgaaaccgctgaataatagcattttcagcgattaaacaaaaatgtccccgagtgagggtgtgctagaatatcccgtttcctgccgccccgctggactggggatgcgataaccgactaagtgatgtaaaatacgccgcactatgacaaagaaaaaagcacacaaacccggttctgccactgttgccatgaacaaacgcgcccgtcacgagtacttcattgaagaggagtacgaagcgggattgtcgttacaaggatgggaagttaagtcacttcgtgctggtaaagccaacatcagcgacagctatattctgctgcgcgatggcgaagcctttctgttcggttcaacctttcaacccttagccgttgcttccagtcacgtggtctgtgacccgacgcgcagccgtaagctgctgctaaagcaacgtgaactcgactccctgtatggccgcgtcaaccgcgaaggctacaccatcgtggcgctgtcgctgtactggaagaacgcctggtgcaaactgaagattggtgttgcacgcggtaaaaaagagcacgacaagcgcgatgatatcaaagaccgcgaatggcaattagacaaagcacgtatcatgaagaattcaaagcgttaagcactggattttgacttgttttgttgttagtatatgaggttctggggctgattctggactcgacgggattgtgaagccttaggagcatgccgaggggcggtttgcctcgtaaaaagccgcaaaaaaatagtcgcaaacgacgaaaactacgcactagcagcttaataacctgcttagagccttctctccctagcttccgctcttaagacggggatcaagagaagtcaaacccaaaagagatcgcgtggatgccttgcctggggttgaagcgttaaatccaatcaggctagtctgttagtggcgtgtctgttcgcagctaaccggcgaatgtaaaaactgactaagcatgtagtgccgacggtgtagtaatttcggacgcgggttcaactcccgccagctccaccaaattcttggttgatggttaccagaaccatcatcgaagtcctgagagcccgcaaggtcaaagccttgcgggcttttttgtgtcctcaatttgtcccgcgcagtccgaagagaactaattaaatccggaccttttaggcactttgttaggcacctcctgaagctttaatgtttttgaggtgcctaaactatggaaacccggcaatggaaagacaaacctctctccgttaaggaaatcgaatctgccaaacccaaggaagcggactatgtgctctatgatggcgatggcctcgagctactgatcaaatccagcgggagtaaaatctggtagtttcgctacaatcgccctgttaccaagaaacgggcgaagaagagcataggcccctacccgccagttaggcttgccgatgccagaaactacagggcagagtctcgctctctccttacgaaacaaatcgatccacaggaacatcagcaagaaaaacttcgcagttcgctggaagccaaaaccaatactttccaactcgtggctgaacgttggtggaatgtgaagaaagccagtgtgacagaggactacgcagaggatatctggcgctctcttgaaagagatgtctttcctgcgattggcgacgttagcgttacagatattaaagctcacacactggttcaggccgtccacctggttcaggccagaggagcgctggaaaccgtccgtcgcctgtgccagcgcattaatgaggtcatgatctatgcccaaaatacaggtctgattgatgcggtgcctagtgtcaacattggcaaggcctttaagaagccgcagaagaagaacatgccaagcattcaaccggatcagctacctcaactgatgcagacaatgcgaacagccagcattagcctttccacacgctgcctgttcatgtggcaacttcttactattacccgccctgccgaagcggctgaatctcgctgggaagaggtagacatagaagcgcgagagtggaatattcctgcagcgcgcatgaaaatcaaccgcgaccatactgttccattgtcagatgaagcaattgcgatactggagatgatgaagccgttaagtggaaatcgagaatttatctttcccagccgcatcaagccaaaccagccaatgaacagtcagaccgtaaacgcatcgctaaaacgctgaggttttggtggggtgctggtttcacacggtctgagatctatcgccagtacagcccttaatgaacaaggctttccacctgatattattgaggcagtactggcccacgtggataagaatgaggttcgtcgtgcttataaccgcagcgattacctgaagcagcgacggtcaatgatgcagtagtgggctgattttgttaacgcggcagatagtggcagtatttttgaaggaggggtgaaaggaatgcgacttgttgggtagtatactggagctggagtctactctgtctttacttgggctagagtgaatactcttaaaattagatctaccacatgagtgaagttaaaccctgtttataagcagggttatatatttttgttctggtttttcagtttaagtcacttttggcagcctgaatatctgcccgttttgcggagtattcccactcatcagctattctaaaaagcattgcagaagtacgaacacaatgtggcatcgaacttgcccattcgcggtattgttcagccaattttctttcttgttgcccaccttcatatagcatccttgtaaataccccccttttattatacagaccaatttgaatacctttctctaattcatcagaagataatttttcaatgatgtgccgaattgcttcatgaggccaagcattatctattgagctcttaggagcatgtgccagaattttacctatgacataatccgtgatgtcttgacgatgatgtagtttggctaaatgacgcacacttacacaccaatcttcaagcatcttctgatcaatgttattcttttcctgccctggaattatccgtattttttcaagtaatctataaacagaagttgctcttttgacctcgagttccgaaagttctctttgtttatctttgtcgctacgataaacaatacatattgcttctataaaaattccaggctgcttcatcattagacgatgtaaaatgaatggttcatctctatcagaaaaacaaggtaaatagatcatttctttaaatgccaatgtattctcagaaacatcacttcgtttttgaagctcatcaaatacctttgtaatataaaatgaaatcattgaatcaaatttaatttcttgattatttatttctttaacaacaatatctaaaagtgctaaaagtgtaactgatggcacatcagaaagacgttgactggcggatatgatagcagaaagccctctctcccaagaaatatatttatctatgataagcaataaatctgaaacctcacctttcacagcgaaaggttgtttttgtaaccaatagcttttgttaatttcgtatccaaactcttcaatagcgcgccataccaactgagaatctcttaatgaagccagtattttcccagccctatcaggagcgatcccaacctgttcaaaatagacatttattttataaagccacttaattccaaaacgttccacaccatcattaattaataacccacaggcatcatcaatgtttttatcgctattaatgagcaatacaaacaaatcaatagtctcatcttcatttagcgaaagtgcggggatatgttttgccgcaatataaatattattaacttgttgaaaaaggtttaacactccttctaattttaaagaagaatatatctcccttagcttgccaatttgcatatcttcgacagtagaaaatcccccaccaacatttagaattgactcttcgatatcgctgacccaatcattgaaaacccataaccctgccttaactagatcattaggttgataaacctcaagtattatttttattttctccataaactcatatttaaatgaccaattggcatctgaatattttttgtggcgagaatactcatggcgcaacgcctcccatacactaaatcgctcattttcagtttgtttatcgagacaattttttaggtgaacaaatgtttcatccattacattttcaggaaatgagctcatatgagaaattagagttttccatctttctggtaatgtacctgcaagtagaattgcttcttggatgacaaaagtctggccctcccaaacaacaccccatgttagtttttctatatccttagtcgactctctgaatttcatttttgagttttgatcagaggtatcatgggaacgaggaagaagattctgtaacaaactccaacctataccaggaactatagtgataatttttttaataactgcatttctaactttcactggcgcccatgtattaggagaccatgccagaaaaatggttcttaaactattaatagggcgatccgagtaagtccctccgggatcgattacggcgagttttgcaagacacgttgcggcacgtaacaagtatgtttgttcccaagctaaggcttctaatgcccattttaatccatgataatgactttgtggagctaacagccctttatcctcattaaatatcgggacaataatctctccattgcccttaagcaattgctcaagggcattaaagaaagggtctggagcagcttctgccagcagcggaagttgatctcgcaaactaacaaacagtcgatggtcattagcaagcccaggaatactttggactattttgttaacgaaatcctggggtgacatacccgtaacccggaattcggcctgttcatgtaatattgccatatgcagcaaaattgttgccattccattgcgtaaccacgagctataagacgttttaatatcattatcaggtacaaagagatcttcggacttagggggtgtagggatataggaaaaaacgtctcttacagccgtctcaaaacgccctaaatgttcttcacccaataaataacctaaatgtataaaagcatctaccgacgatcgcaatgaccaaatatcatccactcgatcaattggcgaatctcggcgtcttattaacggtcttaatgggttttcaacttgagaatagtctgcataacccgctaattgcttgagaattgatttatctttttctgaacatgtactccatgcgccagcgagtaaagcaggaagcaactcagggttatctttccattctggtaattcagccgtgctacttgatatctggcgagctaagacagacaaacttcgaccacactgccgcgccatttgataacttttatctgaatcaaaccccatggattcaagagccttacctaaagatatgctatcaggacggctcagaatttcgtgattagttttcgtgtttcatcagccccagcactcactacggtgatagatgattgctgtaacaagccggccaaaaatcttgctcgatcacgaggcaagaagatcattcctttttttccagaaagctgccttgcggcatcgtccgtatcaataattagtgctcgactttgaaaggaatgtcgaagttctaattcggtggttctgatagctgcaatcgcaaaagcaataacctcatctggggaatctgcagctaaagatatttttcgaccattctctcgtagatgatttaaaaaacgctctttttgcttttctctccccgccagtaagactgcttcagttaaaggaggattaaatttagtggaatattcatcccaaaactctttaatacttctaacaccaacttgtggcatgagctcaagatggtagcgagcgtagtaagcagctacagcagggcaagcactgagccaatcttcaagcatagaaccatcaattaatttgatatctttccacttaccactgctacgtttctcttgtagccagtcttcaagctttaccttaggattatcccatgttcttaatgaagcgaaaacgaaagtagtcttcagacgtatctccggaacaacttcgcgtgttctcttttcgtaatcagagttaactttatcgagcaatttttcgttaacaccaaattcccaaaatgaatcgccatcaggaacatacgctccctccccttcggctttaagtacaccgtcataacctctaacctgtcccttatcaccattaggaaatctaatttcagtaatattgttagccgttgcacgtataaggtcagcaactagtgctggaaaaatgacttttgctggaatagaatcagcccattgctgaagatttaatgcttttatccatttcatatttgtattctgcccaataaaattttaaacaaccaaaaaggtacaaaaaatcagcatgtacaagacattttccgtgcacacaaaattctaacaaaacactaaagagtaaaaaaaccgagcttatttcttgagtttaaacattaacctattttttaactcccgctaaatctactgttctatagttaatcatcaagttagtgaaatttcttgaactggaatgctccttaccctgacgttcacatcaagtatgagcctgtgctttgcgcataccatatccttgattcagtcatactgatagttctatgccaaagtggatatgatcaacatcacaattctgagtcaggaaaacttaactaattgatgacactgagttttcaacggacattagtttcgtcattggttatactaagggtaactttttatatggccgcagtatctataatagggttaggatgtggcaatctttgacattgaaaaggacgaattacttcggctcaccgatactcagctagaagagctgattgctcggctagcggaagctgaagtagcaatgcatgaccatagccctgcgtgtgtaaattggtctggttcaatcactgcccctgacggaggaattgatatccatgttcaggttccagttgatcaactggatgcaggctttctggtaaggcctgatacggtctttcaggcaaagaaacataggatgccaaaggttgcaatcgagaaagagatgggcaccagtaaaacactttcatcgaccatttctgaacaagccagaaagcaaggcagctacatcattgtcagcttgggcgacgattgctcgccgtcaggaaagacggatcgtctcaaagcaatgcgagatgcggtaaaagacgatcctaacgaaagcaatcttcatcttgatttctacgaccgtttccaaactcattcaatggctgcgccaacacccttcagtcatgctgtgggtaaaagagaaacttggacaagggtattctggttggcaaccatacggtacgtggagtaatccaccacaaggtgttacggacactttaatctcagccccaggtgtaactattactttaccgtcgggaaaggggcaaaaactcaaaattgaggaagctattaatccaatgcgggcacttattcggtcgacgaataaggtggttcgtattacaggattatctggtgttgggaagacccggattgttcaggcactcttcgatccaactgttggaacagatgcgttagaccggacggtggcgatttatgtcgatactggttctgagccagtaccgtcggctacagcaatgcttgataagctggttgctgagagccgacgagcaatcatgatcattgataattgcccatcagatctccatgcttcgcttgctagcaaagtatcaactgcaggaaaagaagtaagactcatcacgatcgagtacgacatcagggatgacaaaccacagacaactgaggtcatccacattgagacagacggtccggaggtggcaaagcaacttcttatccgtcgcttcccttctattggtcagaataatgcccgtcggattgctgagtttgcagatggtaatgcaagagttgctttggctatagcagagagagtggaggaaggtgagagtttagccctactttcagatgctcagttgtttaatcgcttgtttgaacaacgtaatcatcccgacggccatttacgggagcaagctgaaatattgtcactggtgtattcgttctcggtatctaattctgatgttgctaccgatgaactagaaatattgggtgcgctctctgggtatcccaaaatccagttattcaaagctgctacgaagttaatggaacgtcacatcgttcagaaaagatcccactggagagccatccttccccatgccattgctaacaagttggcagcatctgcacttaatagtattccggttgatcaacttagggcggcctttgaagctccggagcggcaacgattattgatgtcgttcgcgcacaggttgggattattgcacagccatgctgtggctaaagagattgttgaagcttggttacagcccgaagggctgcttgggaaaataataaacctagatgatgcatcgacacgtattctgaattatgtcgctccagttgcccctggagctttgcttgagcggattgaagaaacgcttgttacgtctcattttgagcatgttaaatcaccctacaacccaaaaagaacagcaattatcaacttgttgcagttacttgcatatgaatcgaaatactttgaacgatgcattaagctcttaatctgtatcgcagaccaggaaagcgcgagcaataattttgattcagctcgaaataagataactaggtttttccaaccgtatctatccggtacccatgcctctttagatcaacgtgttgcgatcatgaatgaatgcattggttcaggtatggccggacgtagaaggctggggctcgaaatgcttgaaacggccctcgacggaccaccgtggacaggattcgggattaatgagtttggtgctcggccaagagattatggatttcggcccggttacgatgaatttgttgcgtggctaatcaccttcatcgatattttggtgagattaggaaacctcagaagttcccgagcttgaagacgatgccaggaggatcttggctggtaaatttcgcaggatttggcgtcatggaggaataaggtcaaaattaattgatgcggttcgtaagttacatacccatcgcccttggggtgaaggctggaaagctgtacgctcaacaatttattttttccatacaaaaagaaaagataacgaagacgtagaaccattgccggaaatacttgtgacattggaacgagaattagagcctaatgacttggttcaggcagttatggcttatgtactcagtaaggggcgcgatttttgggcgctagatgctgattatgagcaccaaggacctaacaaatttagtgaaatcaggaaactacttggtgccaaagctttcaagttgggacacgaatttgcagtatctgcccatggacttgatgagttgtgccctaatctttttttgcgggatggaatgccctatcgcgtcgaatttggtaaaggcttagctaacggggctcctgacatacgaatttattggcggcaactagtcattcaattggatctacaacacaaatctcaaagtgatttttcggtgattcgaggtttcattgaagagactaattctatcgattcagcattagcgcaggaacagctcgatcagtgcgcacaacattctgaacttcgattggaattagtcaacctgcatccttggcaggagtttactgaaatcgatctggatcgctgcatgtcgcttctagatgactctgacatacggccccatatgtatggggcgattctgtggggtgagcaattctctaatttgccagaaagcagtgttctcgagcttgctcataaactgctgagtaaaccgaatggtgatgaagtagtattggaagcactgagtatgaaactagctgataaaggagatgctgcggatacactaggtcttgcgctacgaaacgatcggactatctgctgcaatccagaggttccgaagagatcacaacgattccggcgggtatatagattacgcaatgaaacgtgttatcgatgccacattgcacttcgatggcaacgagactgaaaagttagaatggctaaatacaatcttcgctgttgttgatgagcattatggctacatttattctttcgaagacgctatcggtatcaccgctgcatggatgccaaaagaatttctcagtcgcatttttgatggtacggaagatcaacaacagaggcgtctgcatttcatcaatcattatgattcacatcaatctcctattgcgaaaatcgatgtagatattttgattgaatggtgcggtgccactaaagatcctcaggtttgggcttcagtcgcttcaggtattaatctatggtcaaaagacggtgagaatagtcctatttgcttgcaagatgatgcactgagatttctagaagcctcacccgagccaagagccgtccttgagatctttgccgaaaacgtagcaccttcatcatggtccggtagtcgtgcgaacgtgatgcaacctagggttgaagcgataggccagttggtcacgcacgagcgtgcagacatttctaagtcggctagagctgtgtatgaaaaactgactaactgggttgaaaaggaaaaagaacgtgagcgattggaagatgagacattggaacaacggtttgaatgaaggctagttggcctgcccccagaattagatacaacgctcagttaataatgtcggatccttcactctcagaattactctttctccagcccgctgcaaattcagacggcgtctgataattcagcatggagtgcgggtgacattcgttataatcctgatgccattcgcttatggttttcctggcatgactgacgtcgctgaaccagtgttcattcaggcattcatcgcgaaagcgtccgttaaaactctcaataaatccgttctgtgtcggtttaccgggctgaataagccgcagctccacgcaatgctcaaaggcccattggtcaagtgctctacaggtaaactccggccccttgtcagttcttatcgtagccggatatccgcgaaacagcgcaatactgtccagaatatgcgtgacctgcacgcctgaaatccccaaggcaacagtgacagtcaggcattcctttgtgaagtcatcgacgcagttaaggcacttgatcctgcgaccggtggccagttcatccatgacgaaatccattgaccaggtcagattgggcgcatccgggcgaagcagcggcagacgttctgttgcaagccctttacgacgacgtctgcgtttaacgcccagcccgttcagatgataaaggcggtacacgcgcttgtgattaaccagaagcccttcacggcgcagtaactgcaatatgcggcggtagccaaaacgcctgcgatccagtgccagtttagtaatgcgccctgataaatgggcatcagccgccggacgctgagcgtcatagcgccaggtcgacagtgacaaacctgtgagtctgcaggcacgacgttgcgacagaccggtcgcaacacacatcaacaccacgacttcgcgcttctggtctgtcgtcagtactttcgcccaggagccacctgaagcgcctccttatccagcatggcctcggcgagcagtttcctgagtctggcgtttctcttcctcaagtgacttcaggcgcttaacctcaggcacctccatgccgccatacttcttacgccaggtataaaacgtggcgtcggaaatggcgtgcttacggcggagttcccgggcagaaactccggcttcagcctcgcggagaatactgatgatctgttcgtcggaaaaacgcttcttcatggggatgtcctcatgtggcttatcaagacattactaccatcgcggtgtattaatcaacgggggagcaggtcaattgtaccaagtgactaaattttgttataaaaagccaacaatcaaacaaaagacactaattaattatgaataaatttgatatagaaaaaatgctattagaagaggggtttaccccaaaggaagtttctgtgacacgtcatcatgctgagaaagaaggttatccttatccctggctcctttcacagttaaagaaaagattcatagttgcaatgatattaatagcaatccttctggcaggactcatttataccattagcagtggtacacaagaaaaaattgtatcttattcgataacgctgttagcaggcttcacaattctgtatacttttattcctttgaaacctgcatacaaagcatttaattttttgagaaaacactctcatgttttataaagtcgctaatgaatattttcatttatttaatcgaagaatcgcattacctcttccccctacagcaatacattcaccactaaagacatctatataatatttaattggatttggcatgttttccatcatccatggaagatcttcagaaaatttcaaatctgaggttgaaataacccaaacagatttaccatcaaaagacgatctaacagcctcatgaaaacgttcgtcccaaccatgccctgttacccttgcatattctttggcaatttcaacagctttattttccgatatcattgctgaactccataccaaacattatacatcaaccctccaaccactactggccccaaaagaatacctgcggtttcatgccgcaataatgtatatgtaatttcgtaagtatttccaagagggaatttgaagccttcaatgatatatcctctactcatccctctggctcttaataagccaatagtttcagcaagcgactcttccagatatcgtaatatatatgatttattatatgcgctttgtctcatgaaaaccctaagttctcttaataaatagaacttaggcgcaattgccatgtgtacctgttcatgataaagagttgaaagcatctgcaaatatgcgtcatctttcgacattgcaccaggatagtagttgcgtcctacttctacgtccccccagggttttgtgcgtccctgaaacgacgtcactatgctttgtgatttttatcttaggagtataacgccaacctccattgcgaggcaggttcattttccttccaatatcgctgctgtatctaggcatttttactcccctgaaaggagttttaaatgtatcaccaggcttcttctttaaaagaagtgcgaggacagtattaacgcctaacagagtgatcgcgtctgctaaatccttagcagcaacgtcaagatctccttcgctacgagctgcgttagtcttcgttgcaaaatcaaacaacttcttagccgcttcaagcgctacgccccctactgctacccaacctacaatgagaagcactaaatcagcgatttcaccaatcccaaaaaagtgcgcaccagcccaaaccacgattacccccgccatagttgctaatgctgagggggtgaccatagcaagaagctgttgacctacgtcagatggtaagagcactgccgctttcgagatgactagttgtagccttgactgtatatcgctagggataacttccattctctatcctcagttatatgttaagctgcctgcagaataactcttgaatactgcattatccagtagttttgcttatcatgtttgtttgctctgaacgaagaagatatatccacttatcatttagcttttttaaaaatttattataaactgacagcattaaaattatgatttaaatcaaaagcccaacctaaccctgtataataaaaatataaaaatcgagagtggtaagaaaaagagcagcttcccgctttcaatcccgttatcagaaatctatgtaaatgaaatcttaaagctgacagaacacgatgcaacaacatgggctcagaaggaaagatttgtacgttatcttgagcgttatagaactggtcttcttaacaatcagcaattgcaggataagtaattaatccaatacctcaacgacctgaaaagataagtagcttgatgaagatgatgtctctgacaggcgctggttgaacagaaaagaagtctgtggtatcgcagaacttgcaagacaaaggctggtggcaggtcagagccgctccatagtacatgaatggtctacagtgggactggcagggatcccaggttattcaggttatgtaggcaatgcagcgaaagcggcaaaattcttgaaatcaggtggttacataggaatggggtttgcctttgctggaaccacgaatgatgtagtcaatgcctgcgttaaaggacgtgagagcgaatgtaaaagaaccgcattcaaagaatatggtaagtttggggcttcgaccttaacgggtgttggagctggtgcagccggtttctttagcaggcgtaggtatatgcgcagcaatagggatcgccacggcaggaaccggcgcggtagtctgcgcagctgttggctcaatagctgcgggctatgtaggtgctaaagcgagtgactctgtaatggatactatctatgaatacatgggaatttgaagaatgaagtcggccataatggttttaatcatgcttccgttggtttgcttagtggtaagcgtttttttgtatctaatgaacaggtctcgctacaaggaattgatctcagacttccaacaacagcatacactgcccgccccttacttgttgcactgcaatataggatatataggttcacctctaatgacctatttttttatgcgattaaaaaaaaataaaaaaattttctttttaaacaggaacgacaatgcttataactttgcacatgaaggtcaaaatctaaaaaaataaacaatttaaaaccattatattatacatttttattagggtttttctgttgcttttcactttccattattgcaatactgatcaaagctcaaataatttgatcatgttaataaaacattcagatagataattttccataccatattttatggttcaccttaaaattagattgtatagtgaattatgtctctggattagaaccaggcgggcatacgcttttaaagcatattggaaaatcaccccaggaacttcatgaaagaattatccaatccaatggggtattggatctatctggttcgttctcgtcgctggagattgccgaagcgatcgtgaagatctaaaaaaagaagtgatgaaccttctgacatatgatgatgaaatgataaaatcagagttcagagacaggtatattaatacctttgcaccggaagatggtaaagggttgcttctgcgaatactcgaaagtatcaacaagtatagtgaccatggcaatcccttattaacgagcattggtgttcgatggagggttaccagaacttcgtcgaactcctcaaagcccgcgagataaacgtactgcgggctttttgtgtctgtgcagccctgcggccttccgtgcgaatgcgcttcaggcatgtctatcaacattttctgcaacgtcattactatacctccttccgcctccccactcccccctttacagccccaacctaaacacgaaataatacccctttacgccgggccacaacgccctgccaacgcttaaacccaaactcaactctgcggacaccctatgaataacgaaatctctctcaaatactatgatgtcgcagatgagtatgcgacggagtccgctaagccggtgagcgaagctgaacgtaccccactggcacattacttccagctgctgatcacccgtctgatgaacaacgaagagatcagtgaagagtcgcagcaggatatggcgcgtgaagcgggtatcgatgagcagcgtattgatgaaattgccgagtttctgaaccgctggggcaacgagtaacagacactcaccggcagacgagctttgcgcagtttcgccggttaatcagcctgacttagtaccgcagcgctacagcgccggtattcccataaaaacgcacaatgctgacagccacgtgtcccacgtggctgatgtccgttcccggccctaccgacccatcttcgtctttatctgccgctacacacactccatcacacacgccttcatccgccacaaagtcccccttccgccgctcaccctctggcgcacctgaaaattatcatccagacttatatagtctgcgcaggcattgtgttttacactgcgcgctgtaaaaaactgagtagattaagcaggcaaaaatggcgatgaacggaacgatcacaacctggtttgaagataaaggttttggctttatcaaagatgaaaacggtgataaccgctattttcatgtgattaaggtcgccaatcctgatctgatcaagaaagatgcggcggtgacgtttgaacccaccaccaacaacaagggcttatccgcctatgcggtgaaggtcgcgccgacaagcaaatacatctatatcgcaggcgagcggctcaagatcacctcgattaagtcttatctggtctacaacgaagaagtcccggtcgatgccggtgtcgataaagagaacgcggtgttgtcagtgggtctgttgctgaataatatccggccgaaaactgacccgaacgctaatgagatgcgctcgctgaaaaagctggcggtcaccaccttccagggtacgacactgatcttctccgaagatgagatcgacattgaaagcacggttaaagtgcttaaaggtctgaagtaatcccgcaggcgggccgaaattgtgttggcaggatttcggccttcaggcgactgccagcctgctattcaggcacatttctctgacacgaaatccccgcccacagggctgatacataacaaagcgttgctctggcggataaaaccgtcctgctctcccctctaatccattgtttatgataaaacaaaggtcaaaagcgcagctcatcaaggttcatccccacaaagcgactttccagggtagaattagaaactttgttcagtcattgccaatgttttccatcatcgcaaagtgatacgaaaagcgggtgaaataaggtataaagccgcatgaaaatcccaaacagaatccagcccctggtcgatgacggcctgattgacgatgtcctgcagcggctgaaaagcggcaaagaagcggacgtctataccgtgctatgcggcggcaaggtgcagtgcgccaaagtctataaagaagcgacccagcgtagcttcaagcaggccgtgcagtatcaggaaggtcgtaaaacccgtaacagccgtaacgcccgcgccatgcagaaaggcacaaagttcggccgtaagcagcaggaagagtcctggcagaccgccgaagtagatgccctgttccgcctggcgaaacgccggtgttcgcgtgccacaaccttatctctgcatcgacggtgtgttactgatggagctggtgaccgatgccaatggctcggtcgcgccacgtctcagcgatgtctctctgtctgaagagcaggcggtcacggatttccacaccatgatccgcaacatcgttcgtatgctctgtgctggtatcgttcacggtgacttatccgagttcaacgtgctgctggatgaccagggcccggtgattatcgacctgccacaggcagttgatgcggcggccaataaccatgccgagtcgatgtttgaacgtgacgtagacaacatcacctcttactacggtcagttcgctccgcagctgctgaagacgcgctacgccaaagaaatctggctgctctatgaagatggcaagctcaccccggaaacgccgcttaccgggaagtttgtggaagaggagcgcgtagtcgatatggattctctgatggatgagatcatcacggcagaagatgaatattacgagcgccagcgcgccagccgtgagcgcgacgaagagtaactgcctcaataaaaaaggcagcgagtcgcctcgctgcctctcacttaccgcactatcacaacgccatcaccgcacgatgaccgtcagcgcaatcagagttaagccgatgatcatcacgccgacaaagaccttatcgagcctgctttttttcatcttctcctccctagaaccactgaccaaagcgacggatatagaaacgcttcatgccctgcgccaccaggcagtagctgaacagcgtcagcaccagccacgggaaatactgccatggcagtggcaccagaccgaccatcgcacccagcggggagaacgggatcaggatgcccagagccatcactgccagcgtagtcagcatcaccggtaaggtggcgcggctctgaataaacggaatcttccgggtacgcagcatatgcactaccagcgtctgtgacagtagcccctcaataaaccagccggactggaacagcgactgcacgcctgcatggttagcgccgaaaacaaaccacatcagcgcaaaggtggtgacgtcaaaaattgacgaggtcgggcccatccacagcatgaagcgtttgatgttgccggcatcccatttacgcggtttattcagaaactcacggtcaaccttgtcccacggcagcgccagctgggaaacgtcatacatcaggttctgaatcagcagatggatcgacagcatcggcagaaacggaataaaggcactggccaccagcagcgagaaaacgttgccgaagttggagctggcggtcatgttgagatacttgatgatgttgccaaaggtctcgcgtcctttgagtacaccctcattcagcacctgtaaatccttctccagcaggatgatgtccgatgaggctttcgccacatccgccgcgctgtccacggaaatcccggtgtcagccgcccgcagcgcaggcgcgtcattaatgccatcgcccaggaaacccgacggtgtgaccgttctgctgcatcagccgcaccagacgggatttctgcagcggtgtcagctgagcaaacagggtgcagcgctcggcttcctgcgccagctcatcatcgttcatcgcctcaatctgatcgccggtcagcatggccggatcggtcagcccgacatcggcacagacccgcagcgtcaccagcggattgtcaccggtcagcactttcaccgtcacaccgctgtcacgcagggctttaatcgctttgcccgcgctggctttaggcggatcgcggaaggtcagcattccctgaataatcagatcgcgctcatcactgtcgctgagcggcgcgtgcagctcgccatcacgggttgccaccagcagcacgcgatagccctgctgatgatagtgttcggtctgcgccagcagcgccgcgcgctgtgctgcatccagcgcgaccaccgtgtcgccctggcgcacggcaatgctcactgccagcatctcttccactgcgcctttacagatcagttgtgaacgatgctgagtcagatcttccaccagcaccgacacccgacggcgggtaaaatcaaacggcagctcatcgatcagctggaactggctgcgctgagactgtgaaatgaccttgtcgcccgcgcagagtaaggcgcgatccatcaggtttttcgcgccactctggctgccgctattgagccatgccagcagcagcacctgtgcatcttcgttgccccgcgcatccagatgatgcgccagcaggatggtgtcctgggtcagcgtgccggttttatcggtgcacagcacatccatcgcgccgaggttctgaatggcgttgagctttttaacgatcactttgcggcgtgacatcgcaatcgcgcccttagccaggttggcgctgacaatcatcggcagcatttccggggtcagtccgaccgcgacggccagtgcaaacagcgtggcatccatccagtcgcctttggtgaagccgttaatcagcagcaccaccggaaccatcaccagcataaagcggatcagcagcttgctgacgctgttcaccccgcggtcaaaggcggtctgcggacggcttccggtcagcgatgaggccagggagccgaaccaggtttcgccacccgtcgctaccacgactgcgctggctgtgccgctggccacgctggtgcccatcaggcagatattcggtgatgccagccgctcctgggcggtctgaccttcggcatcgatacccgcatcgctgctctgtttctcaaccggcagcgactcgccggtcagtactgcttcactgataaacagattacgtgaactcagcagacggacatcggcaggcacctgatcgccggtgctgagcagaatgatatcgcccggcaccagttcactcatatccacatcctgacgctgcgcggtttcgctgcctggctcacggcgcaacacggtgacctggctgcgcaccagtgacttcagagcctgcgccgcacggttagtgcgaaactcctgccagaagcgcagcagcccgctcagcatcaccatggtgaagatgatgatcacgccggagagatcggtctcctgaccggcgcgcagcggcagaatatagtcggtaaacaggctcaccagcgccaggaccagtaatacgtagataaacgggttattaaacgccatcagcagctgaatcagcgcgggtggcgctttctcatgcgccacttcattacggccatacaaagccagtcgtttcgccgcctcagcctgagtcagaccctgacgctgactacgcaggtttcgccagcgtcctatcaatgtgctggtctgcctgctgcgccacggcaaacatttttttactttttttatcattacggttgccggatgaagtgatcgcaacctgttccagtttcatgtcgctcatttcgacatctccctgatttaaagcaatagttgtcctgcacgggaaataacgtgcatggataaaacctggcgtagccgggttatttaatggggtgactttcagaaacagtcaggttattccgcctgcgcgataaataatgacgcgcgcagggttacctgacgccggttatacgcggcgttttaaaagtctgatatcagcgattgggcgcagcctgggctacgccagacggggcggaggaaaaagagcgaatataaacagcagcataacgcgcactcctggtgatgacaggattaaaattaaggagcgcgatcgttaattaaagcggggatcgctgctcgccggttggcaagcagcagaggaaactcagcttgccagaataaaggttaatctcgggtgactgtccaactgaattctcctgaagttatctgccgccattataaagagaggccggcttcggtaaagcaataacgtattgaataacagtttcgttgaggatttgtttctgctcaggttgccgcttcggtaacagcgtggcgatcttcttataacctccaggtaatccttataaccttttggcatatgattagcccatattcgactattcttcgcatcggccctttcgtaaactcgcgtaactttttagaggcaaggaaatttcatgaaaactataattccatcactgctggcgctgacgctggctgccgccttcacagcccaggccgcaacaccaaaagatacgctggtgattgcacaatcaactgacgacgcagacagcttcgacccggccaaagggtttgaactgaccagcgttcaggcttttacgaacatctatcagcgtctggtgcagtctgacccgcagaatccggtggatctgaaacctacgctggccacctcgtggcagcccggcagcgacaaccgcagcctgacctttgaactgcgtaaagatgcgaaattctctaccggcaacccgctgcgtccggaagatgtgatcttctcgctgggccgcgtggtgaagctgaacctcgatccctctttcatcctgacgcagctcggctggaccaaagataacgtcgatggcttcctgaagaaagtcgacgacaatcatgtgcagatcagctggaccgccaacgtcagcccaacctacgtcctgagcctgctctctgccccggtttcgtccatcattgatgaaaaaaccgcgatggcgaaccagaagaacggcgatttcggtaacgcctggctggccacccactcggcgggcagcggcccgtatcagatccgcaaagtggtgatgcatcaggtggtgctgctcagcgctaacccgacctcaccagcgggcgcgccaaaaatgaagaacatcctgatcaaaaacgtaccggaaccggctgcgcgtcgtctgctgctggaacagggtgatgccgatatcgcccgtaacctgggtgccgatcagattgctgcgctgaacggcaaaccgggcgtgaagacggaagcgattcccatggcgtcgctctactacatccagttcaacatcggcgctaacgagacgatgaagaacccggccttctgggaagcggcgcgctacctgtgggattacaaaggcatcgccagtgagctgctgaaaggccagttcgacgtgcatcagagcttcctgcctaagggcttcctgggcgcgatcaacgacacgccatacagctacgatccggaaaaagccaaagcgattctgaagaaagcgggcctgaacaacgtcaccttcaagctctccaccagcaaccagccgccttatctggatatcgcacaggcgctgcagggcagcttcgccaaagcgggcgtgaaagtggaagtggtgccgggtctgagctccgaagtgtcgaccaacgtgaaagcgcataaatatgaagcgacgctgaacgcctggggctccgactatttcgatcccaacaccaatgccgcctcgtttgcttacaatccggaagatggcagcaaaaccatcgccttccgttcagactggcacattcctgagctgaacaagcaggtgattgcggcgaccgccgaaagcgatccgaagaaacgcgtggcgctgtatgaagcgatgcagcgtgaagtgatgaagaactcaccgtatgtgattgggatgcaggctaagaacctcatcgccctgcgcgacaacctgaaaggctatgtgcagggcattaaccctgacatggtgtattactcgcaggtcactaagtaatggcacagtctgttccttcagccgggttcgcccggcttttttggcagcgtggcgggcgcctgatcggtagcgtactgtcgctgctggtcacgctgcttggcctgctcgccttcacctttatgctgtcgcatctctcgccgatcgacccggtgcagcagatcgcgggcgatcacgccagtgaagcgacctatgagcaggtgcgtcatgacctgggtctcgaccagccggtgctgatgcagttctggcgctacgtcgaacatctggcgcagggcgatctgggtgtctcccgcctcaccaatcagtcggtgagcggcgacctgatgaccaccttccccgccaccatcgagctggcgacctgcgcgatgatcttcgcggtggtgttcggcgtgacgctggcgctgctggccgcctggaaaccgggcagctggatcgataatctcgcccgctttgtctcgctgctgggctactcggtgccggtgttctggctcggcctgctgggcctgctgctcttttatgcggtgctgcactggtccgccggaccgggacggctggatgatatctgggtctacaccctggagccgaaaaccggctttgtgctgatcgacagctggctgtcgggtgaaccggagatgttccgcaatgcaattgcgcacctctggctgccggtggtgatcctcggcctgctggcgatggcgggcattacccgcctgctgcgtgctgcgctgctggaagagagcagcaaagagtatgtggtgctggcgcgtgctaaaggcgcgggtcgggtgcgcatcctgctgcgccatatcttccccaacgtgctgggcacgctggtcacggtgatcgctctctcctacgctacgctgctggaaggctcggtgctgactgaaaccgtcttcgcctggccaggtgtgggtcgctatatgaccaatgcgctgttctccggcgatgtgccggcgattctgggctcaaccctgttaatcggcagctgctttatcctgattaacaccctggcggatgttttaacctggttaaccgatccgagaaacccgatgacgcaacaactctctgaactcgaaacgctgcgaccacgccgtcgccgtcaacgcgttacctcgttaaccgttgggctgacgctggtggcgattcttatcctgatggcactgctggcgccgctgattgcgccgttcgatccgaacgtgcagaccatgtcgagccgtctgctggccccgtcggcacagcactggttcggcaccgacggctttggccgcgatctgctgtcgcgcgtgatttacggcgcgcgtccgaccctgctgctggtgtcgctgattctggtgctgaccattccggccgggctgctgatcggcatcaccgccggttacgtgggcggctggaccgaacgcctgctgatgcgcattaccgatatcttcctgtcgctgcccaacctggtgatcgcgctggcgctggtggcgattctcggccctggcctgatgaacggcgcactggcgctggcactgaccagctggccgccgtttgcccgtcaggcacgcgctgaaaccctggcactgcgccgcagcgactaccttgccgccgcgcggatgcaggggattacgggctttcgcctgatgttcggtcatatcctgccgctctgcatgccgacggcggtagtccgcgccgccctgagcctgggcgggattatcctggccgcggccggactcggtttcctcggtatgggcgttcagccgccgacggcggaatggggttcgatggtggccgaaggcagtaaagtcatttttgatcagtggtgggttgctgctgcaccgggcgcggcgattctgtttgccagcctggcctttaacctgacaggcgatggcctgcgcgaccgactggatacccgtcatgcaaaataatctgctccatgccgaggggctgaccattcgcagcgacgatgcgctgctggtcgacaacatcagtttttccgtgggtcgcgagcgcgtggcgctggtcggtgagtccggttccggcaagtcactgaccgcccgcagcctgatgggcttactctcgcccgcgctgcatctgcaggccagccagctccaggtggccggtgaaaatgcgctgacgctaagcgagcgtcactggaaccagctgcgtggtaaccgcgtggcgatggtgatgcaggacccgaagtatgcccttaacccgacgcgcaccattggctggcaggttgaagagccgctgatcctgcatcgccgcctgagccgtgccgagcgcaaagagaaagtgtgtgaaatgctggatgcggtcggcctgcccgatccgcgtcgtctgatgcagcagtatccgcatcagctctctggcggcatgggccagcgcgtgatgctggcgatcgccctgattaccgatccggacttcctgatcgccgatgaaccgacctccgcgctggatcatgccatgcgcgatcaggtgctggcgctgatccgcggtctggtggaggcgcgcaacatgggcctgctgctgatcagccatgatttgcagcaggtttcagaacattgcgagcgggtgatggtgatgtataaaggccggttgctggatacactacccgctgccgatctgccgcacgctacccacccctacacccgcacgctgtgggcctgccgtccgggcaaagcgacccatggacagacattaccggtgctggaccgcgctgcgctggaggcgaatgatgattaagctgcagaatctaagcgtcgcccacaaacagggttatgagctgcgcaccgtggtgcatgaggttaacctggaggttaacgctggcgagtgttttggtctggtgggtccgtcaggctgcggcaagtcgtcgctgctgtgggtgctggcaggtctgaacccgcactggcagggtcagatgcagcttgccggtcacgaagttcagccgggtaaagctttcaccggcgcgctgcgtcaggaagtgcagatggtgtttcaggatccctatgcctcgctgcatccgcgtcaccggctgcgtcgcacgctggcggagccgctgaagctgctgaaacgcgacaatatcaacgatcgtatcgatcagggcttccgtcacgtcggactcgatcccgccctggcggatcgctatccgcatcagctctccggcggccagcgtcagcgcgtcgccatcgtgcgcgccctgctgctgcagccgaagatcctgctgctggatgagccaacgtcggcgctggatatgtcagtgcaggcggagatcctcaatctgctcaacgatctgaaacagcaggatggcctgaccatggtgctggtgagccacgatcccgacgtgatcgatcacatgtgcgatcgcgccgtgcacatgtcgcagggtcgcatcatcgaacagatttctgcctgaaatcaggccggacggcgttcacctgccgtccggcgctgctgcatccgcctcgcctttctgtaaaatcctcttcttccgcctttatcctcatcctctctattgccagaatggcgcactgttctcttcctctgagacatttgattaccacgcgacgctgtaaacctttacagactgaagcaggcacgcgaatgcgacagcgcaaaacgcagcggctggctgatgcggtatactcgcgaccattatttcatgagaggaaaaggcaatgacggtaaaactgcgtccgctggagcgggaagatctgcactttgtccatcagctggataacaacgccagcgtgatgcgttactggtttgaggagccgtatgaggcgtttgtggagctgtctgatctctacaacaagcacattcacgatcagacagaacgtcgctttgtggtggagcacagcgggcagaaagcgggattagtggaactggtggaaatcaaccatgtgcaccgacgcgccgagtttcagatcatcatcgatccggcccatcagggcaaaggactggcaacccaggcggcaaaactggcgatggattacggcttttcggtgctgaatctctacaagctctacctgattgtcgatcaggagaacgaaaaagcgatccacatctacaccaagctcggcttcgagatcgaaggcgtgcttaaacatgagtttttcatcaacggggagtaccgtaacaccatccgcatgtgcattttccagcatcagtatctggaacgccataaaacgccaggcggaatggtgaagccgaccgcgcagtaatcagccgcgcgcgccaaccgggttcataaagggacgcgggtgttcaggcttgaggtcgtacatgccgccatagaaaggatcgaccagcagccagccggggaatccacccagcgggatgttacccagcagataccacaggttagcgcgtgcctcgataggcaccgtgaccggcacgtagcccgggctttccagcatcagcagatagtgctttttgccaaagtagcggccggtagatttttccagttcaacggtctgcggcgtgaaaccctgcgcaaccgcatagccacgctcatcctgcacggtaaagcgcgcgccctgcggcaaggagtcgatgcgcaccagttgggtttcattgccgacaatggtggcacagccgctaagcagcagcgcggcggccagggccagaattcgctgtttcatgaaggggtccacagagtgatcagtgatcagagtgtagaccgccctctccacctcaatcgggctatcatcgcccgattcagccagcttattgcggttgacaagcacgggcgatagccgcgatgtcgttgggtgaggtgcgacagcagccgccaatcagcttcgcgcccgcctgctgccactctgccagtttgtcatgcaacgtgcagcctgatggcgctgagtgccaggttttgctgctggcatcatactgctcgccagagttgggatagaccaccagcggcttgtcggtcagcttctgcaactgctgcagcgcaggcgtcacgctctcaagtgccacgcagttgattcccaccgctaccacctgtggctgctgattcagccagctcacgacgtctgacagcggcgtgccgtcgctgatgtgtccggcgtcacgcagggtaaacgagaaccaggcgcggccttcaggaaattcagccagcagcttcaccagcgcctgcgcttcggcaaacgaaggcagggtttcgcaggccagcagatcggcacccgccgccagcagcgcctgcacgcgtgggcggtgaaacgccatcatctccgcttccggcaacgcatagtcgccgcgatattccgaaccatccgccaggaaggcgccatagggaccgaccgatcccgctaccagcagcgtttttgcgtcgggccggaccgccagataatcgtgacgggcgcgtcgcgccagctcgacactctgcgcgatcaactccagtgactccgcctcatcaaggccacgtgtggcaaagccctgcggcgtcgcctggtagctggcggtaatggcacagcgcgcgccggcgacaaaatagtcgtagtgcacctgatagatcagctcaggattttccatcagcaccttagctgaccataacgcatcggccagatgacagccgcgggcttccagctcggtggccagggcaccatccagaatcagcagtggtgactccgttaaagcctgcgcgacagggttatacgacatcattggcctcctcaggcttcggggatgatttgtgggtcagatggtaagcggcatagcagaacagcacaaacgggatgccacaccacagcgcgatacgctgggtcggatcaaacgccagaccgacacaggccagcaggcagagcaggaaacccagcaccggcgtcagcggatagagcggcgcacggtaggccagatcggccagcgatttgccctgctgaagatgacgacgacggaaaacaaaatgcgaagcgcagatgctgagccagacggctaccaccgcaaagccggagatggccgacagcgccacaaacaccgtgtcgggcgcgaccacgctggagaccagcgccagcaaaccacccaccatgctgacggtgatcgccagcatcggcacgccgcgcttgttcacccgggcaaaggcgcgcggcagcgtattttcattggccagcgaccagagcatccgcccggaggcatagagtccggagttggccgcagacaggatagcggtcaggatcacaaagttaataatgtcagccgcccacgggatgccgatcttttcgaagaccagcacgaacgggcttttcacgatacccgcctgatccataggaatcagcgccgccagcacaaataccgtgccgatgaagaagataatcagccgggccacggtagtacggatcgccagcggcagcactttctccggctgctgggtttcaccggccgcaataccgatcagctcggtgccggaaaaggcgaagttgactgccaccatagtcatcagaatcggcagtacgccgttaggcagccagccgtgcgccgtcaggttgctcaggcccggtgcgggcgtgccatccttcatcgggataaacccaaacatcgccgcaccgccgagcacgataaaggcgacaatcgtcaccaccttaatcagcgagaaccagaactccccttcggcgaagaagcgggttgagatgacgttcagcagatagatggcgcagcagaagaccagacaccagatccataccgggatctgcgggaaccagtactgcatacagaagcccgccgccgtcaggctggagccgagggcgacggtccaggtgagccagtagagccaggccacggtgtagccggttgccgggctgagatagcgtgcggcatagacgtggaacgcgccggtttccggcatcgccaccgagagctcgcccagacagaccatcaccagccagaccaccagcgcgccaatcagataggcgagcagcgtccccgccgccccggtggtggaaatgatgtagccggtgttaaaaaacaggccggtgccgattacgccgcccagcgataacatcaccagatggcgcactttcatggtgcgtttaaattgttcctgcgagggagttggctgttcgctcatcacttttatccgtatggacgtctaaacatctataagggacagttttatacgcgtcacagccggtaattgcaacggcagggaaacagggaggaggtaaaggcggttcagtgccccgtcgcggcggggcctgatgcgttagccgaaaacgctttgaatataacgttccagcgccatgcgggaactaaatccgtgcgggatgccgtagtgttcctgtgaatcacccgccaggtagagagggaattgggtgtagtgatcgcaggtcttcatttctgaagcaggttcagcgaacggctggctcttctctttcagtgtcgggtgaatgacgagtgccatgcgccccatgcgcgcttcgcgattcacataaacatagttctctccacggcgataaccataggcccgtggggtaatttcatcgacttcgaaacccgctttttccagtacgcgcgctacctcatctggtcgtaaatacatgctcgatcctctcctctttcaaaagcttcgcaaccttacaacagcatgacagagtgggcattcggaattttccctaaagaacactcccgcgtctcgtttatctcaaggtcgtctacactagtattacgtttttaaatcaaagggagctaaaaaatgtttaatcgcactgtaaaaaacgatgacattgatattaatcaggatgttaacgaactggccgattcactggaagcgctgctgaaatcttacggcagtgacgccaaagacgaagtggattctgcacgcagtcaggcagaaaagctgctgaaacagacccgctccagactgaacggcggcagcaaccgtgtctcacaggttgcgcgtgatgccagtgcgcaggttgacacctacgtccatgacaagccatggcacggtgttggtatcggtgccgctttcggtatcgtagtgggtgtgctgctggcttcacgccgctaagctcaactccagaaaatctcctgagccctgccctgtgcggggcttttttatgccctttttctggccgatgacatttacaaaagatttttccaggctgcagggcgcatccctgctggctttgccgctgttgcgcaaatgcaaatcataaaaccctatatctggtgggcttgacccacaaaaccactacatctagtatttatctcatcagcacgacaccagatgtccggcagaatgaggcccgcaaactgctcctcctgctctgtttcctgacatcagaaccgcatatagagggaaatacgaatcatgcgcattattatttacactaaagataactgtgtccagtgcacggcaaccaaaaatgcgatggaccgtcagggtctcgcctatcagcttatcaatctcgacagccagcccgaggcgatcgacaacctgaaatcactgggttaccgccaggtaccggtcgtgatggcggataacgatcactggagcggtttccgcccggacaaaatcgccacgctgcgcacgctttctgctgtcgggggataaacacatgttcccgctggtctatttttccagccagtcggaaaacacccaccggtttgtgacgcgcctcggcctgcctgccaggcgcatcccgcttgatgcccggcaacaactgcatatcgaccagccctatattctggtcgtgcccagctatggcggtggcagcagtcgcggtgcggtgcccggtcaggtgattcagtttcttaatgatgaggcgaaccgacgcggtattcgtggcgtgatcgcagcgggcaaccgtaacttcggtgccggttactgcctggcgggcagcatcattgcaaataaatgtcaggttccctgcctctaccgcttcgagctgatgggaacgcctgacgatatcgcgaaagttaaagcgggagtaacccaattttggcaacaacagacaccctcaacggcgtgacgctcgattatcacgcccttaatgccatgctcaatctctacgacgccgagggccgcatccagtttcgacaaggatcgcgaagcgacacgtcagttttatctgcagcatgtgcaacccaataccgtccccttcaatagctgcgctgagcgtttacgctatctggtggcagagagctattacgaagcggaagtgctgaaccagtacgattttgcgttcctgcttgcgctgcatgaggtcgcggaaaattggggatttgagttcaaaacctttctcggtgcctggaagtactacaccagctacaccctgaagaccttcgacggcaaacgctatctggaaaccttcgaacagcgcgcctgcatggtggcgctgacgctggctcagggcgatgaaaagcttgcgcgggccctgctggaggagatcctcagcggccgtttccagcccgctacaccaaccttcctgaactgcggcaaacagcaacgcggtgagctggtctcctgcttcctgctgcgcatcgaagacaatatggagtcgattggtcgcgccgtgaattcggcactgcagctttcaaagcgcggcggtggcgtcgcctttttgctgtcgaacctgcgtgagtccggtgcgccaatcaaacgtattgaaaatcagtcgtcgggcgttatcccggtgatgaaaatgctggaggatgccttctcttatgcgaatcagctcggcgcgcgtcagggcgctggcgcggtgtggctcaatgcgcaccatcccgatattttccgcttccttgataccaagcgcgaaaacgccgatgagaagatccgcatcaaaaccctgtcgctgggcgtagtgatccccgatatcaccttccagctggcaaaagagaacaaaccgatggcgctgttctcgccttacgacgttgaacggatctacggtcaggcctttggcgatatcagcatcagcgagaaatatgacgagatgctggccgacgaccgcatccgtaaaacctatattcagccacgcgacttcttccagacgctggccgagattcagtttgagtcgggctatccctacatcatgtatgaggacagcgtgaaccgcagtaatccgattgccggtcgcattaacatgagcaacctctgctctgagatcctgcaggtgaacagcgccagcgagtacaatgacgatctcagctatcgccgcatcggcaaagatatctcctgtaatctcggctcactgaacattgcgcacgcgatggattcacgcgatctggcgcgtaccgtggatgtggcgatccgcgctctgacctcggtgtcgatgatgagcgaaattggctcggtgccctcggtcgccgaaggcaatcgccgttcgcacgccattggcctgggtcagatgaacctgcatggctatctggcgcgggaaggcatcgcctatggttcaccggaagcgctggatttcactaatctctacttctactgcatcacctattatgcgctgcgcacctctaatcagctggcacaggagcgtcagcagaacttcgatggctttgcggaatcgcagtacgccagcggcgcctacttcgataagtatctgcagcgcgaatggctgccgcgcacgcaacgggtagcgacgctgtttgccgacgccggactgacgctgccgacacaggcggactggcaggcgctgcgcgacgcggtgatgcagcacgggctgtttaatcagaacctgcaggcgatcccgccaaccggttcaatctcctacattaaccatgccacctccagcatccatccgattgtctcccctatcgagatccgcaaagagggcaaaaccggccgcgtctactatcccgcgccctttatgaccaatgagaatctccatctctatcaggatgcgtatcagattgggccggaagcgattattgatacctacgcagaagcgactcagcatgtcgatcagggcctgtcgctgacgctgttcttccgcgatgacgtctcgacccgtgacatcaacaaagcgcagatttacgcgtggaaaaaaggcatcaaaacgctctattacattcgactgcgccagatggcgcttcagggcacggaggttcagggttgcgtctcatgctccctgtgatgaaaacgatgaaactaaaacagattcaggcaattaactggaaccgcattcaggatgacaaagatcttgaagtgtggaatcgtctcaccagcaacttctggctgccggagaaagtgccgctctccaacgatctgcccggctggcagacgctggataaacagcagcagcagctgaccatccgggttttcaccggcctgacgctgctcgacactatccagaaacgtggtcggcgcgccggggctgatggaagatgccattaccccgcacgaagaggcggtgctgtcgaatatcagctttatggaagcggtgcatgcccgctcctacagttcgatcttctcaaccctgtgtaacacccaggatgtggatgccgcttatcagtggagcgaagagaatgcgccgctgcagaacaaggcgcgcatcatcctggaacactaccaggccgatgatccgctgaagaagaagatcgccagcgtcttcctggagtcgtttttgttctattccggcttctggctgccgatgtactggtcgagccgtggcaagctgactaacaccgctgacctgattcgcctgattattcgcgatgaagcggtgcacggttactacatcggttacaaatatcagcaggcgctggctgccgctgacgatctgcgccgcgaagagctgcagcagttcgcctatgatctgctgctggcgctgtatgagaacgaagtggcttataccgaggcgctctatgccgatgtcggctgggtagaggaggtgaaaaccttcctgcactacaacgccaacaaagcgttgatgaatctgggctatgaggcgctgttcccggcggagctgacagcggtgaatccggccattctgtcggctctgtcgcccaacgccgacgaaaaccacgacttcttctccggttcaggctcctcctatgtgatgggaaaagcggtcgaaaccgaagacgaggactggaatttctgagggttaccgggtgctgttttgtcagcatccggttttctctggcagtgccgtgtcagccgcgccatttcgtctaatcataagaaaaaaatattactgcaaaacagcctgactatttcaccgtttgttgattctgcccctccccgcatttccttttttttcgaccaattattccactgaacccgatcgtttcaggcgtgattatttccctgcatcggaatccattatttccgtaatatttcacgtcggtgacacttgtttttctccctttcacgcggtaaatcggctgaaatgccaaaaacccgccaatgatttcacaaaaaattaatccacgcttatcccttgtgagcactgaagataatcggcatctgaatgtcccgcggccggtcaatattccacttcagggttgtcagataacgtcagtgtgctacggtatggcctgcttaaatttcagcgggaacgacaggataatattagatatttcaaccaggatttaatgactgcatggctattaagctcgaagtaaaaaatctctataaaatatttggcgacaatccggatcgcgcgtttaaatatattgaaaagggtgcgaccaaagatgtcattcttgagaagaccgggctctcccttggcgtaaagaacgccagtctggccattgaagaaggcgagatattcgtcatcatggggttatccggttcaggaaaatcgaccatggttcgccttctcaatcgtctgatagagccgacgcgcggccaggtgattattgacggtgtcgatattgccaaaatatcagccagcgaactgcgcgacgtgcgcagaaataaaatcagcatggtattccagtcatttgctttgatgccgcacatgaatgtattaaataatacggcatttggtatggaattagcgggagtcgcactggctgaacgccaggaaaaagcactggaagcgttacgtcaggtcgggctggagaattatgcgcacgcttatccggatgaactttccggagggatgcgacagcgcgtcggattagcccgcgccctggccatcaatcccgacatcttattaatggatgaggccttctccgctctggatccgttgattcgtactgaaatgcaggatgagctggttaatttacaagccaggcatcagcgcaccatcgtctttatttcccacgatcttgatgaagcgatgcgtattggcgaccgtattgccattatgcagggcggcgaagtgatacaggttggtacgccggatgagatcctgaataacccggccaatgactatgtccgcacctttttccgtggcgtcgatatcagtcacgtattcagcgccaaagatatcgcccgtcgtagcgcgggagcgttgatccgcaaagcgccaggtttcggcccgcgctccgccattaagctgctgcaggatgaagaccgcgactacggctacgtgctggagaaacagaagtttcttggcgtggtctccaccgactcgctgaaagccgcgctggcagcaggtctgggactcgatagcgccctcctcgactcgccagccgcggtgcccgccgatacctcactgagcgatctgctctcgcacgtcgctcaggcgccctgtgcggtgccagtggtcggtgaggagaatcagtatgtcggtatcatttccaaaagcacgctattgcgcgcgttagatcgtgaaggagcccagccatgagtcaggaaaccaccaatccgtgggatagcggcaccgccgccagcagtcaggctgcgcccaccagcagcggcggtgccgatgcctggggcacgcccgatggcagcgcgacacccgatgcagccagcagcagtgactggctcaacagcgcccccgcgcccgcgccggaacatttcaatatcatggatccattccacaaaacctggatcccgcttgatcactgggtgactaccggcatcgactgggtggtcaaccatttccgcccgctgtttcagggtatccgggtaccggttgactatattctcagcgcctttcagcagctgttgctggggatgcccgcgccggtagcgattctggtgtttgcgctgatcgcctggcagatcgcgacgcccgccatgggcatcgccacgctggtatcgctgatcttgattggcgcaattggcgcctggtcgcaggcgatggtcacgctggcgctggtgcttaccgcgctaatgttctgcattctcatcggcctgccgctggggatctggctggcccgcagtgaacgggcagcgcgtatcgtacgccccttgctggatgcgatgcagacaacacccgcctttgtctatctggtgccgattgtgatgctgtttggtatcggcaacgtgccaggcgtggtggtcacgattatcttcgccctgccaccgattgtacgcctgactattctcggcattaagcaggtgcccgccgatctgatcgaagcgagcgaatcctttggtgccagtccgcgtcagctgctattcaaagtgcagttgccgctggcgatgcccaccattatggcgggcgttaatcagaccctgatgctggcgctgtcgatggtggtgatcgcctcgatgatcgccgtgggcggactcggtcagatggtgctgcgcggtattggccgtctcgacatggggctggctacggtgggtggtgtggggattgtgatccttgccattatccttgaccgtctgacccaatcgtttggtcgcgatagccgcagccgcggtaatcgtcactggtatcacaccggcccgctgggcctgatcttctctccttcgcgtaaaaaataatctgtcgggcggtgcctgcgcgccgcccatcctgacgcgacatctgaaataaggaatgactatgcgcaacagagcctctctgctcgccgccgtggtaaccacgctggccgtttcacacgtctccgctgccgatctgccgggcaaaggtattacggtacaacccatacagagcactatcgctgaagagacttttcagaccctgattgtcagccgcgcgctggaaaaactcggctatcaggtcagcaagccgagtgaagtggattacaacgttggctacacctctatcgccgctggcgacgccacctttaccgcggtgaactggcagccgctgcatgacgacatgtacaaagccgccggtggcgatcagaagctctatcgtcagggaacctatgttaccggtgccgcccagggttatctgattgataagaagaccgccgagaaatatcacattaccaatatcgaacagctgaaagatcctaagatcgccagcctgtttgacgccaacggcgatggcaaagcggatatgaccggctgtacgccaggctggggctgtgaagcggtgattaatcatcagaacagcgcctttggtctcagtgataccgtgaccgccaatatgggtaactattcggcgatggtggcggatacgctggcacgctacaaacagggtaaaccgatcctttattacacctggacgccctactggctgagcgatgtgctgaagccgggccgcgatgtggtctggctgcaggtgccgttctcttcgctgcctggcgaaacagaaggatgtggatactaagctgccaaacggtgcgaactacggtttcccggttaacaccatgcacatcgtcgccaacaaagcctgggcggcgaaaaacccggcggctgcccgtctgtttgcggtcatgaagctgcccattaccgatatcaatgctgaaaactcagcaatgcatgccggacaaaactcagaagaggcgattaaccgtcatgtggatggctggattaaggcgcatcaggctgagttcgataaatggatcagcgaggcgcaggccgccgcgcaataacatgaaaacatatccgccccagggtggttgataaaagtgctggctcagtgagcatacgctttaagtcgggcagttatctgagggcagaaatttttctgccctttttttatgcctgctttcccgactggtatggcctgttaataaacatgcgtgtgaaatagttttttgagttactattaacctcaaatgattattagcgaccgatgctgtttatgaatgcgactcgccagggtctgacgcctgctttagtaatgctgatgtcagtagcaaccggcctctgcgtagccagtaattactacgttcagccactactgaataccatcgcccaacagtttgatctctctgtcagcctcgccggatttattgtcaccacggcgcagctgggctacgcctgcggtctgttgctgctggtgccgcttggcgatcggtttgaacgacgcagcctgattgttacgatgatcctgctggctgctgcgggcatggtgattatcgccctttcgcactcctttctctttttactgctgggcacggtgatgaccggcctgtttctcggtcgccgcacaaatcctggtgccgctggccgccacgctggcagagccggagcggcgcggcaaaatcgtgggaacggtaatgagcggtttgctgctggggattctgctggcgcgcaccgtggcaggcggcctggcgcagcttggcggctggcgtaccgtctactggactgccagcctgctgatggtggtgatggccctggcgctgtggcgatcgctgccgcgcgtgaaacagtccgtgcccatgagctatccgcaactgctggcctctatttttcgcctgtatgccggtaatcgggtgctccgcacccgcgcctggaccggctgcctctcctttgccaatttcagcctgctgtggacctcaatggcctttctgctcgccggggcgccctatcacttctcagagggcgagattggcttgctggggctggtcggtgccgcgggtgcgctggccgcacgtcaggcgggcgcgctggctgacaagggtaaagcgaagctgaccacccaactgggcctgctgcttatgctgctgtcgtgggctgccattgcgtggggcgcggagcagcttgcgccgctgatcgtcggcatcctgctgctggatctggcggtacaggccgtccatatcaccaatcaaagcgtgatctacgcgcagatgccggaggcgcggaaccgtcttaatgccggttacatgaccagctactttatgggtggcgcggccggctcactgctctccgcgaccgcttaccatctttggggctggtatggcgtctgtggcgctggcgcgctgctgactgtggttaatctgctgatttgggcagccggatcgcgctttgagccggaaaaaatcaactgaagcctggccggacagcgcattgcgtctggtcacaaatggttaggtttgttatggttagtagcaaacctattcacttcagttatttttccccgcgatattattaaatttgccccctttttgatcacgttccggcacagcggctgccgccggacgtacgggtttttgacccagggccagggaatggcctggaatacctttgatggtgaatagtgattctgtcagcgatcacctgccaaaaagtgactacgcttatcctgtcaccatagttattatacaagttgcaattagtgaggttttttttaatggaaagttcgtttactcccattgagcagatgctaaacatccgtgccaatcgccacaaggattttccgttacaggaaattattctgacgcgtctctgtatgcatatgcagggtaaactgctggacaaccgcaataagatgctgaaagcacagggtattaatgaaaccctgttcatggcgttgattacgctggatgcacaggaaaaccatagtattcagccctctgagctcagctctgcccttggctcttcacgcaccaatgccacgcgcattgctgatgagctggaaaagcgcggctggattgagcgtcgcgaaagcgatcacgaccgtcgctgcctgcacctgcatctgaccgataaagggatggagtttcctgcgtcagctgctgccacctcagcatcagagcctgcagtacctctggtcgtcgctctccgtcgatgagaagtcgcagctggaaggcatcacccgtaagctacttaatcgtcttgataaaatggatgaagatcagctgatcgcctcgctttcccgctaatagcaataagtgcgacacaatcacctgtcggaatcgttattttaatttccttttttatctggccagcgctcagtcgctggctttttcgactcgggcgctggcgaaaaggaatttctgccgcccgactaaatggaaaacgtggagaaagacatgagtgcaacggcagaagcacaaagcccgcaaccgtcagccaacaaaaagaagaagcgcaaaagtgtgctcatcgtgctggcgctgatctttgtgctgattggtattgcctggggagtttactggttcctggtcctgcgccattttcaggaaacggatgacgcctacgttgcgggtaaccaggtgcaggtgatggcacaggtctccggtagcgtgaataaagtctggtttgaagataccgatttcgtcaaaaaaggcgatgtgctggtttcactggataagacggatgcggagcaggcgtttgaaaaagcgcagacggcactcgccaccagcgtgcgtcagacgcatcagctgatgattaatggcaaacagtatcaggccagcattacattgcaacagaccgctctggcgcaggcacaggccgacctgaaacgccgtgagccgttaggtgcggctaatctgattggccgtgaagagttgcagcacgcccgcgatgccgtcgcgacggccaaagcacaactggacgtggcgattcagcaatacaatgcgaatcaggcgatgatcctcaacacctcactggaaaatcagcctgccgtgcaacagagcgcggctgagctgcgtgacgcctggctggcgctgcagcgcaccgaaatccgtagcccgatggatggttttgtctcccgtcgcagcgtacaggtcggttcgcaaatctccaccagcaccccgctgctcgccgtcgtgcctgcaacgaatctgtgggtcgatgccaactttaaagagacccagctggctggcgttcgtattggtcagcctgtcaccgtggttgccgacatctacggtgacgaagtggtttatcagggcaaagttgcaggactggatatgggcaccggcagcgccttctcactgttgccggcacagaatgccaccggtaactggatcaaagtggttcagcgcctgccggttcgtatcgaactgaatcaggaagatatcgccagacatccgctgcgtattggcctctcaacgctggttaaaatcgataccaccagcaaagagggcagcgcgctggccaccagcgcccgtcagcaagccgcttacagcagcaacgcactggcgattgaccttgcgccggtcaatcagctgatcaccgatatcgtccgcgccaacgccggatgatgacgcggaggctgtaatggcacaaaaaccgcttgaaggaatgccgctggtcctgatgaccattgcgctatcgctggcgacgttcatgcaggtttctggactcgaccatcgccaacgtggctattcccacgattgccggtaatctgggggcgtcgaactcccagggaacctgggtgatcacctcgtttggtgtggctaatgcgatctcgatcccgctgaccggctggctggcaaaacgcatcggtgaagtgaagctctttacctggtcgaccattctgtttgctatcgcctcctgggcgtgcggcatgtcagacagcctggagatgctgatcttcttccgcgtcattcaggggatcgtcgcgggtcccttgatcccgctgtcgcaaagtctgctgctcaacaactatccgcccgccaagcgcagtgttgcgctgtcgctgtgggcgatgacggtgatcgtcgccccaatctgtggcccgatactgggcggctggatcagcgataactatcactggggctggatcttctttatcaacgtgcccattggtgtggcggtggtgatactgacgctgcaaaccctgcgcggccgggaaaccaaaaccgaaatccggcggatcgatatggtcgggctggtgctgctggtggtggggatcggctgtttgcaggtgatgctggaccgcggaaaggagctcgactggtttaactcgtccgagattatcgtgctcggggtagtggccgtgattgcgctgtcagtcctgctggtgtgggagctgactgacgatcacccgatcattgatctgtcgctgtttaagtcgcgcaacttcaccattggctgcctgtcgatcagtctggcttatatgctctacttcggctcgattgttctgttgccgcagctgctgcaggaggtctacggctacaccgcaacctgggccggtctggcgtctgcgccagtgggcattttgccggtgatcctgtcgccgatcatcggacgctttgcccataagctcgacatgcgacggctggtcacgttcagcttcattatgtatgccgtctgcttctactggcgcgcgtatacgtttgaaccgggaatggactttggtgcctcagcctggccgcagtttattcagggctttgccgtggcctgcttctttatgccgctgaccaccattacgctgtcgggactgccgccggagcgcatggccgctgcctccagcctgtcgaactttatgcgtacctttgcaggctcggtgggaacgtcgattaccaccactatgtggagtaaccgcgaatcgatgcatcatagctacctgacggagtcgatcaccccttacaacgtcaattcgcagcagatgtatagccagctggagagcatggggatgacgcagcagcaggcgtcggcctggatcgcgcagcagattactaaccagggactgattatttcagcgaatgaaattttctgggcgtcggcgggggtctttttgattctgctggtgctgatctggtttgcccgtccgccgtttagcgcaggcggcggtggcggtggcgcgcactgatgtgacacagcaaaacgggcctttcggcccgtttttttatgcgttctgacgccaccattcggcgagcagtacgccggttgcgaccgagacgttaaggctttctacgttgccggtgccgccaatcgacaggctcatgtcaccctgtttgaacgcggtatcagagagaccttcacgctcctgccctaacaccagcaccattttctccggcagctgagcctgcgccagcggcgtgccctgatggctggaggtggtgacgatggtgtaacccgctttacggaacgcttccagaccttcactgaaggttgcgccgctgatagcctgcacatgctcagcaccgccttctgcggtacgtaccgctgcgcctgactccagcagcgaggcgtcgttcaccagcaaaccttttacgccaaagtgcgcgcagctgcgcataatcgcgccgaggttatgcgggttgctgacatcttccagtgccagcacgcaatctttggtattcgcctggctcagccattcagaaaccgccatacccatgcgctttttgatcaggaagcagacgccaccatgatgctcagtgcctgacgctttggtaatctctgcatcttccacgacgtgataggctttgcggttagccgccagccagcgcagcgcttcgcggaaacgcggagtcacttcctgcacgaaccaggcgcgaacaatagcttcaggacggctctggaacagcgcctgacaggcgttctcaccatagacgcgcgtctcttcgttgcgctgacgacggatctgctcgggatcgacgaagctcttgccgctgatgccgccgtgatccggcttatcgctttcggttgccggacgatctgctgatggcgcgcgtgacacggtgcgccatggggaatcgctgctgccataggcgccgcgattatcatcgccacgatcgttgcggcggcctgcgccatcgtctgaacggcgtggagcgccacgtccgccttcatcacgacgcggtgaactgctgcgaccggtgtcgtcgctgcgacggccagcggagcgaccaccttcctgactgcgttcagtacgggggccagacgaacgacgattatcatccgaacgggcagcagcgtgaccacctttgcctgtacgaggattaggcgcgcgcgcgcttttatcgtcctcgccacgcacgtacatcaccttaaccttaccgctcttgcctttaaattcgtcgttcatgtcttcctcctgcattgagagcgcgcagattacctgatgtgctggcgcttagctatcaactattgaacctatcgagcaatccagattgagagggaatccgtcccctttcataatgaacaatatttatcagactgacacttttcaacatcagaggttcctatgaatacggtatgcgcttcctgtcaggcaaccaatcgcgttcctgaagaacgccttgccgacgtggcgaaatgtggtcgctgtggaaatgcgttatttgatggcgaagtggtgaatgccaccagcgctaactttgacaaatatctgcaggatgatctgccggtggtgatcgatttctgggcgccctggtgtggtccctgtgtcaattttgcgccggtgtttaaagatgtcgccagtgaacgcagcggtaaagtccgctttattaaagtgaacaccgaagcggaaccggccctgagcgcccgtttcaacattcgcagtatcccgaccatcatgctgtttaagaacggcgagcgggtcgacatgctgaatggcgcgatgcccaaagcgcctttcaatgaatggctggatgagtcactttaatcttcagaggccagcctggctggccttttccttttcgcgtgtgcttcgattacactgacgtttttcctgccctgaatactcatgtctgataatgctgttttgcgcttgcgcacccaacgcctggcccgatccacccgtcctttcctcgcgcgcggcaatcgggtcatccgctgtcagggctgcctgctgccagaggtcaactgtctctgcagtcagatcgtgccgcagtccgcccgtagccgcttctgcctggtgatgttcgataccgagccgatgaagccgagcaacaccggccggctgattgccgatattctgccggaaactcaggcttttggctggtcacgcaccgagccggatccgctgctgctggcggcggtgcgcaatcccgattatcagccgctggtggttttcccggccgcttatgccgaccccggtcgtgaagtgctgacaatgccgcccgtcagtggcaagccgccgctgtttattatgctggacggcacctggaccgaagcccgcaaaatgttccgtaaaagcccctggctcgacgccctgccggtgatgtcgctggatgtcagcaccccgtcgcgctatacgctgcgtgaagcccacggcgcaggtcagcactgcactgctgaagtggccgcggcgctgctggcgcaggcgggcgatcggctggcggctgaggcattatctcaccattttgatcagttccgcgcagcctacctggcagggaaaccgcaccacgccggacaggcttaatcgcccagtcacgctcctggcgggagcgtccctgcggtgacagagattaaaatcggaatgcgcagcctgcgatctgcccggaagcactgccagcaaaaagcgtttacaatcacgcaaatcccgaactctggagagcgagatgagccaacgcggactggaagcgctgttacgacctaaatcaattgcggtgattggtgcctcggtcacgccagggcgcgccggatactttatgatgcgtaacctgctggcgggcggttttagcggcccggtgttgccggtgacgccaaaatataaagcggtcagcggcgtactggcctggcccaccatcgacagcttacctttcgcgccagacctggcagtaatctgcacccactcaaaacgtaacctcgaactgctacaacagctcggggagaaaggctgcaaagcctgcattattctctctgcgcccgccagccagtctgccgaaactcaaagcctgcgccagccagtggcagatacgtctgctgggaccgaacagtcttggcctgctggccccctggcagggattgaatgccagcttctcgccagtgccgatagagaaaggccgtattgcatttatctctcagtccgccgccgtatccaataccattctcgactgggcgcagcagcgtaatctcggattctcctggtttatcgcgctgggtgacagtctggataccgatgtcgatgatctgctcgacttcctggctcgcgacggtaaaaccagcgctatcctgctctatcttgagcacctcagcgatgcgcgtcgttttgtttctgcctcacgcagcgcctcccgtaataaaccgattctggtgatcaagagtggtcgcagccgggaagcacaggcgctgctgggcacccacagcggtctggacgccgcctgggatgcagccattcagcgtgccgggttactgcgggtgcaggatacccatgagctcttctccgccgttgagtcgctgagtcatatgcggccgctgcgtggcgacaggctgatgatcatcagtaatggtgccgcccccgccgcgctggcgctggatgagctctatgcccgcaacgggaaactggcgcagctcagcgagcagacgattcagcagctcgaggcgctgttgcccgctggcgcaggccgcggtaacccgctggatttaaaagatgacgccacagcggaacgttatgccgcctgcacagagatcctgctcgacagccatgaacttgatgcattgatgattattcatgcgccaagcgcggtcgcgcccgcgactgaaacggccggacatctgatcgacaccatcgcccgtcacccgcgcggtaagctggtgacgctgctgaccaactggagcggcgagttctcttcacaagccgcgcgccgagcctttacgcaggcggggataccgacctggcgcacgccagagggaacggtgaccgcctttatgcatcaggttgagtaccgccgtaaccagaagcagctgcgcgaaacccctgccctgcccgccaccctgaacctggacagcgcccatgcacaccagctgctgtcacaggcgctggagcgcggtgttaccgcgctggatacccacgaagtgcagccggtgttgcaggcttacggcctggccacgctgccgacctggatcgccagcgacagtaaggcggcagtggcgattgccgatcagattggctatccggtggcgctgaaactgcgttcacccgatatcgcgcataaatcggaggtgcagggcgtgatgctctacctgcgtaatgccagcgaagtggagcatgccgctgaggccatttttgatcgggtaaaacagacgttaccgcaggcacgtatcgaagggctgctggttcagagcatggcgagtcgtgcaggcgcacaggagctgcgggtcgtggtcgaacaggatgccctgtttggcccgatcattatgctgggggaaggcggcgttgaatggcaggccgataaacaggctgccgttgcccttcccccgctgaatatgacgctggcacgctatctggtgattcaggcgatcaagagcggaaagatccgcagccgcagcgcgctgaatccgctggatatccccggtttaagccagctgctggtgcaggtctctaacctggtggtggattgcccggagatccagcgactggatattcatccgctgctggctgcgggcaatgattttaccctgctggatgtcaccctgacgctggctccgttccacggcgataacgaagcacggctggcaatacgtccttatcctcagcatctggaagagcaggtagagttaaaggatgggcaattctgcctgttccggcccattctgccagaggatgagcccctgctgcgcgatttcatcagtcaggtcaccaaagaagatctctactaccgctacttcagtgaaatcagtgagtttactcatgatgatctcgccaacatgacccagatcgattatgaccgcgagatggcgattgtggcggtacgtcagcatcatggacgatccgagatcatcggcgtcacccgcgctatctctgatgcagataacattgatgcggagttttcggtgctggtccgtttccgacctgaaaggcttaggcatgggccgtcgtctgctggaaaaaatgatccgctatacccggcatcacggcttgcaacaattgaacggtatcaccatgccccataaccgcggcatgattacgctggcacgaaagctcaactttcatgttgatattcaactggatgacggtattgtcagcctgaaattgtctttacagaatgagatcaactaaccttgtagagaaaggtaaaaaacgttcgaatcggcgaagttgatgttattatttgtggttataaccctgatttgatggcaaaaggccatgcaatgaacagagaagaagtgcactgtgatgttgtctaaatttaaacgtaacaaacaccaacaacacctcgcacagctgccgaaactgtcacaatccgttgcggatgtgtcgacactttactcgcctgccgaatttcgccagacgttgctggagaagattgcggcagcgcagactcgcatctgtattgttgcgctctatctggaaaatgatgacgccggacgtgccgtcatggatgcgctttatagtgcgaagcaggcgcggccggagctggatatttcgattctggttgactggcaccgtgcgcagcgtgggcgaattggcgcagcgcgaggcgtaaccaatgccgactggtattgcgaaatggcgacacgttatccggatattgccatcccggtttatggtatcccggtcaatacccgtgaagcgctgggcgtgctccaccttaaagggttcattattgatgatatgctgctctacagcggcgccagcatcaatgatgtctacctgcatcagcatgataagtatcgctatgaccgttatcaggttatccgtaattcccagctgacagatacgatgtatgactggatcacgctcaatctgaagtcagcagaggcggtaaaccgactcgattttgctgagcgcccctcaagtcctgaaattaaaaatgagacacgccagttccgtcaggacctgcgcggtttcaattatcagtttgaagggaatgccggcaacgatgaactgacggtcacgccgctggtcggtctgggtaagcatagcctgctcaataaaaccattttccacctgatgccctgtgcggaacagaagctgatcatctgtaccccctacttcaacatgcccgccttgctggtacgtaatatcattcatcttctgcgtcagggaaaacaggttgagatcatcgtcggcgataaaacagccaatgacttctatattgcgcccgatcagccgttcaaaatcatcggcgcactgccttacctgtatgaaatcaatctgcgtcgctttatgagccgtttgcactactacgttacgaccgatcagctggtcgtgagactgtggaaggatggcgagaacagttatcaccttaaaggaatgtgggttgatgatgaatggcagctgattaccggtaataacctcaatccacgtgcctggcggctcgatctggaaaatgcggtgctgatccacgatcctcatcaggagttagcggctcagcgtgagaaggaactgacgttaatccggcagaaacacaacggtagtgacgcatttccgtgagcttgagagtattgctgattacccggccaaggtgcgcaaactgattcgccgtctgcgccggatacgtatcgatcgcctgatcagccggattctttaatcactgcggccaataaggcatctgctatgcgaagtgtgctgcttgctgtgttgttgtgtagcggatgcgcccatatggcggaagatcagtggaccggacgggataaagcggagcattttgtcgcctctgcagtcctggccgctgccggtagtgaatatgggaaggcagcgtcagcaccattctgaccggcaaagccagactgttttcattaacgcctggggcgggaaaagagtggtatgacagccgcccgaatggcagcggctggagctggaaagatttcgcctgggatgccgccggtgctgccagcggcattgccctgtggaatcagagtcagtagctttctctgttaaagcttaatccccttaccgcgcttgtgcagcaacagcgacaccagaaatgccaccgcgcccatcgctgaaacataccagaagaaagtcgtctcaatcccctgctgcttcatcagcaacgcaacatactctgccgacccaccgaagatcgcattcgctactgcgtaagatagtcctacacccagtgcgcgcacctgtggcggaaacatttctgctttaagaatgccactgatggcggtgtagaagctggtaatcagcagcgccagcatgattaacaggaaagccacaccgggactttgcacgttttgcaacagggtcagaatggggaccgtacagatggccgcgcccgcgccaaaaatcatcattgaggtgcgacgaccgattttatctgacagggcaccgataatcggctgaatcagcataaagaccagcagcgcaccggtcatcaggccgctggcggttttaggatccatacctgacgtattaaccagatacttctgcatgtaggtagtgaaggtgtaaaaactcagggagccgcctgcggtgaaacccagcaccatcaggaagggacgagtatgattacgcagtaacccgattacgctacccgcatcgcgatgttcgcggctcgtcttatctgaggtctcttccagtgagcgtcgtaaccataatgcgacaacggcgaggagtgcgccgaggaagaacggaatacgccagccccagcttcgcagtttctgcatccgtcagcaaaaattgcaggaccacgacggtgagtaccgccgctaactgaccacctatcagcgtgacatactggaatgaggcgtagaatcctttgcgtccttccagagccacttcactcatgtaggttgcgctggtcccatattctccgcccaccgataatccctgaaacatacgcgccagcagcagaatgacgggcgcagccacgccgatcgttgcgtaaccgggtaagcaggcgatcaccagcgaaccaaaacacatcatgcagactgaaaccagcatcgaattttttcggccatgtttgtcgccgatatagccaaacagccagccgccaatcggacgcattaaaaatcctgccgcaaaaacgcccgctgtctgtaacaactgagtggtggtatcgccctgcggaaagaaaatgtgggcaaaatagagtgagaagaaggagtaaacgtagaagtcgaaccactcaaccaggttacctgatgacgcgccgacgatagcccagatacgtttctttgtatcatccgtctgagttttattatttgtaggtgccatgccttacctctgttccttgctgatcagcagcgtttaaaggagtgagtaaagcatttaagtctactgaaggtaaaggcggcgtaatccgagattattattgtgagccatgtcgctaattatcgaaaaatcagcgggttgctggtcattcagaagtggagaatggggagttaagggtgacataccgcgtgcctgcaggtcatattttcagcttaaagtggcaaagcgcagacgtaaaaaagccccgcacttccgtgcggggcttcttcacttatttaatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagatatatccggtacaggctgaaaatctgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccggattacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttgcggataaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgcttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgctttgtcattccttattacggaggaataacgcgctgcgtcgtttcaattttcagcttgttccggattgttaaagagcataatacgtcgcagcacaccgtcgccggtatgctctgaggtatttcagaaaaaacagataaacggtatggtggagctaagcgggatcgaaccgctgacctcctgcgtgcaaggcaggcgctctcccagctgagctatagccccatacagttactgcagagaccactactaccactcaaccgagtacacttcgtgagaaatgtaattcgtgctcaggcaaggcatgtttccgcgaagcatagtgaactatgcgagccggagacataacgcagcgtgagtgcgaatttggtaggcctgagtggacttgaaccaccgacctcacccttatcaggggtgcgctctaaccacctgagctacaagcctgtagaggttttttctgctcgttactttttatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccctatcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaagagcaagctctctgtgctaccgtccgacttgcatgtgttaggcctgccgccagcgttcaatctgagccatgatcaaactcttcaatttaagtttgatttgcttaaacaagttaagcgttgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctatttcagaagtttttctccggcggcgcagtctcctgtgcctcctgacccgttttccgttgccggtttgccgtgtcagtggaggcgcattatagggaacggctcagatagcgcaagtgcaaattgagacttttttactgaccgttcattttgcactcaaaaggagtattaaataagcaaaaacccctcaaaagggcaaaaaaaacgggccagaggcccgtttttcattccacacccttactgatgtgcagtaatgatgttgttctccacatccatttcgatggttttgcctggcaccagcgaaccggcaaggatctgctgagccagcgggttctcgatctgctgctgtatcgcacgtttcagcggacgtgcaccgtagaccggatcatacccgttctccgccagcagtttgatcgcatcatcagagatgtgcagctgataaccccgttcatccagacgtttgtacagccgctgcagctgaatctgcgcaatggacgcaatatgtttctcagccagcggatggaacaccaccacctcatcaatacggttgacgaactcaggacggaaatgctgtccgaccacacccatcacgatatctttcatttccgggtaactgagattgccgaaccgctcctggattaaatctgatcccaggttagaggtcataatcaccacgctgttacggaaatcgaccgtccggccctgcccatccgtcagacgcccatcatccagcacctgcagcagaatgttaaagacatcagggtgcgctttctctacttcatccagcaggatgaccgaataaggccgacggcgcacagcttcggtcagataaccgccctcttcatagccgacataacccggaggtgcacccaccagccgtgatactgagtgtttttccataaattcggacatgtcgatacgaaccatcgcatcgtcactgtcgaacaggaaattagccagcgctttacacaactccgtcttaccgaccccggttggccccaggaaacaggaaggaaccgataggccggtttggatcagaaaggcctgcgcgactacggcgaatagcatttgataccgcctcaaccgcttcatcctgtccgatgacccggccatgtaagtcctgctccatgcgcagtaacttatcgcgctcaccttccatcattcgtgcgaccgggataccggtccagcgtgccagcacatcggcaatctcaacatcggttacccggttacgcagtaacttcatggtcttgccttccgcctgagtcgctgcggctaactgtttttccagtgccggaattttaccgtactgcagctctgacatctgagcgaggtcaccctggcgacgtgcctgctctaaattcagacgcgcctgctcaagttccgctttaatgttctgcgtgccggacagcgaggctttctctgtcttccactcatcttccagctcggcgtattcgcgctctttctggttgagctcggtttccagcatctcaagacgcttgatgctggcatcgtccgcctctttcttcagcgcctgctgctccagcttcagctgaatgatacggcgctcaaggcgatccagtgactccggcttcgagtccatctgcatacgaatgctggaagctgcctcatcgatcaggtcaatcgctttatccggcagctgccggtcagcaatataacgatgagacagggtcgccgccgcgacaatcgccgggtcagtgatttgcacatggtgatgcagttcataacgctctttcagaccacgcagaatggcgatggtatcttccacacttggctcagccacaaagactttctggaaacgacgctccagcgcggcatctttttcaatgtactggcgatattcgtcaagcgtagtggcacccacacagtgcagttcaccacgcgccagcgcaggtttaagcatattgccggcgtccatcgcaccgtccgctttaccggctcccaccatggtgtgcagctcgtcgataaacagaatgacgttgccttcctgtttcgacaggtcactcagtacgcctttcagacgctcttcgaattcaccgcgatatttcgccccggccaccagcgcacccatatccagtgccagtacccgacgtcctttcagaccctcaggcacttcaccattgatgatgcgctgcgccagcccttcgacaatcgcggttttacccacgccaggttcaccaatcagtaccgggttgtttttggtacggcgctgcagaacctggatggtgcggcgaatctcttcgtcacgaccgatgaccgggtcgagtttgcccttctctgcccgctcggtcaggtcgatagtgtatttttttaaagcctggcgctgatcttcagccccctgatcgttcacgttgtctcctccccgcatctgttcaatcgcactggtgattttttcgcgcgttgcgcccgctgctttgagcagatcggccagtgagccccgcgattccagcgcggccagaacaaataattcggatgaaataaagttatcgttgcgcttctgcgccagcttgtcgcacaggtttaatacccggacgaggtcagatgagggttgtacatcgccttcgctgccttcaacttgtggcaggcgatcaatagcctgctcaacctgagcgcgaaatggcgtaacgtcgacaccggccgaagtcagtaaaggtgaaaccgatccgccttcctgtttgagcaatgcgctcatcagatgcagaggttcaatgaattgattgtcgtgtcccagagcgagggactgcgcgtcggcgagagccagctgaaatttattagtaagacgatccagacgcataattcctcccattacaggtcaaaatgctactggagattaaatgaggtcatccctcaaaatttcaaggttaatgacctgagatttgagtaaaaaatacgctaactggaccgtcttatggcgtaaggttataacagccagatcaaagttgccatacgcccggtgatcccatcgcggcggaaagagaagaaatcgtcgcgctgcgtaaaggtacaaaggctgctggcgctgactgaattcacgcccgctgcctgtagtcgcatctgcgccagcaggccgatgtcggcgtaaaagcggtcacctgatggacggaaagcctgcacagcccggggatcctgagccataaaggcctgacggacttcttcgccgacctcaaacgcatcaggtccgattgccggtccaagccaggcatgaatctgatcaggcggcgaacgaaactgcgccagcgtattttccagtacacccgcacaaagtccgcgccagcctgcatgtgccgccgccacttccgtgccatcctgcgaacagaaacaggaccggcagacagtcagcggtcatgatggcgcagacaacaccgggctgatcggtaatacaggcatcagcacgtaatggcgtacttccccctgcagtcagacgcacaacctcagtgccatgaacctgatccagccactgcggcatggcaggtaaacccgcctcttccaacagcaactgccggttacgcgccaccgcatccggattatcccccacgtgcccgccgagattcagtgcatcccagggcgatgtgctgatgccgccctgtcgctgcgtcgagcaggcccgaacgcgtgacggagcgggccattgaggagtaatcagattcatcaccaattcaactggtctttaaattcttcagtgtctgcttttaacgccgcgatgagatcaaccatgtcctgcggaagcgcagcatggaattccatttcaataccgctaatggggtgatagaggcgcaacatcgtggcgtgcagtgcctgacgatcgaaaccgcgcagcgtagtaataaatgcttcagacgcgccttttggcggacgcggacggccaccgtaaagcggatcgcccaccagcggatggctgatgtgagacatatgcacacggatctggtgagtacgaccggtttccagacgcaggcgcagacgggtatgggcccggaagtgctccatgatgcggtaatgcgtgaccgccggtttacccattgggtgtaccgccatgtgggtgcgtttggttgagtgacggctgataggctgctcaacggtgccgcccgcagtcatattgccaatcgcaaccgcttcatattcacgggtgatttcgcgacgctgcagcgagtccaccagatgcgtctgagccggaacggttttcgcgaccaccattaagccggtggtgtctttatccagccggtgtacgatgcccgcgcgcggcacatccataatcgccggatagtgatgaagtaaggcgtttaacaccgtgccatccggattaccggcgccagggtgaaccacgaagtcgcgtggtttgttgatgacaataatgtcttcatcttcataaacgatgtcgagtggcagattctgcggttcccagcgctgcgcctcctcgatctcagcgtcaatcgcgaccagctcgccgcccagcactttttctttaggtgtatcgaccatgacgccgtttacagtaacgcgacgatcgaggatccactcttttatgcgagaaacgtgaataatcagggaacaattccgccaaagtctgatctaagcgttgtccgagttgtgattcggataccgttgcggtgagttgaacttgttgtgccatatacagcttcttcgttaacgttgggttttcacggcgatgccgtttaatataatgtgctatcgtacctggtcattaccgggagctatacggacagcttccgccataacatttgaggataatcacttcgtcatgacgcgtatgaaacatctggtggctgctgccacactgagcctggcacttgttggttgttccggctcaaatgacgcggtaccggacagcccgccttctgaaatctatgctacagcgcagcaaaagctgcaggacggtaactttaaagctgcgattaagcaactggaagcgctggataatcgttatccgttcggtccttattcgcagcaggtgcagctggatttaatctacgcgtactataaaaatgccgatctgcccctggcgcaggctgccattgctcgctttatgcgtctgaaccccacgcatccgaacattgactatgtcatctatatgaaaggtctgacggacatggcgctggatgactccgcgctgcagggcttctttggtattgatcgttctgaccgcgatccgacgcacgctcgtgatgctttccgcgacttctctcagctgctgcggagttacccgaatagccagtatgcggctgatgctcagaaacgcctggtctatctgaaagaccgtctggctaaatatgagctgtcagtggcgcaattctatactaagcgtgaggcttatgtcgcggttgttaaccgtgtcgaaggtatgatgcgcgattatccggatacgcaggcaacacacgatgccctgccgctgatggagaatgcttaccgcaatctgcagctgaaacgctgaagccgataaagtggcgaaaatcattgcagctaacaaaagctgatcgttcgaaggattttcagccataaaaaaagcagcctctcagggctgcttttttttgctcacagaacagtcagatttggatctgttctcagcgagctaactcatcaagcatgccgtgttaatcgtttcgcttcaagccatttcggccagtttctctgcatttctcacagaatgttgtgactgacaaaaagtgacattttttcgtgatcgaaatcccacattgaacgctttttcgcgctatgctgagaagaccaagacggaaatgacagagaggtaagaacgatgattctgaacattaccagtaaacaaatggacatcactccggcaatccgaagccatgttgaagaccgtctcgccaagctcgaaaaatggcaaaccgacctgattaatccacatattgtcctttccaaagagcccaaagaattcgtggctgacgccactattaacacacctaacgggactctggtggccagcgccaagcacgatgatatgtataccgctatcaacgatttgattgccaagctcgagcgtcagctgaataaagttcagcacaagtctgaagcacgccgcgccagtgccagcgtgaaagacatcattcccgccgacgaagagtcctgattttcttaacgctgtttcttaacgcgcctccgggcgcgttttttattgacagcttttaagcagtacggttactctcaggtcactctcttttcggacattaccatgaaacttgatctgtttttcttcgctttcttttttaccttcccctgaacgggaggccattcgtcgtgtgaaaatgaaagcgaagacgaacaccgaagcctcccaaccgggaggctttttttttggatagcatacaggtgagccctatgaatcccgataatccattgctggcgctacgcgataaaatcagcgccgtggataaaaaacttctgacgctgctggccgagcgtcgtttgctggcagtggaagttgcacaagcgaaactggcgacgcatcgcccgattcgggatgtggagcgcgaacgcgcgctactggagaatctcatcgtactgggtaaggcacacaacctggatgcgcactacatcacccgtctgttccagctggtaattgaagattccgtgctgactcagcaagcgctgctgcaaaaaaacctcaaccatccccatgcgcatgccgcccgtatcgcctttctgggcccgaaaggctcttattcgcatcttgcagcacgcaactacgcgtcgcgccatttcgatagcatggtggagtgtggctgcctgaagtttcacgacatcatcaaacaggtcgaaaatggcgtagctgattacgccgtgatgccgattgagaataccagttcaggctcgatcaacgatgtctacgatctgctgcaacagaccagcctctcaatcgtgggcgagctgacattgcctatcgaccactgcgtgctggtgaatggccccaccgatcttcagcagattgagacggtttacagccatcctcaaccgttccagcagtgcagccagtttattaatcgtttcccgcactggaaaatcgaatacaccgagagtaccgcggcagcgatggagaaagtggctgcgctcaactcacctaaggtggcggcgctgggcagtgaggccggcggcgaaactctatcagctgcaggtgctggaacgtaatctggcgaatcagcagcagaaccacacccgctttatcgtgctggcccgcaaagcaatcgaggtttccgaccaggtgccagcgaaaaccacgctgattatggcaaccggccagcaggcgggtgcgctggtcgacgcgctgctggtgctgcgtcagcacaacctgattatgagcaagctggagtcccgcccgattaatggtaacccatgggaagagatgttttacatagatgtgcagggcaacctgcaatcagagcggatgcagcaggcgctgcaggaattacagaccatgacccgctctctgaaggtactgggctgttaccccagcgaaaatgtggttcccgctgaacctggcgaataaaaagaagaaaaaaggcatccaactggatgcctttttcattgatggatggctgtcatttatgggcggctgtcattggccgatcgcaacaggcttcggctttcgaccaggaagcgttttgcgtgatcgccaaaccactgttcaacccggttaaagctggcgataaacgcctgcttgtcgccctgctccagcagcgcaatggcttcaccaaaccgctggtaatagcgttttatcagcgccagattactctctgaagacatgatgatatccgcatagagttgcggatcctgagcgaacagccgccccaccatcgccagttcaagccggtaaatgggcgacgagagcgccagcagctgatccagattgacgttctcttcggctaaatgcagaccataagcgaaggtagcaaagtgacgcagcgcctgaatgaatgccatgttctggtcatgctcaacagcgctgatacgatgcagacgcgcaccccagacctgaatctgctccaggaaccactgatacgcttccggttgtcttccatcacaccagaccaccacctgttttgccaggctgccgctgtccgggccaaacatcggatgcagacccagcacaggcccgttatgggcagccagcattgcctgcagaggccggtttttgaccgacgccagatcgaccagaatacaatcttccggcagtggtggcagttgggcaatcacctgctcggtcaggtgaatcggcacgctaatgatcaccattccggcatcgctgagcagagtctcagcctgaggccagtcctctttatccagcgttttaaccgtgtagcctgatagcccgagcattttttcaaacagccggcccatctggcccttaccaccgacaatcaccaccggacgcagttcaggacagagggttttaaagcctttgtcattctcgctggtataggattcccgcatcacgcgacgcagcacatcctcaatcagatccggtgggacgccgagcgcttcggcctctttacgacgggaagccagcatcgtcgcttcacgctcaggcacatagataggcaggccgtaacggctcttcacctcacctacctcggccaccagttccagtcgcttagccagcagatccagcagcgctttatcaacactgtcaatttgatcgcgtaacgcggtcagttcagccaccattgctcttacacctcttgtgacagacgcgccgacaggactccctgcagatcctgatgcatttcacgcagcaacgtttcggtgacttcccagttgatgcatgcatcggttacggaaacgccatacttcatttcgctgcgtggctgctcagaagactggttaccttcattgatatggctttccagcatcaaaccaatgattgaacggttcccatctttgatctgcgcaatagcggattccgctacgccaggctgacggctgtagtctttgttcgaattaccatggctgcaatctatcattaaggctggacgcagtcccgccttgagcatctctttttcacactgcgcgacatcttcaggaccgtagttcggcgctttgccgccacgcaggatcacgtgaccatccggattgccctgagtctgcagcaggcagacctgaccggcctgattaatcccgacaaaacggtgtggcattgcggctgcacgcatggcgttgattgccgtttcccaggctgccatcggtgccatttttaaagcctaccggcatcgacaggcccgaggccatttcacggtgcgtctgagattcagtggtacgtgcgccaatggcagaccaactgaacaggtcgcccagatattgcggactattgggatccagcgcttcagtggccagaggcaaacccatttcaaccaggttcaccagcagctggcgcgcaatgtgcagacccgcttccatatcaaacgagttatccatgaaaggatcgttgatcagccctttccagccgacggtggtacgaggtttttcaaaatagacgcgcatcacgataaagagctgatctttcagctgttcagaaagggtttgcagacgacgagcatagtccagtgccacttcggtatcgtgaattgagcagggtccgcacactaccagcagacgcggatcgcggccagcaataatgtcagagatggtctggcgcgacgccgcgacctgatcctgctgttcagtggtcagtggaaactttgctttcagctcttcaggcgtgattaatacctgttcaccggcgatatgcacattgttcagcgcgtctttttgcatgatggcgatcctttggctcgtattggcagtcatggactcctcactgaggaatgcaaatactgtatcacaggcaatacatagcgcaatattatatgtacacttttattaccacggatgaagaagggtgcgaaatatacttaaaataaacaataaaatcatggatataataaaaacctcaatcacaaaaaaccaaagacaattgtacaaataagtttacagttaaggttattgcctttcttctacccacaggcagaataaaagaatcattctgttcgcgctgagagagttatgtacccatcaccacaaaatatttatctgcgaccttttgagctcagcgacgtatctgcgtttaccactgcggttaatgcctcgctggatagccttatcccatggatggtctgggcgcatcacgattatcagcctcatgaagcagaaagctggatccgctttacccactggcaacggatgaaagaggaagcggaagagtttgccatcgttgatcagcatgaccagctgctggggggcgcaggaatacgctttgcccgtcatccgggtgacaccagcgcaattggctactgggtttcgccgtgatgcccagcgtcagggaatcgccagccgcgcggtggccgcgttgctgccgctggggttttcacgcccagagacccgggtgattgagattctggcagcagaggataacctggccagtcggggcgtggctgagaagtgcggtggtcagttcattggctgtcgctatggcctgattgtattagaggaagggccggttaataccgcgatttatcattttcagcggccggacgacggttaactgtaggcagcaaggttgacagtgacataaaaaaaaggggctggcatcacgccaaccccttgtttgctattaacttttagatgtcgcgttagcgataccttagttaagacgctctttaatacgagcagacttaccagtacgctcacgcaggtagtacagtttggctttacgcacagcgccacgacgtttaacagcgatgctgtcaattacaggtgaatgagtctggaatacacgctcaacgccttcgccgttagaaattttgcgaacagtgaatgcagagtgcagaccgcggttacggatagcgataaccacgccctcgaatgcctgcagacgttttttagaaccttcaacgacccatactttcacttccacggaatcacccgggcggaaggaaggtacgtcctgtttcatctgctcttgttcaatttgcttgataatgttgctcataattaaatctcatatcctgggtaaactgatagtcggggaagagcttactcttccacatcatcgttttgttgctgctgagattcccgctggaactcattcagcaaccttgcttgctcttcagtcagagccaggttttccagaagttcaggtcttctcagccaggtacggcctagcgactgcttcagacgccagcggcgaatatcagcatggttgcctgacagtaatactgccgggacctccacgccgtctaacacttcaggtcgggtatagtgcggacaatccagcaaaccttccgagaaagaatcctcatcggctgacgcctgcttgccgagcacgccaggaataaaccgggcgactgcgtcaatcatcgtcatcgctggcagttccccgccgctgagaacgtaatcaccgattgaccattcttcatcaatttcggtctggattacgcgctcatcaatcccttcataacggccacagaccagaattaacttgtcccgtgccgccagtttcgcaaacgccctgttggtccagtttgcgaccctgaggtgaaagatatatcaccctggccccatcacctgccgctgctttcgctgcggagatggcatcccgtaagggttgtaccatcatcagcattcccggtccgccgccgtaaggacgatcatccacggtacggtgccggtcgtgcgtgaagtcacgaggactccagctctgaatgctgagcagaccgttttttacagcccggccagttaccccgtaatcggtaatagcgcgaaacatttctggaaacaggctaataacaccaatccacattgtattcgccgttacgttaccgttcgattcggagatcaaaaaccaggatcccaatctacctcaatgatgccagtagagagatcgactttcctgataacctgttcatcaagaaacggaattaaccgctcctgagcaccgaatgcatccttcaggtttgccttaacgacgagaacgtcgttcgagccggtttccatcatatcgatgactttacccatctcgtagccttcaaggttaactacctggcagcccataaggtctttccagtagtagtcgccctcttccagcgatggcaactgcgtcgagtcaacctgaatttcgcaattggttaactgagccgccgcatcccgatcttcaatgcctttgactttgatgatcaggtcctgattgtggtgcttccaaccgtccagttcgacctgctgccatttaccggcgcgctggatgaaccagggttggtagttgaagatgctttcagcgtcttcagtggaggaaaacactttgagccagccgcgaataccgtaggcggctcccatcttacccaatacaatcgggttaacaggaggctgtgcggcaatttgtctgctcatgctcaccaccgtgacagattaagctgctttcttagcttctttgaccagcgcgttaacgcgatcagaaagcgttgcgccctggccaacccagtgctcgatacgatccagatcaagacgcagaccttcagcctgaccagatgcgatcgggttgaagaaaccaacgcgctcgataaaacgaccgttgcgtgcattgcggctgtcagtgacgactacctgatagaaacggacgctttttagcgccgtgacgtgccaaacgaattgttaccataacatcctcttcagttaataaaacacccggcccccatcgaggaacggggtccgggtgctgtataaaaagcccgaaaattttactcattttggcgaaaaaagcaacctaaaccgtgccatttcgggcttttttgtggaacgctttagcggccaggaaaacctggcggcatcatacccttcatgccgcgcatcattttcgccataccgcccttcttcattttcttcatcatacgctgcatatcgtcaaactgcttcaataagcggttaacgtcctgcacctgcataccggagccggtcgcaatgcggcgcttgcgtgagcctttgatgatctctggtttttcacgctctttgcgtgtcatcgagttgatgatcgcttccatgcgcaccagcactttgtcatccatctgtgacttcacattgtcaggcaactgtcccataccgggcagtttgcccatcaggctggccattccgcccatgttgcgcatctgcttcagctgctcaaggaagtcgttgagatcaaaaccgtcgccggttttcagcttcttagccagtttctcagcctgatcgcggtcaaccttgctttcgatatcttcgatcagtgacagcacgtcacccatgccgaggatacgcgaagcaatacgctccggatagaacggctcaagtgcatcggttttttcaccgacacccataaatttaatcggcttaccggtgatatgacgaatcgacagcgccgcaccgcctcgtgcatcaccatcgactttggtcaggataacaccggtcagcggtagcgcttcattaaaagctttagccgtgtttgccgcatcctgaccggtcatggcatcgaccacaaacagcgtttctaccggattgatcgcggcatgaacctgtttgatttcgtccatcatcgcttcgtcaacgtgcagacgaccggcggtatccaccagcagtacatcgtagaacttcaggcgagcttcacgcagcgcattgttaacgatatcgaccggcttctggctgagatcggatgggcagaaatccacgcccacctgctgtgccagcgtttccagctgtttgattgccgccggacgatagacgtcggcagaaaccactaagactttctttttgtgcttctcacgcaggaacttacccagcttagcgacgctggtcgttttaccggcaccctgcagacccgccatcagcaccacggctggcggctgagcagccaggtcgagtgcattgttctctgcacccatcgccgtaaccagctcgttacgaacgattttgataaactcctgacctggagtcagacttttattcacatcatggccgaccgcgctctctttcacacggttgatgaagtcacgcaccaccggcagcgcaacgtcagcctcaagcagtgccatgcgcacttcacgcagggtctctttgatgttctcttcagtcagccttccgcggccgctgatgtttcgcagggtttgcgacaaacgatcggttaaattatcaaacatggtctctcactaaaaaaaagatcgcgaggcgcctgatcggcagaatgcggcggattataacacgaagcctcagcgatctctgcaattgcccctcagatcgtttggagcctgcttcggctggcgctatactgcctttttccttatctgactgaacctgaaaggatctatgttcgttttcgcgatagtggcgctattcgcctactccttaagtcttgccctgatcattcccagcctgttgaaacgtaacggcggctggcggcgaatggcgatgctctctgcctgtgtggcgctggtgacacacgcggtggccttgcagcaacgcatatttgctgttgatagcggacagaatttaagcctgctcaacataggctcgctggtcagcctgttgatttgcgccatcatgaccattgtggcgtcacgcaaccgtggctggctgctgctgccgattgtttacagcttcgcgctgatcaatctggccttcgccacttttgtgcccaatgcgtttatcacccatctggaaaccacgccaggcatgatgatccatatcggcctgtcgctgttcgcctacgcgacgctgattattgccgcgctctatgcactgcagctggcgtggatcgattaccagttaaaaaacaagcgcctggcgttcacacaggatatgccgccgctgctgaccattgaacgtaagatgtttcacatcacccaggtgggcgtcgtgctgttgacgctggtgctctgcaccggtctgttttatatgcaggatctcttcagcgcagaaaacgtcgataaagccgtgctctccatcatcgcgtggtttgtttatatcgttttgctctgggggcactatcatgaaggctggcgtggtcgccgcgtcgtctggtttaactgcagcggtgcggtgctgttaaccatggcttacttcggcagtcgcatcctgcagcatctgcttgtccccacctctcgttaaaaaggaagttctgcgttggagaatgtttcaaccaccacgctgattattattctctgcgtcatggtactggtttccgcctggtttgccgggtcggaaaccggaatgatgacgcttaaccgctataagctgcgccatcaggccaaaaacggcagtcgccccgctcgccgggtggagaagttactgcgtcgcccagaccggttgctcagcctggtattaatcggcaataacctggtaaatattctggcttccgcacttgccaccattgtgggcatgcgtattcacggtgacgaaggggttgcgatcgcaaccggtatcctgacctttgtggtgctggtatttgctgaagtgctgccgaaaacagtggcggccctctatcccgaaacgcgtcgcctttcccagcagcctgctgctggtcccgctgcaatacatcatgctgccgctggtctggctactcaacaccattacccgtctgctgatgaggatggcgggtatccgcgctgacggtgccattaactccgcgctgagcaaagaggagttgcgtaccatcgtctatgagtcacgtagcctgatgtcacgccgtaatcaggacatgctgctctccgtgctcgacctggagaaagtcagcgttgatgacatcatggttccgcgtaacgagatcgtcggcattaatatcaacgatgactggaagtcggtggtgcgccagttgagccactcgccacacggccgcattgtgctgttccgggactcactggatgactgcgtcggcatgctgcgggtgcgcgaagcctggcgcatgatgacggagaaaaaagagttcaccaaagagacgctgctgcgcgccgccgatgagatctactacatcccggaagggacaccgctgaacacccaactggtgaagttccagcgcaacaaagagaaagccggcgtggtggtggatgagtatggcgacatcaaggggctggtgacgatagaggacattctggaggagatcgtgggtgacttcaccacctccatgtcaccgtcactggcagaagaagtgatgccgcagaatgatgggtccgtgctgattgaaggcagcgccagtgtgcgtgaaattaacaaggcgtttaactggcagctgccagagcaggaagcgcgcaccatcaacggcatgctgctggaagcgctggaagagatccctgccatcgccacccgtgttcagatcggtcactacaacatcgatattctggacgtgcaggacaacatgattaaacaagtgcgcattacgccgaagacgccactgaaaaaatcggtagggtcctgaagcgataaaaaaacgccgcaatcgacatgatgcggcgttttttttagcagcaaagccctgactagatgtgcagttctttcagcttttcagcaggcagtttcagatcttcgttgcggttaacgccgatctcatgcgccagcacattgcgggcgatctgctgcgcttcatccagtgagtgcagcttgtagctaccgcactggtattcattcagctcagggatctggttctgatctttcactttcagaacatcttccatcgcccctttccacgctttggcaacgcgctgctcgtctggtgtaccaatcaggctcatgtagaagccggtgcggcaacccattggcgagatatcgacgatttccacaccatcaccattcaggtgatcacgcatgaagccggcaaagagatgctccagcgtatgaatgccacgctcagtgagaatatcaatgttcgggcggcaaaaacgcaggtcaaaaacggtaatcgtatcgccatgcggagtcttcatggttttcgcaacgcgaactgccggtgcgcccatgatggtgtgatcaacggtaaaactgtccagtagtggcatacgtcacctcctgttctgagaattttttttaaaacgatgaaacttttctgttcgcccaacgtctgaatatatgaaagacgcgcatttgttatcatcatccctgacaacagagatgttaatttggccacattgatgtggcctttttcttttctacccttcccggctcgccagatacgcttcaaaatccagcttatcattcgcttccagctgctgctgtgcagcaacagacgcctgcgcctgacgcgtgaaatcttcttctgtcagcacttccagcggctcttcgcagagcagatggcgatactgttcagccagcgccacgccggttccggttacaccgttgtccttcattgcctgaaggatgcgcgccgagtaggttagctcaggatcgtcgaacgatgctaccagttgatcgcaaacctgctgatattccgtgctgtcctgattatgactgtctaacacttcagcaacccgacgcagatcggcaaacagggttttgcccacttcaaccagcgaatgttcctcttctccgcagcctacggcaattttctggtccggtttacgcccttccagcacaacccggttccagtttatacgggtgcattgcaactcatctgcactcatttccggcgcatcggccagggtacaccagatcaggaacaggtcgaggaagcgaacctgattctcatctacgccgatcgcagagaacgggttgatatccagcgaacgcacttcaatgtactcaataccaccacgcagcagcgcatcagagggcgcttcacccgagcgtgtcacacgcttaggccggattggcgcatagagctcgttttcaatctgcagcacgttggtgttgagctgcagccagttaccgtcggcatctttagtgcccatcgctgcatactcttctgacggcgtcttgatcgctttcttcagcgcagtgacatagccttccagtgagttaaacgtgatgcccagagagctctgcgatttattggtgtagcctaaatcgctcagacgcagcgaggtggcatacggcagccacatcgtgtctttgtcgttggtttcaaacggcagcgcgctctcacggccctgcaggaagctggagctgatagcaggcgatgcgccaaacagataggggatcacccagccgaagcgataatagttgcggatcagccgcagatagcccgccgagatcgtctcttttccgctttccttatctttcacgtcagcccactcctgccagaatgagagtggcagtgagaagttatagtgaatgccggagatggtctgcatcaacgcgccgtagcggtttttcagcccttcgcggtagagcgtcttcatctgaccaatattggacgtgccatattgcgccagttcaatattgtccgcatcgtcaatcacgcacggcatactaaacggccacatgcgttcatcacccagttcacgggcaacgtgacgatgaatatcgcgcaggaatgccagcatatgatcaatgctgtgatccactggcgtaataaactccagcaacgtttcggcaaagtcagtggtgatccagtcatgtttcagcgccgaccccagagattccgggtggccgctttttgccagctcgccatttgcctgtacacgcagcgtttcacgctcgatgccacggccaatacctttaagggcattgggatgcgcttccagccaggagagcgctttagatacgtccgggatcacattacccccccgctgtgataataatttatttttgttcagcataatgttaaccgtagcctcgaatctgtgcgaatcaatgccaccattgcataccctgtaatgtggcagtcgcgataacgatataacgcagtgttttgccgacagcgagaaacagcatcgcgggtagccaggcgaaacgtaaccagcctgccagaaacgcagagcagatcacctatcactggcagccagctgaataacagtgctgcaggtcccagtcggtgcaaccacgtcattgctgtgtcatgccatcgcccctgacgttttaacggcagcaagcgaccaataagaatgttggttaagccgcccaaggtgtttcccagtgatgcggccaaaagcaacccgtaaactgatgtcttttttgctatcaatagtgctatcagcagtgcttcagaacttcccggcaggagcgttgcacttaaaaagctgctgccgaacatcgaggcataggtaagaacgtcactcacagtaagcggacatccaccacagccatacctgccgccttcgctgcctgaataccaaagtccgcatcctcaaacaccacacaacgtgtcggcgtcacacccatcagctcagcgcagcgtaagaaggtttcaggctcaggtttatgacgctgtacgtcgtcagcaccgacgacggccgaaaagagctcacgtacgcccagctgcgtcagtaacgcctctgccatgctgtgttcgcttccggtaccgaccgccatcggacgacgcccgtgatacgctttcaccacctccattaaaggcagtggcttcacgttttccagcagcatcgctttcacagcagcggttttttctgcggcaagaagatgagggtcgagtgacgactgattggattcaatgatgaactgcgacagccgccaggttggtgcgccattgaagtcgataatacgtgcttcatccagcgttaatccataacgcgtcagtacctgacgccacgcttttcgatgtgtcggctcagtatcaagaatcgtgccgtccatatcgaaaatcagggcgtcatattgatcgtacattgtcactccggacattcatcaaatgagacattactttagcctaatgtggacaggttgtcgccaggggggatgaacagcaaatgctttgaaagcattaacaatttttgttttcagataaaggtgatcgtgcacggccagcgataaacgtacgaaattccagcgtttttttaacattcttctggcagacaagcggcggcggacgggcatgggcagctaaacagaaggcgttgatgcgggaaacaggcgtttcggatcgcttaagtcaggatgatgaatcaatggagcagattaaacaggaaaagagtgcgtgtgaagccagagggaaactgcagaggtttttcaggatactcactcagcgtttgctgtacggacggttacggaagtaacgctatcgtgtttagtgaggtcttagcgatcatcgcgccatgatactttgagggattttgaggctaaagaagaagatggtgcatccaggaggatgactcagcttgcgcttcgccctgcgggccgttgcagatgcaacgttatccctcttcgtgcggccggaacgcttattgcgtcatgtcacactgaggaactgccaacattcgagaagatggtgcatccaggaggattcgaacctccgaccgctcggttcgtagccgagtactctatccagctgagctatggatgcattgggatctatcttttggggtctatcttttgaggtacaactttttatggacttacagaaaccaacctgaggatgttacaaagaatggtgcatccaggaggattcgaacctccgaccgctcggttcgtagccgagtactctatccagctgagctatggatgcataaaacaaattcttgtacaacgcagggtgctaactactcaccatgaaaggaattgctaattcgctttgtttcgatggtgcatccaggaggattactcagcttgcgcttcgccctgcgggccgttgctgatgcaacgttatcctccttagtgcggcctgtacgctaatgcgtcatgtcacaccgaggcacttctccatattcgaaaatatggtgcatccaggaggattcgaacctccgaccgctcggttcgtagccgagtactctatccagctgagctatggatgcatcgaaaatggcggtgagggagggattcgaaccctcgatacagcttttgaccgtatactcccttagcaggggagcgccttcagcctctcggccacctcaccttacgctttctttcgaactgtgcgtctgaacgttgtttctgctcatcggcactgcgtggcgcacatattactttcccggacttttaagtcaaacaatttttccgaaactttgtttgattgagcaaatcacacacaattgggacaaaatggcgacaaaaagagtgaattatcaacaatgaaagatgatggcgttaacaaaacagaggaggaacaggtagaaagaaaaggcaggatttttacagaaagcggtagcgcctcgcacaggtgcgagacgctgaatccgttaaacgctggtttgttgcgttttttcagcctggatgcgttgatagatctcttcgcgatgcacagacacttctttcggcgcgttaacaccgatacgaaacctggttacccttaacacccagcaccgttacagttacctcatcaccgatcatgagggtttcaccaactcgacgagttagaataagcattctttgctccttgaaagattaaaagagtcgggcttgtacaggctcccggcattatccatcatttaacgctgcacaatgtgtatgagaaatacaccaatgcacatcgatgcgccaatacattctgctgatagttagtttagccgaaatacactacatcaacctgactttgtcatttgctgctttagcatcgtattaaaaagcgccggaacaaccgttctgacgctttttacgatgccttgttttaattcacttacagacggctgctgacccagtcctcaacccctgctaatacgcctttcagagcacccgcatcgttaccaccagcttgtgccatatcaggacggccaccgcccttcccgccaacctgctgagccagaccggcaatcaactcacccgctttaacacggtcagtcagatctttggtcacacccgcaatcagcgacaccttaccttcagtaaccgttgccagcacaataatcgccgaccccagctgattcttaagatcatcaaccatggtacgcaacattttaggttcaacattgttgagctcactgactaacagtttcactcccttaatgtcgatagcattgctgctcagtgaagcgctctcctgcgcggcttgctgatcgcgcagttgctgcaactctttctccagagcccgtacatgatcgaccagaccacgcactttctcattcaggttgctgctgttcgcttttaccagctgcgcaagatcctgcagctggctgctctgcgcattgacctgcgccagcgcgccttcacccgtaatcgcttcgatacgacgaataccggctgcagtacctgactccgcctgaatacggaacagcccgatgtcacccgtgcgcgcagcatgggtaccaccacacagctcaacagagaaatcacccatggtcagaaacgcgcacgcgctgatcatatttctcgccaaacagtgccattgcccctttagacttcgccgcatccagatccatcacttcggtttcaaccggcaggttgcgacgaatttgcgcattgacgatatcttcgacctgacgaatctcctgaggtttcatcgcttcgaaatgcgagaaatcgaaacgcaggtacttgtcgttaacaagcgagcctttctgcgccacatgctcacctaaaacctgacgcaaggcggcatgcagtaagtgagtagcagagtggttaagacggatgcgcgcacggcgtgccgcatcaacctgtgcctcaaggcggtcaccgatacgcaactgccctgcggtcagcttaccgacatgaccgattgcctgaccatatttttgtgtatcctggacgctaaattcagcattcttccctttcagcagaccggtatcgcctacctggccacccgattcgccatagaatggcgtttcatccagcacgaccacggcatcctgacccgcggtcacttcatcaaccgcctcgcctgcaacatagagcgctttcaccgtggcagctaaatcgagctggtcgtagcctttaaaggatgaggcggcatcaatacgaataacgttgctgtagtcagcgccgaagccactcgcttcacgtgcgcgctgacgctgctgctccatcgcccgctcaaagccggcttcgtcgatcttcagattgcgttcgcgacagacgtcagccgttaaatcagccgggaaaccaaaggtatcgtagagacggaagacgatttcgccatccagcgtgtcgccctgcagtttttccagctcttcgtccagcagcgccagtccgcgctccagggttctggcaaactgatcttcttcgcttttcagcacctgctcaacctgagcctgctggcgctgtaactcttcgcctgcggcacccatgacctcaaccagtggcgcaaccagcttatagaagaaggcctctttggcgcccagcatgttgccatgacgcacggcacgacgaatgatacgacgcagcacgtagccacggttctcattagacgggatgacgccatcggcaatcaggaatgcacaggagcgaatgtggtcggcaatgacacgcagcgatttgttactgaggtcagtggcaccggtaacctgcgccacggcctgaatcagtttctggaacaggtcgatttcatagttggagttgacgtgttgcagaacggcagaaatacgctcaaggcccattccggtatcaaccgacggttttggcagcggcagcatggtgccatcagcctgacggttgaactgcataaagacgatgttccagatctcaatgtaacggtcaccatcttcttccgggctgcccggcgggccaccccagatgtgatcgccatgatcgtagaaaatctcgctgcacggaccacaaggaccggtatcgcccatctgccagaagttatctgacgcatacgcgctgcccttgttgtcgccgatgcgaataatgcgttcacgtggcacaccgatttcattcgcccagatatcaaaggcctcatcgtcggtttcatagatcgtcacccacagacgctcttttggcaggctgaaccactgctcgctcgtcagcagttcccaggcaaaaccaatcgcctctctcttgaaatagtcaccaaagctgaagttacccagcatttcaaagaaggtgtggtgacgagcggtgtaaccgacgttttcaagatcgttgtgtttgccgcctgcgcgtacgcagcgctgtgacgtggtcgcacgtgtgtagtcacgtttgtcctgaccgaggaacacatctttaaactggttcatcccggcgttagtaaacaacaacgttggatcgttattcggtacgagggagctgctggttacaacctcatgtcccttgctatgaaaaaagtcgagaaacgcttgacggatctcagcagtgctcttgctcatatatatcctggaatcacgctaacgaacgttccctctgatcggcgcgaccacattctggtggtgcctgattagcggaacaaaaagtgggaataagataaattttcttcagtgggaagtaaaattacatcggcttttagtcatcaaaatttctgaaaatggactggatatcttcgctcataaaaccctttgactgcagatagcgtagtactttcgctttctctttccactctgtgggcagcgggtgtccgaattttcgttcagccagctgagccgcacacgccgcccagtctacctctgtctcttccattgcaagatcaatggcttcacggtcgatgcctttctgggccagttcaaggcgtacgcgctgcgatccaaagcccttacggctccggctctgaataaatcgttcggtgaaacgctcgtcgtttaaccagccgctttcctgacaccagttaagaacctgttccagcaacgcttcggtaacaatttcgggctcttttttctgcgcccacgcagcacgctgcgctgattgttgcagcttacgcgctaactctgcacggctgtggtcgcgctgacccagaatacgcatcgcacggtcaagcaaacgagagtaagagacgacattaggttggggctgagagggttcagtcatactgcgcaccttgtacaaacagagggagattatggcgacagaaacaggacagagggaaggcaagaaaggtaatagagggggataaaaactacgggagaggctttcgcccctcccgcatcagagattagaagtcttcgttcgcttcagccgcgtcttctttctcagcagccttgtcggctgctgcgagtttttcatccgcgccgttgagcaacatctcacgtaacttcagatcaatctcgtttgccacagcagcattctctttcaggaagttgccggcattcgatttaccctgaccaatcttgtcgccattgtagctgtaccatgcacccgctttttcaatcagcttgtgcttcacgcccaggtcgaccagctcaccaaaggtattgataccttcgccgtacatgatctggaactcagcctgtttgaatggcgcggcgattttgtttttcaccactttaacgcgggtctcactgccgaccacgttatcgccctctttgattgcaccgatacggcggatatcaagacggacagaggcgtagaacttcagcgcgttaccaccagtggtggtttccgggttaccaaacatcacaccaattttcatacggatctggttgatgaaaatcagcagggtattggactgcttcaggttaccggccagtttacgcatcgcctggctcatcatacgtgccgcgaggcccatgtgtgagtcaccgatttcaccttcgatttccgctttaggcgtcagcgccgcgacggagtcgacgatgatcacgtcaacggcaccagagcgcgccagcgcatcacagatttccagcgcctgctcaccagtgtctggctgagagcagagcaggttatcaatgtctacgccgagtttcttggcgtaaaccggatcaagcgcatgttctgcatcgataaaggcacaggttttacctttacgctgtgcagatgcgataacctgcaaagtcagcgtggttttacctgaagactcaggtccgtagatctcaacgatacggcccattggcagaccgcctgcgcctaatgcgatatccagcgacagcgagccggtagagatagtttccacatccattgagcggtcttcacccaagcgcatgatggagcctttaccaaattgcttctcaatctggccaagcgcggcagctaaagccttctgtttgttttcatcaatcgccatttcaactcctaatcaagccgggtaaacacgcactcagggtgcctgtactctttctgttgccgacaattatactgtatagtcatacagtatcaagtttaatttgtcagaaattcgccatacagtttctgcagggcccatgccaccgactggcggcgtacggcatcacgatcgccgctaaaatgctgctgaaaagtcaatacgttatcctgcggcccggcaaagccaaaccacaccgtgcccaccggtttttcttcactgccgccatccggaccggcaataccgctgacggagatcgcgtagtcagcatgggccgccctgcgagcacccagcgccatctcccgcaccaccacatcacttaccgcaccatactgcaacagcgaagcagcctgaacactgaccatctgctgtttggcctggttactgtaggtcacaaaaccccgctcgaaccaggcggagctgccgctgatatcggtaaagactttggcaatccatccccccgtgcaggattccgcacaggttacggtggcattgcgctgcttcagcttctcacctatctgcgcactaagcgcctgcaattgctgatcatccattgcgactctccctttggctatgggttgaaggtggtgcagaaaaactgctttttcaaggccactcaccattattacgctgtttttgcggccagctttccactgcgcttaccggtttttcaccgcaaccataaaaagacgcgggaaggcgagcaacacctgaccatcggcctgagccggataagccgcgagcagacgctgatgataatcggtcagaaacgccgactgttcggtctcatccagcgttgccaggaaaggccgtaaaccggtcgcctgcagccagctgataattgcctgcgcatcggccatcacgtgataataggtggtacgccagatatccacctcacagccggcctgcgtcagcagatcgtaatactcgcccgtggaaagcagctgtgtacgttcagcggcatcggcattgatgcgtgaaacgccagcgatctgttgccgccacctcgcgcatcagccggtgcgacggctcattgaggttatcaggcatctggatcgctaacacgccaccgggcgccagctggctgaccagatggggaaacagcgttgcgtgattatccagccattgcagagacgcattggcgtagaccacctgctgcggcacatcggcctgccagttgcggatgtccgcctggataaaacgacagtgcggcaggcgttcagcggcctgagttaacatcgtggcggaactgtccagcccggtaatctgcgccagtggccaggcatcggcgagcagctcggtgctgttaccgggcccgcatcccagatcggtcacctgctcaacctgttccaggctgaggcgcgccagaagttcgcgggctggacgggttcgttctgcttcaaacttacggtacagcacaggatcccactctttcatcatgacctctcgctcagttatcagatgcatccgcttactgagacggatgaaagaggaaaaagtgcgacccgttgctcacttttgaatcatgcgctggcagagaccggccggagtcattaagttaaaacactgtttcatttttttaacatccgattcaggagtcatttatgagtgaaaaatcgccctttgccggtgtctggtgcccttcagtcaccccgtttaatgcgcagggtgcggtcgatattgatgcgctcgggcgacatttctcccgcctcaatgactccggtatcgataccttactggtgatgggcagcattggcgagttcgcctcactgacgcagcaggaacgcttacaactgattcaggaagccagacccttgtcatcgctgaagatggtcgcgaacgtctcggcaacctgcattcctgacatgctggagctggctgaagccgcctggaaaaatgattttgacgcggtgatggtgctgccaccctactattatggccagacgcaaaaccagctgatgcactacttcgaagcactggacgcgcagctgggtggtaaatggtttgcctacaactttccagcccgcactggctgcgatctgacgcccgcgctgattgccgccctggcggcaaagctgcccaacttcgccggcattaaagatacggtggattgcctgtcgcacaaccggatgatgattgaagagacccgcaaggtgcgtagcgatttcgccgtactgtccgggtatgacgagtacctgctcccgaacctgctggcgggcggtgccggtgtaatttcaggactgaataatattgtgccggagtactttgcgcagatgatgacggcatggcgaagtggcaatctgccggagctgacgcgcctgcagcagcagatcggccgtctgatggcgatttacagtattggagatgatttcgtgacgacgattaaaacggccgtggcacggcgctatgactcgatgagcagcggctcacgaaactacggtggcacgctgaatgcggaacagtgtgccgcaattgataagctgttcagctaagcaggaaagcgggcgcatccctgcgcccctgatctcagttctttttcacaaactcagattttaatttcatcgggccaaaaccgtcgattttacaatcgatgttgtggtccccttcaaccagacgaatgcttttcactttggtgccgatcttcagcgatgaagaactgcccttcaccttgagatctttgatcaccgtgacgctgtcgccatctgccagcagattgccgttggcatcacgcacttccagtgttgcgttgctgctgtcaccttctccctcggtccagatgtgaccgcaggaggggcagttaaggttatcgccatcttgccaggtgtaatcggcgtgacaagccgggcaggcaggtaaagacatagtgactccagaaatatcagtggctgtgtggcctgaaaaagggcgtcatcatataaccttacagttaacaaggatagcctttataacaggccgccctggcgcgccttgctcaccgcctcacccagctgccacaccgccatcgcataatgggtactgtggttgtagcgggtaatgacatagaaattgggtaagccgtaccagtactggtagctggtgcccaaatccaggcgtagcagactgacctgatcgttaccgttcagcgagccctgtggtgacaatcctgacgccgccagcatgctcacgctgtaacgggttttgaagccatcttccagcatcggtgcctgaccgctggccggtaccgccacattttcgccgctgtgccagccatgcttctgaaaatagtgcgccacgctgccgatagcatccaccggatcccacaggtttgcatgaccgtctccgttgaaatcaaccgcataatcattgtaagaggagggcataaactgaccatagcccatcgccccggcaaaggagcctttcagcgccagcgggtcatcctgctctttgcgcgacatcaacagaaaggtttccagctcgctgctgaagtactctgcgcggcgcggatagttaaaggataaggtcgcaagcgcatccagaatccgcgttttccccatcacacgaccccagcgggtttccacgccaatgatgcccacgataatttccggtggcacgccataaacctgctgtgcgcgttgcagggcatcctgatactgattccagaaacgccaccccattttgcacgttatcgggcgtaatgaacttgttgcgatagcggatccaggcgccattaggtcctggcgctggcgtatagcttggtgcctgacggtccattagtcgcagcacataatccagtcgtttggcctgaccgatgatgttgtgcagttgctgacggtcaaagtcatgcttctccaccatcttatcgataaattgctctgctgccgggttaccggcaaagtcgccaaacatcgcctgtccgctgtgcgacggctgcagtaaaaaaccgccctgtggcgcagccagcatcttctgctgggacgggacttcaggtttgctgctgcaggaggccagaagcgggatgaacgcaaggaaggctaacttgaggcgcatcggttatccataaacgaggggtaatttcagatgcggtaatagtagacgttcagcgcaatgacatacagggcaaaatcttaaaaaaacgtcaaggcagccgtgggctaaaatggctgcgggtctctctctgtcccgcagccatcatgcgcttagcggcggtttctcaccagctgatagcgacgggtcagatactcaaccggcgcgctccagatatgcaccagccggcagaacgggaacagcaggaacagcgtcattcccagcaccatgtgcacgcggtagataaacgccacgccgtcgagatgctgcgaagcgccaccgtggaaggtcaccaccgcctgcgcccagcccaccagcttcatcatttcactgccgtccatatgctgggcggagaagggaatggtcagcaggcccagcgtcgcctgagccaccagcagggtcatgatcagaatatcaccgacgctactggtcgcccgcacccgtggattggtcagacggcgcttcagcagcagtccaccgcccaccagtgtcatcgccccgaacaggccaccggcaatcatcgccagtttctgcttcacgtcgatcggcaggaaggattcatacatccagtgcggcgtcagcatcccgacgatgtgaccgaagaaaataccgatgatgccgatgtgaaacaggttggaggcgagacgcatcccttttttgtccagcatctgactggaaccggcacgccagctgtactgcccgtagtcatagcgcagccagcttcccaccaggaagaccgttccggcgagataggggtaaatatcgaagaagaaagtgttaataaaattcatgctgattctcctgtggtacgcgccgtcgccgcggcgatgtccagatactgcggcgcgaccgcatcggcgaagcgacgctgatgcatcgcctgctgcgccgaggcgcagccctgttcgccgagaaatttaatctgctcctcttcccagacagcatccagtgctgccggcgtatcgtcgcgcgcttcctgcgccacctgtggcttgagggccgcaggatcaaccgcgctaccggatagcgtcagtaacactgtgaagagatcggcgtaggggctctgacgctcttcaagccgcgccgccagcaaggccaggataggcacgatgtcgtccagtccctgacgcgcggcctcatcgcttttacaggcgagatactccaggtagagcggcaggaaatcgggcagctctttgctgtccagctccagaccatcggcacgatactgttccagcagatcaaccatcgcctgaccgcgatcgcgtgactcaccgtgcacgtgttcaaacagcagcagcgaggtggcgcggccacgatcaaacagttcgcagtagtcagcctgcacgtcgagcagtggccgggcacagagctgattgataaaccgcaccagccgtgcactctgctgcaggttgagttcagtggcgtcatccagcgccgcgatcaggtcggaagagtgggtaaacagcgcctcgtccgggtagtccagcagccgcgaaagaatacgtaacgtcatcatgaggcatcctccggacgaatggttttcttactgatgtcgatggcatcaatacggcggctgttgaacaggttgaatttgctgtcgctgccgtgacagccatcgccaaagctaaagccgcagcctttgctttccgggaaggcttcacgcgccagtttcgcgatggctggaaggcaccacaaagcgatcttcatagttcgcgatcgccatatagcggtacatctcctgcgcctgcgcttcggtcaggccgacctgctccagcgcccggatatcatgctcaccgtccacgctttctgcgcgtttgtaatgacgcatcgccagcatccgcttcagtgccagcagcaccggtgcggtgtcgcctgcggtcagcaggttcgccagatactcaaccggaatgcgcaggctttccacatccggcagcacgccggtgtgcgccagcgccccgccatccaccgccgactgaatcggtgacagtggtggcacataccagaccatcggcagcgtgcggtattcagggtgaagtggcagcgccagcttccactccatcgccattttatagaccggtgaacgctgtgctgcgtcgatcacgctcagcgcaacgccatctttcagcgcctgcgcaatcaccgccggatcgttgggatcaaggaagatatccagctggctctgatagagatctttctcgttttccgctgcggccgcctgttcaatgcggtcagcgtcatagagcaacacgccgagatagcggatacggccgacacaggtttctgaacagacggtgggctggcccgcttcaatgcgcggataacagaaaatgcatttttctgatttgccgcttttccagttgaagtagatcttcttgtacggacagccggtgaggcacatccgccagccgcgacatttatcctggtcgatcagcacgatgccatcttcgccgcgtttgtagatcgcgccgcttgggcaggtcgccacacacgccgggttgaggcagtgctcacacaggcgcggcaggtacatcatgaaggtgtgctcaaactgaccgtaaatctccttctggatgttatcgaagttcttatcctgcgaacgtttggcaaactcgccgccgaggatctcttcccagttcgggccgttttcgatctttttcatccgctgaccggtgatcagcgagcgcggacgcgcaatcggctgatgcttaccggcgggcgcattgtgcagatgctgataatcaaaatcgaacggttcgtagtaatcatccagcgcgggcacatccgggttggcgaagatcttcgacagcaggccgatgcgactgcccatgcgcggctccagcttaccgttgatcttacggatccagccgcccttccacttctgctgatcttcccaggcgtgcggatagccgacaccaggtttgctttcaacgttgttaaaccaggcgtactccatgccctcgcggctggtccagacatttttacaggttaccgagcaggtgtggcagccgatacatttgtcgaggttcagcaccatgccgacctgtgaacgaattttcatggttttacctcctgctggctgccctggcaggcatcgttgccttccccatctaaccagttaacgttgttcatttttctcactaccacgaactcatcgcggttcgagccgacggtgccgtagtagttaaagccccaggagagctgcgcataaccgccgatcatatgggtcggtttcgggcaggtccgcgtcaccgagttatggatcccgccgcgctggctggtgatctccgagccagggatattcacgatacgttcctgcgcgtggtacatcatggtcatacccgccgggatacgctggctcactactgcacgtgcggtcagcgcaccgttggcgttgaacgcctcgatccagtcgttatccacaatacccagctcacgggcgtcatcttcactcatccagacaatcggtccgccgcgtgacagtgtcagcatcagcaggttgtcgctgtaggtggagtgaatgccccacttctggtgtggcgtcaggaagttcagcgccttctccgggttaccgttgggtttgctgttcagcaacggcttcgccgcacgggtatcgattggcggacgatagaccatcaggctctcgccaaaggcgcgcatccactcatgatcctgatagagctgctgacggccgctcagggtttcgccacgggatcagctcatgaacgttggtgtagcaggcgttgtaagagacatgttcatcttccagccctgaccaggtcggactggagataattttgcgcggctgcgcctggatatcgcggaagcgaatcttctcatcttctttattgagcgccaggtgggtgtggtcacgaccggtaattacgcccagcgcctgccaggctttcaccgccacctgaccattggtttccggtgccagcgccaggatcacttctgccgcatcgatcgccgtgtcgatatttggccgccccgctgccgggccatccgttttgacgtagttcagctgcttgaggaaatcgacctctttgctggtgttccagctgatacctttgccgccgttacccagggtctccagcaacggtcccagcgaggtaaagcgctcccaggtcgccggatagtcgcgctccaccaccataatgtgtggcgcggttttacccggaatcagatcgcattcgccttttttccagtctttcgcctcaaaaggctgcgccagttccgcgggcgagtcatgtaacaccggcagagtaacgacgtccgtttcaacgcctaaatgacccgggcagagatcggagaaggctttggcgatgcctttgtagatctcccagtcactttttgagtcccaggcaggatcgacggccgccgaaagcggatgaataaacggatgcatatccgaggtattcatatcgtctttttcataccaggtcgccgttggcagcacgacatcggagtagagacaggtgctcgacatgcggaagtcgagtgtgaccaccagatccagtttgccttcggcaccctgatccagccactccacctcttccggcttcacgcggccctgctggcctaaatctttgccctgaatgccgttttccgtgcccagcagatacttcagcatgtactcatgcccttttccggatgagccgagcaggttggagcgccagacaaacaggttacgcgggaagttctgcggatcgtccggctgttcagcggcaaaccgcatggtgccctgcttcaggctttccacggtgtaatccagcggcgactgaccggcggctttcgcctgcgccgcgatgtgcagcgggttgacgttaagctgcggcgctgaaggcagccagcccatacgttcggaacggacgttaaggtcgatcaggctgccgctgtagcgacttttatccgccagcggggagagcagttcgctggtggccagggtttcatagcgccactgactggagtggttgtagaagaaggaggtgctgttcatctggcgtggcggacgctgccagtccaggccaaaggccagcggggtccagccggtctgcggacggagtttctcctggccgacatagtgcgcccagccaccgccgctctgaccgacgcagccgcagaaaatcagcatgttcatcaggccacgatagttcatgtccatgtgataccagtggttcataccggcaccgacgatgatcatcgaacgaccgcgggtcttctcggcgttttcggcaaattcacgggcaatgcgaatgatgttctgacgggagactcccgtaatctgctccgcccaggccgggctgtacgctttgatgtcgtcgtaggtttgcgcgcagttgacatcatccagaccgcgatccagaccataattcgccagcgtcagatcgtagacgctggtgaccagcgcttcactgccatccgccagttgcaggcgtttcaccggcagcttatgcagcaggatttcgtccagcgcaacgctgttgaaatgctcgctggtaatgccaccgaagtaagggaaaccgacctccaccacctcatcatggctgccgagcaggctgagctgcagttcaacttcctgatgtgacgccccatcacgctgctcgaggttccatttgcctttttcgccccagcggaagccgatagatccctgcggcgcggtcagctccccggtcgcctcgttgatcgcgacggttttccactccgggttattctcctgaccgagcccatccaccagatcgctggcgcgcagctgacggccggcggcgtaaaaaccgccctcacggggttccagcagcaccagcatcggcatatcggtgtaacggcgcacgtagtcgcggaaatagccaacttcgcgatcaagatgaaactctttcagcatcacgtggcccatcgccagcgccatcgcgctgtcggtgccctgcttcggactcagccactggtcacacagcttcgcgacctcagcatagtccggcgtgatcgccacggttttcgtccctttatagcggacttccgtaaagaagtgcgcatccggggtacgggtctgcggcacgttagagccccaggcaataatgtaggaggagttgtaccagtcagccgattccggcacgtcggtctgctcgccccaggtcatcggtgaggccggcggcagatcgcagtaccagtcgtagaagctcagacaggttccgccaatcagtgacaggtaacgtgcgcccgcagcgtaagagaccatcgacatcgccggaatcggtgagaatcccataatgcggtcagggccgtaagtcttcgcggtacagatgttcgcggcggcgatcatctcgttgacttcctgccagctggagcggacaaagccgccgcgtccacgcgcctgtttgtagcttctggccttttcaggattactgatgatggatgcccaggcgtccaccgggtcgctgtgctgcgctttcgcgtcgcgccagagctgaatcagcttcttgcgcattaacggatatttcaggcggttagcgctgtagagataccacgagtagctggcaccgcgtgggcagccacgcggctcatggtttggcagatcgggacgggtacgcggatagtcggtctgctgggtctcccaggtgaccagtccatttttaacgtagattttccagctgcatgagccggtacagttaacaccgtgcgtggagcgcacgattttatcgtgctgccagcgactgcgatagccatcttcccagtcgcggttgctgtttaacgtctggccatgctggccggaaaagggttcggccagctgtttgaaatagcgaaaccgatcaagaaacttgctcatccggaatactcctgaaggcttaatgtgacattgctgactctgcatctgtcccgacacagaaagtgaaattgtgccggtgcgccacaccggctttgtcgttatcaggcgcgtgattttcggccgtaaaccagccaggtcaccgcgatgcagcagagataaaagaccaggaagattttcatcgcgccggcgggtgaaccggtcatcgcgagcgacaggccaaaagtctgcggaataaagaaaccgcccagcgcgccaatggcggagataaagccgagcgcagcagaggtttctgttgccgcttcacgctgtgccagcgcatcgtcgccgccctcagctttgatacgttccagcgtcagcttacggaagatcaccgcaatcatctggtaggtggagccgctgcccagcccggacgtcaggaaacaggcccataaacacggcgaagaaggcaacgaacgagccatcatgtccggcacccggcagggtaaggaacagcagcgcagcaaacagcgccatcagcacgtagttgacaagcgtgacgcgggtaccgccgaagcggtcagaaatgatgccgcctgctgaacgggccagcgcgccaataaaggggccgaaaaaggcgtaatgcatgatcacgacatcaggaaattgcgtcttcgtcagcatggcaaaaccggcagagaaaccaataaacgagccaaaggtggccagatagagcagcgccataacccacaggtggggacgtttcagcaccggtaactgctcacgcagcgaggatttcgccgccgccaggtcgttcatgccgaaccaggccgccagcgtgccgatcgccaggaacggcacccagatccaggcggcattctccagccagatgctgtcgccggtgacggtggtctgacccacatcggcaaaaccaaaaatggcacaggagatcgccagcggggcgacaaactgcattacgctgacgccaagattaccgaggccaccgttgatgcccagcgcgccgccctgacgggctttgggaaagaagaagctgatattgcccatgctcgacgcgaagttagcgccaccaaaaccgcacagcagggaaatcaccataaaagtggtgaatgaggtctggctgtcctgtacggcaaagccgagccacaggcagggaatgatcaggatgccggtgctgaaggcggtccagcgacgtcccccaaagatgggaataacaaaagagtaaggcacacgcagcaacgcgccagaaaccgacggcagtgcggtcagtaaaaagagctgctcagtgctgaaggtaaagccaactttattcaggttaaccgcaacggtgctgaacagcatccagacgcagaagcccagcagcagacagaagacagaaatccacaggttacggctggcgatacgtttaccacgcgcctgccagaacgcatcgttttccggttgccagtcctgaattaacgcgccgcgcgtcggggtttgcaaagaggtggattgggtcataaatctctcatcagcagaataataattgtgcgtatcctgcgcatccgccgtggtgtcgggcttgatacaaatcaacggcaatgcaggttacagaggtgcagcgccctctcttcaccccggttaagtagttgactgaattcagataacccttataaatcatagggtttaaacacggccgcccatgccttctgtaaaagggtgtccgactggaaataaaggagtagtccattgggggtatatagcgaccccgtttcaccggtaagataggctctccgcccgctcagggctggcgtatgtgacaggagcaggagccattgtgacggcagagaaattgacgcttttattgatcgacgaccatcccatgctgcgcaacggcctgaagcagctgattgcgctggatgaaaggctgcaggtggttgccgaagcgggtaatggcattgatggcctggcgctggcacagcagcatgatcccgacctgatcctgcttgatcttaatatgccaggtctgaacggactggataccctgacccagctgcgtgagatagccctttctggccgggtagtggtgttcagcgtttcagataatgaagaggatgtggtcagcgcgttgaagcgcggcgctgatggttatctgctgaaagatatggaaccggaagccttactgaaagcgctgcatcaggctgctgccggtcagatcgtgctgagcgaggcgttaaccccgattctggtcgcccggttgcgtgaagcgcagcctgctcagacgcgcgacatcaatcagctgacccggcgcgagcgcgatattctgcaactgatcagcgacgggatgactaataaagcgattgcccgcaagctggccatcagtgaaagcacggttaaggttcacgttaaatatctgctgaagaagatgaaccttaaatcccgacttgaagccgccgtctgggcgctgcagaacgggctgcactgacttttcccccttcccgatgcggcgcagtgccgtcctgctggccataaactgccgcagaaatcgcgagccgcctcgcagcctcgcatcagcgtcatgagaacaggcacttttttgtcgccagccgccgccacatttgccaggatgcctgtcaggttacacccggtcaggatcgcggctgtgcatcacgctggcatatgccctgccctattcgttatcatctgattatcctgcgcgcctggaatccctttcggtttcatgggcgttgaccgccagaaatttaccgcattaaaaatgagctaaaaccttatgcaagagccaaccgaaaaggactttccttcccacacgccgatgatgcagcagtacctgcgtctcaaggcggagcatcctgacattctgctgttttaccgtatgggtgacttctacgagctgttttatgacgacgcaaaacgtgcctcgcagctgctggagatttcactcaccaagcgcggtgcgtcagcgggcgaaccgatcccgatggcgggtgtgccctatcatgcggttgaaggttacctggctaaactggtgcagctgggcgaatccgtagccatctgcgagcagataggcgatccggcgctgagcaaaggcccggtcgaacgcaaagtggtgcgcatcgttaccccaggtaccatcagtgatgaggcgctgttgcaggagcggcacgacaatctgctggcggcgattgtgcaaagcccgcgcggttttggctacgccacgctggatatcagctcaggccgttttcgccttagcgaacctgccgatgctgaaaccatggcggcagaaaactgcagcgcaccaatccggcggagctgctctaccccgaagatttccaggcgatgtcgctaatcgatcagcgacgcggcctgcgacgccgtccgctgtgggagtttgagatcgataccgcgcgccagcagctgaacctgcagttcggcacccgcgatctcaatggcttcggcgtggagaatgcgcacctcggactgagcgcggcgggctgcctgctgcagtatgttaaagatacccagcgcaccacgctgccccacatccgctcgctgagcatggagcggcagcaggacagcatcatcatggatgcggccacccgccgtaatctggagatcacccagaacctggcaggcggcaccgacaacaccttagcggcggtgctggataaaacggtcaccccgatgggtagccggatgctgaaacgctggctgcatatgccgctgcgcgatgcgcgcatcattaaccagcgtcaggagtcgattgctgagctacaaaatctcagcgacgtgctgcaaccggtgctgcgtcaggttggcgatctggagcgaatcctggctcgcctggccctgcgcaccgcacgtccgcgcgatctggctcgcatgcgtcatgcgtttcagcaactgccggaacttaaccagctgctggccgatgttgaggcgccccagttgcagaagctgcgcacgcagatgggcgagttcactgcgttacgtgagctgctggaacaggcggtgattgagtcaccgcctgtgctgatccgcgatggcggagtgattgcgcccggctacaacgcggagctggatgagtggcgtgcactggcagatggcgcaaccgactatcttgaccggctggagatccgcgaacgcgagaagctgggactggataccctgaaggtcggctttaacggcgtgcatggttattacatccaggtaagccgcggacagagccatcaggtaccgatgcactatgtccgtcgtcagaccctgaaaaatgctgaacgctatatcattccggagctgaaagagtacgaagacaaagtactcacctccaagggtaaagcgctgtcgctggaaaaaagcctgtatgaggcgctgttcgatcagttgctgccgcatcttgaagcgctgcagttgagtgccgccgcgctggcagagctggatgtgttaagcaacctggcagaaacgtgcctggtccctgaactattgccgcccggtattgcaggataaagccgggattaaaatcagcggcggacgccatccggtggtggaacaggttctgaaagagccgtttattgccaacccactgtcactggcaccccagcgcagaatgctgattattaccggccccaacatgggcggtaaaagtacctatatgcgccaggcggcgctgattgcgctgatggcatggattggcagttttgttcctgccgatgagacgctgattggcccgctggatcgcatctttacccgtgtcggtgccgctgacgatctcgcctccgggcgctcgacctttatggttgagatgaccgaaaccgctaacatcctgcacaacgccaccgaaaacagcctggtgctgatggatgagattggacgcggaacatccacctacgacggtttatcgctcgcctgggcctgcgccgaaaacctggcgaaccgtatcaaggcgatgacgctgtttgccacccattatttcgagctgacaacactgccggaaaaaatggaaggcgtggtcaacgtccatctggatgccgttgagcatggcgacacgatcgcctttatgcacagcgtccaggagggtgcggcaagtaagagctatggtctggcggtggcggcgctggccggcgtacccaaagaggtgattaagcgggcacgcaataagctgaaggaacttgagaccgtttcaaaccactccgcgtcatcgacggtcgatggctctcagctgccgctgctggttgaagagacctcgcccgctatggaggcgcttgaggcgctggatccggatacgctgacaccgcgtcaggcactcgactggatttatcgtcttaaatcgctggtctgatattacatcccgtacatcgcaccgcgttaatgcgcggtgcgatgcttgctcgcccgcaaatcacttttctgcagacataaaaaaagcgatggttttcaccatcgcttttcgcattcaaactcagatttactgttaacgattattcacgaaacagtgcttcaatgctgaggccctgcgcctgcaggatttcacgcagacggcgtaaaccttcaacctgaatctggcgtacacgctcgcgggttaagccgatttcacgacccacatcctcaagtgttgccgcttcatagcctaacaggccgaaacgacgtgccagcacttcacgctgcttggcgttcagttcgaacagccatttaacgatgctttgtttcatatcatcgtcctgcgtggtgtcttccgggccgttgtctttttcatcggccagaatatccagcagcgctttttcagaatcaccgcctaatggcgtatcaaccgaggtaatgcgttcgttgagacgtaacatgcggcttacgtcatcaaccggtttatcaagctgctctgcgatctcttccgcactcggctcatggtcgagcttgtgggaaagttcacgcgcagtacgcagataaacattcagttctttcacaatgtgaatcggcagacggatggtacgggtttgattcatgatcgcccgttcaatggtctgacgaatccaccaggtggcgtacgttgagaaacggaaacccgcgctccgggtcaaatttctctacggcgcgaatcaggccgaggttaccttcttcaatcaggtccagcagagctaaaccacgattgctgtaacgacgagcgattttcaccaccaggcgtaagttactttcgatcatacggcgacgggaagggatatcaccccgcaatgcacggcgagcgaagaagacttcttcctctgccgttaacaacggagaatagccaatctccccgagatagagctgcgtcgcatctaacacacgttgcgtcgcaccctgtgatagcaactcttcttccgctacgtcgctatcactggcttcattttcaacgagtgccttctcgtcaaaaatttcagctccgttctcatcgaattccgcgttctcatgtaactcgtttactttcagcgtattctggctcataagcggctcctacccgtgattccagggcagaacataaacctgttttgttctgccggattatcgctgcggtaaataacgcaacgggtttacggatttccccttgtaacgaatttcaaagtgtaatctgactgaactggttccggtgctacccatggtcgcgatcttttgccccgccttaacttcctgttgttcccggaccagcattgtatcgttgtgggcgtaggcgctcaggtaatcatcgttgtgtttaatgatgattaaattaccgtaaccccggagtgcgttacctgcgtaaaccactcgtcctgaagcagtggcgaccacagattgtccgcgcgtcccggcgatatcgatacctttattgccaccttcggcggcagagaagttatcgatgatcttcccgtcagtcggccagcgccagcttccgaccggcgttgaactgttggttgtactgctaaccgttgggggtgcggtaacgactggagctgttgtcgttgcaacatttgctccattcgaaggcaacattttgctgccacccgaattacctgaatcatcagaatacgtaataacaggttgctgtgcaacagcaggcgatttaatttgtggcgccgccggaacgccgccctgcgttgcatcagcaacggtaatgggattgccgccggtaatcggctgacccgacccattgccaatctgcagagtctggccgacattcaggccatatggcgcaggaacattgttgcgctgggctaaatcacggaaatcgttgccggtaatccaggcgatgtaaaacaatgtgtcgccacgcttaacggtataagtttcaccggagtagctacccttaggaatgttctgataactgcgattgtaaacaatccggccattctgcgtctcaacattgctgttggtactaatcattccaccacttgcgggggcagatgctgaatttttgcttaacatttgtccctgggctggcgtggcaggaacgccgcctgaactcatgtctgctccagactggttagtgttcatgccgccattatcgccaacgcgactgatgggtgcctgtgagttgtcgctggagctacagcctgccagccaaaaacctaccagtgaaagcgccgccagacggcgtaactgaaaaagtgtgcttcccgtgctcattaatcccccgtgatggcaactctgatctatctgtttcactgtatctgccagcaggatactctgcgcggcgcgataaaatctgcgttttcgatgaataaactggatagtaacaacatcaggtacgtggtgctatgaaacagttgtgaagaaatacgaagagggtcaggccagatcgccctgcaccagcgggacaaaacgcactggttcgatggtctcttccatcacctcttcgccctgacgacgcaggcgcttcagtacctgctgatcttcgccaaccggcagcaccatgatgccgccttctgccagttgtgctatcagcgcaatcggaatttcaggcggtgcagccgtgacgatgatggcatcgaaggggccacgtgaaggccagccctgccagccatcaccatgacgggttgagacattatgcagatccagctgtttcagacggcgcttggcctgccactgcagccctttgatgcgttccactgaataaacatggtccaccagatgggcaagaatcgccgtctgataacctgaacccgtaccaatctccagcacacgcgaatgcggattaagcccgagcagcgcggtcatccgcgcgaccatgtagggctgtgatatcgtctgaccggagccgatgggcaaggcaacattgtcccaggctttatgctcaaacgcttcgtcgataaaacgttcgcgcggcacctcgctgatggctttcagcaggttttcatcatcgatgccctgctgacgcagttgtgacagcaacgtctcaatacgccgattcaccatgccaggttcacctcagctttagccagccagtcactgagcacgtttctgcgcgctgtgcgccgttaaatcgacatggagtgccgtgacagagacgtagccctgatccacggcggcgaagtccgtatccgggcccgcatccagtttttcccctggcggaccaatccagtagagtgtattgccacgcggatcctgctgcgcgatcacctgatccgccggatggcgactgccacagcgcgtcacgcggatgcctttgagttcagataacggcagatcgggaacgttgatgttgagaatgcggccggtgcgcagcggttcatgcgtcagcgccctgaggagcgcgcaggtcacggccgccgcggtggcgtagtgctgatggccgttgagcgaaaccgcgatagccggcaagccaagatgtcgcccttccatcgctgccgccaccgtgccggagtagatcacatcatcgcccagattggggccggcattgatgcccgacaccacaatgtcgggacgcggctgcatcagcgcattcacccccagatagacgcagtcggtcggcgtccccatctggacggcgatatcgccgttttcatgggtgaaggtgcgcagaggcgtttccagcgttaatgagttcgaggcaccgcttcggttacgatcgggggcaacaacctgcacgtcagcaatctgccgcagggctttcgccagagtctgaatgcctggcgcatgaatgccgtcatcgttactgagcaatatccgcatttcgttctgacctttttttattcgactggtcgccgtgacggaacctgttttaacggcatggcaacaggtgaggaatagacggcgatttttgcattctagcgaggcgcgcaaggaagtggtaggcgtaaatcacacgacggtgggggtttgccgcaacattacccacactgcgggtcaggttgcggcgaagattactcatcaatctgatcgggcgagtccgcgtgggtcagcagctcccggaccacgctggtagcgaagctgcccgctggcagccagaatgccagttccagcgtaacatcatcccaccagctccactgcatatcgcgcggcaccaccagcatggcacggcgtgcagcatcgaccttttcacgttcaatcagtcccagcagcagcgtctcatcagccagcgcctgctgttcaaaggccagcgcgtcagcctgcgggccaggctcgccccgtcccggcagcggcgcggtgatgcgcagctcatgctgctcaacccggcgctgtgactctgccagttcatcaggctgggcgacaaaccagctgcctcgtccggtcagctgcaacgcatcgccgttgagcacctgagtcagcccaccctgctgttgcagacgcgcactggtcacctgattaaacagcgcactgcgcgcggcagagagcatcaggctgcgcttgttgcggtcgcgaataatgatctcattgcgcgcccacttttctgccatcacgaggttattgccgccgcgaccaaaacgctgttcaccaaaatagttcggcacgcccgcatcgcgaatctgcgccagacgcatttcaaccgcatcacggtcactgatctggcggatgatcagccggaaacgcgttccccgccagtgcgccgatgcgcagcttacgtttgtggcgcaccgcctgcagaatctcgaccccttccagctcaaaaccgcgcagatcgggcatcgcattacccggcaggcgaaaacagagagtctgttccgtcaccgcatggcgatctttcattccggcataactcatgtcgcgctgatgaataccgagatacttcgccagtgcctcagccacaaagcgggtattggcccccactttacggatgcgcaccagcaggtgctcaccttcaccatccgcgccataaccgagatcctcaaccaccacgaaatcttccggattggctttgatcacgccggaggccacgggtgtaccgtgcaggtaattcagcatcattggctgtcagctttcaggactaacgccaccgcttcacaggcgatgccttcgccgcgcccggtaaagcccagcttctcggtggtggtcgctttgacgttgaccgcatccatatggcagcccagatcttctgcaatattgatccgcatctgtggcacgtgcggcagcattttcggtgcctgagcaataatcgtgacgtcgacattaccgatgcgatagcctttggcttcgatacggcgccaggcctcacgcagcaggccacggctgtccgcccctttaaaggccggatcggtgtcaggaaacagcttgccgatatcgcccatcgccactgcgcccagcagcgcgtcagtcagcgcatgcagcgccacatcgccatccgaatgggcgataaaaccctgctcaaacgggatccgcacaccgccaatcactaacggaccctctccgccaaaggcgtgaacgtcaaaaccgtgaccgatacgcatcatgcgctctcctttaattgaatctgactcagataaaaagccgccagcgccagatcttctggccgggtgactttgatgttatcactgcgtccgctgactaacagcgggtggtagccgcaatactccagcgccgaggcttcatcggtgatggttgcgccttctgccagcgcccgcgtcaggcaggcggtgagcagcgcatgagggaaaaattgcggcgttaaggcgtgccagagatcgtcgcgctctacggtatgggccaccgcggctttgcccggctcgccccgtttcatggtgtcacgcactggcgcggccagaatcccgccaacgtggctctgttcacgcacgttgagcagttgctggagatcgtcgggatgcagacagggacgcgcggcgtcatggaccagcacccaggcggaaccctgtgcggcctgcaatccggccagcaccgattcggcgcgggtctctccgcctgtcaccctgagcacgcgcggatcgcgtgccagcggcagtgaagcgaagtgctggtcatcaggactgagggcgacaatcacctgtttgatagcgggatgggaaaacagacgcgcaatgctgtgttccagaagggtgtgctgaccaatcgtcagatactgcttcggacaggttgcctgcatgcggctgccgatcccggcagcgggcaccacggcaatcacatccgcaagggaggccagagtgttcatgttttatcgttgttggttaagcgctgcttgttgcgcgttgcgtttgttctggtcaggcaccagacgatagaaagtctcaccgggcttaatcatgcccagttcattgcgtgcacgctcctcgatcgcttccgagccgccattgagatcgtcaatttcggcaaacagctgatcgtttcgcgatttcagtttggcattgtttgcctgttgcaccgcgacatcatcattgacgcgcgtatagtcatggatgccatttttccccagccacaacgaatattgcagccagccaagcagcaccaataacagtaacgtcagttttcccatcccgccccctaaaaacggcccaatcatcccataactttgcacaggactccacaccagcggagaaaatggcgcgctttgctgcgcgtctgcgcaaaatatgaatcagtaccgattcagacgggaaaagatttgtaacctgccgatgcgtttgcacatcagcgcgggcgcactgagggcttaccagccagagagaaaagagaacattaaccagaagagcgtgaccaccatgatcaccgtggcgagcgcggcccacagccactgtccactcagcagcgtattcagcgcgatacccgtgaccaccgcaaccggcagcagcgccagaaagaatggccaggtataaagaaagaagaacagcgtgttagagccgaacagcaggaaaggaatcgccagcgcgcaccagtaagcgagaaagccgataacgccgcccggcagcaatgagcgcggctcatccggggaggagtcatcttttcgagcgagcattggggtaatgttctgcataggcatcctgttggcgcgagggcggcaaatcagaaacgatttgccgctgtctcttcaggatttgatgatatcgcggtcacgcagcaggtctaacaattgggcggccagttttgtaaccaattgttcgccatccagctggatttccgggctatcgggcgcctcatagacgctgtcgatgccggtgaaattacgcagttcaccggcgcgcgctttgcgatacaagcctttcggatcacgcgcttcacacacggctaacggcgtatcgacaaatacctcgataaactgtcccggctccagcagatcgcgcaccatctgacgctcggcacgatgcggcgaaataaaggcagtgagcaccacgagtccggcatccaccatcagtttcgccacctcaccgacgcgacggatattctctttacgatcatcatcgctgaaaccgaggtcacgacagaggccgtgacgcacattgtcaccatccagcagataggtgctgacgccgatgcggtgcagcgcctgctccagcgcaccggcaacggtggatttccccgagcccgaaagccctgtgaaccacagcaccacgccctgatggccatgctgctgttcgcgagaggcgcgtgtcaccggatgatcatgccacaccacgttatcgtcgtgctgagccattactgaccgcccagcaggtcgcgcgcattccagtgtgggaagtggcggcgcaccagcgcattcagttccagctcaaacgcgctgaactcgccggtattaaccggggcatcatggtttggctgatggatcatgccggcacccacggtgacgttgctcaggcgatcgataaagatcatgccgccggttaccgggttctgctgatagctgtcgagcaccatcggttcgtcaaaggtgatctcaatgcgaccgataccgttcagcggcagcgtatcgacctgacgcgtctccagcgagttgatctcgacctgatgcagcaccttctctacccggccacgagttttcttaccggcgattttcaggtcatagctctgaccggcctgcagcggctgttctgccatccagaccacgtcaacgctggcagactgaaccgctgccagctcttcactggcatccaccagcagatcgccacggctgatatcaatctcatcctgcagcaccagggtaatcgcttcgcctgcacccgcttcctgcagatcgccatcgaaggtcacaatgcgggcaatggtcgactccacgccagaaggcagcactttaacgcgctggcctacctgcacgctgcccgacgccagagtgccggcatagccacgaaaatcgaggttcggacggttgacatactgcaccgggaaacgcatcggctgatgatcgacgacgcgcttcagctccacggtctccagcacatccagcagcgtcgggccgctataccacggcatggtctgactggcagaggcgacgttatccccttccagcgccgacatcggcacaaagcggatatcgaggtcttccggcagctgcgcagcaaagtcgaggtaatcctgtttgatctgttcgaagcgctcctggttgtactccaccagatccatcttattgatcgccaccaccaggtgtttgatccccagcagcgtcgagataaagctgtggcggcgggtctgatccagtacgcctttacgcgcatcgatcagcaggatcgccagatcgcaggttgacgcgccggtcgccatgttacgggtgtactgctcatgtcccggcgtgtcggcgataataaatttacgcttttcggtcgagaagtagcggtaggccacatcgatggtaatgccctgctcacgctcagcctgcagaccatccaccagcagcgccagatcgagcttctcgccctgggtgccgtgacgtttgctgtcgttgtgcagcgatgagagctgatcttcatagatctgacgggtgtcgtgtagcagacgtccaatcagggtactttttccgtcgtcaacgctgccgcaggtcagaaaacgcagcaggctcttgtgttgttgcgtggtcagccaggcttcaacgccgccctggtcggcaatctgttgtgcaattacggtattcatctggcgtctccttagaaataaccctgacgttttttcagttccatcgaaccggactgatcgcgatcgatcatgcggccctgacgctcgctggtggtggaaaccagcatctcttcgatgatctccggcagcgtctgcgcctcggactctaccgcgccggtcagcggccagcagccgagcgtacggaaacggaccatccgttcggtgatctcttcacccggctgcaggttgatgcgatcgtcatcgatcatcatcagcatgccatcacgctccagcaccggacgcggtgcggcgagatagagcggcacgatctcgatgttttccaggaagatgtactgccagatatccagttcggtccagtttcgacagcgggaagacgcggatgctttcgcctttgttgatctgaccgttgtagttgtgccacagctcagggcgctggtttttcggatcccagcgatggaagcggtcacggaatgagtagatacgctctttggcgcgtgacttctcttcatcacgacgtgcgccgccaaaggctgcatcaaaaccatatttgttcagcgcctgcttcagcccttcggttttcatgatgtcagtgtgtttggcactgccgtgaacaaaggggttgatgcccatcgccacgccttccgggttgcggtgaaccagcaactctgcgcccatcgctttcacggtgcgatcgcgaaattcgtacatttcacggaatttccagccggtatccacatgcagcaacgggaagggcagcgtgcctgggtagaaggctttacgcgccagatgtagcatgaccgaggagtctttgccgatggagtacatcatcaccggattgctgaactccgccgccacttcgcgaatgatgtggatactctccgcctccagctgacgcagatgagtgagtcgtttttggtccatgattttccctcaagccagattgacaacggcggactcgcgagccccctgctgtgctgaatgtttaaaccaggcgagttgcccgtgcagattaaccacctctccgatcaccagcagcgccggagtgggtgccgaggcggccagcgcctcaagttgttctaaggtgccggtcagcacctgttgatcctggcgggtgccgcgactgatcaccgccaccggcgttgatggcgcgcgaccatgctgaatcagcgcctcgctgatggcagcggctttaacggttcccatgtagatcgccagcgtctgacgcgcacgcgccagcgatggccagtcaatgtcatccccatcgggacggcagtgaccggtaataaacatcacgctctgcgcgtagtcgcggtgggtcagcggaataccggcataggccgtcgcaccggcagccgcggtgacgcccggcaccacctggaacggcacacccgcctgctgagccgcctgcagctcttcgccgccgcggccaaagataaagggatcgccgcccttgaggcgcacgacgcgcttgcctttcagcgccagtgaaaccagcatctgattgatctcttcctgcggcaacgtgtgcgcgctggcccgtttgccgacgcagatgcgatcagcatcgcggcgcaccagatccagcacctcttcgctgaccagatggtcgtagagcaccacatcggctaactgcatcacctgcaggccacgcagcgtcagcagaccgctgtcgcccggcccggcgcccaccagaaagatctcaccctgacgggtcggctcttcctgcagctcacggtccagcgtgcgtttcgcctcttcgacgttaccggcagacatctcactggcgaaccggccgtcgaaagcgcgttcccagaagcgccgacggtcagacatgcggctgaagcgctgtttgactttatcgcgccagagtccggccacttcagccatctgacccagactggcaggcagcagcgtttcgattttttcgcgcagcatgcgtgccagcaccggtgcggtgccgctggaggagatcgccaccaccagcggtgagcggtcaacaatcgaggggaagataaaggtgcattttggctggtcatccaccacgttaaccagcttatgccgcgcattggcggcttcaaacacctgggtgttgagatggttgtcgtcggtggcggcaatcaccaggaaaacgccatccagctgggccgggtcaaattcggtcgccagccactccagctcctgcttatccagcagtgcctgcagttcagggcagagttcacgagatgcgatcagaacgcgcgcgcgtgcacggcgcagcagttcaatttttcgcgccgcaatatctcccccgccgacaaccagaaccgggcggccagaaagatcggcaaaaagaggcaaatagtccacgttaaccctgatgttttaactttgtattaacgcgactatacgtcgctgagtttatccagatgaaattacgaattggaatgagtagttaccgaatggaataacgacgccgcaaagcacagaacaatttggtcttaacagatgaaatttaatggctttttcgtgaacaggctcacatattgaaagccacacctgcggcagcaaaagcagataagtgccagcgataatggtccgttacgcctttcggtagtgacagcgcccgattccactaacaaagtcacgggacaaaaaggatataatgcgcgcggcatggctggccctggcccccatgcggaacggctcccgaataatgaaaaaggatgcactatgttttattccctccgcttgagggtagcgacaattttatttggcgcactcatttctccgctggctctggccactccgcctggccagtttgccgaacagcaggtccggcacatcgccaccttgtttcctggccggatgagcggcagcccggctgagctgatggcagccgactacctgcaacagcaatttaccgcgctggggtataagaccaatacccgccagttcaggaccggctataagtggcaggaagaggacggcacgcagcgctggcataagctcacggcaacctcggtgattgccgcgcgtgcaggcagcgtgccgcaggagattctgatcgtggcacatctggatacctggacgccgcaaaatagcagccaggcccagtacaatctgggcggcttacgcctgcagggcgtcgatgataatgcatcgggtcttggcgtgatgctggagctggcgcagcagctgagccgcaaaccgctgcactacggcatacgctttgtggcgctgagcgccggagaggcagatctgcacggcatggatgattatgttgagcggatgagcacgcgtgagaagaagaataccctgctggtcatcgatctgaatagcctgatcaccggcgatcatctttattttaacagcggcatgaatacgccccgggcggtgcgcaagcagaccagcgaacgagccctgttactggcacgccagcagggcattcccgccgccagtcatcagctgaaccgtaaagactttgacgctcttaatgccttcgacaaggcgggctttccgctgctggatgtgaccgccagcaactggacgctgggtaataaagatggtgcgctgcagcgtcatcgtagtccccactttcctgatggcgttacccgccatcagactgacctggataatctgagctatctcgaccgctggctgccggggcagataaccttgcgaacccgcgacagcgttcgcgtgctgctgccgctgctcagtgaactgaccaatcccaaagtgtaaggatctgacatgtacgtggtctttctgaattacgttcgtccggtagaagaagttgaagcgctgctggcagcccatatcgaatggctggatcgctattttgacgcgggcttttttattgcagcgggacgtaaagatccgcgcacgggcggcatgttactggtcagggagatggaacgagaagagctggatgcaattttagcggaagatccgtttgtcacggtggcagagtatgaggtgacgaaagtgaatgtgacccgtgcagcagaggcgtttgccggattaaaaggcgcttagctttccgcctgactgcagccaaaaacttctctccctgtgtgcggggagagaagtcctgcgtcagccttcgtgcagaccacactcgcgcttgaggccgaagaagcgcgtctcttcttctgccatacccggctcccacttgcgggtggtatgggtatcgcccaccgatagatagccttcatcccacagcggatggtacttcagcttatgctgctccaggtactgatgaatctggcggttatcccagtcgataatcggcagcagcttaaagacgccacgctggacgcccagcaccggcagattcgcccggctgcccgactggtcgcggcgcaatccggcaaaccaggtctgcgcgcccagggtttcaatggcgcgattcatcggctcaactttgttgatctcgttatatttctcaatcccctcgacgccctgctcccacagtttgccgtagcgcgcttcctgccaggccggagaggtttcggcgcggaacactttaaggttgagattgagctggtccgccagctcatcaataaaacgataggtctccgggaacagatagccggtgtcggtcaggatcaccggaatatcgggctgcagacgcgtcaccagatgcagcgacaccgcggcctgaataccgaaactggaggagagcacataggcacccggcagattctccagcgcccagctgacccgctcttccgctgatgacttctccagctgcgcattggtcgcggccagcgccatagcacgctggactttggacatctcattcagtgctgcgaggtcggggtgactcattttgcttcctcccaaaaatcgcgtgccgggtccagcaccggcgcaacaatgcccgcgcggatggtgaagtcaccaaagccttcagcggcctggcgctcagtggcccagcgtcccaccagctcatcaatggtggcgagaatttcgctttcgttaatgttttcacggtacatgcggggaatacgcgttccgctgcggtttccacccagatgcaggttgtagcgacctggcgctttacccaccagacccagctcagccagcatggcacggccacagccgttgggacaaccggtaacgcgtaacactatgtgctcatcaccaacgccatgcgcatgcatgatcccttccactttggtcacaaaggcaggcaggaagcgctcggcttctgccatcgccagcggacaggtcgggaacgccacgcaggccatcgagttttcgcgctgtgccgtaacgtgatccatcagaccatgttcgcgcgcgattgcttcgatctgcgctttttcgctttccggcacgccggccacaatcaggtttctggttagcggtcaggcggaaatcgccctgatggattttcgcaatttcagcgatgccgcttttcagcggtcggcccggatagtcgagcaggcgaccattttcgataaacagcgtcaggtgccatttgttgtcgatgcctttaatccagccaatgcgatcgccacgggtggtgaactcataaggacggatcggctcaaacgtcaggcctgcccgtttttcaacttcggctttaaaggtctcaacgccaacgcgttccagggtgtacttggttttggcgtttttacggtcggtgcggttgccccagtcgcgctgagtcgtgaccaccgcctcggcaacgtcgaggatcttctccaccggaaaatagccaaactcgctggcggtgcgcgcataggtcgctttgttaccgtgctcaatcgacagcccgccacccaccagcaggttaaagcccaccagcttgccgtgctcggcgacagcgacaaagttcagatcattggcgtgcagatccacgtcgttatgcggcgggatcaccacggtggttttgaatttacgcggcagatacgtttcaccgaggatcggctcttcgtcggtggtggcgactttttctttatcccaccagatctccgcataggcacgggtgcgtggcagcagatgctcagagagtttcttcgcccactcatacgcttcctgatgcagttccgactcaaccgggttcgacgtacagagcacgttacggttaacgtcgttggcggtcgccagcgcatccagccccacttcatgcagcatctgatgcgtcggcttaacgttcttcttcagaatgccgtgaaactggaaggtctgacggttagtcagacggatgctgccatagatggttttatcggtggcaaatttgtcgatggccagccactgagtcggcgtaatgatgccgcccggcaaccggcaacgcaacatcatggcgtggcgcggctccagcttctgctccgcacgttcggcacgaatatcgcgatcgtcctgctggtacatgccgtgaaaacggatcagcaggaagttgtcgccggtaaaaccgccggtcagaccctcttccagatcttctttaatggtgccgcgcagatagttgctctgcttcttcagacgctcagcgtctgctaatttgccttctacaaccagcggtccagggtgtttatcgctcattagtaaacgtctcgctgataacggcgctcaatgcgcagctcacttaaaaattcgtcggccgtttcacgatccattccgccgtgttcgaccaccacatccagcaatgcctgctcgacgtcttttgccatacgattcgcgtcgccacagacataaagatgcgcgccctcttcaatccagcgccacacttcggcccctttcgcgcggatcttatcctgtacgtaaatcttctctgcctgatcgcgtgaccaggcgaggtcaatatgggtcagcagaccatccttaacatatttctgccactctacctgatagaggaaatcgtcggtgaagtgcggattaccaaagaatagccagtttttgccgctggcaccgtcgttgtcgcgctgctgcataaaggcgcggaacggcgcgatgccggtgcccgggccaatcatgatcactggcgcatccggattagacggcaggcggaaattgtcattgtgctcgatgaagacccggacttcgccctcttcttcgatgcgatcggccagccaggtcgatgcaccgccgccacgctggcgaccttcaatatcaaagcgaacggcaccgacggtgatatgcacttcggtatcggtttcagcctgcgaagaggcgatagagtagagtcgtggcgtcagcggtcgcagcagtccggtcagctgttcagcgctgagttcagacggtgccaggcgcaccatatccacaatcggatagtgctgcgcatagtgctgcagcctggctttatcatccaccagtgagagcaactccgcgttgcgtgacagctgggcatactgcgccacgatctgcgcggtgttaaccgtcagctcgaaatgcttctgcagcgcctccgccagcggcagggttttcccctgaacctctaccggctcatcgcctttcagccagaccagctccagcagttcgctgaccagcgccgcgtcgttctcataccagacgcccagcgcatcgccaggctggtagcgcagaccggaatcgcccagatcgatttcgatatggcgcacatctttatctgagtcccgtccggtaattttctgattcaccgccagactcgcgctgagcggcgactctttagtataggggctggtggtgacttcgttgacgctgccggctgctgtcgccgcagcctgcgccggggattcagtgggaacgcgtttcttgagaatttccgtcagtgcattgcgccaggcggcggcctgctccgcatactcaacatccgcatcaacgcgatccagcagacgctcgccgcccagctccgccagtcggctgtcaaaatctttacccgcctgactgaagaattcataagaggtgtcgcccaggccaaacactgcgaaggcggcaccctccattttcggtgcctttttcgacatcaggaatttatgcagcgccaccgcctcttctggcggttcgccttcgccctgggtggaggttacaaccaccagcattttttcctggccaatctgtttgaacttgtaatcaccggcattcaccaggtttacgttcagctttgcggccagcaggtcatcacgcaactgctcagccagacgacgtgcgttgccggtctgggaagcggaaagcagcgtaatggcgggcgcttcggccggagccggagcagatgcagtgctggcgacggcgctacccggggtctgttccaccctgccccagaaatagcctgacagccacgccagttgagtcggggaataatctgtcgtcgccgcctgtaagcgagcgagttgttccggagagagcggaagcattgaaccaggtgcctgagtcgtcatcgcgttaaaaattccagtatcagaagtccggaccgtaaaatggcggaagagtgcgtaggttaccggtccgtatattaacgattaaatacaccttcgacatatcaaataaccaaaatgactaaatggttttccaggtagaaataatcgttaaaagtggtaagtaaagcggtgatatatcagttaattagctggacgccactgtataaacgcgcaggaaaagtatcggtttgtgcggttcgggtgcgaaaaaagcggtaatcaggtagaattcagcggttttttaatgtctgagaaccattatgtctaccaccttgtttaaagagttccagttcgaagccgcgcatcatctaccgaatgtgccggccggacacaaatgtggccgtctgcacggtcattcgttcctggttcgtctggagattaccggcgaagtggatgcgcataccggctgggttatggattttgctgagctgaaggcggcgtttaagccggtctacaatcggctggaccactactatctgaatgatatttccggcctggaaaatcccaccagcgaagtgctggcgaaatggatctgggatcagatgaagccggaactgccgctgcttagcgcggtgatgatcaaagaaacctgcaccgcaggctgcgtttaccgcggctaaccctgtcggatcgaacccttcgatccgacgcggcttttctctccgtcctgcctctgacgctcaacgctttcctgtagttaacggctcactgcgtgccgctttatcaggatcaggcgatattgagatatttatgggtctgcatcgacagacgccagttacgggcaatgcaggtctcaatgcagagccgggttgcatcatctttgcggctgattggctgcagggcgatgatacgcgctttggtgtcatcaatgcctgccagcagccgatccagcgcttccacatcacgctcgcgcgctaccggatgcttgatttcatcggcccggctcagcgcctggggcagaacatcgtagccgccgcgcatgttgaccttcggcgagacagtcacccaggtccgttcggaacagtgaatctcgtgggttccgctggtctcaatctggcactggaaaccgtgctgctccagcgcagtggttaacggacgcagatcgtatatcgccggttcaccaccggtgatgaccacatgacgcgccgtccagccctgctgcgcaatggcactcaccagggtcgccgcgtccgcatcaccccaggcgtcgctttccaccgtcttgatcaaaatatcgcccagcgacgtttcccgatctgtccgcttttcccaggtgtgtttggtatcgcaccagctacagcccaccgggcatccctgcaaacgaatgaaaatggcaggcacgccggtgtaataaccttcgccctgcagtgtctggaacatttcgttaatcgggtattgcattacggactcgcttgaaaaaaacagggcgctgattatggcagatttgccgcgcagctcaaccacgcgttgtgccttttctccgcgccggacaaaacacaaaagagaggcttcagacggctgacaggctcagaaacgtggatggccaggaccgaagagcaaagcgtcccgcgctcaggacaaaaacgccggaagcgtttttgaacaacgcaaaacgttgtcccggtaaggggcgcacctcagggatgaggtacgtaatcgcgcggacccggccggcagagatgccgctttggcgatcgggcctttccatctgcgtttgcacaccgccatcaacaaaaagccccgcacaaggcggggcttcagaggccgatgatgtcacttagcgcgacatcaatgcacagtcattactgacctttaacttctttcagaccgttgaatggcgctttagaacccagcgcttcttcgatacggatcagctggttgtacttagcaacacggtcagaacggctcattgaaccggttttgatctggcccgctgcagtacctaccgccaggtcagcgatggtagcatcttcggtttcgcctgaacggtgagagatcacggcagtgtagcccgcgtctttcgccattttgatcgcagccagagtttcggtcagagaaccgatctggttgaatttgatcagaatggagttagcgatacctttatcgataccttctttcaggattttggtgttggtaacgaacaggtcatcacccaccagctggattttgtcgcccagtactttggtctggtaagcgaagccgtcccagtcagattcgtccaggccatcttcgatagaaacgatcggatactgtttagtcagatcttccaggaagtgggtgaactcttcagaggtaaacgatttaccgccttcaccggccagaacgtatttgccatctttgtagaactcagatgccgcacagtccatcgccagggtgatgtctttgcccagctcgtagcctgccgcttttaccgcttcagcgataacagccagcgcttcggcgttggaacccaggttaggcgcgtagccgccttcgtcacccactgcagtgctcatgcctttgcttttcagtacttttgccaggctgtggaacacttcagaacccatacggatggcttctttcaggtttcggagcgccaaccggctggatcatgaattcctggatgtcgacgttgttgtcggcatgttcgccgccgttgatgatgttcatcattggcagtggcatagagtatttgcctggggtgccgttcagttcagcgatgtgctcatacagcggctgacctttagaggctgcagcggctttagcagctgccagtgaaacagccagaatggcgttagcaccgaagttagatttgttctcagtaccgtccaggtcgatcatgatcttatcgatgttcgcctgatctttcgcgtctttgccttttaccgcttcagcaatcggaccgtttactgcagcaacggctttggttacgcctttgcccagataacgtgatttgtcaccgtcacgcagttccagcgcttcgcgtgaaccggtagaggcacctgatggtgcagctgccaggcctacgaaaccgccttccagatgcacttcagcttcaacagtcgggttaccacgtgagtcgataatttcgcgaccgatgacttttacgattttggacattacgattttcctcagtacaagttagtcaatcctaagacaagcaacgcgcgaaaagttcgcgcgctgcctgtgaaacttacttcgctaaacgcttctgatgctcatgtgcggctttaacaaagccggcaaacaacggatggccgtcgcgtggggtcgaggtaaactcaggatggaactggcaggccacaaaccacggatggttcgggatctcgataatctcaaccagttgatcatcaccagagcgacctgctacgcgcagaccggctgcttcaatctgctttaacagcatattgttcacttcatagcggtggcgatggcgctcaacgatagtgtcagagccgtagagctggcgaacctggctgcccggcgttaactgacactgctggctgcccagacgcatcgtgccgcccagatcgctctgctcgctgcggacttcgacgttgccatcttcgtcacgccattcggtgattaatgccaccaccggatatttacagtctggcacaaattccgtggagttggcgcccggcatcccggcgacattgcgggcgaactccatcagcgcaacctgcatgcccaggcagatgcccaggtacggcacgttgttttcacgtgcatactgcgcggtcatcagcttgccttccacgccacggtaaccgaagccacccgggatcagaatcgcatccagatctttcagtaattcgacaccgcgtgattcaacatcctgcgaatcgatcagtttgatgttcacggtgacgcgatttttcaggccgccatgtttcagcgcttcgatgaccgacttgtaggcatccggcaattccacatacttgcccaccataccgatggtgacttcaccacccggattggcttcttcgtagatcacctgctcccattcggccaggttggcttccggtgcattcaggttgaagcgcttgcagatatagtcatccaggccctgcgatttcagcatgccaggaatcttgtagatggaatcaacgtctttcagcgagataaccgctttttcagggacgttacagaacagggcgattttagcgcgttcgttggccggtacggcacggtcagaacggcaaatcagcacgtctggctgaataccaatcgacagcagctctttcaccgagtgctgggtcggtttggttttcacttcaccggcagccgccatatacggcaccagcgtcaggtgcatatacatggtgtgttcgcggcccacatcaacggccatctggcgaatcgcttccaggaacggcagtgattcgatatccccgaccgtgccgccgatttcgaccagtaccacatcatgaccttcaccgccttcaataatgcgttctttgatggcgttggtgatgtgcggaataacctgaatggttgcgcccagatagtcgccacggcgctctttgcgcaggacttctgagtagatacggccagtggtgaagttgttacgacgcgacattttggtacggatgaagcgctcgtagtgacccaaatccagatcggtttcagcgccgtcatcagtgacgaaaacttcaccgtgctgcgtcgggctcatggtgcctggatccacgttgatatacgggtccagcttcatgatggtcacgttcagaccacgggcttcgagaatggctgcgagggaggctgcggcaatgcctttacccagagaggaaacgaccccgccggtcacaaaaatataattcgttgtcatgctgaacctgagagtttaggtttaaagacggtggaataaccaggacgggaaaacagtatactggaaaccgctatcagccacaattgatgaatcaccgccatcctccaacgcattgctgcggctaacatagccgatagccgccaatgaaatgttgacgtgcgtcacaaagttgccgtcaggctgaatcgagtaagcgaaagcggtgactttatgcacagcgctggaataatcagcgcttctcgccccgtttcacctgctgccaggcggcttccatctgctccagtgtggcacccggcatacttaacccctgtgcagcgatgatcgcttcgacttcgcggaagcggcgctcaaacttgtcgttggccttttgcagcgcagtttccgctttgctgcccagatggcgcgacaggttaaccgtggcgaaacagcaggtcgccaatctcctcttccagcttctcaccatccaccacgctctgctgcgcctcgtgcatcacttcatcaatctcttcatgcaccttagccaccaccggccccagcgtggtccagtcgaatccgacattgtgacaacgcttctgaatcttgtgggcgcgcatcagtgcgggcagtgccttagggatatcatccagcgccgaatgctgggctttgtcagcccgctcagcggtttttatcgcttcccagtttttcagcacttcgctgctggtttctgctgtggcatcgccaaaaatgtgtggatgacggcgctccagcttgtcgctgattgcgtggcagacatcctcaaaattaaagcgatcctgttcgctggccatctgcgcatagaacaccacctgaaacagcagatcgcccagctcaccgcgcagatcgtcaaaatcttcgcgctggatggcgtccagcacttcgtaggtctcttccagcgtatagggcgcgatggtggcgaaggtctgttcacgatcccacggacagccatgttgtggatcgcgcagggttttcattatgccaagcaggcgctcaatagcattcattcaggaggatccttgattagtgagatgacaggcaacgggcgaagaggcaaagcgtacaacacggcaggacgctattcaccgcgtccggccgtgtctggtggtgcagaaaacgcctgcgcaacctcctgctgccggttgcctcagtgcctgcctgaatatcagtgcaggcgacgggcgtcaatgatatcagagacctggttcagacgcgccaggacacgtcccagtacctgatggttgtagatctcgatatccatgtcgatggtcgccagctgttttttggtgtcgctgcggcttgagacgcccaggacattcactttctcgttggcgagaatggtggtgatgtcacgcagtaagccgctgcgatcgttggcggtcacgcgcaccaccagcgaatagccgctggagtagctttcgccccacaccgcatcgacgatacgttccggcgcatgcgaaatgagttcagccagctggtcgcagtcggcacggtgaatagagatgccgcgcccctgggtgatgaagccgacaatatcatcccccggaatcggctggcagcagcgggcaatgtggtgcatcaggttgcccacgccttccacgacgacgcgtccgctctctttgcgtgaagagggagtgtacgatttctgggtcagctggcgcagtgcttcgcgatcttcctcttcggcgctcggcttgttcagcttcgcctgcaggaagttaaccatctggttaagacgaatatcgccgccgccaatcgccgccagcagctcttcaagcgaggtgacgttatagcgcggcagcagcagtttttcggcttcgcgcaggctgatatccagctgattcagttcgttatccagaatctgccgtccggcgattatattcttgtcgcgatcctgcttgcggaaccagttgtggatcttcgagcgtccacggttggtggtgatgtagcccagattcggattgagccagtcgcggctcgggttcggctgcttctgggtgatcacctcaacctgatcgcccatctgcagctggtaggtgaacggcacgatacggccaccgattttcgcgccgatgcagcggtgaccgatgtcgctgtgaatatgataggcaaagtcgagcggcgtcgatccagcgggcagatccaccacgtcgcctttcggggtaaagacgtagacccggtcatcgaacacctggctgcggacctcttccagcagtttcgccggagtccgccatctcttcctgccagctgatgagcttacgcagccaggcgatccgctcttcatgaccggccgcgccacgcgcgctgctggaagttggcccctctttatatttccagtgcgccgccacgcccagctcggcatcttcatgcatctggcgggtacggatctggatctccaccgttttgccctgcggccctaacaccaccgtatgaatcgactggtagccgttgggtttggggttagcgacgtagtcatcgaattcgctgggcagatggcgatagagcgtatgcaccgtacccagcgcaccgtagcaatcctgcaggcgatcggcgacgatgcgcaccgcccgcacgtcaaacagctcatcaaaggccagcgattttttctgcatcttgcgccagatgctgtagatatgtttcggacggccatagacttcggcgcgcacgccctctttgaccatctctttgcgcagattgctgacgaagttctcgatgtactgctcacggtcaatacgccgctcatgcagtaatttggcgatgcgcttatattcgtcaggatgcaggtagcggaagcagtaatcttccagctcccatttgagctgaccaataccgagacggttggccagtggcgcatagatattggtgctctctttggcggccagtacccgctcatcttccggcgcatctttcatttcgcgcaggttcatgatgcgttcagccagcttcagcactacgcagcggaaatcttctaccatcgccagcagcatgcggcgaacgttatccacctgttcagaggccatggagtcgttgtggatcgctttcagctggcggatagcatccatatcgcgcacgccgtgtaccagcgaaacaatgcctttgccgacggcggtttccagctcctcttcactcaccacttcatcgttagccagcgggaaaatcagcgccgcacacaggctttcgatatccatgctgagcattgagaggatttcaaccatctcaataccgcgccacagcagcagcgactgatcaggatggccctgcgtctgcgcttcacagtagcgccaggtctcggccacacgttgacatgattgcgggttggcaataccgagactggcgatccactggtcgagggcgaaatccccctcagtatttaaatgcgcacttctgaccgcaaccataacctctcctgcacaacgacatacatcgcttatgtttttctgaacagcaccatggattcgagatgacgggtatgtgggaacatatccagcatcgcgaccctttccaattggtagcctgccgacagcaatgtctggctgtcgcgggcgagtgtggtgggattacacgaaacatagaccacgcgatctggtgcaagtttaaccacatgcgccattacgcccgcagccccggcgcgtgccggatcgagtaataccttgttaaatccctgtgccgcccacggctggcgcgacacttcttcttccagattatgctgaaagaaactgacatttttaagattattcaaatcagcattatacgctgcctgccgcactaatgctgcaatcccctccacaccaaccacattatgtacgaagattcctataggaagtgtgaagtttcccatgccgcaaaacagatccagcacccggtcttccggctgcagatcgagccaggcaattgccttcgcgaccatctgctgattaacaccatcgttaacctgaataaaatcctgtgggctgaaggttagcttaagctggtgagattgataaaacggcgtcgactcatttaacgcactcaactcttcctcgcccgcatccaggaaacagcatcagctgatgcttatgcgaaaactgttccagtttttcacggtcatccgcatgcagcgcatcaagatggcgcagaatcatcagcggcccgttgtctgccagcaccagctccacatgcccgagacgcctgacggcgcgtaagtcactgagacactgatgcaatggaaccagtaaagcctcaagttcgggcactaaaatggggcattgctgaatatcaaccagatcgttgctggcttcctgacggaagcccatctgcaaccgctgcgccttattttgccattgcagccccagacgggcgcggcgacgataaccccagggctgaccggcgattacctcatccaccgccacgtcttgtgcggcggcctggcgcagcatccggctcagcgcctgggctttgctctgctgttgcagcgccacatcggcatgctgctgctggcagccgccgcagcgttcataatgcgggcagcgtggcgtgatgcgcgccggactgcggctaatcagtcgtgtcactttcgcccgggcaaattgacgtttatcctctgtcagcatgacctccgcctgttccccaggcagggcaccggcgacaaaaagggttttgcccttgtgacgcgccaccccttgtccgaacggatcgagcgcctcaatggtgacggtgatccgttgttgcgtcgtcacgcgctgttttgcaacgtaaaattgcgccatagtgttattaattctctttatcgaaaacgacctgcattgtttttgtcgacagcatgcacagggacgttaatgccggagtagccaggcgactattatgaccaaatacagcctgcgggcgcgaatgatgattttaattctggcacccacgctgatggttggcctgctgctcagctcattttttgtggtgcaccgctacaatgaactgcagcgccaggttatcgatgccggagccaatatcattgaaccgctggcgatctccagcgaatacagcatgacctggcacaatcgtgacgccatgcgtgaactggtcagcctgctgcaccgccgccattcgggcatcgtccgggcgatctcggtgtttgataatcacaaccagctctacgtcacctccaatcacaagcagaacctcagcctgctgcaacaggatgatatccgcgccctgcccgacgatgtctccatggaacgtcacggcaacgtattgattctgcgcacaccgatcaccaccgagcgttacgatgtggatgaattgccggacgaagatgccaagccgtcgggcaatccgctgggctacgtggcgatagagctggatctgcagtcggtgcgcctgcagcagtacaaagaggtgtttgtcgccacgctgatgctgctcttctgtctctgcctggccatgctatttgcctatcgtctgatgcgcgatgtcaccgggccgatccgcaatatggtcaccaccgttgaccgcatccgtcgcggccagctcgacagccgcgttgagggatacatgctgggtgaactcagcattctgaaaaacgggattaatgcgatggcgatgtcgctgaccgcctatcacgaagagatgcagcacaatatcgatcaggcgacctacgatctgcgagagacgctggaacagctggagattcagaacgttgagctggatctggcgaagaaacgcgcccaggaagcggcacgcatcaaatctgagtttctggccaatatgtcgcatgagctgcggacgccgcttaatggcgtgctgggctttacccggcagatgctgaaaacccagctgcgcaccacccagcgcgactatatgcagaccattgaacgttcagccaataacctgctcagtattatcaatgacgtgctcgatttctcgaagctggaagcgggcaaactgatgctggaggcgatccccttcccgctgcgtgccacactggatgaaacgctggtgctgctggccccgtcggcgcatgacaaagggctggagctgacggtggtgtgtgacagcagcgtgccggacaatgtgattggcgatgcactgcgcctgcaacagattctgattaacctgatcggtaacgccatcaagtttaccgagaaagggtatatcggcctgcgtgtcggacagcgggtgattacgcagtcgcgcgtcgagctggagattcaggttgaagatagcggcataggcatctctgagcagcaacagacacagctgttccaggcgttccgtcaggctgacgccagcatttcgcgccgtcatggcggcaccgggctggggctggtgatcacccagaaactggtgcgggagatgggcggcgaaatcaccttcagcagtcagccggacaagggctccacctttgtgattcgcgtgcagctggatctcaatcccaatgcgcccggcatgccacgcgtgctggatgcgctgtcacatgcgcgcattgcctatgttgaagcggatgctaacgttgccagcgcagcactggagatgttaagcgccacaccattgcagatcgattacagcgaaacgctggagggtttaaaagcgtctcactatccgctgctgctgatggcgatgccggtcgacatcagtcagcccgagctgctcaatgaacgcatgattaatgcgctgctggatcgggccgacaacgtgctgatggcgctccccagcccgatgatgttgctggcggatgaactgaaggtacgcggcattgacggttgcatcgctaaaccgatctccctgacgcgactcctgccgatgttactggatctgcatacccgtcagatcagtgaactgccgctttcaccccggctgccgctgacggtgatggcggtggatgataaccccgccaacctcaagctgattggcgcgctgctggaggagcaggtgcagaacatcctgctgtgcagcagcgccgaacacgccatccgtgaggcacgtcagcagtcgctggatgtgattctgatggatattcagatgccggacatcgatggcattcgcgccagcgaaattatccgcagcatgccgcatcatgccagtacaccgattgtggcggtcaccgcccatgcgattgatggcgagcgtgagcaattgatcaaggcgggcatgaatgactatcttgccaaaccgattgatgagagcaagttaagacagttgctggcgcgctatacgccaccaccagtggtcaccgtgccggaactgctgccaatattacccacgctggactggcaactggcgctgcgacaggcggcgaacaaagccgatctggcgcgcgatctgctgcggatgctgctggaatttttaccggaagtgcatgcgaagatggcgcagtttatgtcgaccaatgaggtcaacgccctgcgtgagattattcacaagctgcacggcagtgccagctacagcggcgtgccgcgcatgaagcaactctgccatcagctggaaagagagctgctggaggccagcgatatcgctgcgctggagccggagctgctggagctgcaggatgagatggagaaacgtcgcccgagaagcccgccagctgttagggattggataaggctattggttagttaaacccggccgatgtggagtggccgggtaatgctggtggttagttaaacccggccagctttaacgtggctgccacattacgtgccgtcatctcaacattctttccggcgctggcgagtgcctcatccagcgtacagatgctgtagagcacgctgaataccgcatcgatcccgtgctgatgcaccacgccgacatcggccgtcaggcttccggcgatgccaatcaccggcttattaaagcgctttgccacgctggcgaccccgatcggcaccttgccattaatactctggctgtcgatacgcccttcaccggtaatcaccaggtcagcatcttttacctcctccgccagccccagcgcctcagtaacaatctcaatgccgcgccgcagctccgcctgacaaaaggcatgcagcgccgcccccataccgcccgctgccccgccgcccgggatatgcagcacatcaatatcgagatcgcggtgaataatcgcggcgtaatgggccagcgcctgatcgagctgctgcaccagcgccggtgtcgcccctttctgtgggccgaaaatggccgatgcaccctctttgcccgtcagcggattcgtgacgtcacaggccacttcaatgcggcactgatgaatgcgggcgtccagcgcgtcaatatcgatgctggcaagatcggcgagtgcaccgccaccgtgaccgatctcgcagccctggtcgtccagcagccgggcgcccagcgcctgcatcatgccggctccgccatcattggtggcgctgccgccgataccaatgatgatgtggccgacccccttatccagcgcatgtctgatcaactcgccggtgccaaatgaggtcgttatcagcgggtcacgctgcgatgcaggcacccgctccagtccactggccgctgccatttcgatataggcggtggactcatcgccggacaggccatagaaggcgtcaacctctgttcccagcggccccgtcaccttcagcctgacgatttttcccttcgtcgccgccaccatcgcttctaccgttccttcaccgccgtcggcgaccggtattttcacgtaatgcgcatcgggaaagatgtcacggaaacccgcttcaatcgccgatgccacatccagggcggataaactctctttatatgaatccggtgcgattacgattttcataggcaatccgagcgcagttgagtaattgaaacggctctgaaccagtccggtttccgcagagaccgacaccgggttttagcgggcgatttcaaccttcgctaacttctcataatagcaggccagcgcgctgtggtcggcgctaccctgcccgtcgttacgcagcgcctgcatcatctccatcaccgccgccgtcagcggcagatgcgcgccgatgctgtgcgaggtatccagcgcgtttcgccagatctttgatatgcaggtcaatgcggaagccaggtttgaagttgcgatccatcaccatgggcgctttggcatccagtaccgtactgccggccaggccgccacgaatcgcctgatagaccagatccggattcacacccgctttggtcgccagtgataacgcctcggacatcgccgcaatattcagcgccacaatcacctggttggccagcttagtcacgttacccgcaccgatgtcgccggtatgcaccaccgatcccgccatcgatttcatgatgtcgtagcaggtatcgaataccgctttatcaccgccgaccatcacagagagcgtgccttcgatcgctttaggttcaccgccactgaccggcgcatccagcattttgatccctttttctgccagcgcatcgtggacttcacggctcgccagcggcgcaatggagctcatgtcgatgaccaccaggcctggcttcgccccttcgataatgccatttttacccagacagacttcaatgacctgcggcgagttgggcaccatggtaatcaccacatcgcactgctcagccacctcttttggcgatttcgccacggtcgcgcccagttcagtcagttccgcttcgttgtcagcgttatgatcgcgcaccaccagcgaataaccggctttcaccagatttttactcattggtttgcccataatacccaggccgataaatccaattttcattgcgtttccccttgattgattagcgcttaaatttgtcgcataacgcctgagaggcgttgcggaacataccgacatcgctgccgacggcgacaaaagtggcaccccactccagataacgacgcgcgtccgcttccaccggtgccagaatgccgctcggcttaccggcagctttggcgcgttcaaaaatgtgtttaatcactttcagcacttcaggatgggcgggctgaccgagatagcccagcgcagcagagagatcgcccggcccgacaaaaataccgtcgacaccgtccaccgccgcgatggcgtcaatgttgtcgaccgcctgctgggtttcgatctgcaccagcaccgtgatgttgtcattgatggtgctgttgtaatccggcagggtgccgtacatgttgctgcggtgcgaaaccgagacaccgcgaatgccggctggcggatagcgggttgatgcgacggcacgcagtgcttcctcttgggtctcgacaaatggcaccaggaagttgttaaacccgatatccagcagacgcttaataatcaccggctcgttgcagggcggacgcaccacgggcgcactgtggctgcctttaagcgccatcagctgcggcacaaacgtggtgatatcgttgggcgcgtgttcgccatccaggaccagccagtcaaaaccggccagccctaaaatctcggtagagatcgggctggcaagcgcacaccagctgccgatcagggtttcacccgctaacaaacgacgacgaaatccatttggccaggctgcattactcatggttaaactcctgtgacgatggctccccgtggggagccgaaaaggttaacgtaccaggcagggacgtttgttgtcgtaggtccatcccggcactaaaaattgcatcgcttcggcatcgtcacgcgcgcccagcccctgcttctgatagagcgcgttggcctgcatcacctgatccatatccagctcgacgccgagaccgggcttctgcggtacctgcaccatgccgcctttgatctggaatggctctttggtcaggcgctgattgccctcctgccagatccagtgggtatcaatagcggtgatcgcgcccggcgcggcagcggcgacgtgggtgaacatcgccagcgaaatgtcgaagtggttattggagtgcgagccccatgtcaggccgaagtcgtgacacatctgtgctacccgcaccgaaccctgcatggtccagaagtgcggatccgccagcggaatgtccaccgactgcagcgacagggtatggcccatctgacgccagtcggtggcgatcatattggtggcggttggcatgccggtggcgcggcggaaactccgccatcacttcacggccggagtacccctgctccgcgccacagggatcttctgcgtaggcgagcacatctttgagctgtttgccgagcatgatcgcctcgttgagcgaccaggccccgttgggatcaagggtgatacgggcttcaggaaaacgcttagccagcgctgtgaccgcttcggcctcttcgccgccgcgcagtacgccacctttgagtttgaaatcgttgaagccatatttctcatacgccgcttccgccagccgcaccaccgtctccggggttagcgcctcttcgtggcgcaggcgataccagtcgcagggatcgctctcctggctctggtaagagagggacgttttgcggcggtcgccgatgtagaagagataaccgagcatctcaacgcggtcgcgctgctgtccgtcgcccagcagcgaggccacattaacctccagatgctgacccagcaggtcgagcagcgccgcttcaatgccggtcaccacatgaatagtggtgcgcagatcgaaggtctgggtgccgcgcccgctggcatcgcggtcggcgaaggtgctgcgcaccaggctgagaatgtttttgtattcgcccacggttttgccaatcaccagcgacgctgcatcttccagcgtctggcggattttttcgccgcccgggatttcgccgacgccggtgtgtccggcgttatctttgataatcacaatgttgcgggtaaagaatggcgagtgagcgccgctgaggttcagcagcatgctgtcgtagcctgcgaccggaataacctgcatggcggtgactttcggtgttgaactcatctcctgctccttatgctgttgcacggccaaatgccgggcgtttgcgatcaaatgtccagccggggaccagatattgcatcgccgtggcgtcgttacgcgcaccggcgggcagtgactgataaagctgattggctttgtttacctgctcccagtcgagctcaatgcccagacccggcgcatccggtaccgcaattttcccgttgcggatttgcagcggatttttcgtcaggcgctgatcgccctcctgccagatccagtgggtatcaatcgcggtaggattgcctggcgccgctgcacccacatgggtgaacatcgccagcgaaatatcgaagtggttattggagtggcagccccaggtgaggccccactcatcgcagagctgcgcgacccgcacggcaccgctcagcgtccagaagtgaggatccgccagcggaatatcgaccgcattgagcatcaccgcgtgattcatctcgcgccagttggtggcgatcatattggtggccaccggtaagccggttgcgcgccggaactcggccatcacttcacgtcccgaatagccctgctccgcgccgcacggatcttcagcgtagctcagcacatcctgcatccctttacacagcgctatcgcctcgtccagcagccaggcgccgttcgggtcgaccgtaatgcgggcgtcgggaaagcgctgcttcagcgccgccgcggtggcaatctcctgctcgccaggcaacacgccgcctttgagcttaaaatctttgaagccatatttatccgcagccgcctcagccagccgcaccacggcatcgctggtcagcgcttcctgatgacgcaggtgataccagtcgtggctggcctgctcaccactcagatagggcagatcggtcttgcggcggtcaccgagatagaacagatagcccagcaccgtcacttcatcacgctgtttacctggccccagcagttcagccaccggtacgcccagacactgtcccagcagatcaagcagcgccgcttccagcgcagctaccgcgttgacccgcaactcaaaagtccaggcaccgttgccgaaggtggtgaagtcagccgactgattgcctttgtgcacctgttgtaccagacggttcattcgcgcaatctgctggcctttcacctgcggaatcgcctctaccagcgtctgatagatggtgtcgccgccgggggcttcaccgacgccggtgtgaccggcgctgtcagtgagaaccacaatattgcgggtaaaacaggcgttgtgcgcaccgccaatattgagcagcatgctgtcataaccggcgaccgggataacctgcatctcagtaatcaccggcgaactttgcgtattcataatgcatccttaccgggccaggttttcagttcgacacgtttgatatcgcccgcgatcaccaggaagctgaatgcggcgacaaaggcgtgaataccgacatagatcagcgcgccttcaaaggagccgctggtggcgatgatgtaaccgatggcgataggcgtcacgatgccagagaagttaccgaacatgttgaacagaccgccgctcaggccactgatctctttcggcgcagtatctgccatcaccgcccagccaagcgcaccgatgcctttaccaaagaaacgccagtgccatgaagaacaccaccacccattcggtatcggtgtagttacacatcaccatcgaaatagagagcagcatgccgagtacgatcggtgttttacgcgcgatattcagcgagccggttttacgcatcagccagtcggagatcaccccgcccagtacgccgccaaggaagccgcacaccgccggaatcgaggcaataaagcccgctttgagaatcgacatgccgcgcgcctgtaccagatagaccgggaaccaggtgataaaaaagtaggttaaggcgttaacgcagtactgaccgaggtagatacccagcatcatacgtgacgtcagcagctgtttgatctggaaccacttctcgctccagctcactttgcggctatcctttttgacatccatgttgatcagcgcaccgccctgctccatgtactccagttcggctttattcacgccagggtgatcggtgggatcgtggatcactttcagccagatgaagctgaggatgatgcccaggccgcccataaaccagaacacgtgcgcccagcccacggaagagaccagccagcccatgatgggcgcgaagataacggtggcgaagtattgggccgagttgaagatcgccacggccgtgccgcgctcctgcgccggaaaccaggccgcgacgatgcggctgttgccagggaaggagggcgcttcggccagtccgaccaggaaacgcagaataaacagcgacatgattatgccgaagccgctgaacagatcgacgaacccttgcaaaaaggtaaagagcgaccaggtaaagatgctccagaaatagacgcgttttgagccgaagcggtcaagcagccagccgcccggaatctgaccaataacatacgcccatgagaaggcagagaagatatagccgagtccgaccgaatcgaggccaatatcttttgacatcgccgaaccggcaatcgaaatcgttgcgcggtcaccgtagttgaatgaggtgacgataaataacatcaccacaatccagtaacgggcattggtgcgtttctgcaccgtttccgcggtctggctgaaactattcatgatgcactcctgaaatatagcgtgagctacattcgctctgactgcatacacatcgcgttgggtatcagagagaagttgggttaaacacggcgatctttttgttttggcaaactttatttatccatccggcgtctggcagccgcggccggtaataactccaggcaacctctttcggatgaataatacgtcgtgacagataacctgactttggctaacggaactcagtataagaacagcctgtggcgatcacattggcgcatagccctggaataatcgccttattgaagtgattgtctggcgaatgcacaaaagcctgcggtatagctcacgaaagtggcaaatacccgtgcaaaatccgccccggataacgctttcccacgctgtttgtgagggtcttcacttgcttttggataatcgacccaaaacagcgagacgaattgacttaatggtggtcatttgcacaatgcgcgacccgccccgcctccctatactgaagctggcaaacaagggcgtgacaggtcagatcattacagcgtgccgcacaagtacggtacgacagacgggaaggtgagcgatgaacccaaaaacagatgaacaaccgctctatatcaaagtccatgagcacgacaatgtggcgattgtggttaacagcctcggtctgccagccggtacgcagtttgcggatggtctgaccctcacagagcatgtgccgcagggccacaaagtggcgctgagcgcgattaatcagggtgcagagatcgtgcgttatggcgaagtcattggctatgcattgcgggatattgcccagggcagctggattgacgagtcactggttgcgctgccggaagcccctccgctggagagtctgccgttagccactcaggttccgcctgatttgccgccgctggagggctatacctttgaaggttaccgcaatgcggatggcagcgtaggcacgcgtaacctgctcggcatcaccaccagcgtccactgcgtggccggtgtggtggatcatgtcgtacagatcattgaacgggatttactgccgcgctatccgaaacgtggatggtgtggttgccctgaaccacctttatggctgtggtgtggcgatcaacgcaccggcggcggtcgtgccgattcgcaccattcataacctggcgctgaatgcgaatttcggcggcgaagtgatgatcgtcagcctcggctgtgaaaagttacagccagagcgtctgctgactggcacccccgacgtgcaggcgatttcgctggacgatcatgacatcgtgcgtctgcaggatgaaaagctggtgggctttggcgcgatggtcaatgagattctgcaggtggcggagcgtcatctccagcggctgaatcagcgccagcgcgaaacctgctccgcagcagaactgattgtcggcatgcagtgtggtggcagcgatgcgttttcgggcgtgacggcaaatccggcagtgggcttcgcctctgatctgctggtgcgttgcggtgccaccgtgatgttctcggaagtcacggaagtgcgtgatgcgatccacctgctgacgccgcgggtgattaatcaggaagtcggtaagcgcttactggaggagatggcctggtatgataattacctcgaccagggccagaccgatcgcagcgctaacccgtcgccgggcaataagaaaggcggtctggcgaacgtggtggaaaaagcgcttggctcgatcgcaaaatcgggacgcagcgccattgttgaagtgctctcgcccggccagcggcccacgcgacgcggattgatctacgcggccacgcccgccagcgattttgtctgcggtacacagcagctggcatccggtatcaccctgcaggtgtttactactggtcgcggtacgccttacggtctggccgcgattccggtgatcaagatggcgacgcgtaatgcgctggcagagcgctggcacgatctgatggacatcaatgccgggacgattgctaccggtgaagagagtattgagcaggtgggctggcgactgtttgaattgattctggatatcgccagtggcagaaagcagacctggtccgatcgctggggcattcgtaatcagctggcggtgtttaacccggcgcctgtcacctgacagtgcactcaacggatatcgccgtgcgcacactacaggcttatctctgttaaggcagagataagcctggccttgcaatcagagctgcgcgccccaggcttcaacccacggcgaggttaccgcctccggttccggattttcagtggcatcaaccagtaacacctcaccaacccgctgagcgccctgctcctgcagcagcgcgtcaaaggttttacccgcgccacagaaatggtcatagctgctgtcacccagcgcaatcacgccatagcgcagcgcgggctgatgaccgagctgatctttaatcgcatggaacagacctgaaatcgtgtcgggaaaatcgccatgcccggtagtagaagtgacaattaacgccacgtcgctggcatagttttgccagtcagccagcgtcggatcgtcaaacaccgttacgctgtgcccctgctgctgcagaatgggctctgcttcttccgcgaccagtagcgcattgccatataccgtacctacaaaaatgccaatctttgccatctgctttctcccttattctgaaacgttatcctgtcctggcgctgcgtcaaactcaacccgcggcacctcaggaatgcgatcctgccagccaaactggttcatcagattctgccagacgccatccagtccggcgcgaagcagcaacggttcaccggttaccggatgagttaatgccaggctgctggcgtgcagcatcaggcggttagcgccaaaatgttcggcagcaccccggtttctgacgcagatcgccgtgcgccgaatcgccaataatcggatgacgcaggtgtgacatatgacgacgcagctgatgcttgcgaccggttttaggagccagttcaaccaggctataacgcgaagtgggataacggccaatgccgaccggcatctcgaccgttgccagtgactgataatcggtgaccgcgggctgtgcggtgcgcgcttccgtggcgtgtttatcggcaattttatccagctcttccaccagcggataatcgagcgtcccgctgctctccagccagccgcgaaccacagcgtggtaggttttctgcatctggtgctgttcaaactgcagggaaagcagacgtccgacttcactggagagccccatcagcagtacccctgacgtgggcttgtcgagacgatgcgccgtaaacacatgctgcccaatctgatcacgaacggtctgcatcacaaacaccgtttcatggcgatccagccagctgcgatgaaccagccagccgctgggcttgttgacggcaaccagccactcatcctgatagagtatctccagcatcagtgggcagcatccgtgattaacgcatcaagttgacgcagggtcagcaacagcggcgcaatacccggctggtcaggcaccagagccacctcataatagggggccacggcaaaattttgtggtaacggatgtcgggccgcaatcagggcatgcatccgcgggactaacacccactggagccactgcagcggctccagcgtatccaggcaaaagggttcgcggctctcgagcgccccctcggccggcggggtactctgccagagatgatgctcacgcatcaccgcttccagttgttccagccgttgcgtaatcaattgttcaggcgtcatgcgccacctccgcgagcagtcaaaaatgggcggcaagcatatcacttgttggcacaggcacaaaaaaagggagcactgtataaacagtgctcccggttcgtttgcagccatcccgccacgttaatgctccctgctcttccatgacaacttgtccagtgcgaactcctgtcgcgcatcgtcctgatgtatccttagcatcctggcccaccacctcttccgagggggttctcattctccatcctggaggtgtcccttgctcaatcctgagcgatcctgtttcatcctgaaaccttccgtgtgccgtaagctccgttacgttcctgcctcatggcttatcatcatcctgacgatatctttttcctgagcttcctgcagtgcgaaacattttgacagaactcgttacgcgcacaaggtactcacagcagaactttacgaaatgtgcggcgtaaattcagataaacgccattaagttgatgattcacaatatttttacatctcagccttccggaagtctcacctgttatatagcgatctctcacagcacatgtaagagatgtctcacaaggtcaggggcaaatcactgcaactcagatgataaccggttgtaatgacttaagaaatatctcaagcgtttccgctaatttcacacgctgtttaccgccgggctgctccagaatcacttccccgctgagattagaaagcgagatgatctcctgttctgactcggtggtggcgataaacagcgtaggcgactgtttaaggcggcgctgcatcaccagatgcccgatcagattctcctgtaaacgcaggaaatcatcctcactccagacctgtaaaagtgtcagctgattctcaccaaaactggcctgcatatcgccggcaaactgcgtggtatagaaagccgtgatctgcggctggagctggatgtcgatcgcccgctcaaccgcatccagcgtctgtggcagagtaaaaggctgcggctgccagacgacccgctgatcgcgatcctccagggcacagggcgaaggtacaccaaagagatcgctgctggccggcgcatgcccggcctgctgaagccagtgctggcagtatcgggtggtaaagtcgcgcaacgcggcggcagtttgctgcatcattcatattctcacttctgatgggttacacttagccactttgattaattttggtggtaaccgcaatgactactcacgaacaggatcaggcactcagcaacctgacgctgggcaaacccacagcctatcacgatcattatgacaacagcttactgcaggcggtaccgcgcagcctgaatcgtgaaccccttggcctgtttcccgatagtctgccctttaccggcagtgatatctggaccctgtatgaactctcgtggctcaacagcaaaggtctgccacaggtcgccgttggcgaagtggtgctcgatgcgcagagccgcaaccttatcgagtcaaaaagcttcaagctctaccttaacagtttcaaccagacccgctttgccgactggggcgaggtttcgtcagacgctggagcgtgacctgagtgcctgtgctgaaggtgaagcgcgggtcgcgctgttccgtctcaatgaagtggaaggtcagcccatcggccattttgagggggtttgtattgatgagcaggatatcgccatagaggattatcgcttcaatgctgactatctggccgatgctgcgggcagcgaaatcgttgaagagacgctggtcagccacctgctcaagtcaaactgtctgattaccaatcagcccgactggggctccgtgatgattcgttataaaggcccgcgtatcgaccgtgaagcactgctgcgctatctggtctcattccgccagcacaacgaatttcacgagcagtgtgtcgaacgcatttttaatgatgtgatgcgtttctgccatccggaagcgctgacggtgtatgcacgctacacccgtcgtggcgggctggatatcaatccatggcgcactaatgtgcccttctcgcccggtttttcgcggctggtccgtcagtagtttgcgagacttctcgcaggctgcatgcactaagcgcagttccgcttgagctgtgcgggccgacaaggctactctggtgatggcggctacctgcgggtggccgaccagggattttcgtcactgccgttgcagtgccaacacgcacccaggcgggtgtaaaggagttcatttgattacccatatcagccctcttggctcaatggatctgctttcacagctggaagtcgatatgctcaagcgcacagccagcagcgacctctaccagctgtttcgcaactgctctcttgccgtgcttaactccggcagccagactgacagcagccaggagctgctctcccgctttgaaaatttcgacatcaatgtgttgcgccgtgagcgcggcgtcaaactggagctgatcaatccaccggaagaggcgtttgtggatggccgcatcatccgttcactgcaggctaacctgtttgcggtgctgcgtgacatcctgtttgtcagcggtcagctcaacatgccgggtcggttaactgcggctgaagaaaatgactccgccactattaccaacaccgtgttttccattctacgtaacgcgcgggcgctgcacatcggcgagtatcccaacaccgtggtctgctggggcggtcactcgatcaacgccgttgagtaccagtattgccgcaatgtcggaactcagcttggactgcgtgaactgaacatctgtaccggctgcgggccgggcgtgatggaagcgccaatgaaaggggccgccgttggccatgctcagcagcgctatcgtgacagccgctttatcggcctgaccgaaccctccatcattgcggctgaaccgccgaatccgctggtgaatgagttgatcatcatgccggacatcgaaaaacgtctggaagcttttgtgcgcattgcccatggcatcatcattttcccgggcggcgtagggaccgcagaagagttgctctatctgctgggcatcctgatgaatccgcagaacagcgatcaggtattaccgctgatcctgaccgggccggaagagagcgccgactacttccgcgtgctggatgatttcatcgttaacaccctgggcgaacaggcgcgtaagcattatcagatcatcatcaacgatgcagccgaagtggcgcgtctgatgaagaaagcgatgccgcaggtaaaagagaatcgtcgcgaaaccggcgatgcttacagctttaactggtcgattcgcattgaacccgatctgcaggtgcctttcctgccaacccatgaaaatatggcgaatctcaatctctacaccaatcagccacccgaaaagctggctgctgacctgcgccgcgccttctcaggcatcgtagccggtaacgtcaaagagatgggcatccgcgaaatccgtgagaagggacgctacaaactgcatggcgaccccgacatcatgcaccgcatggatgagctgcttcagggattcgttgcacagcaacgcatgaaactgccaggcaccgcctacattccctgctacgaaattatcaaataaaccaggaggcagcccccgggctgcccatactctcatggctcttcatcttgttattgttgacgcgttgaatctgattcgccgtctgcatgcggtacagggctcaccctgtgtcgaaggctgcatggccgcgctgcgacagatactgggtcacgcccatccgactcatgcggtggcggtatttgatggcgaagcgcgtcatcagggctggcgtcaccagctgctacccgattacaaaagcggtcggccgccgatgccagacgatttacaggcagagatgccggcattacaggaggcctttcgcgccgcaggcgtaagctgctggatagcgggcgaggatgaggcggacgatttagcggcgacgctggcggtgaaaatggctcaggccggacatcaggccaccattgtttcaaccgacaaaggctactgtcagctgctggcacccgagatccgcatccgcgactacttccagaaacgctggcttgatctgccttttatcgaggctgaatttggtgtggcgccccagcggttacccgactactgggggttgtgcggcatcagcagcagtaaaattccgggcatcaccggcatcggtccgaaaagcgcgaaacagctgctgacagagtttcacacgcttgagggaatctatcagcaactggatcaggtgccagccagatggcgggagaagctcgctgagggtcggcagatggcagagaccagccgtcaggtcgcaaccctgaagcgggatctggtgctgcagggcaatctgaatacgctgcgttataccggctgagtgcccctgcactcagcccggcgattaacgtttcgtcgcgacgaccaccggcagccgcccagattcggcgcacatgtaccgtcacctcttcgcggtcatgataaagctggcgggcgcgaatctgcacgttaatgccattatcatcaaatcgttcctgcatcatggccagattctgcgtcacctcttcatagcgctttttcatgggcaacttaaggttgaagatcgcttcacggcaccagccgttaaccagccagtcggtcatcaggttagccacgcgcaccggcttctccaccatgtcacacaccagccagctgatgttggtgcgtggcggacggaatttaaagccatctgctttctcgtgcatcacctggcccgtatccatcaggctcggtgccatcggtccgttgtccaccgcatataccatcatgctgcgctgcaccagctgataagtccagccgcccggacaggcaccgagatccacggcgtacatgccgctggctaaacgctcatcccactcatccgcagggataaagacgtgaaacgcctcctccagcttaagggtggaacggcttggcgcatcggaggggaacttaaggcgtggaatacccatgtaaaacggtgagctgttttcccggatggagtagccgacgtaacaggtgcccggtgcgatgaaaaacacatgcacgaccgggcgtttcgggctctcataattcaacaggattttgctttcacgcagtgccgagcgcagcggcacggtaaacttgcggcagaacttagtcagctctttggcttcgttggtgtctggcacttcaacacgtagttctccgcccttttccactacgccggtcagcatgccgacaatcggggtaatgcgatcttcctgcggcaggtcacgcagcatttcgccgacgaccagcatctgacggacaaaaatcagctcgtcaaacggcaactcacgtgccagccgctcggcatcttcaaactgatagcactcgaacagcacgtagccagagtcatctttaacccgtggaaagccgtagatttcacgttcagccgctttggcgctgatttccgccgcacactctttttcaaaaccggggcgacaatagagtaaaactttattcatggcgttctgcctttcgtttaagacgcagcgcgccaatcaacatcaatacccaaccggcgaggaaacagaccccgcccacgggtgtgataaaaacccaaaacttcagatgtgacagcgccagacaatagaggctgccactaaacagcacggtgccgagcgccatcagcgcactgctccagtaaaaccagatattggcgcggcgtaacatcgcagcacccagccccatcaccgctaaggtgtgataagcctgatattccagcccggtatgaatccaggccatttcagccgcaccaagcgactgacttaaaacgtgggcaccaaatgcgccaaaagccaccagcagaaatccgctgatagccgaaaaaacaaacatggcacgactggacattaaccgatcctcagagtccttttgcatctgaatgcaaataaatcaatacgttattgttgatagcgaaagcggaatttttcttgttcggttgcagctttttccaggatccactgtcggaaggcggctattttacccagtttctgcctgactgtcatgacaaaccagataaaaagcgtttttactgactaatacatcattaaacgggcagattaatcgcccggcttctatttcgctctgcgccatgacgttattcgccagcgccacgccctgaccatgaatcgccgcctgcaataccatggcgctgtggctgaagattggcccctgctgcacattgatatgctgcaggcccagttgccggatataagattgccagtcccggcgggaggcatcatgcagcagagtaaaacgcgacagatccatcggtgtttttagcggattatccccggtcatcagcgacggtgaacagaccggcagcagatattcggcgtagagtttttcaacccgcaggccgggccagttaccccggccgtaaaaaatcgccacgtcgacatcgtcggccagtttctcttcgtcgcggtcaaccgcctggatacgcacgtcgattcccggataagccatattaaagctggagaggcggggaaccagccactgaatggcaaagctcggcagtaaactaacggtcagcgcacccttggcactgcgtgcctgcagtttgcgggtcgcttcgttgattgccgagaaaatctctttgatatcgagatagtagctttgtccttcttcggtcagtaatagcgaacgattcctccggcgaaatagctttaaccccagaaaatcttccagagatttaatctgatggcttacagcagcctgggtgacaaacagctcttctgcggctttggtaaagcttaaatggcgtgcagctgcatcaaaaacacgcagtgcgttgagaggaggaaggcgtttcgacatggttttccgtatccggatcggcaaaaaatacgctggcttatacaaagcgtttacgtattagaatttttaatccgaggcattataatttgtccgttgaggaacctccagcaaatacctatagttgccgcacttcctgagccggaacgaaaagtttttagatttgtgagtgagttcgcagattttctgaaagcttttggcttgtggtcgtgatgttgtgtttgcaatttttgatccgacgattgcggatcgaactcttaattcctgtagatttaccctgtctgtccatagtgatttttaaatagcaccgcaaattgcggtgctttttttttgctgcttagttgccagactctaccatctctttgacatcagagcggttgatttgctgctcgttgccattcgcatctttatagctgatcatgccggtatcgttatcgactttaggcttgccggcagccacaatggtgcgaccatcattggtatgcatcacgtaattgcttgaacaggcactcagggtaaaagccagggtacacacggccagtactgcggttaattttttcatctgctatctccttgtagattgattgcatcaaaccacccgcgttacgctaaccagaggcagccgataagtgagatcgactagtaaacgtccgatcgttatgcgggtttggttcaaaccttgcaatattcagcataacgcgcttttccagctttgccagacgcagaccattctttcagtgtggtcctaatttttcttatcatggaccaggcatgaccgcatttaatcccaccgcatttcgccagcagtttcccgcactcgccgacgcaggcgtttatctcgacagcgcagcgaccacgctgaagccgcaggccgtcattgacagcacgcagcagttttacagcctcagcgcgggtacagtccatcgcagccagtttgccgccgcccaggccttaacccatcgctatgagcaggcgcgcaaccaggttgcccgctggcttaatgccgctgacgatcgtgagattgtctggacgcgcggcaccaccgaagcgataaacctggtggcaaacagctggctgcgcccgcgcttacagcctggtgatgagattgtggtcagcgaggcagaacaccacgccaacctggtgccctggctgatgaccgcgcaggcgtgcggtgcccgcgtcgtaaaatggccgttaggcgcggatcgcctgccggatatcagccagctgcccgccctgctcaacagccgtacccgcctgctggcggtcggacagatgtcgaacgtcaccggcggatgtcccgcactcgctcaggcgatcccgctggctcacgccgtgggcgcgaaagtgatggtcgatggcgcacagggcgtggtgcattgtccgcctgacgtacaggcgctggatatcgacttttacgccttttccggacataagatttacggcccgatgggcattggcgcgttatatggcaaagcggaactgctggaggcgatggagccctggcagggcggcggtaagatgataacggatgtcgatttcagcggattcacgccgcagccggtgccgtggcgttttgaggctggcaccccgaatgtggcgggcgtggtgggcctgagtgcagcactgagctggctggtgcagtacgatctgcccgaagcggagcgctggagtcagcaacttgcgacgctggcggaagagcagctggcggaattacccggtttccgcagcttccgctgttcaaatgccagcctgctggcatttgaattcgctggcctgcatcacagcgatctggtgacgctgctggctgagcagggaatcgccctgcgcgctggccagcactgcgcgcagccgttgctggcggcgctgggcgtcagcggcacgctgcgggcctcttttgcaccctataataatctgcaggatgttgatgcgctggtgcgcgctatgaagagcgccatctcgctgttatcggagttttgattatgcattcatcgccgttagcgccacacccgtttggcgaacagattaccgttgccagcctgaaagagagctttggccgctttcatcagtgggaagatcgttatcgtcagctgatccagctgagccgccagttgcctgccttacccggggaactgaaaacagcagaaattgaactgagcggttgtgaaaatcgggtctggctgggcagccagttacgcgaagatggcacgctgcatttctatggtgacagtgaaggacgtattgtgcgcggcctgctggccgtgctgctgaccgccgctgagggccagacgccgcaacagctgctggcgatggatcccttaaaactgtttgatgaactgggcctgcgcgcccagctcagtgcctcccgcagcagcggcctgcaggcgctggccgccgcagtggagcacgccgcgcgtcaggcgctgacggcgtcctgacgggcagcacgcgccagaaacttcttcagcgcatgcgagacggcaacaaagccgaaggtggcggttaccatggtggccgcgccaaagccggaggtgcaatccattctcttcggcccctccgctgtgctgcgtgaagcacatacgctgccatcagcctgcggatagaccagcgcttcggtagaaaagacgcagtcgatgccaagtttgcccttgctgtttttcaccacgcccaggcttttcagtcgttcgcgcagctttgccgccagcggatcctggatggttttcgccagatcggcgacctggatctgagtgggatcgatctgcccacccgcgccaccggtggtgatcagcgggatcttattccggcggcaccaggcgatcagcgccgctttcggtcgcacgctgtcgatagcatcgatcacatagtcgaaaccggctgccatcagttcggcggtgttctctggcgtaataaagtcatcaatgcagatcacttcacagtcaggattaatcgcacgcagccgttctgccatcacttccgttttggctttgccgacgttgccctgcagcgcatgaagctgtcggttggtgttggtgatacagacatcatccatatcaatcagggtgattttaccaattccggtgcgcaccagcgcttccgccgcccaggatccgacaccgccaatcccgatgacgcagaagtgtgcgtcagcaaaacgttgcagcgcatcctggccatagagacgcgccgtgccgccaaagcgctgatgccaggcgtcatttaacactttcatagttgaacctgttacgtcgtgcgggcccgaaggcccgcagagaagaagttagttagcgccgagaagcagtgaaccattattaccgttttgcgggctggagaacagcggttgtccggcacccggcgcggctttaattacccagacgcgtccgtagtgattatagaagcccgccagatgcgcagcgtcggggccgataccctgatagatatcaaagtgctggcctttaatcgcgccacccacgtcgagtgccaccatcaggcgcatctcatatttgccgttgaatttgcccttctcatttaactgcggcacttcagccagcagtacggtgcccgccggaataattgagcggtcagacgcaacggaggctttcgccaccagtggaactgcgctggcaccgcgcaccggcgtaaatggctcagccttaaagaagacaaatgatgggttggtttccagcagcgcacggacctcctgcggtgagtgctcctgcgcccactgacgaatcgcctgcatcgacatatcttcgcgcttcacttcaccgcgatcgatcagctctttgccaatgctgtgataaccccagccatttttaccggcgtaaccaaagaaggtcatcgggcggccatccccaaagtcgacataaccactgccctgcacatccatcatgaagttatcaatcagggaattgctgtaggcgatgatgtagcggtcatcgagtccgccactatagatagaggcgcggctcggtaatttttctccgcgtttgcgcggtggcatgcggtagatgggatactggaattcaccctgacgggtgtaacgcgcttctactaccggcgtgtagtaaccggtgaactgcacgttaccgtagttatccgtaccctccatctgccaggcgttaagcccatactgacgaagctgtcgggtatcggcacccgccatcagccagctctcaattgcactataagtgccgtttctgacggctatacagggcggatgaggcggactgaatctgacggacctgctcgccaaagtctctgccattaaccggtgcgcctttggcattgggctgattcaccagcgccagcggttgttccagtttgccatctttatattgctgaccgcgatcggtcggtttggagctacaggccgccagcagcgtaattaacgcgccagtgagtgcatacttcacccaatgtgatttcattatcttctctttttataactgttcgccccgcgacgatagcaaagcccccgacagaatgaaatgcatccgctcagacgtcacgcatatcagtttaataattaaccagatggttgaatccttcagcaactggctgttaatttggcttttatctgcaaaaaggggttgcatgaattagcgcggagagtatagtgcgcttccacggacgcggggtggagcagcctggtagctcgtcgggctcataacccgaaggtcgtcggttcaaatccggcccccgcaaccaatacttctgcagcagttttacagaagtcacaatgtgagaagtaaaagtaatagaagcaatacggacgcggggtggagcagcctggtagctcgtcgggctcataacccgaaggtcgtcggttcaaatccggcccccgcaaccaatacttctgcagttgttttacagaagtcacaatgtgaaaaaagtgtgatacggacgcggggtggagcagcctggtagctcgtcgggctcataacccgaaggtcgtcggttcaaatccggcccccgcaaccaatcatttaaacacctgaaagggtgtttttttgtttctgacgttcccaaaagccgcttcagcctctctctgccctgaaaagcgcgcggatagcccggctacccgcactcccttaccgatgggccagtgcagccccactctccacatacgctttgatgccgttcagaatcgcctctgccacctgatgctggtaacgggtggtttcgcaacttgcgctcctcctccacattactgataaacgctgtctctaccagaattgacgggatatcaggggctttcagcaccgcaaatccggcctgatccacggtgcgtttgtgcagatggttgatgcgccccatgcgatgcagcacctctttgccgaatttaaggctgtcatgaatcgtctgacgctgcaccatatcgaacatggtgtgatcgagatagcggtcaccgcttttgctgacgccgccaatcaggtctgattcattctgagtctgagccaggaaacgagccgccgccgaagtggcaccactggttgataaggcaaacactgaagagccgcgtgccgcgcgactggtaaaggcatccgcatggatcgacacaaagaggtcggcacgctgtttacgggctttggcaaccctgacgcgcagcggaataaagacatcttcattgcgcgtcatataggctttcatattggactctttatcgatcagcgctttgagtcgccgtccaatcttcagcacaatatctttctcgcgggtcttatatttgccgtgcgcgcccggatcttccccaccgtgaccgggatcgatcatgataatgatcggacgatcgcgccccgctttgccgggtaagggcgcctgcaccccttcatctttctccagatcgccctggttgtaatctttcagcagggccagcagaggatcgtcctcaacctggttctggctcggatagagatcgaccaccagccggtgattgatcccggcgaccggcgagagattaaagatcttcggcgcgacgttgcgctttaattccagtaccacgcgcaccgtgttgctgtcgaactgaccgacacgggcatttttaataaagggatcgtcgacccgaacctgcttatctacccctttcagaaccggattgagatgcagcccctgaatatcaatcaccaggcgttcgggattgctcagcgcaaactgcttgtacttcagcgcgacattggactccagcgtcatccgcgagtaggtcgatgagggccagatacgcaccgccacaatgtggttcttcgccgccaaccctgtccggctgacgcttaacagcagtaaggcgcccgtcccctgtaaaaatcgtctgcgtgaaaaatgggaattaacgtctgacatgccgctccagctgctgtgtaatgtctaaaaaagcgccagttactaaaatggcggcgaaaactttatccaatccgcagcatgatgtcaccccggaaaccctaaataatgcaggctgttagcggctttgacacccagaaaaacgtaaattttcgtcaggattaagacttgcaaaaccgggcgtaaaagcataaaaatacaaaaaatacgaataaacattcactgagggttggccgtgaaggaacgtagtaccgaactggttcagggttttcgccataccgttccctatatcaatgcccaccggggtaaaacctttgtcatcatgctgggtggcgaagcgattgagcatgagaacttctctggcatcgttaatgatatcggcctgctgcacagcctgggcattcgcctcgtcgtggtgtatggcgcacgaccgcagattgatgccagcctggctcagcagcagctggagccggtttaccataagtttacccgggtcaccgacgcgcaatcgctggagttagtgaagcaggccgccggccggctgcagttagatatcacggcccgcctctcaatgagtctcaacaacacgccgctgcagggcgcgcatatcaacgtggtcagcggcaacttcattatttcacagccgctgggcgtggatgatggcgtggattactgtcacagcggccgtatccgtcgtattgatgaagaggccattcatcgtcagctggataacgatgcgattgtgctgatgggcccggttgcagtttctgttaccggcgaaagctttaacctgacttcggaagaagtggctacccagctggcgattaaactcaaagcggagaaaatgatcggcttctgctctgagcagggcgtgctgaacagcgagggtgaaatcatctccgagctcttcccgaatgatgcgcaggcccgtatcgatgagattgaaaaggaaggcgattatctttccgggaccgttcgcttcctgcgtggggcggtgaaagcctgccgcagtggtgttcgccgcagccatttaatcagttatcaggaagatggcgcgctgttgcaggagctcttctcacgcgacggtatcggtacccagatcgttatggagtcggcagagcagatccgtcgcgccaatatcaatgatatcggcggcatcctcgaactgatccgtccgctggagcagcagggtattctggtgcgtcgctcgcgcgagcagctggaaatggaaattgataagttcaccatcattcagcgcgataatctgaccatcgcctgtgcagcactctatccgtttatggatgagaagattggcgaaatggcctgtgtggcggttcatcctgactatcgcagctcttcacgcggtgagatgttgctgcagcgcgtggcacttcaggcacgccagatggggctggaaaaactgtttgttttaaccacccgcagcatccactggttccaggaacgcggctttacgccggtagatattgagtccctgcccgagagtaaaaaagagatgtataactatcagcgccgttcaaaagtgttgatggccgatctcacctgattcaatccgtaagggacaggcccccccgcgtggtctgtcccctctcttctcagccagattcccctagtcgctccaccagaccgctgcgtcgctgcgtttgcagctgcacggcacgctgaaatacgccgggttcgctgtagatggtcagttgccgccgtgcacgtgtaatcgcggtatagaccagttcacgggtcagcaccggcagaaactgcgtgggcatcaccagcgcggtatgatcaaactccgagccctgtgatttgtgcaccgtcatcgcccaggccgtttcatgtgagggtaaccggctcggctgaatcgccttgatcgatccatccggcagcgggaaaaagaccttcaggttgccctcttcatcccgcatcgtcatgccaatatcgccattaaacaggccgagcgcgctgtcatttcgggtgatcatcaccggacgcccttcataccagcggctgcccatgccaggacgacggatgcgctgcagctgcatcagtcgctgctcaatacgctggttcagaccctgcacgccaaatggcccgtcacgtaatgcacacagcagctgataacggccaaaagcggcaatcacttctgcgggcgacgactgctgtctgatcaactgcaggaagggctgataaccctgggctacctcatccagcatcgcctgatacgcgtcagcgctgttcagcggctggtaactgatatcctcataagccgcagcaaacaccgccctgacctgctctgcatcgccacgattgatcgcttttgccagctggccgatgcctgatgagtcatcaaaacgataactcttctgcagcagacagatactgtcgcggactgcgggtgcctgcacatcgtcactgccctgcagtgtgcagccggtcagcaggccgagctgttctgcccgcgccaggctgtagccgctttcggtgcagcggcagatgtcgcccagcaccgcaccggcttcgaccgaggccagctgatcgcgatcgcccagaaacacgacgcgggcatgggcaggcagcgcggcgatcagttttgccatcattgagagatcgaccatcgacgcttcatcaaccaccagcacatcaaggtgcagtgggttaccggcatggtagcgcagccgctgagtgtcgggctgagcgcccagcaggcgatgcagcgtggtggcttcggcaggaaaacgccggcgttcttcgtcgctgaccgccagttcctgcagtgcactgcccagtgactcggtcagtcgcgcggcggctttgccggtcggtgccgccagctgaatccgcagtgcaccgggattcaggcgaatcagggcagcgaggagtttcgccacagtggtggttttaccggtacccggcccgccggaaataaccgcagtcttgcgggtcagcgccacggccgccgcaattttctgccagttctccggctggtcgtcaaacaggctgttcagcacgtcgcctgcagcatgcatatcaaacgcagttttcacttcctgcgcagcgaagaagtcggcaacccggccttcgctttgccacagccgatgcagatataaacgctgattgctcagtaccagcggcgtaaccaggctgccatcactgactgccgaccagtcagcaaagcgtgctgtccagtcttccggcgcaccagcagcgtgccagatcgcctgagccagcgcaggctggcgaccagcgaacagattcgcttcgcagaggttgctcagcggtaaacagacgtgcccctcacccgcgtcagcgctgacgcaggccgcagcgagcagcagcccaggctgtgattccggggccaccagccgggcaaactgtatatccagcggccgcaggagacgcttctctaccgcctgcaacagcagactcagcatgtcactcataacatctccccggtttcaccaaacagtgcatcaatttcttccacaaaggcttcagcaggtcgggtggcgaaaatgccgttgtccggcgagcagccatccatcccgcgcaaaaacagataaaacaccccaccaaaatgccgctgatagtcgtagtccggcaaacgatgctgcagatagcgatgcagcgccagcgtatagagctgatattgcagatcgtagcggtggccaatcatcgcctgcgccatcgcctctggcgtgtaagcggcgtggctatcccccagccagttcgatttgtagtcgagcagataatattttccctgccagcggaagaccagatcgataaagcccttcagcatgccccgcacctgacgaaaatccaggggggcggcctgctgagagagactgtcgtgccggcgcagcagagcgtcaagatccgccgcagtcagcagattgttgatcggcagatagaactccatctcaatcaggcgtttgctgctttttatcgccgacagcgtcagcccctcagcattgagcggcgtatgtaagacccggtcaatccactgttccagaaccggcaaccagctcagcggatagccattatgctgcagctgatcttccagccagaccctgtccggcggttcggtaaagtcgatcgactcaaacagaccgtgcaaaaacgtaccaggtgccgctccgcgcggaaagtggtggggtgttaatgcagcctcttcacccttctcttcttcgcccgctgcatcaatatcaaaattgggcatcgcatccagcagcggcgagctgtgatgctgttgcaggcctgaataactggttacccgccagacgtcagccagcgcgcgcgtaatgtcgcgactgcttaaaacctcatcgccctgctgcgcatcctgccacatttctcccggcagcagagcctcttcaaccagcgcaatcccttcaccggttaacgcattcaatcgctgactgagctgctgcgcatccgccgcctcaccctgctgcaccaggtagcccagcgcgctcttgtgcagatcgctttcgccctcttttttgcgggtgcctttgatcagtggcgcaatgccgacgctgcagtgatagaccgaacgggtcagcgccacgtagagcagacgcagatcctccgccaggcgctcctcttcggccagcgccagactttgtgcatcaccctgcacatccagcagtgccgtgaacgtgtcgcgatcgtgataaagcgcgctgaccgcctcgcggaaacccggcagcaaatggcagccagaccagcggatattgcagtcctttcgatttatggatggtgatgatctgcaccagatggcggtcgctttccagacgcaactgctggctggaggcctggctgtttggccgggcaatctgctgcgccaggaagcgcaccagggcgtgcggactctccagctgcaccgaagcctcctgcagcagttcacccagatgcatcagatcggtcaggcgacgttcaccgttctccgaggccagcatattctctgccagctgccgcctgatcatcacgtcacgcagcatcggtaacacgccgcgctgatgccacagctgctgccagacggcaaactgctccaccagcgcatcccactcacgttcattctgtgtcagcgcgtcgagcgttgctgcatcgatggcaaaaatagaggtcgccagcgcgctgcgcagcagacgttcctgctcgggtgcctgtatcgcctgcagtaaccagagcagttcgcgcgcttccggcgtggtgtagacgctgtcccggctggagagatagaccgaagggatcgacagcgcattcagcgcgtcgcggattaaaccggcctcattgcgactgcgcaccagcacggtgatatcggaagcccgcaccggctgcagcgcctcgcctttgcccaagcgggcgcgcccctgctgtccggccaccagccagcggctgatatcggccgcacactgctgtgccataaactgctggtaatcgctgttacccacgccctcgccaggctgcagccagaaccgtaaagccggttgctgctgctcgtcaaaaatcagtttcagcgactgattgggcgcagcaggcttaactggctgaaaggggatcgccgagaacagaaaaggcgaatcgagctgagaaaagaggcggttgacgctcccgaccatctcaggtgatgaacgccagttggtatccagcgtgtagtgagcgctgacttcgtttctggcccgcagataggtaaaaatatccgcaccgcgaaacgcatagatcgcctgcttgggatcgccgatcagaaacagtgcctgttcaggctgattaatatagagcgtgcggaagatgcggtattgctgcggatcggtatcctggaattcatcaatcagggccaccgggtaacgcgcccggatggtttctgccagcaaaacgccacctggctgctgcaacgcttcatccagtttactgagcagatcgtcgaagcctaacagcgcacgtaaccgtttctcgcgctgcaccgtggcgcgcacatcggtcagcgcctgcgcaatgatgacatcccgcagcgacagcggttctgccagaaactgatcgatcgcctcaaacagcgaatgacgcggcgcttcaccctttttagttttctcctccagcacctgctgtccaaagcgctccagctctttgggcagctgataatccagcgtgtcgctgctggcccactgcgtgacgcgggcgacccagttgggcagatgtttactgctgtagctgcgcttatcaacgccagatgcagtgataatgccctcaacatcggcgctgagcgcctgccactgctgcttgatggcctcgatgcgcgccagattgcgggcgtgccgtgatgccagcgtctcatcggcggcaggcggacgtttcagccccggggactccccctgtagccaggggcgcagcgtggccagcagactgtccggcccgctccactctgcggcgatgacccgcgccacatccagactcagtggatagcactgacgacgccagaaatcggcggccgactgcttcagcagcgcctgctcatcttcaatcaactcctgctcgaacagcatacccgactcaaaggcattgagattcagcatccgctgacagaagccgtgaatggtaaaaatggcggcttcatccatctgccgctcggcagccagcagctgcgcggcggcctgactcagatccggcatctgctccagcagtaactggtgcatcggattgctgcttttgccgcggatacaggccagacgtagctgatgaatattctcgcggatgcgcccgcgcaattcggcggtcgcggcctcggtaaaggtcacgactaaaatttcttcgacagagagcggccggctgtaggcgttttcaccgcccagccccagcagcaggcgcagatagagcagaccaatggtaaaggtttttccggtgcccgctgacgcctcaattagccgctcgcctctgagcggcagcgttaaaggattcagcgatacgggaggtaactgcgtcattgggtctcactctttaccggcagcgactgctgcagttgtgccacttcgctccaggttttccagccaggctgacgggcaaactcaactttgccattgccggtgcctgcaatctgcgaggtcatcaccatgcccttatgttcgatcacggcctgccggaaaaagtctgccaggctggccggggttaaccgctgaacctgctctgtcattttttgccgggtatcaaattgatcattctgccgatcaaagtcgcggctaaagcgatccgcttcctcaaagagcgtctgaggacgctgctgcaaatcattgatcatcgcctgctgatactgggcaaagtctgcctggctcatactacgcagacgtttttccgcctgcgggtagaaggcctgatagcgctgcaacagccagcccggttgtttgctgttactttgcagcaggaagccgattccccactggcgacccactggcatctggaaggcaaacaccgcgtagccgagctgctctttggtccgcagctgattgtagaaccacggctgcacaatctggctcagcatggagctgtgcgccatgctctgatattcactgtatcccagtggaatatagagcgcggcaagggcggagtcggtgctgctgcctttttgttgcaggttggctttcagcggttttttaatcgagacatactgactatgccagtcgcgggtcgcatgactctgcatctgctgtttgagctcatgccccagctgcgtcacgctgtcagcactgaggttgcccactaccagcatctccggcgtcgcgtcgcggaacagcgtatcgcgatagtcagtgacatccttaagtgagagtgtgcttaccagcttgcggcgagcctcgcgctgggtatatggcagctgtgacagcagttgcatcggctgaatcgcctgttcaaacgctttgcccttttccgccgcgtccagccgctccagataccaggatttcgcctgctccagctgctgttctgtcggctggaaagtggcgtaaccttccaccagtttcttcagcagggtcggcagacgctgagtgaagccgttggcgctgaataccagcccttcatcttcacccgttgagaagctgatgccgcccactgaagcctgtgaattaagctcgtccagcgccaggctggaaaggtagtcattcaggccaaacagcacctgctgacgggcatcactgatggtgtgcttattgcgtaacgccagggtgatcgccgcttttggctcgctggcgtaataacgactgggcatccagtaaatacgcatatcatcctggttatccagtctcaccggatgctgatacgttttgccgtctgacggtaacagggtgaagtcgtccgggatataggggtttagcacgggcatcgccagcgtaatctggctggcgcgctgctgccagtctgcaaaggtttgtggagtgatcttctcaacctgataaggcgcatccacaaaataggcttttttgttgtgcggctcctgcggactgatgtaccagatacgcgcatgctgcggggtcatctctttcagccgggcattaatcgcggcggcatcgtactgatccgccagataaggtgcatccagcgtatgttcaaccggtacgcgcagcatggtgtcggccagccattcaatgtaatccatatcgcgggtaattgagggatagcggaagtcgagcgccagcacatgcgaaacttcatcgaaatagcgcttatcatccccctgctgacgcagcagattgatgtagctgaatatcgccgccacgacctggtcgcgctgcgccagacctttatcagtcagtgacgcggtaatcgcaaacacgccgctgttgcgctcggtcatcgggtcagcacccgcattcaccccgtcggccagcccctgtttttgcaaccagtcagtcagcgtgtttttgctgcggttactgattaaatagctgatcagcgtgtcggttttactgcggaaccgatcgctgttgttggcaatgcggaattcaattttgagctgcttgcgcggctgagccggaacgtaatggatgatgatgccctgctgcgcatcggtcaccaccggcatcgtaatctccggcacgctggcgtcatgattttgcacccggccaaaggttttagccgcaatcgacgccatctccggcagcggtttgttgctgtagatcaccgctttcatcagattggcggagtaatgcgtatgataaaagtcctgcagcgcctgatgcagtttgctgcctggcttatctttcagggtctcaagattgccgcccgagaaacgtgacgccggatgcgccgggttcagggtttccgcgccgacctgtgccatacgcaggccatcgcgcgagcgcgccatggtcagctcggcattcacggcgtggcgctcgcggtcagcgttaaccggatccagcagcggctcagccaccgcatccgccaggcgatcaaccgccggtttccagcgcgtcattttccacttccagataaaaggcggtgcggtaggaggctgtgctggcgttgtggctgccgccatgctttttcaggaattcggccaggttatcgggctgcgggtagtgctttgaacccatcagcaccatatgctcaaggtagtgcgccagtcccgcctgctgatcgggatcgtccagcgatcctatcggcagcgtcagcgccgccagcgatttcggtgccacaggatcggaaaccagtaacaccgtcatcccattatcaagccggatagcctgatagtggcggggatcctgttcacttttgcgaatagtgtcgttaaccggctgccagcctgatgatgcctgctcctgcgcctgcgctgtgcaagccatcaggcttaacattagcgccgctatccagcgtgcgtgtacccgcatgtaaacccctctcgtttcccgataaaccgccaatgtcggacgcggcggctcaaagcagagcaaaatttctgtgtaatgagtcagtcagcaaaaacgccttctgatcggctattcatcatcctgatgtgcagccagtaccggtaaataccagcgctgtgccgcctcagttatgtgctgtagttgtggctcatccagcacccggcaaagacgttgcagatagggatcgctgccttcaccctcaagctgatagttgcctgaccaggccgtcagcaggcgattacgcgccttaagctgggttgcctcatcagtcagtaactgctgactttttttgtcgtagctggcggtcagccatgcgccgccacttttgttaagcagcatcagcggctgacgcatacccgcgagataccccgtgacatactcattcagcgcagcaatcgcctctgcctgcggcacagcaaggaagcaccagcggctctgctgccggccaaacatccggctgctgccggtgccgcccagcgcgcagtagaccagatgttccagccagagtagcagtccgtcgttcatgttgagtatgccaggccgccagcgcagcaatccatcactctgaacctgcgtcagccacccggttaagctgacctgctccagttgcagattcacttcccagctctcgccgtcgctgcgctgggtgaccacttctgccgccacttcctgcatctcattgcgctgcgcctgccagaacagctcaccgaacgcgccataaggcagattaccggccgcacgatggtgcgcataaagccgctgagtatcctcgccttcgaccagggcattcagcatctgcgcgttaatctgataacgctcaaggttgtcgagcgcaaacggctcgctgtcgggcagttcgttctcctccagccagaaactcacgccaagccgctgatggaaccaggcccggaccggatgtcgccagaagcgcaggaacgcctccagcgtgagcgcatcaattaacggcgcctccagcggctgcacaaaatcgggctggggctgccccgcaccccgcgcggcaggcaaccactcacgggcgaaactttgcagtctggcagcaggctggaagttttcggcggcaaacggcatccggctgtgcaggtgctgcaggtgcatccgcacccgttcggcactctcatccagctcaagatggccatcaccgtccagataaaaactctgtccaatgtaatccagcagtttctgtgaccagcaccgaggggtagcgttccgtattatcctgaatcgcccggccgatataactgatatagagctgctgctgcgccgaaatcatcgcctccaggaagagatagcggtcatcatcgcggcgactgcggtcgcctttgcgggactgctgctgcatcagatcaaaacctaacggcgctaaggtccgtggatagacgccgtcgttcatgcccagcaaacagaccagctgaaaaggaatggagcgcatcggcatcagggtacagaagttaatctgccccgccaggaaacgctgactgatgcgctgttgatcaagccggctgcgcagatcatcgcgcaacagcgccaccggaatcgcctcttcaaaccgcgcatccatgccatattcaatcaattgctgccactgctcttccaccagcagtaaggcggcctcggtttctgcatcggggctgaaaaaggcattgagcagttcccggcacatgggcagccaggccgccagtggccggggttcggcaagcagctgccgccagtgattaagccgggagagcaattcagccagatgtcccgccagctcccccaccagaccacccgactcgtcataaggcagaatcccttcccagtcaccgttatggctctccatcgcataacccaacagcatacgctgcaggccaaagcgccaggtgtgctggccggtaaccggtagtgacagggcttctacgctggcatcatccagcccccagcgtacacccgattcgctgacccagcgccgcagtaaacgcaggccgctttcatcaatggcgaagtgggaagcgagcgccgggacatcgagcagcgccagcacatcctccgagacaaaacggctgtccggcagtgccagcagatgcaaaaacgccacaatggccggatgagcctgactggcacggcgatctgaaatcgcaaacggcagatagcgatcggcaggtgcattggcgaacaccgcctgaataaaaggggcgtaggcgtcgatatccgccaccatgacgatgatgtcacgcgctttcagcgtcggatcggcctccatcattgccagcagatgatcctgcaacacttcaacttcgcgctgggcactgtggcagacctgcaccgcaattgatcgatcctccggatcaaggcagcgcttctgatcgctgtgtgccagttccgccgcattcagtccgatgatggcgttatcctgcagattgagaagatcgtgctgcatacagtgcagcaggttgtccggctccacatcgacaaaagcatcgatgtcgtcgtttgactccatctgactgagcagaaacaggttgtcacgccccagcttgccccaggaggcgagcaaagggttggtcagttgctgttcaccagcgtcgttaaacagcgccggtgcctgctctgcatcccggaagagtccgcgtgattcatcagcaccatggcggcggcgctgacgactttgcagtttcgccagaaacgcataatcctgaatatcgccccagtaatcgcggcagggattggtgaacagcagatggatgtcgatgtgacgtcccagcgcctgcaacgcctgcagatagaccggcggcagcgcagagatgccacagataaagacccgtttgggcagattttccggcgtgcttttcgcctgatccagcgtctggataaatcgcgcatagaggttggcgcggtgccattcaggctggcgcagggcctgggtataactcaccagatcgcgccacagtgcggcctgccagcgctgcgcctcgcccagcccctcaatggtttcgccacgctcccagctgttgagccagtcggcacgatagaccagatactggtcgaacagatcggccacgcgggagctgagctgaaacagtttacgcttgtcgccgtcgtcatggagatagtggcgcagagaagcaaactcttcatgcttcagcatctccggcagccggtgcatcagcttccagcccatgctggccttactgaaagcactttctaccgggatatcgggcagtacgcggacgaacatctcccagataaaactggcaggaagcgggaattcgatattggcagcaataccaaaagtttgcgccagctccatctgcagccactgcgccatacccggactctgcaccagcaccatttctgaggcgaaaggatcatcaagagggtcatgtttaatcaccgcagccgccagaatcttcagcacatcaagctgatttgagtgataaacgtgaaacatgaaaactcctgtgataactcagaacgtgactgcggtattgcggctctgtcactttaccgcgtatcgcggttgaaacccatcaaaagggcgaccgggaagagttaacatcgcagccgcgtcagggtggcacggcgctgataaggtcccgtcacgtcagcccgatccagggtgcagcctgaaggaccgctctgctgttgcagtattgaagtccagccgggactctcatgtcccatcagttgctgctcagccacccgccatgcttcacgctgataccactgctggctgaatcccagtgccagtgcgcgatgatagtgcaacagcatgctgctgcttaatgccattaacagcagagcaaacaacacttccggcaggctgaatccaccgcgcttactggcaggtggccgggggcgtgagcgggcagtaatcgatccagccgtgcggcaacgcggtaatctgattgccccgtaaccgtacccactgccagaccgccataccactgccgctggcctcccctttaagcagaccttcatccttttcacctcgttgtaaacagctgcgccagccctggcgatcatcctgctgacagctggccgcctcactggctgaccagctcagggagaagccccattgcagcgcagactgcgcccgccagaaaccctgaataaactgctgctcatccgccagcagtcgcattccctgctcagacatcttacggctggcatgcagcgtaaagctgccgatgaccataatcatcaacaccatgcccagagcgctgctgcctcgctgcttcacaggttctctgcctcaacccagctctccatcgtttcaagccagcgtccggcccgtgcctgcagcactatcctgacctgcgtgccctgctggctgacgctgaactgctccagcgtcataaacgcgggatcggagagccgctcccagcccgctgactgacactggtcaacacctcgctgcatctcaagctgctgttgtcgcaggcgataaccgtaatagtcactctctgcatagctcaccccttcccatttaccgttgctgttctcatcccagcgcagcagcaggcagtttctctctgatttgcagcgcctcactgccacactcaccgtgacaataaccggcacgccgcaccgctttttccagcgtcgccatcatctgctgtaactcctgacgcagctgcgcccgttgcatcacgccggcgttctctgccagcagcagcggcagaaaacggccagcacttaacatcacgacggcgctgattgccagggcgatcagcatctccagcaggctgaatccggccattttcaacgacacgtctcctcatccgtcatgcagaggcgaatacgggctctggccgagataatcagccgcattcgtccggcgctgttacccagctcaatgctgcccgcccgggccacattacgtcggccatagaagcccggttcaccccggatgccatagagcgaaacgccagcgtgcggcgccacgaattgcagccgttttcggctatcacaccctgcaacggggaggcttccggcaccgatgcaccagggatcgccaggccgtgaccataaaaccagatcgctattttgccggttggccttggcacgcagccgaagcaggaatccctgcagttgctgggcgctgtcgcgcagttgctgccgctgttgccagcgctgccagccatgcagcgcggcaagactcagcatgccggcaatcaccatcaccagcagcagttccggcagggtaaaaccgcgtaagtgtgctgttttcatagcgtcagaatgcgggtgatgaacagatgaaacaaggtgcggtttggcaggctgggaagcacgacgcagagaaccttccccaacagcatgaattggcagaagcgtgcgagcgttgccgcagatttaccggtttgcgggcaaaaaaaagccccggcgatgaagccagggcgttatcttttatcgcgaatcagatggcgacaggggctttgatcgcgggatgcggatcgtagccttcaatctcaaaatcttcgaactgatagtcaaacagcgacgccggtttgcgtttgataacaagtgatggcagcggacgcggttcgcgggtcagctgcaggcgcgcctgctccagatggttactgtagaggtgggtatcaccgccggtccagacaaagtcgcccacctgcagatcgcactgctgcgccaccatatgtaccagcagcgcatagctggcgatgttaaacggcaggcccaggaagatgtcgcacgagcgctgatagagctggcaggagagtttgccgtccgccacgtagaactggaagaacgcgtggcaaggagccagcgccatctcgctcagctcgccgacgttccaggcagaaacgataatccggcgtgagtcgggatcgcgcttcagctgctccatcacctggcttagctggtcaatctcctggccgctggccgtttccccagctgcgccactgtttgccatacaccgggccgagatcgccattctcatccgcccactcatcccagatggagacgttgttatctttgagataaccgatgttggtatcacctttcagaaaccacagcagctcatgaataatcgagcggatatgacatttcttggtggtgaccagcggaaaaccatcctgcaggttgaaacgcatctggtgaccaaaaattgaaagcgtaccggtgccggtacggtcagcttttggcgtgccttcgtgcagcacatgttgcattaaatccagatactgtttcatttttcctcgcgaaattgtggctgcgggcgacgacgatacgcccagatcatcataataataccggcaataatcattggcacagagaggatctgtcccatactgattccgccttcaaacaggccaagctgggcatccggctggcggaaaaactcaacgataatacggaaggcgccatagccaatcaggaacaggccagagacgctgcccatcgggcgtggcttacgaataaacagattcaggatgataaacagcactatcccttccagcaccagttcatagagctgcgaagcatgacgcggcagcacgccgtaggtgttgagcagcgcctggtattgcggattggtggcggccagcgcgacatcttcgctgcgggagccagggaacagcatggcatagcggaagcccggatcgacacggccccagagctcaccgttaatgaagttgccgagacgaccggcacccagaccgaacgggatcagcggcgcgatgaaatcagccacctggaagaaattacgtcgggtgcggcgggcaaagaccagcatgacgacaatcaccccgatgaggccaccgtggaacgacatgccgccatcccagactttaaacagatagagtggattttccaggaacagcggtaagttgtagaacagcacatagccgatgcgtccacccaggaagacccccaggaaaccggcataaagcaggttctccacttcctcttttttccagccgctgcccggctgattggcgcggcggacagccagccacatggcgaaaacaaagcccaccagatacatcagaccgtaccagtgaagcgaaaccggtccaatcgagaagatcaccggatcgaactgcggaaatgcaatatagccgttattcatcattcaccgtctatttttcaaccctgaaaagggggtgttgtcaggcacataaattaaggctgcgcatcatagcacagccggttttgtgaattgtcccgcaaatgtaaacgcggataacgcccagagtctgacccgtcaggcgtacattgttgcagccagactggtcacggacagcgcgcaacaaccggagcgtacacgtagtacgtgaggattactcgctgtgctcgccccttcagggccgccctgacgggcgttcaggttgctaaagcagcctgtgtgagcactgcccgggaccagaatggcaaataaaatagtctgacccgtcaggcgtacattgttgcagccagactggtcatgtacagcgcgcaacaaccggagcgtacacgtagtacgtgaggattactcgctgtgctcgccccttcagggccgccctgacgggcgtttcaggttgctaaagcagcctgtgtgagcactgcccagggccagaatggcaaataaaatagcctgaagtagcgcttagcgaccgccgcggattaatccacccagcccgcgacgctccataaaggtcgagaccagatgacgaacctcagtggcggtatgagcattcatcccctgctcgctgagttgctgcgcttcttcgtgatccagatggcgcagcaggtatttcacccgtggtacgtttttgccgttcatgctgagatggtgataccccagcccgaccagcagcgccacgcacattggatcgccggccatttcaccacacaggcacaattccagattggccagacgggcttcctgcgcaatcgtattcagtgcacgcagcatcgccggatgcagcgagtcgtagagattggccacgcgggtgttgttgcgatccaccgccagcagatactgggtcagatcgttggtgccaaccgagacaaaatcgacccttgacgccagatgcgggatcataaacagcatcgacggcacttcaatcatgatgccgatgcgcggcgcggggatcgtatagcccagcatctcttcgacttcgcgtcctgcgcgatcgatcagctttttcgcttcgtcgatctcatcgatatggctgatcatcggcagcagaatactgaggttgccggatgcggcgttggcacgcagcatcgcgcgcacctgcaccaggaaaatttccggctggtcaagcgtcaggcggatgccgcgccagcccagacagggattctcttcactgataggcatgtagggtagctgtttatctgcccccacatccagggtacgcagcgtcacaggcttgttgtgaaacagctgtaacatgccctgatactgtgccacctgctcctcttccgacgggaagccgttctgcagcataaacgggatttcggtgcggtagagaccgatgccatccacccagttgcccagcgtctgctcatgctccgggcttaagccggcattcagcatcacctgcacgcgctcgccgcttttcagctcaccgggctgatcgaccacgccttccgccattttgctcagcgcattctcttcgctgatcaaacgctggtactcctgcaccagcaccggctcgggatcgatcaacagctcaccgcgatacccatcgacgatcagcaaacgtttgttgagctgatgaggctggatgtcagcgcccatgaccgtcgggatccccatcgcgcgcgtcagaatcgccgcatgggagttggctgcgccgtcacgcaccaccacgcccgccagccgctcatgcggcagctcagctaaggtggtggcggtcagctcatcggccaccagcacaaagcgttccggccaggcattggtgccgaccagcgtatcgtcaaggtgaaacagcaggcgctgacccagcacccgcagatcgcctgcgcgttcacgcaggtaggtgtccgtcaggctggcaaactgttcagcaaacttctcgatgacctgtttcactgcccattcagcgaccgagccgcgttcgatctcatcgaacagatcttttttcagtcgggcatcggttaacaggtgagagtaaaggtcgaaaatggccgcactctctttctgagcgctggcgctgaagcgtttactgaagcgacgaaattcactggtggcttcactcatggcgagcgacagacgctcacgttcgcgatgaacatccagcgttgaggcagccgaaacctgatcgagcagtggctgcgtctcatctacccagcccggtgccaccgccacgccaggcgcagctgcaatcgcgcgcacccgcgtctgccggaactgaccaaacagctgggccatctgcgactgcgacagcaatgccgccatctgggtggcaagggtgaccagaaacgactcttcgctttcatcaaactgacggtgctcgcgctgctgtaccaccagcacgcccagtaactggcgacggctgataatcggcacgccgaggaaggagcggtagcgctcctctttcactgcggggatatatttaaagctgggatgactctgggcgtcagcaaggttaatcggttcggccagacggcccactaaaccgacgatcccctcgtcaaacgccagggtcacggtgcggccacgcggttttttaagtccgcgcgtcgccatcaggtagtagcagtgacgatcgtggtcggcgaggtaaacggaacagacttccgtatccatcgccagacagatctcattaaccaggatgtcgagtgcttcattgagacgcggcgcactcgccactttttctacaatttcgcgcaactgagtgagcataaagggcgtggcctatcctctcttacgtcgatgggcaggattatttcgctgccccgcactctcctgcatagacatcaccacgccagcgaattccttcatcacccgacgataaacgtcgcgcttaaaggagacaacctgacgcaccggataccagaaactgacccagcgccagccatcgaaactcgggcgtgctgctgtgctgcacattgatatccgcgtcattacacattaactgcagaagaaaccacttttgtttctggccgatacataccggctttgtgtcccaacgcaccaaacgttttggcaacttgtaacgtaaccagttacgggtagaagcaagtattcgaacatctttccggtgtaatccgacttcttcgaacagttcgcgatacatcgcctgttctgcggtttcaccgggattgatgcctccctgaggaaattgccaggagtgctgtccaaagcgcctggcccataacacttgtccctgccggttacagattacgataccaacattcgggcggtagccatcatcatcgatcaccggactacctcaaagcaaaatttgaatgagctgattgtttcacactccttacaggcggtaaaccactggattcatggggggttaagccatcatcgccgggataactcacagaaaatggcaaagttataaacaatgaccgagaaaaagatcgatcttattcaccttttctgtggatagctttgtgcagaacgcgggagttatctgaataaccttttccgtgcgcgctgaagagccaaaaagaaccaacaacacatcattatgatttttaatgaaattaaatcgaaaaccttaccggtaaatcttttataaacagtgaatattttcatggtaactgacaattgcttaaaatataagcacactgctttttatccacagataatcgctcagggttaggccagagcggcgaaattatggccagatcgtgaaaagtcaaggctgtaaatggaaccagtaccgcactcagacggtggttatcccatttttctgtggataaccgggctggagatcctgttcattgttgcgggtaagatgggataaccctgaagcacctggggcggcgagcgtgcaatccgctaaaaaaagcacgatctatcatgttattatcgatccctgacgcggattatttatgtgagaaacgtgactcacctgctgttgtacaatttttaatcaatgcgagtattcaccatgagttaccagccaggaccacctgaagatgaagccagcctgctggcacgcgcgcaggatttagccggtttaaccctggaaaccctggccgcgcgcgccggtctgcccatgcctgcggatctcaaacgtgataagggctgggtcggcatgctgcttgagtggcatcttggtgccagcgcaggcagcaaagcggagcaggactttgcccatctgggtatcgaactgaaaaccatcccgattgatgcgcagggtaaaccgctggaaaccacctttgtctgcgtggcacctctgaccggcaacagcggcgtgacctggctcaccagccatgtgcgccacaagctggcgcgggtattgtggatcccggttgaaggcgggcgtgagattccgctgcgggaaacgccgtgtcggcgcgccgctgttatggagccccgatgcggaagaagatgagatgctgcgacaggactgggaagagctgatggatatgattgtgctgggtcgcgtagagcagattaccgcacgacatggtgcctggctgcaaatccggcccaaagccgccaatagcaaagcgctgacagaaggaatcggcgatcagggccagccaatcatgacgctgccgcgcggtttctacctgaagaaaagcttcaccgggcccctgctggcgcgtcattttctcctctgattgtcgccacccgcgttgatgtgtcgcaattttgtgggagatcggcgaattgaatgcgtataatcgccgtttacttttcgtttaggattaaatgtcggtatgtttgagtggatttccgatcccaacgcctggctggcgctgggcaccctgaccatccttgaggtggtgctgggtattgataacatcattttcctgtcgctggtggtcgctaaactgccgaaacaccagcaagccagcgcacgtcgcattggtctgatgggcgcgatgctgatgcgtcttggcctgctggcttctatcgcgtgggtagcccgtctgactaatccgctctttacgctgatggatcatgcgttctcggcgcgcgatctgattctgctgtttggcggactgttcctgctgtggaaatcgagcatggagatccatgaaacgatcgaaggcagcgaaggcgaacacaacacccgcgtccattccttcctgggtgcgattgtgcagatcatgatgctcgacattattttcagcctcgactcggtgatcacggccatcggcctctccgatcatctgttcattatgatggcggcggtggttattgccgtgctgatgatgatgttcgctgcgcgcgctatcggtgagtttgttgaccgccatccgtcagtgaaaatgctggctctctctttcctgattctggtcggtttcaccctgatcctggagagttttgcggtccacgtaccaaaaggttacatttatttcgctatgttcttctcaatggcggttgagtgtcttaacctgatgcgcagtaagaaaaagcacgcctgataaagtcaagggcgagcctgctcgcccggttattttcagattcatacgattaaccctgccggcaaaaccatttattactacactgtttgcacttgaccatttgtgaggattaggcgtgatgaaagggttggcaggagtagcactggtgatggtaaccgccgcattcttaagtggatgcagttctgattatgtcatggcgaccaaagatggccggatgatcatgaccgaaggcaagccgagcattgataaagagaccggcctggtggagtacactgaccagacgggtcatatggtgcagattaacagcgatgaggtttctacgatcattgaacgttaagtgcccgatttaatcacctgccaccgattcccggctggcaggtgatttccccgacttttcccccttccttccccgccattgctcgcgctatagtccctgaggacacaacattccattccataaagaaaaggaagctggcaatgcactatcatcgtattccccacagcacgctggaagtgagtcagctggggttgggcaccatgacgtttggcgaacagaacagcgaagccgacgcccatgctcaactggatttagctatccgttccggcatcaactttattgatactgccgagatgtatccggtgcccccgcgtccggaaacccagggtctgaccgaacaatatattggcagctggcttaaacagcgcggcagccgcgacaaaatcattctggccagtaaagtggccggcccttcacgtggcaatgatgcgtcgattcgcccggatatggcgctggaccgtaaaaacatccgcgcagcactcgatgccagcctgaaacgcctgaatactgactaccttgacctctaccagctgcactggccacagcgtcagaccaactattttggcaagctcggctatcagtacagcgaaaccaccgctcaggtgacgctgctggagacgctggaagcgctgaccgaacaggtgcgcgccggtaagatccgctatatcggggtgtcgaacgaaaccgcgtggggcgtgatgcgctatctgcagctggcggagaagcatgaactgccgcgcattatcagcattcagaatccctacagcctgctgaaccgcagctttgaagtgggtctggccgaaatcagccagcatgaaggcgtagagctgctggcgtattccagcctggcgtttggaacgctgagcggcaaatacctgaatggcgcgcagcctgcgggcgcacgcaacacgttgttcagccgctttacccgctacagcggcgagcagtcacaaaaggcgattgccgaatatgtggcactggctcagcagcatcagattgacccgtcgcagatggccctggcctatgtgcgtcagcagccgtttgtggccagcacgctgctgggcgccactacgcctgagcagttgcagatcaatatcgacagcttcaatctgaccttaaatgcagagatcctggaaggcattgaggcgatccaccgtcgttatacctatccggctccctgagcgctctgttgccagctgccgcgatggcggctggcatctcttacaggtcgcgataatagagttttaccggcttagcgggatactccagcgcttggccctgtggcagccagccataacgttcgtagtagcccccaaacgttgaccataaccataaccgtggatagccttgtgcctgcgcataggcgatgacatgctgctgcagcgcctcactgacacctttgccgcgcaccgactcatcaacatagagcgccgccagccaggggaaaagatcctgacggctgatcaggtcgcagcgccagaatcccaccgtgccgactgccctgcccgcctccacggcaacgaaagtcaccggaaaatcagcaccgataaggctgctgttcaccacactggcaaagaacgcccggctggtggcttcaccaaatgcgtgccactgccagtcgatgatctgatcggcaaattggggggcatcgctgagcgatacaatctcaatcacatcagtttcccctgaaagatcgggactgaatcaaacaggtagccatcaaagtcaggcgcatcggcgtcggaaagctccagcagcgtattcttgacgttctcaaggtgctgccaggtggattgccaggcccccatcacatcacgccgacgcagagcagccaggattgtctggtgatcgccaagccacttcaggcgataggcgcgggtttcaaactgcgggcgcagctgctgccagagcgggctactgtcatgatgtcgccagatgctggtgacggtatcgagcagcatctggttctgactggcacccgccagcagcagatgaaacaacttgtcgttgtcctgactgctgtcgttggcggcgatagcacgctgctcctgttccagcgttcggcgcagattttcaatgtccgctttggtcgccatttttgcggcaaaggctgcaatattgctctccagcaactgacgtgcctgtagcatttcaaacgggccaacgtcgctgcggaagaaggcctcttcttcatcatcactggcggaaggaatacgcatcacatagacgccggagctctggcggatatccaccgtaccttccagctccagcatcaataatgcctcgcgcacgatggtccggctgacgccccaggtttcagccagctgacgttcaggcggcaggcgcgatcccaccggatagtgcccgtcacagatctgctgacgcaggtgctgaccaatttcctgatactgctttttttcttgcggcgcttcggctttgtccacactgtcaccctttgcaatcaatgcgctaacggcattgccgcggttccctgcgcgacaatgcccgcgaaaccggagaggctggctcgcaaactggggctcagtgtatcaaagccagcgcctgatcgagtacctttgcaccattcagcgtgccgtaagcaaccgtatcgatcaccgcgatgggcaactgatagctgtcggtgagttttctgttctcctccagtttgaagcgcacctgtggcccgagcagcacgaccaccacctcgttgccgtagttttgcagctcttcacgcaggttttgctccggaatggcgtagatctgaaatgccagtccgcgcgcggcagcctccttttccatccgcgtcaccaccattgaggtcgacatgcccgcagcacaggccagaacaattcgtttcatgctcgtttcctcgcgttatttcggctcatcatcaagccacagggtaaattgctgcgtgtcgcgcagcgtacggaaccagtgggcagatttcttcatacggcgctgacgctgcttatctaagtcgatttcgataagaccatagcgatttttaaaggcattcattggcgagacattgtcggtaaacgcccacagcatgtagccctgacagttaatacccgcctgactggcgcgtatcgcctgatgcaggtgctcgctgataaacgcgatgcggtaatcgtcctgaatctccccgtcggcatttttgaactgcgcttcgttctctattcccataccgctttccgccacaaaccacgggatattgccgtactcatcgcgcatccgctgcgccatatcccagataatttcaggctgaatttcccagccgcgcgaagggttcatccgtcgccccggcagttcaaagtgttcgtaataccaggcgggatgaaagggtgtctcgggatgccaggcgcgggatggtgccttcacgcgatgcggatagtagagattaagcccgacttcatcgacggtattggcggcaataatcgccagctcttccggggtggtttcccactcaatctgatgcttatcaagcagcgccagcagctccgccggatactcgcctttaatggcgggatcgagaaacacccggttgtagaacaggtcataaatatgcgccgccttctggtcgtgcggggctgacgatcgcggataggtgacttccggattgagtatggtaccaatgcgaccggcatagcctgccgcgcggaacagcttcactacccgggcggtagcaagattcttgtggtggttccactgcatccatttatgggtgttctgctcataaggccagcgcagcgcgtcgagatagacgcgggtctgcaccacaatcggctcgttaaacacaaaccagcgcgtgacccgaccggcatagcgtttaaacacctgttcgacataacggataaagagttcaacgacatgctttgactgccagccgccatactgctccagcagcgtggcgggcagctcgtaatgctccagacagagcatcagttcaatgccctggcgctgcatttcatcaatcagccggtcatagtaagccgcgtattcctcatcgaccgtagcggtttcgtaatcgatcaggaaacgcgaccagttgatcgaagtgcggtagtgggtcagcccgctggccttcattagcgccacatcctcactaaagcggttgataaagtcggtggcaaccgccgggccgtagccgttgtgccagacgtgacgatcctgctgataccaggcgtcaggccaggagtcctgccccgctttttttccgctccagccttccgtctgccaggcggaggcagcagctcccagaatgaaattctcaggtatgtggacagtctgacgactcataacacctccgttcggttagggttcagctcaggttgcaggctctttgcttccgctgcttctgctgcatccgcgcggcgggctgcgactttcacaaatggcagatagataagtactgacaccagaatgcagacgatctgcgtcaccaccgcacccatcgatccggccgttgacagccaggcattgataatcggaggcgtggtccatggcaccatcaccacggctttcccggcaaatctcatcaccgtagcgaagtagccgatagaacctgtcactagcggtgtgatgatgaaagggatagccagtatcgggttaagcataatcggcataccaaatataaccggctcgttgatattgaaaatgcctggcccgaacgacagtttggcgatttcacgcatctctttgcgtcgcgttgccagcatcacggcggtgagcagcccgatggtcaggccggagccgccgatgctcatataaacatcccagaaacggcatggtgataatgttcggtgcctcttttccctgctcaaaagcggtcatgttgaccataatcgcgcccagcaacagcggctcacggatcggcttcaccatctgattgccgtgaataccaatcacccagaacagctgggcgacgaacatcagaatcagaatgccccacaggctctgcaccaccgactccagcggctgctgcaccacctggtataccgcgtcgtaaaggtacatgccggtgacgcgatggaagataaagccaaaagtcgctatcagcgtcacggtgatgattgaggggatgagcgcggagaaagaggcggccacgttgggcggcacggtgtcgggcattttgattttcagccgttcaacctgttcgaggcggcagtagatctctaccgacagaatggcgataaacatgccgagaaacaggcttttggtatcggagaattgtttggccagcacgtcggtgaccaggtgcatctgcccatcgaccatcatctgtaaggtggtcggcgttacggatacaaagcagatgatcgccagcaggccgggaaacagcgtttttataccgttgatgcgcccaagctcaataccaatcaggaacaccgcaccaatgttgagaaagctgagcgtggcgtaattgatactgctggtgatgggcttgaggtcagctaaaaaagccagggcggcaaagctggcaaggccatttttgctgtccagcaccatgttagagatcaataccgagaaggcgccaacaatgatcaccggcatcagggtaatgaacgaggctttaatcgccatgatgtagcgataactgttaaagcgggtggcaaagctgcccagggaatcgataaggcggtcctgtagagacatgatcaaccctcagagatgtaagatcggtattcctgtaatcgtcgtggtcttccctgttagtggcataccaaaatgacgaatctcctcggttttttctgtgacgaacctcccggaaacgtttattggcattccagtatgattaaaacggccaatttggcataccaatagcggaggcgttatggattacgaacagaccatgatggaattgctgatcaatgcaggggaagcccgtttcgtcggcgatgatggcgattcagtgtgcgcgcaaacgcgactggaccggggctgacgcggcgctggcagcttcagataccgcggcaaaagcggcacataaaattcagaccgcgttgattggtgcagacgagggaagcggaaaattgccggtcacgctgattctggtgcatgcgcaggatcatctgatgaatgcaatgctgtgccgcgagctggcagaggagctggtcatgctgcgcaaagagatctatggctgacaggcggcgcgctggccgcccgggtgaggtgattagctgttttccagtgccagtagcgactcaatagtctgcgcgcggcggatctcgcgcggctggccctgctcaaacagcatttccgggatcagcggacggctgttgtagttagaagacatggatgcaccgtaagctccggtgtcgtggaacaccaggtaatcgccaacctttgccgccggaatcgcgcgtggttcgaccatgccgccctccagctgggtaaagacatcacccgattcgcacagcgggccagcgaccaccgtgtcgatagtctgctgctcatcaatggcccgctcatcgcccgccatcagcgagatatggtgatagctgccatacatggagggacgcatgaggtcactgaaaccggcatcgaccagcacgaagtgacggctgcccatcgacttaaccgcccgtacctgagagaccagcacaccggcctcggccaccaggaaacggcccggttcgatctccagctttatcgcgtgacccagatgctgagcgatacgctgccgcgctgcatcccacaggccgaaatagtgatcggtatcgatcgcctcttcgccatagcgataaggcacagagaggccgccgcccgcagagatcgcggtcagatcctgacccgacgccatcaccagttcaaccatcgcatcacagacctgctgcagatgcgcataatcgacgcctgagccgatatgcatatgaatgcccaccagctgcaagccgtgctgcttaatcgccgccagcgccccggctaaatcggcatgccagataccgtgcttgctgttttcgccaccggtattggttttctgactgtggccgtgaccaaaaccaggattgacccgcagccacaccgcatgtcccggtgagaccgcgccgagctgatgcagcatatcgatcgatccggcattaaccggcacctttaacgcggtcacccgctccagtgtcggctgatcgaacagatccgcggtaaagacgatctcatcaccgccaggctggtaacccgcggccagcgcacgttcgatctcacccagcgataccgagtccactttcacgcctgctgcgcgcatcaggcgcaggatatgcgtattcgagcaggccttctgcgcaaagcgcaccacatcaaatgcctgcagctgggcaatacgcgcctgaataatctgcgcatcataagcccagaatggcccggtgtagcggcgtgccagcggcagcaggttagcggcgctgagtgcggtttcggtactctgtaatgaacgtggcatgacaattctcctgtggcaatagctgcattaagccagaatcgtgtcatagcgaaaaatatctgttttaatagcatctatgcagaatggatataggaagggtgcgtggcgaacattaactggcggcatatcgagatttttcatgcggtgatgaccagcggcaatctgacccaggccgcgacactgctgcacacctcacagccgacggtgagccgggagctggcacgcctggagcagcagctgggattagagttgttcggacgggttcgtggtcgcctgcaaccgacggtgcagggattgcgtcttttcgaagaggtgcagcgatcctggtacggactggatcgcatcatggaagcggctgaaggactgcgccagttccgtcagggtgagctgtcgatcgcctgcctgcccgttttttcgcagtcgctgctgccaccactgtgtcagccctttttacagcgctacccggatgtgagcctgaatgtgattccacaggagtcgccgctgctggaggagtggctgtcagcacagcgctacgatatcggcttaaccgaaacccagcacgctccggccggcactgaccgtctcgccctgctgacctgcgatgaagtatgcgtattgcctcagcatcaccctctgagtcagcgttcagagctgacgccgcacgattttgcgggcgaacagtatgtgagcctgtcgcgcagtgacagctatcgtcagttgctggatgcgctgtttcatgagcagggcgtcgagcggcggctggtgatggagacgcacagtgccgcttcggtgtgcgccatggtcagagcgggcgtgggcatttcaattgtgaatccgctgacggcgctggattacgccgacagcggtgtggtgatgcgtaagttcagcgtggcggttccgtttaccgtcagcctggtgaggccgcagcaccgccctgcatcggcgctggtcgatgcctttgtcagccatctgcaacggcaggtggctgactttccggcacgcatcgccgcccgcctggcttaagcgcgaaccccggcggttgcgcggcccgatttgcggaaggtgatcagacagatcagcaggccgattgccgccagcgcagcggcagcaaccggcaccgccgtcaggccatatccacggccaatcaccgcaccgccgacccaggcacccagcgcattgcccacgttaaacgccgaaatgttcagggttgagaccaggttaggcgcctctttgccgtgacgtaccacgttgatctgcagacccggcaccgtcgcaaaggtcgccatcgcccacaggaacagggtgatctctgccagccacagcgcatggctggtccagctgaacagcagcgagaagatggcgatcagggagaagctgaggatcaggctaaaggagactttccagtcggccagtttgccgccaagaatattaccgaccgtcaggcctgcgccaatcaggaacagcgtccagctgacgccgcgatcgctgatgcccgtcacctctagcagcagcggcgcaatgtagctgaacagcgcaaacatcgccgcggcaaagaacaccgtcatcagcagcgacagccacagtttcccgttggccagtgcaccaatttcactcgccaggtgaaccggcttttcctgtttattgttgggcagactcacgatcagggcgataaacgccagcacgccaatcactgccacgccccagaaggtggctcgccagccaaacatctgtccgaaactggttcccagcggaacgcccagtacgttggctaaggtcagtccggtaaacatcagtgcgacagcggaagcctgacgaccggctggcaccagactggcagcgaccaccgcgccaataccgaagaaggcaccgtgacaaagcgcggtgacgatgcgtgccagcatcagcaggttataattgtaagccagcgcacacagcaggttgccgacaataaatatcaccatcagcagaatcagcgtttttttacgcggcagcctggcggtgagcagcgccataatcggcgcaccaatcgccacgcccagcgcgtagccgctgatcagccagcccgccgacggaatcgacacctgaaggtcacgcgccacctccggcagcaatcccataatgacaaactcagtggttccgatggcgaacgcactcaacgccagcgccattaatgctacaggcataacactctcccaatatcatttgcaggtgaactgcacagacgcgcagcccctcgacgcttattaaaatttgatctgcgtcacggtgagcattacagcacagtgctgatgcgcgacatagcctgcgcgcagcaaaggattattgccggggccgcaataatcctgccgctttgccggaacaaatggctttgtcagcctgctggctaagcccattaaagcgcacatgacgcagggtcaggttgtcatttcccgcgaacccgttacgctttttagtgcgtatttaattaataaatccttaacgttgccgatatatccctaatcaattgccaggtgatgtgatcaacttctgacgcagggagagagaatgcaacgactcatagccttaatggtgtttggcttaaccggctgctcggtgggtcattatgagtacagtaaagaagctgaaaaacgggtggatatgaccgtgaccggcattcccaccgtgctgggtttaggcacgctcggtaccaccatcccattgacgccggagtacagcctgaccgccgcccatgtggcaaagttttcgctttaccgggtcaaagcctggcatccgcaatgcgatctggccgtggtctaccataaaaacagcgaaatgaacctgccacccaactttcgtaacagccacatcggcgatcaggtcaatctctacggctacagttttatttcggccatgccggtcagttccagcgggcagaaacctgattaataccacgctggcaaacagctggaacaaatcagactgcgtcgtggtggcggcgaatgcgggggtggttaaagggatgtcaggcggcgcagtctataacgcctctgatgatacgctggcgggcgtgattattggctacagcaataacatcaacgacaatgtcagcggtaagacactctataagaacgttgcgctctatgtgccttactcgcgatttcagacatggctggatcaggcgattaaatcctgatatctgctgaacgaacagatgtaaaaaaggccggaatttccggccttaagcttggtgacaaagtcgggcctggttcgctgtaagaccgagcctgcacaggtaacacggtcagatcggaaagacgcaaaaactgtcatccatgaccgctcggcccacgccatccatggcgcgggacgctttcctcttctgaccgtgttccctgtgccgtgagtttatcagttgctgccaaattcactctgattcggctttgtcatcacgctgtcaggcctgaagatcaggcctgacagcgactcataacgattacttgctgcctggacgcagtgccgggaacagaatcacatcgcggatagtgtggctgttggtaaacagcatcaccatacggtcaataccgatacccagaccggcggttggcggcagaccgtgctccagtgcggtgacatagtcttcgtcatagaacatcgcttcgtcgtcgccagcatctttggcattcacctgctgcaggaaacgctcagcctgatcttccgcatcgttcagctcggagaagccgttaccgatttcacgaccgccaatgaagaactcaaagcgatcggtgatttccgggttctcgtcgttacgacgggccagcggagagacttcagccggatattcagtgatgaaggtcggctgaatcagatgcgcttcagcggtctcttcgaagatttcggttacgacacggcccagaccccagcttttctcaaccttgatgtgcagtgattgagcaatcgccaccgctttatcaaagtcttccagatcggccagatccgtttccggacggtatttcttgatcgcttcacgcatggtcagtttttcaaacggcttaccgaaatcaaactcctgctcgccgtaaggcaccacggtgctgcccagcacatcctgcgccagcgtacggaacaggctttcggtcagctcgatcagatctttgtaatccgcataagccatatagagttccatcatggtgaactctgggttatgacgtggcgaaataccttcgttacggaagttacggttgatctcgaacacgcgatcgaatccgcccaccaccagacgcttcagataaagctctggagcgatacgcagatacatgtcgatatccagcgcattgtgatgggtgatgaacggacgcgcagacgcgccgccagggatcacctgcatcatcggggtttccacttccataaagtcgcggcccaccatgaactggcgaataccggccatgatctgcgaacgaattctgaaggtgttgcgcgattcctcgttggcgataagatcaaggtaacgctgacggtagcgcgtttcctgatcggccaggccgtggaacttgtccggcagcggacgcagtgctttggtcagcaggcgcagttcagaacagtgaatcgacagtttcgccggttttggttttgaacagcttgccgcgcgcgcccaggatatcgccgagatcccactttttgaactgctcgttgtagatgccttcagccagatcgtcacgcgagacgtaaagctgaatccggccacccacatcctgcagggtcacgaaagaggctttacccatgatacgacgggtcatcatacgtccggcaacactgacttcgatgccgagatcttcaagctcttcgttgctcttctcgccatagctctcatgcagctggtttgagaggctgtcacgacgaaaatcgttaggaaacgccacgccatttgcacgcagcacgctcagcttttcgcgacgcgctttcagttcgttatttaactcaacggcggcatcagcgctctgcggttgttgttcagacatgtcggttccttataaccctgcttttaaactagcttcaatgaatcgatccaggtcgccgtccagcaccgcctgggtgttacgcgtctctacgccggtgcgcagatctttgatgcgtgcatcatcgagaacgtaagaacggatctgacttccccagccgatgtcggacttgttgtcctccagcgcctgtttctcagcgtttttcttctgcatctcaagctcgtacagcttcgctttcatctgcttcatcgcctgatctttgttcttgtgctgagaacggtcattctgacactgggtgacggtaccggttggaatatgggtaatacgtaccgcagattccgtccggttaacgtgctggccgcccgcccctgacgcgcgatagacgtcaatgcgcagatcggctgggttgatgtcgatatcaatatcgtcatccacttccggatagataaaggcggagctgaaggaggtgtgacgacggccgccggagtcaaacgggctcttacgcaccaggcgatgcacgcccgtttcggtgcgcaaccagccaaaggcgtagtcgcctgacacgcgaatggtcacagatttaatgcctgcaacttcaccttcagactcttcgataatttcggttttgaagcctttggcttcagcccaacgcagatacatacgcatcagcatgctggcccagtcctgcgcttcggtgccgccggaacccgcctgcagatcgatgtagcagtcggcgctgtcatactcgccagagaacatgcggcggaattccagctcgcccagcttgccctcaaggacatccagctcggcaaccgcttcgtcgaaagtctcttcgtcttccgcttctaccgccagttcaagcagaccctgcacatcttccaggccctgcgacatctgatccagcgtctgcacgatcgcttccagcgaggagcgctctttgcccagcgcctgagcacgctcaggttcgttccagacatcgggctgttccagctcggcgtttacttcttcgaggcgttctttcttggcatcgtagtcaaagatacccccgaagaacgtcgctgcgctcactgaggtcctgaatacggtttttgaccgggttgatttcaaacatggctttagcgtctttcttatgttcgatgggacaggaaatttaacgcataagtttacccgaaactggcggcagtttgtagcgctgagacagcgggctgatgccggggcggcgtgacgcgttgcatttgcttatcgggctgcgacgacaaccgctcgcacagcaggttaacgcagggaaaaaacaggctgacgcgcctctgccgtgaccggagacgcgcgcgccttatgaaaatcaaagcggccagatatggtcaatgatcagctgtaccgagcggttaccgcgatactcattgatatccagcttataggccagctcgacctgacgaatgctgctgtcgggccacagggtggtatcgacattaaaggcgatcccgtcgatcagcggaccgccgtccagcggttcgaccatcactttcagatgtcgctcgcccaccagccgctgttgcagcagcttaaatttgccgtcaaaagcgggttccgggaacgcctggccccagggccccgcttcgcgcagcatctcagcggtctgcagcgaaaactcctgcggctgcaacgcaccatctgaccagatgatgccctgcagagattcgccatccagccactcaccgaccagatcggcaaagcgctgacgaaactcctcgtagcgtgcggtttccagtgataagcctgccgccatggcatgaccgccaaacttcagcatcaggccgggattcagcgtatccagacgctccagcgcgtcgcgcagatgcagaccggcaattgagcggcctgagcctttcagcgtgccgtcgcccgccggagcaaaggcaatcaccggacgatggaaacgctctttcagacgggaggcgaggatccccaccaccccctgatgccattcgggatgataaaaggccagccccagcggtagatcgctctgctcacgctccagcgcctgacacagcgccagcgcttcgctctgcatgccctgctctatctctttgcgcgtctggttcagcgcgtccagctcactggctaacatccgtgcctgactgagatcctcagtcattaacagcgccacgcccaccgacatatcgtcgagccggcctgcggcattgagccgtggccccagcgcaaagccgagatcgctggccgccatctgacgcgcatcgcgattagcaatctccagcagcgcccggatgcctggccggcattttccggcccggatgcggctgagtccctgccacaccagaatgcggttgttgacgtcgagcggcaccacgtcggcaaccgtgccgagcgccaccagatccagcatctctgcaagattgggttcggtgcgggtggcaccaaaccagccctgggtgcgcagatgggcgcgcagcgccagcatcagatagaacgcaacgcccacgcccgccagtgcacgtgagggaaagttgcagtccggcagattgggattaacgatcgcctcagcggccggtaaggtctcgcccggcaggtggtggtcggtaatcagcaccggaatcccgtgctgatgggcacattcaacgccggcgtgggaggagatgccgttgtcgacggtcaggatcatcgccgcgccgcgcgcccgcgcctgctcaaccacttcagggctgaggccataaccatcttcaaagcggttaggcaccagatactgcacgttgccgccgcccatgctgcgcagcgccatgaccgtcagcgcggtactggtcgcgccatcggcatcaaagtcacccaccaccataatgcgacgcccatccagcagcgcctgatgcagcagttccactgcgctctcaatcccgcttaaggactggaacggcagcaggtttttcgccccgcgctccagctctgccgcgtcgcgcacgccgcgttgcagatagagtcgtttcagcagcggcggcagcgtcgccggaagcgcatcatcaaccgtcacctcacggcgacggagttccacatcctgttttaccaccgattaaccaccacgcttctgattgtccagcacctgcttcagctcctgcggcgactgataacctgggatcatcatgccgctgtcagtcagcatcgcgggcgtgccctgaatgccgaacagcacgccaagtttatagtgctgggcgatatcgattttgcagctgtctggtgcggccatcttcggcgcattgcctttcatcgcctcatcaaacgctttattgcggtcagcgctgcaccagatcgctttcatcgctggttcaatctgaccattcagcccttcacgcggaaacgccagatagcgcacggtgatgcccagcgcattgtagtccgccatctgctcgtgcagcttgtgacagtagccacaggtgatgtcggtaaagaccgtgatcacgtgctgctctttaggcgctttgtagacgatcatctccggcaccagcgcttcgacttttttgtccagtagctggttggtgacgttgaccggctgtttgccgctgacgtcatagagcgggccctggatcatatgtttgccgtcgtcggtcacgtagagcacgccgctttctgacagcacggttttaaaacccggcagcggtgacgggctgatctccgtctggttcagaccgagctttttaagtgattgctgaatggcgctgtcatcggcctgtgcgagaccggaaaaggcgctggctaaaagagccagcatggcaaaatgcttgttcatttttgtccttatcgccgcggtttcaggcccgcggatggtgttgttgatgcaactgacgcaggcgctcagtggcgacgtgcgtataaatttgggtggtggagagatcgctgtgtcccagcagcatctgtacgacacgcagatcggcaccgtggttcagcagatgggtcgcaaaggcatggcgcatcacatgcggtgataacttttcgctgtcgatccccgccagcgtggcgtaatgcttgatgcgatgccagaaggtctggcgcgtcatctgctgcgcccgattactgggaaacatcacgtccagcgtctgaccgttgagcagccacggacgaccatgttccatatattgctccagccagtaaaccgcttcttcacctaaaggcaccagccgctctttatcccctttaccgataacccggacaacgccctggcgcaggctgatgtcgctgagcgtcaggccaatcagttcggagacgcgcaggcccgtggcgtagagcagctccagcatcgctttgtcgcgcagctccagcgggatatcgatattcggcgcctgcaacagccgctcgacctgcgcctcactgagatctttcggtaaacgctgcggcagttttggtgctgacagcagcgcgctgggatcgtccgggcgcagcttttcgcggtaaagatactggaacaggcgacgcatggcgctgagcagccgcgctgagctggtcgccttgtagcctccctccagccgttcagccagaaactgctgcagatccagcggcgccacgctaagcagcgtcagctggtgatgcgccagccatccggtcagcgtctggagatcctggcgataagaggagagagtgttctgcgccagattgcgttcaatccagagcgcatcaagaaactgttctgtcagatcgctgtcctgcacgttatctccgccgtctggtgtaaaatcatgctcattatgcctgattcagcagcgcttctggtacaattgcgccaaagtcagtatttacagagtgttatctgcatgaaaatcggtcttttttacggttccagtacttgttacaccgaaatcgtagcggagaaaattcgcgattttattggcgaagagttagtgacgctgcataacgtgaaagatgacgacccgcgcctgatggagcagtacgacttgctgatcatgggcatcccgacctgggatttcggtgagttgcaggaggactgggaggcgatctggccgcagttgcccgcgctgaatctgcaaaacaagattgtcgcactgtatggcatgggcgatcagattggctatggcgagtggtttttagatgcgctcggcatgctgcacgagttgctgcagccgatgggggtacgttttgttggctactggccgcttgaaggctatgagttcaccagcccgaaaccgctgagtgccgatggctcgcagtttgtgggtctggcgcttgatgatgtgaatcagtttcgaggtcaccgatgagcgcgttgagcagtggtgcgagcaggtgttaaccgaaaccgccggactgctctgacggcccttctgccggtgtcgaaccctagcctgaacaggtgagcggctttaatcgctcttgcctgtcattattgaaccgcaatgcaggcagatgaacggcttcagacgctcttgcctgcactgcttccattaatgccgcgccgggctgaagcagcaggcgcgtaacgcccgccattcgccaggctgcatattgtcctgcatcagccaccagcgcagcgtggcaccctgttcgctcttcgccaccagcagcacgccaacgggtaaccagcgtaatggctgagttggccgccagcgttttccctgccagatccagcaatggacgctttcccgctgtaacgtaccgtgcggttgaatcaatcgccaaacgctgcgccagccctcagccagcaacagcagaataatcggcgctttaaccagccagccgcctgcaggcagcgtcatcagcaccacgccagtcacggctgctatcagccaggcgcagactaacccgcacgccagacgagagggccgcagcttacattgccaccgggccgcgagcatggttacgctgctggatcaggttcaccatccgcttaagctccggatcctttggctcaccgtgattcatcagccagttaaacagatcgggatcgtcactctttagcaaatccacaaagacctgcttatcggtgtcgctcagcgtctcatactcaaatttgaagaacggcataatagccacatccagttccagcatgccgcgacggcaggcccactgaatgcgtgatttatcattaatatccatgcatcaatttccacaattcacaacgtggcgcctagtgtaacctggtttaatgcggctcgcaggcgcagcgtcgcatgctgtgcaacctgccacatttcaggctggatcttttcagggttatcacgccttttgtgcgccgttttccgtaaacaggttgcattgccagtcggctcttttaacattgaagatattattccggatgaaccttcttatacaggatatctccatgcccacatttactttaccgccgcgccagcctgccgcgtcgtctcgtctgccgttaaccctgatgtcactggatagctgggcgctggtttccattaccggcgccgacagcacctcttacctgcaggggcagttaacgctggatgtcgccgcgctggatgccgaccaccattcgctcgccgcacactgcgatgctaaaggcaaaatgtggagcactatgcgcctgttccatcgcggtgaaggctatgcttatctgatccgtcgtgagctgcgcaacacccagctgcccgagttaaagaaatacgccgtgttttcgaaagtgtcgatggtggctgatgatgagtcagtattgctgggcgtggccggttttcaggcgcgcgccgcgctggcaaatctgtttgatagcctgcccgacagcgaaaaaccggtggtgcagcagggagaaaccacgctgctgtggtttgcccatccggccgaacgttttctgattgtcacttcgctggcccaggcagaagcgctgaagcagaagctcaatgacgatgcacagtttaatgacagtcagcagtggctggcgctggatattgaagcgggcattccggtgatcgatcccgccaccagcgtgcagtttattccgcaggccaccaacctgcaggcgctggatgctatcagctttaaaaaagggtgttatgccggtcaggagatggtggcacgggcgaaatatcgcggcgccaataaacgcgcgctctactggctggcgggtcaggcaagtcatctgcccgaagccaatgccccgctggagttgcagatgggtgaacgctggcgtcgaaccggcagcgtgctggctgcggtgcagttagatgacgggattagctggattcaggtcgtgatgaataacgatctggagccggacagcgtgctgcgggtggaaggcgatgaaggcggacatctgaccattcagccactgccctactcgctggatgaaagctgattgagcgtatggcccttccgctaagtgaagggccagtgccacaattcagaggctcacttcagcgcacataaaagtagatagcgcagaagtgacagagactgccgcccagcacgaacagatgccagatggcgtgattaaacggaatgcggcgcgccacatagaaaatcacccccagcgaatagataatcccgcctgcggcaagcagccagatgcagcccggcggcaggatcatcgccagctgataaaccacaatcagcgacagccaccccatacagagataggtcaccagcgacagcgctttaaagcgatgcgcaattgtgagcttgaacaggataccggccagcgccagcccccagatcaccgccattaatccatacgccagtggcgtcctcagcgcgaccagcagaaacggcgtataggttccggcaatcagcagatagatggcgcagtgatcaaactttttcagccagggtctggccgggccagccggaatggcgtgatagagcgtcgaagccagaaacagcaggatcatgctgccaccatagaggctgtaactgataaaagtgatggtgtcggcctgcctctccgttgcctgattgagcatcagcaccagtccgacgataccgaacaggcagccaagaccgtgactgatactgttggcaatttcctcggcgaacgaatagcccgcagcgtgttgatgtttgtgagagagtgtgggggtcataacagattcctgatcagctccatagcagtgatatcgttatccagcgtagccaacaattttttcagtgtacacttgtacgctaaaattatcttggtgaaattcactatcccttaaaccgggtgatgaatctggtaaactggccgccagtcaactgttcaatgagtcattcatgttttcgcatagcgatctcgcccgccttaacgatctggaaatgcaggtctatcagttcatcattaagcaccgcgaaggcgtcagctatatgacgatccgcgagctggctgagcaggctggcgtctccaccaccaccgtgctgcgtttctgtcgcaagatgggctgtgaaggctggtcggaattccgcatccgcctgcgcttaaacgaacagcagagtgcgccaatgctcaacacggcgggcgtcagtgaaatgctgagcttttttaagagcatcaataatccggagtttgaacagctcatcgctgaggccgcgcagaagattaatcaggctgagcgggtcttctttattggcgtcggcacctccggcagcctggcaaaatatggcgcacgctttttctctaacctcggtaaattcagccacgcgattgacgatccctattatccggtcagtcccgatctctatgaaaacgccattgccattattttatcggtctccggtgaaacggaagagatcctgcgcattgccagccagttcagcctgaataagtgtaaaatcattgcgataaccaacacggagagctgctcactggcgaagatcggtgatttcaacctctgctaccatgtgcccatcatccgtatggcggacaattccgacattacgactcaggtgccagtgacctatattattgaagcaatcggccgccagctggggaaataaaacagcctgttttttggatgtaacaaacgcaattattgccgcgctgttatatcgtgactttcattattgccttgctacactcagctcaatttcaatatccgtaatggggtgaagcatgagtgcagaattgcagttaccaaaaggctttctttggggcggagcggtggcagcgcatcaggttgaaggcggctgggatcagggcggcaaaggcgtcagcattgctgacgtgatgaccggcggttcacacggcgttgaccgggtgatcaccgacggcgtgcagccgggtcatttctacccgaaaccacaagggtgtggagttttactcccactacaaacaggatgtcgcgctgtttgccgagatgggcttcaaatgtttccgcacctcgattgcctggacccgtatcttccctaacggtgacgagcaacagcccaacgaagcaggcctgcaattctatgacgacctgtttgatgaactgctgaagtatggcattgaaccggtcatcaccctttcgcacttcgaaatgccttatcacctggtcaaagagtatggcggctggcacaaccgcaaagtggtcgacttctttgtgcgcttcagcgaagtggtgctgaaccgttataaaagcaaagtgaaatactggatgaccttcaatgagatcaacaaccagcgtaactggcagtatccgctgtttggttactgctgttcaggcgtgatctttaccgaacatgagaaacctgaacaggcgatgtatcaggtgatgcaccaccagtttgttgccagtgcaaaagtggtgaaactcggccacgacatcaatcctgactttcagattggctgcatgatcgccatggtgccggtctatcccttctcctgccacccggacgatgtggtgctggcgcaggaatcgatgcatcagcgctatgtgttcagtgacgtgcagatgcgcggctactatccggcctacaccctgaaagagtgggcgcgcaagggttacgacattcagatggaagcggatgatgccgagacgctgcgccagggctgtgcagactatgtcggtttcagctactacatgagcaacgcggtgaaaaccgatgccagcggcgttgacgatccgatcaccggctttgaaggtgtggtgaaaaacccgcatgtgaaagcgtccgactggggctggcagatcgatccggttggcctgcgctatgcgatgaacgagctgtatgagcgttaccagaagccgctgtttattgttgaaaacggctttggtgctatcgataagccaaatgccaatggcgtaattgaagatgattaccgcatcgactatctgcgtgcgcatattgaagagatgaagaaagccgtggcgtacgatggtgttgaattaatgggctatacgccgtggggctgcctcgattgcgtctcgtttaccaccggccagtacgacaaacgttacggttttattcatgtgaataaaaacgatgatggcagcggcaatttttctcgtgggaagaaaaagagtttcagctggtatcagcaggttatcgccagtaacggcgaaaacctgtaagtcatcacgccgcatcagcggcgaagtgagttaacgcccaccggcagcgtcaatgatgctgccggtgacgtaagaggccgcgtcgctggccagccagacgatcgcttccgccacctcttctgcttcaccgccgcgtcccatcgggatcacgctggcaagcctgtccactctgcctggctctccgccatcggcatgcatctctgtatagatgaatcccggacgtacgccgttgacccgaatcccctgctgcgccacttccagcgacaatcctctggtcagcgtgtccatcgccccttttgaagcggcgtaatcgacatattcgccaggcgcaccggtacgcgacgctgctgatgagacgttgacaatggagccgccctggccgccgtgatgcgtgcccatccgcttaaccgcctcacgacagcagagaaaagacccaatcacgttggtggcaaagaccttgtgcaggcgtgccgcatccagctgctcggtgcgacactgctgaaacaaaatcccggcgttgttcaccagcaacgccagcggttcggactgctggtcgagctgcgcaaacatcgccatcacctgggcttcatcactgatatctgcctgaatagcaaaggcttcaccgccctgctgctggatctgcgccaccacctgttgagcttccgcttcgcgctgacggtagttcaccgcaacccgataacccccggcggccagtaacagcgctgtggcccgcccgataccgcggctgccccccgtaaccagtgccagtttcatgctgattctccagtataaagggccgacgaatcggccctttatggttaacgtttgcctgcggggaaattactgatagtcgctcatcggcacgcaggagcagaaaagattacggtcgccaaacacatcatccagacgttttaccgtcggccagtatttgttgtggctgcccgccgggaagactgcaagttcgcggctataaggatgtgaccactcactgacgatttccagctgagtatgcggcgcattaaccagtggattgtcatccagcggccattcacctgacgtcacccgatcaatctccatgcggatcgccagcatcgcgtcgataaagcgatccagttcgattttgctctccgattcggtcggctccaccatcagcgtacccgctaccgggaaggacatcgttggtgcgtggaatccataatcgatcaggcgcttagcaatatccagctcactgatgccggtctgctctttcagcggacggatgtcgagaatacattcgtgcgccacgcgaccgtcacggccggtgtagagcaccggataggccgactgcagccggcgggcaatgtagttggcattcagaatcgcgaccgaaactggcctgtttcagcccttccgcgcccatcatgcgaatgtacatccagctgattggcagaatggatgcactgccaaacggcgctgcggatacggcgccctgctgcgtcagtacaccgtcgatctgtaccacgctgtgccccggcacaaacggggccaggtgcgctttgacgccaatcggtcccatacccggaccaccgccgccgtgcggaatgcagaaggttttatgcagattcaggtgcgagacatccgcgccgatatagccaggcgtggtgatgccgacctgcgcattcatgttcgcgccatccagataaacctgaccgccatactgatgcacgatctggcacacttcgcgaatggtctcttcataaacgccgtgggttgacgggtaagtcaccatgatgcaggagagtttgtcgcccgcctgagccgctttttcacgcaggtcgccaaggtcgatgttgccctgtttatcgcaggccaccaccaccacgtccatgcccgccatctgggctgaggccgggttagtcccgtgcgccgagcttgggatcaggcagagatgacgatcgccctcgccacggctttcgtgataacgacggatcgccagcagtccggcatattccccctgcgcgccggagtttggctgcatacagagcgcatcatagccggtgagctgcaccagccactgcgaaagctggccgatcatctgcagatagccggaagcctgttcagccgggcagaatggatgcagctccgcaaattccggccaggtgatcgggatcatttctgccgctgcattgagcttcatggtgcaggagcccagcgggatcatcgcctgattcagcgccagatcctttttctccaggctgtgcatgtagcgcatcatctcggtttcgctgtgatgacggttgaacaccggatgggtcaggatctcgctgtggcgttgcaggccagcaggaatcgcgtggctttcgctggccacttcgctgtcgagcttttccaggtcctgaccgtgttcatcacccagcagaatggcaaacagcgccagaatatcttcgcggcaggtggtttcatccagcgtgatacccacggcgttatggatgtcgctacgcaggttaacgccaaagctcagggcgcggttcagcacagcggctttatccgccacctccaccgtcagcgtatcgaaccagtgctgatggcgcagcttcaggccgccctgttgcagcccagccgccagaatgttggtgaagcgatgaatgcgtgaggcaatgcgtttcaggcccgccgggccgtggaacaccgcatagagaccggcgatgtttgccagcagcacctgcgacgtacagatgttggagttggccttttcacggcggatatgttgttcacgggtctgcatcgccatacgcagcgccgtgttgcccgctgcatcacgtgaaacaccaatgatacggcctggcatagagcgtttatgctcgtcgcggctggcgaagaatgccgcgtgagggccgccgtagcccattggcacgccgaagcgctgagctgaaccaaagacaatatctgcaccctgtttgcctggcgcttccagtaacaccagcgacataaagtccgccgccacgctgaccaccactttgcgggctttcagtccggcaatcagcgcgctgtaatcgtgcgcttcgccggtagtgcccacctgttgcagcagcacaccaaacaggtcgtcatgatcgggtgctttgtccgcgctatcaataatcagttcgaaaccgaacgtctccgcacgggtgcggaccacatccagcgtctgtggatggatatcatcggcaatgaagaatttattggcatttttgagcttactgacgcgttttgccatcgccatcgcttcagcggcagcggttgcttcgtccagcagtgaggcggacgcgatatccatgccggtaagatccagcgtcagctgctggaagttcagcagcgcttccagacggccctgggagacctcgggctgatacggagtataggcggtgtaccagcccggattctccagcatattacgcaggatgaccggcggggtgatcaccgcgctgtatcccataccgatccaggatttgtaacgcagattctggctggcaatcgctttcagttcggccagagcctgctgttcagtggcggcttcgccaaccgctggcgggcctggcagctgaatgtctgccggcacaatcgtgctgattaacgcttccagcgaacgggcaccaatagcgtcaagcatctgcgcctgctgctcaggtgaaggaccgatatggcgctcaatgaatgcaccgttgtgttcaagctggctgagagtctgagtcattagcagtaaatcctgaatcgggctgggggaaccggagagcaaacataaatctgcggcctctgtgtgaggccgcctgacgactactcgtcgatggaggctttgtaagcatccgcatccagcagcgtgtcgatttcagacgcgtcactggctttgattttgaataaccagccgccttcataaggctcgctgttgacctgctccggtgagtcagtcagtgcttcgttgaccgccacaatctcaccgctgatcggcgcatagatatctgaagccgctttaacggattccgcgaccgcgcactcttcaccggcggcaaacgtcgcgcccacttccggcagatcgacaaacaccatgtcgcccagtagctcctgcgcgtgttcagtgatacccacggtgtagctgccatcttcttctttgcgcacccactcgtggctgtcgcggtacttcaacgtattcggcacattgctcattggccatttctcctgaataaaatttactgagcgaccggtttaccggcgcggacaaaaacgggacgggtaacctggaccggcatctggcggttacggatctcaacgatggcggtgctgccgactgaggccggtacgcgcgccagggcgatgctgcaacccagcgtcggtgagaaagagccactggtgatgatcccctcctgcggctgcccctggtcatcggtgaaacgcaccggcaagccgttacgcagcacccctttttctgtgaggatcagccccaccagcttttcggtaccgcgttcacgctgcagttccagcgcttcccggccgatgaaatcgcggtcagcaggttcccagcagaccgtccagcccatgttggcagccagcggtgaaacgccttcatccatctcctgaccatacagattcatacccgcttccagacgcagcgtgtcacgtgcacccagtccagcaggtttaacgccagcagccagcagacgctgccagaaatcggccgcctcctctgcgggcatagcaatctcatatcccgcttcgccggtatagccggtggtggcgataaacaggtcacctgactgcacgccgaaaaatggcttcatgccggcaacagcctgacgctgctcctcgctgaacagcgtctgtgccttctgctgcgcctgcggaccctgcacggcaatcagcgccaggtcgtcgcgttccgtcagcgtaatgccatagccctgcgcgtgttgcgtgatccaggcgagatcgttttcacgggtggcagagttcaccaccagccggaagaactcttcgctcataaagtaaacaatcaaatcgtcaatgacgccacccgaggcattcagcatcccggtgtagagcgctttgcctggctgggtcagttttgccacatcatttgccagcaggtagcgcaggaattcacgggtacgcgggcctgtcaggtcgacgatggtcatgtgagagacatcaaacataccggcgtcggtgcgcactacatgatgttcatccatctgggagccatagtgcagcggcatcatccagccatgaaaatccaccatgcgggcaccgcaggcctgatgctgttcaaacagaggtgtttgctgagtcataaccatcctgtgcagaagcgagtgagtgcaaaagtgcgccggaattcagtgccgacgcaaacgttctcttatggctgacgttaccaccgaatctgacgattaaccataagcaaaccggggtcgaaagcagaggcacagcctaaccaggaacggctgccaacaggatataaaactgcaattttgtgattaatcgcgcaataaatgcagggaatttaaatatacgcagcaaatttatgcgggatggcattcaggatgttaaaaaaatcccgcgcccagcggacagaagaatgagaaaaagtaatgcgaattagcccgcaaaattagaataaatcaaacgaagacctgtgctggtgcagcgttgcctttttgtggtgcagagcggtgtcaggcataaaaaaagccagcagaagctggcttatcagaagggcggatttagcgtagccaggcgggcagatcattcaggcccatcgcctgcttcagcatcatgggtttgacacccggcagacggtcagccagtttcagacccacgtcgcgcagcaattttttcgccgggttattgcctgcgaacatctcacggaagccctgcattcccgccagcatcattgcggcgctgtgcttacggctgcgctcatagcgtcgcagatagaggtgctgaccaatatctttgccctgctgatgcagacggcgaatctcaccgatcagctcggcggcatccataaacccaaggttaacgccctgacccgccagcggatgaatggtgtgagccgcatcgcccaccagcgccagacggtgtgccgcgaagttgcgggcatagcgcgccaccagcggaaacgatttgcgctcgctttccagctggcacaggccgagccgcatatcaaacgccaccgagagctgctgattgaacagcgcttccggcatggtttccagacggctcgcttcctgcggcgagagcgaccagacgatggaactgagatgcggatcctgcatcggcaggaaagccagaatgccgtcgccgtggaacacctggcgcgctactgcgtcgtgcggcttctcagtacggacattagccactaacgcatggtgatcgtaatcccagaaggtcagcgggatatcggctttgttgcgtagccaggagttagcaccgtcagcggcaatcattaatcgcgcacttaacatgctgccatcctgcagggtaacgaaggcttcgttatcaccaaacgcgacctgctgtaactgcgagggtgccattatcgtcacgtcgctgcaggcgctggcacgttgccagagcgcattgtggatcaccgggttttcaataatatggcccagatgcgacaggccctgatgctcatcatcaaaggcgatggagccgaaactgtccttatcccacacttccatgccgtgataagcgctggcgcgcagcgagagaatggtcgaccagacatccagcttctgcagcagccgttcgctggcggcattgattgccgacacgcgaactgacggtgacgcactcagcgccagcggtggctccggtgatttttccagtacggcgatgcgcagtccgctaccctgcaagccgcaggccaccgccagtcccaccataccgccaccggcaatcaccacatcaaaagtttgcatctgagcctctttattaacgcttaacccagccaagcgtgcgctcagccagttgatttcttaaccacggtagatgatccatcgccagcaggcccaggttacgtcctgccaccagcgggccatagcgattcgcaaagacgcgaaccagtccgtcggtgataccgatggtggcggcgcggtcgggctgacgacgctgctggtaatgatgcagcaccgcatagctgccggggtcctgctgctgccgatgggcggctgccagcgtttcagccagtgacatcacatcgcgcaggcccaggttgaagccctgcccggcaatcggatgcagcgtctgcgccgcattgcccaccaccgccacgcgatgcgtcactggcgacatcgcccggtgcagcgccagcgggtaatactcacgctggccggtgtgggtgaatttacccagccgccagccaaaggcacgctgcagctggctgaggaattcggcctcgctccactgctcaatgcgttcacgctgcgaaaccggatgacaccagaccagcgacaggcgattgccggacatcggcaacagcgccagcgggccatgttcggtaaaacgttcaaatgcccggccctgatggggcagcgcggtggaaacattggcaatcacggcaagctgttgatagtcgtctctttgccactgaatgccgcacgaagccgccagcgcagagcgcgtgccatccgccgccaccagcagtttgccgctgagttgttcgccactgtccagcgtcacctcaacctgctgctcacggcggttagcctgggtaacacgagccggacagcgcagcgttacgccgggtgcttttttcagctcagcaaacagacgctgaccgacgtcaaacagctcgacaacctgtcccagcgccggaatagcgtagtcagccgccgccagcgacacaaaaccggcgtgaccgcgatcggagacatgaatgtcggtaatcggcgtggcacaacgggcgatgtgctgccacagattgatgtccgcaagctgctggcaggtaccggcagagagcgcaatagcgcggccatcgaaaccgggatgcgcccggctgccgggctcgctgctttcaatcagcgttaccggcagtgtgccctgggtcagatgggagatcgccagcgccagcgtcgccccggtcatgccgccaccggcaatcagaatcgtcatgcctgttttgccgccgccatcaatgcttcaatctcatccgcctctttcacgacgctgtcggtgagattttcaatgccatcttcagtgatcacaatgtcatcttcgattcggataccaatgccgcgatactgcgcgggcacgtcggcatccggtgcgatataaagacccggctcgacggttaacaccatgccgggctccagtacgcggtcgcggctcggggtgccgtagtggccgacatcatgcacatccagtcccagccagtggcccaggccatgcatatagaactgacgatggacttcctcggcgatcaatgtatcgacgtcgccctccaggatgcccagctccaccagcccggtgaccatgatacgcaccacttcatcattcacttcacgaatgctgatgcccggccggaacagttcaagcgagcggttgaggcaagccagcacgatgtcataaatcgcgcgctgcgccgggctgaatttgccgttaaccgggaaggtgcgggtgatatcgcctgcatagccgtggaactcacagcctgcatcgatcagcaccagatcgccgtcgcgcatttcgctttcgttttcggtgtagtgcagaatgcagccgttaactccggcacccacaatggtgttataggagggaaaacgcgcgccgtgacggttaaattcgtgctgaatttccccttcgagctgatactcgaacaggcctggccggcaggtttgcatggcgcgggtatgcgccagtgcactgattttcccggcgcgacgtaacagttcaatctcatccgcatctttaaacaggcgcatctcatgcacccagggacgccagtcagtgagggtatcgggcgcactgagatgctggcggaagccgcgacgcagcttatccagcgcgctgaacaccagtgtgtccgcgtgggcatattcgccctgcgcatggtaaaccacatccaggccattcagcagcaggtgcagctggtcaccaatatcattccagggtaaagcgcgatcgacgcccagtttgtcgggtgcggcctcctgacccagacgacggccagaccaggtttccgccgcaggatcgcgcacgcgattaaacaacacgctgtggttatgattctcatcgcttttgatcagcaccagcaacgcctgcggctcgttaaaaccggtgaaataccagaagtcgctgctctggcggaacggatattcggtgtcattactgcgcatcacttctggcgcagcaaagattaacgctgcgctgccaggcaccatcttcgccagcagcgcctgacgacgctgcaggaatcgttccagtgaaatcatctctgcactccctgtaaactgaccggttaaactcgttgacctgaaattagtgtagcgtcggtttttgcacttctggcgcggttggctgcgggcgggtgaacgtatcgtggcacagcagcgcggcgacacgaacgtactcaatcacctcctccagcgactgctccagctcctcctggtcttcatcttcttcgtaaccgagctgtgcgatagtgcgcagatcatcgatcgcttcgccggtttcgccggtgactttatccagtttaggctgtgttacgcccaagccgagcagaaaatggttaacccagcccgccagcgcgtcggcacggtcaaatacagtgatgtcgtcgtcagcaggcagcagcagctgaaacaggaagccttcatcttccagcgtggtcgccgtatgctcgtgtagttccgccagtggcacggcaagagtgtgtgaaaacgccatgccttcgttagccagatcgtgtaccagcgtcttccagctggtgtcctggttaccaccgcagaggatcccgctcagcaggccatgcatttccgcgggcgtcattccaacgccctgctgtgagagcaccgccgcgagcgcgttgtaatcgggggttgcgttctgtaaggacataagttttcatcgtcgttggcagaataagttcgtgttatgctaccactagctgcctcaaggtttccagaaaaggggttgtatcttatttcgtgggtctatatagttgcccgcctcccaagccattgactgctaagggagttgcgagcgaagtaatcagtcaggaaggtggcatgtctgcacaaccggtagatttacaaatttttggtcgttcgttgagagtaaattgtccgccagagcagcaagatgcgctcaatagcgcggctgaagatctcaatcaacggttgcaagatctaaaagttcgcactagagtcaccaatacagaacaactggtgttcatcgccgcgttaaacgtctgccacgagctagcgcaagagaaagtgaaaacgcgcgattatgctgctaatatggaacagcgtatccgtatgttgcagcagacgattgaacaggcattagttgagcagggtcgcatctctgagcgtgagggtgcgaagttcgaataaaacttcatggttgctatacttaagtaacggtgaggtaaattttctctgagatgtttgcatgtgggccagtcccctgagccgatatttcgaaaaaacagaatgtgacgctcgtaacctgtgtgcatgctcggttcgtccgagaagcctgatggttatgacggcatgttcaccttgaaccaagggttcaagggttacagcctacggcggcatctcggagatctctcttcctgtagtcctgcttttttcccctgactgacatgttatagtcgctcaacagcgacttatccggcggggaaatcatgtctgaaccttccatgtctgaaccttcaatgacccagcgtcaggcgattcgccagcatgtgcgacatctgcgacgggcacttaccgatgagcagcaaacgcaggccgctgagcagctcgccgaaacacgcgctcaactacgccccggtgactgaagcgcgcaatatcgccctgtttctgtcggtggatggcgaactcaatacccgtccgctgattgcccgcctctggcatctgaagaaaacggtctgtctgccggttttacaccccttctctcccggtaatttgttgtttctgcgctactcgcccgataccccattgctcaaaaataagctgcgcattcctgaaccgccgctggatatccggcaggtgatcacccttgatcaactggatctgatgatggtgccactggtagcgtttgatcagcatggacagcgtctggggatgggcggcggcttctacgatcgcaccctgcagaactggcggcaccacggttttttgccggtgggcctggcacacgattgtcagcaggtcgatagcctgccggtggcagaatgggatgtgcctttgccggcggtaatgacgccatcaaaactctggcagtgggagtagaagagtcgcttttgcagacaagtgaaaacccatacctgggcgcatctggcagcaatgaaatagcttaacgcgcagggaacatggtcagaagaggaaagcgtcccgccgcccggataaaaacgctgggagcgtttttaaacaacgcaacgcgttggcccggttacgggcgcacctcagggatgaggtgcgtaatcgcgcgggccgggcatgccatggatggcggcttttgcatctttccgatctgaccgtgttcccttcgcagtctcggtcttacagcaaatcgggacagcctgtattaactacctgaagagacgcgactaagcgcccgttcaggttggtagcgcttagtaaagcagacgggcgcgaatggtacccggaatcgccttcatcagttgcagcgcgttctcagccacttccggctctgcatcaatgtcgatcaccacatagcccataaacggcgaggtttgcagatactgggcggcgatgttgatgccctgctcggcaaaaatctggttgatggccgtcagcacgccagggcggttctcatggatatgcagcagacgactggcgctgataccgtgaatcggtagtgacacttcggggaagttaacagccgagagagtcgagccgttatcggagtatttcgccagcttgcccgccacttcaatgccgatgttctcctgcgcttcttccgtcgagccgccaatgtgcggcgtcaggatcacgttgtcgaactcactcagtggagagataaacggctcgctgttggtagctggctcgctcgggaagacgtcgatggctgcgccacccacatgcttgctggccagcgcatcgcacagcgccgggatatccaccaccgtgccgcgtgaggcgttaatcagcagcgcgccaggcttcatctgcgccagctgctctgcaccaatcatatcctgtgtagagacggtttccggcacgtgcaggctgacaacgtcgctcatgttgaggagatcggccagatggcgtacctgcgtggcattacccagcggcagcttgttttcaatgtcgtagaagaaaacatgcatacccaggctttctgccagcacgcccagctgcattccgatgtggccgtaaccgataatacccagttttttgccacgcgcttcaaatgagcctttggcaatcttattccagatgccacggtgtgctttcgcattcgcttccgggatgccacgcagcatcagcagcatctcaccaatcaccagctccgcaaccgagcgggtatttgagaacggcgcattgaacacgggaataccccggctggcagccgcctgcagatcaacctggttggtgccgatacagaaacagccaacggcgaccagcttttcagccgccgcaaaaatctcttcagtgagctgggagcgggaacggataccaataaagtgtgcatcacggatcgatgcttttaacgcgtcggaatccagtgcgcccttatggaattcgatgttggtatagcctgcagcccgcaggtttctccagcgcgctctgatggacaccttccaccagcaggaacttaatcttatctttttccagtgatacctttgccatttcccgatcctattcagcattcaatgaggactaccataagccagccttctgtcaaaatatcaaaaaaatcgcgtcgggcaatacaaacgattgcccagccgccagcacggcagcggctgacggcagcacattgccggacaaaataaggaggtcggactggaagagagaacgaacccactgccgatgacggttatgtgacataagtcaccaaatttcaccgcagcgagaaaagatgatttgcaggcagaaataaccgacgccgcatcgacgccggacagatcattttttgatggttttcacgccatcaggcccgccaatcagtgcaatatcggcaccacgcgcggcaaaaaggcccacggtaacgacgccaggcaaggcgttgatggttttttccagctcaatgggatcgagaatgcgcagattatgcacatcgagaataatgttgccgttatcggtgaccacgttctgacgatactcaggcaaaccgcccattttcaccagctgacgcgccacataactgcgcgccatcgggatcacctcgaccggcagcgggaaacggcccagcacatcgacctcttttgaagcgtcagcgatacagataaaggtttcagccacggcggccacgatcttttcgcgcgtcagcgccgcgccgccgcctttgatcatctgcatctgtgggttgatctcatccgcgccatctacgtacaccgacagcaggtcaatctcgttcaggtcgaacacctgaatacccaggctcttcagcttctgggttgaggcatccgagctggagacggcaccttcaatctgatgcctgaccgtggcaagcgcatcgataaagtgggcagcggtggatccggtgcccacaccaacaacggtgcccggctgcacgtactcaagtgcagcccagccaacggcttttttcagttcatcctgggtcatggtatgtttaaaacctgtgcgacaacgaagtgcgcgtagtataaaacaaggcttgctgaaaatgctcggctgaccgacgtggatttatcgctttggaagccagcccacaaaaaacaagagagccatcacaggtgatacttttgtggcatagtgacatccatcctgaaggagagagaagaataatgaaacgcccggattatcgaacgcttcaggcgctggattcagtgatccgcgaacgcggatttgagcgtgccgctcaaaaattatgtatcacccagtcagcggtttcacagcgtatcaagcagctggagaatctgtttggtcagccgctgctggtgcgaaccgtgccaccacgtccgaccgaaacagggtcagaaactgctggcgttgctgcaccaggtggaactgctggaagaggagtggctgggcgatgagaacagtggcaccacgccactgctgctgtcgctggcggtcaatgccgacagtctggcgacctggctgctgcctgcgctgaaagatgtgctggcagattcccctgtacgcctgaatctgcaggtcgaagatgaaacccgcacccaggagcgtctgcgtcgtggtgaagtggtgggtgcggtgagtattcagccgcagccgctgcccagttgcctggtggatcagctcggtgcgctcgactacctgtttgtggcgtcgcgtgactttgccgatcgcttcttccccaacggcgtcacccgctctgccctgctgaaagcgcctgcggtggcgtttgaccatcttgatgatatgcatcaggccttcctgcaacagaactttgatctctcaccgggcagtgtgccctgccacatcgtgaactcctctgaagcctttgtgcagatggcgcgacagggttcgacctgctgtatgatcccgcatctgcagattgagcgtgagctggcgagcggtgagttaatagatctgacgccaggcttgtgtcagcgccggatgctctactggcatcgttttgcgccggaaagccggttaatgcgtcgggtgaccgatgcgctgattgcgcatggacatcgggtgctgcgtcaggatgacgtcgcagcctgaaaacaaaaacggggcgaaagccccgttttgactgctgacaaattatgccccgaacggctgtaaggatggattggctcagggaacaaggtcagatcggaaaggcgcttaagccaatccctggccgctcggcccgcgccgtccatggcgcgggacgctttcctcctctgaccatgttcccttcgctttgaatttattcattgcggtcaaatcctgagattcatcggcagtcttaacggggcatcagccccgttttgcactatggcgtattgggcttgatctcaaacaccacatcaacctgatcgtcaaagttaatgctctgctgatcgtaggtctcctgcgccgaggtatctgccgctgcagccgctttatacatacggttcatcggcatcggctgatagttagcgacctgataacgaatgctgtagatcgatcccagtttcgcgttaaagccttcagccagctgtgatgcctgctgcgtcgcatttttaatcgctgctttacgcgcctgctctttgtaactctccggatttgccacgcctaactcgacgctacgcacctcattcagaccggacttcagcgccccgtccagcagatcattcagcttgtccagctgacgcagggttacctgcacctgacgcaccgcacggtagcctttcaggacggatttaccctctttggtgtaatcgtactcaggctgggtgctcaggtttgccgcatcaatatctttcttctcaatgccgtttttctgcagaaaatcgaaatattgtgcaacccggctatccgcctgctttttcgcatctgcggcatcttttgacgacacgttcaccacgatagagagcgtggcgatatcgggacgggcatcgaccgttgccttgcctgaggtcaccacgtgtggcccgttcggtaactcatcagcgtgtacgccaggcaatgccccggcgctcatgattgcggccagagccaatgctttcagtttcatgaaagtcctccttgaaaaggtactatgacggcttccaaccggcgaagcccaacagcgcatcggtatgcgccatgctttgagtggtcattatggcaaaagttcggcctccgcgcggcaataaccgcatcggatcgatgttgggatcaaaatccggcaatgccctggcgcgccagttgcagggagataaaccacatcaccgcgcccaccagcaggttgatgatgcgctgggctttggcggtgcgcaggcgtggtgacagccaggcggccagcagcgccagaccaaagaaccacaggatcgacgcactaatggtgcccagcgcaaaccactgacgcgcggtggtggtcggcaactgaccgccaagactgcccagcaccacaaaggtatcgagatagacgtgcggattgagccaggtcactgccagcagcgtcgcgataatgcgtcccctgctctgctttaatggctcaccatccgccagatcggcgtcgccgcgaaaagcgctacgcagtgcgccccagccataccacaacagaaaggctacgcccgcccaggtgatcaccatcagcagcagtggagactggctcagcaaggcgctgccgccaaagatcccaccgcaaatcagcagaatatcgctcagcgagcagagggccgccgtcatcagatgatattgacgctttacgccctgattcatcacaaaagcgttctgcgggcccagcggcaggatcagcgcggcgcccagggcaagcccctgaaaatagagagataacacaggattatttcctcacatcgttagaggaggagaagtataaagagagaggatgattagcggaaattgaaagaattaatctgcgattagcaaaatgaatgggcgacagacgccgcccactgaaaaattactgtggctgaacctgggttgcttctgcttcaggcgtcggcttctgatgcagatgcacatccatctgcggataaggaataccaatcccttttccatccagcgcacgcttaaagttcttcagcagatcccagtaaacgtcctgcaggtcgccgctgttgctccagcaacgcaccacaaagttcatagaggaggctgccagttcgttaagaccgatctggatacctttatctttcagcacgcggctatccgcttcaacaacctgttgcagtaaggcgatcacttcatccacatccgcctcgtaagccacgccaatgataaattcattacggcgaaccggttcacgcgagaagttgacgatgttcccgctgatgatcttgccgtttggcaccaccacgattttgccgtctgccgtttctcagcgtggtggagaaaatctgcacatgcagcacggttcccataacgccgcccagatcgacgaactcgccggtgcgaaacggacggaaggtgaccagcagaacacctgcagcaaggttagagagtgacccctgcagcgccagacccacggccagacccgcagcacccagcacggcaatcaccgaggcggtctgcacaccgatgcgtcccagcgctgcgataacggtgaaggcgataaccccatagcgcaccaatgcggagaggaagtccgccacggtagcgtctatgtgacgggcgcgcagcaggcgatttacggcattagaaatgatacgggcgataatcatcccgataataatgatggcaatagctgcaacgatatttacggcatagctgatgatcagcgcctgattgcgaaccagccagttacctgcgttgtttaagccgtcgacgacgtgtaactcttccattaataagccctgttgttagattcccaccgggaatgaaaaaactgccagatgacatccgacaccctgccatcaagggtaatcaattatccccttaagcgccaaaccgaccggcgtttaaccctgtttttccagaaattgtgcataaaaaaaggccctttcgggccttttttgtacggtaacgactcttcagttacagcacgtcgacagcgttaagctctttgaaagcctgctccagacgcactaccatagaggcctgggctgaacgcagccagacgcgtgggtcgtagtattttttgtttggcttgtcagcgccttccgggttacccagctgcgactgcagatagccctcgttctttttgtagtactgcaggatgccgtcccaggttgcccattgggtatcggtatcgatgttcatcttgatcacgccgtagctgatagactcttcgatttctgcagcagaagaacctgaaccgccgtggaaaacgaagtccagcgcgttgtgcggcaggccatgtttttcacacacatatttctgcgaatcgcgcagaatggtcggagtcagtttcacgttacctggcttgtaaacgccgtgaacgttaccgaatgatgccgcaatagtgaagcgcgggctgatagcattcagtttttcgtacgcgtagttcacatcttctggctgggtgtacagtgcagatgcgtccatgtggctgttatcaacgccatcttcttcaccaccggtgcagcccagttcgatttccagcgtcatgtcgagtttcgccatgcgcgccagatatttgctgctgatctcgatgttctcttccagtgactcttctgacaggtcgatcatgtgagaagagaagagtggcttaccgtttttctggaagtactcttcacctgcgtccagcagaccgtcgatccatggcagcagtttcttggcacagtggtcagtgtgcaggataaccggcacgccatactgctcagccatcaggtgaacatggtgtgcacccgcgatagcgccgaaaattgccgcgccctgtggtttgtcagtcttgaagcctttacccgcgataaatgcagcaccgccgttagagaactggatgatgattggcgctttaactttcgccgctgcttccagtgccgcattgatggagtcggtgccgacgcagtttacggctggcagtgcgaatttgttctctttcgcaactttgaagatcttctgtacgtcatcaccagtgacaacgccgggttttacgaaatcaaaaattttagacatgattgtgtcctgtttcgtgaccgttgttccccttgaggaaacgtcgatttaaacgcccagacgggcaagacttcaggcgatgccgccaggcatcgcccccaaaggattactgcttcgcacgctcttccagcatggcaactgcaggcagttttttgccttccacgaactcaaggaacgcgccgccgccggtagagatgtaggaaattttgtcttcgatgccgaacaggtcgatagccgctaaggtatcgccgccgcctgcaacagagaaggcatcgctgtctgcaatggcgttagccacgatctcggtgcctttacggaaattagggaactcaaacacgcctaccgggccattccacaggatggttttggcatccttcaggatggcagccatcgcctgtgcggtttcatcaccaaagtccataatctcttcgttatccgcaacttccgaaacctttttcacggtagcggtagcagtttcagagaattctgtgccaacgcgtgaatcagttggaaccggaataccgtgctgatcgcgcaggcctttagccgcttcaacgaagtctggctcatacagggatttgccgacgttgttgtcgatagcgacgaaggtgttggcaatgccgccgcccacaatcacggtgtccgcgattttgaccagagattgcagcacatcaaatttggtagagactttagaaccccctaccacagccaccagcggacgctccgggttgctcatgactttacccagcgcttccagtttctgcagagagcagcgggccagcacaggcgataggggcaaatttaccgacgccgtgggtagaagcctgtgcgcggtgcgcggtaccaaaggcgtccatcacaaagacgtcgcacagagcagcatattttttagacagtgcttcgtcatctttcttttcgcctttgttaaagcgaacgttttccagcacaaccagttcgccagcgccgacttcaacgccatcgaggtaatcttttgccagggtcacggtggtgccgctaagcttgtctttcaggtagttaactaccggcagcagcgagaactcttcattgtattcaccttcggtcggacgacccaggtgagaggtaaccattactttcgcgccctgtttcaacgccgcttcaatggttggcagagaagcacggatacgtgcatcagacgtcactttaccttctttaaccggtacgttcagatcggcacggatcagaacgcgtttaccagccagatccagatcggtcatcttaattacagacatggtgaatcctctcgttgattctcataagttttgccagacgcataccgcgtcttacctgaaaccgcttgcggccatcgctaacgtcgtgtcgagcattcggttagcaaagccccattcgttgtcacaccagaccagggtcttgataaggtgttgaccgctgacccgcgtttgtgttccgtccacaatggcactgtgcggatcatggttaaaatctactgagactaacggtaattccgtatagtcaactataccacgaaatgtcccttctgccgcgcttcgcaacagggtgttaacttcacacgccgtcaccgcctgatgcacagaaacgctgagatcaatggccgtcacgttaatcgtcggaacgcgaacggctatcgcctcgaagcgatcgttgaatttcggaaaaatacgggtaatgcctgccgccaggcgagtgtccaccgggatgatcgactgactggctgcacgcgtacggcgcagatcgctgtgataggcgtcgatcacctgctgatcgtgcatcgccgagtggatcgtggtgacggtgccggattcgataccaaacgcatcatccagcagtttaatcaccgggataatgcagttagtggtacaggaagcgttggagacgatgcggtcactggcggtgagtaactgctggttaacgccatacaccactgtggcgtcgagatcgtttccgccgggatgagagaacagcacttttttggcgccagcctgaagatgcgcttcgccatcagcgcgtgagccatagacgccggtgcagtccagcaccacatccacgtcgagttcacgccacggcagatcggcaatggctgcacggtgcaaaatgcgcagggtatcgccacccacccacattacatcgcgctcctggcggacatcgaaagcaaaacggccatggctggtatcgtatttcagcagatgcgccataccggtagcttctgccagctcgttaatcgcgaccacggtgatctctgcacgtcggcccgtttcatacagcgcgcgcaggacgttgcgtccaatccggccaaaaccatttatcgctacccgtaccgtcatttctctcctgccacgtcagactgaaaaaaacgtgccgttagcctgagcgtttcactgcattttgtacaggagattcttacccggcattgtccgaaaccagggcgatttgcctggcgactgaaacggttcagctacaataatagaaggaaggaataacaggaatgattgtgatcaatctgactgcttaaatttggatctgcgtcacaaattaaggcaaaaggcggttattactgcaggaataaaaaaataaaagggacgaaaatctcgtccctctgtttttacagccgggcggaaacaggcccgcctgaccggttttacgccagcagcgctttcgctttcgcgacgacgttgtcgacggtaaagccaaacagttcgaacagctgatcggcaggtgcagattcgccgaagctggtcatgcccacgatagcgccgttcaggccggtgtatttgaaccagtaatcagcgatgcccgcttcgattgcgacgcgtgcgctgaccgcttttggcagtacggattcacggtactcatcactctgcttgtcgaaggcatccgttgatggcatagagaccacgcgcactttgcggccttcgctggtgagtttgtcccaggcaccgacagccagttcaacttcggaaccggtggcgatcaggatcagctcaggcgtgccatcgcaatctttcagcacgtaaccgccgcgcgctacgttagccagctgagcagtgtcacgctcctgctgcgccaggttctgacgggagaagatcagcgcagtcgggccatctttacgctcaatggcatatttccacgccaccgcggattcaacctggtcacatggacgccacaggctcatgtttggcgtggtgcgcaggctcgccatctgttcaaccggctggtgcgtcgggccatcttcgcccagaccgatagagtcgtgggtgtagaccatgatctgacggatcttcatcagtgccgccatacgcgctgcgttacgcgcatattcaacaaacatcaggaaggtcgcggtgtaaggcaggaagccgccgtgcagcgccaggccattggcgattgcggtcataccgaactcacgcacgccgtagtggatgtagttacccgcagcatcttcgttgatcggcttagagccagaccagattgtcaggttgctgggtgccagatcggctgagccgcccaggtattccggcagaattttaccgaaagcttcaatagcattctgtgaggctttacggctggcgatcttcgccgggttcgcctgcagctgctcaacgaacttctgcgactcttcctgccagttagctggcagtttcgttgctgacgcggcgtttaaactcggcagccagttcaggatgagcctgtgcgtaagcggcgaatttctcattccatgcagactctttcgcctggcccgcttctttcgcgtcccactcagcgtagatatcagaaggaataacgaacggcgcgtggttccagcccagctgcttgcgggtcagtgccacttcatcatcacccagcggtgcgccgtgtgaatcatgggtaccggctttgttcggtgaaccaaaaccgataacggttttgcacatcagcagtgaaggcttgtcgctgacgcttttcgcttcttcgatcgctttcgcaatcgcatccgcatcgtgaccatcgacgccgcgcaccacgtgccagccataagcttcaaagcgcttagcggtgtcgtcggtgaaccagccatcaatgtgaccatcgatagagataccgttgtcatcataaaacgccaccagtttgcccagcttcagcgtaccggccagtgagcagacttcgtgcgagataccttccatcatgcagccatcacccatgaagacataggtgttgtggtctacgatgtcatgacccggacggttgaactgtgctgccagcgtgcgctcagcaatggcaaaacctactgcgttagcgatgccctgccccagcggaccggtagtggtttcaacgcccacggtgtagccatattccgggtgacctggagtttttgagtgcagctgacggaagttttccagttcgctcaggggcagatcgtagccggtcaggtgcaacaggctatagatcagcattgagccgtgaccgttagagagcacgaaacggtcgcggtcagcccacagcgggttggttgggttgtggttcaggtagccgcgccagagtacttcagcgatgtccgccatgcccattggggcacccggatgtcccgatttcgctttctgtactgcatccatacttaacgcacgaatggcgttggcaagctctttacgagagggcattttctactccaggtcggattaatgcttcgcaccttaacttattgttattaatgagttaccgggcaaaacaaggaaaaagttgcccatcaatgtacatgagaaacggggcaaaagtacatgctgtaaaacgctaaatgcagccgcttcgtatggcttttccagccatatctgctagcaaagtgcagactggcacgctataaccaaatcgtttattcacctgtctgagtttcaggtgtttgtttttcttaccttgttatgaatgggatacagcatgaaaatcaaaaaaatggtgttagcgcttggactgaccacgctgctcagtggctgtcagggtttagacaacaatgcgctgatgcagtcgggcgcgcaggcgtatcaggcttataccctcagcgacgatcaggtaaagcagctgagcgataaatcctgtgagcagatggacaaagataatcagattgcgcctgctaacagtgattatcagcagcgtctgaacaagatcgcggcggcgctgggcgataacatcaacggcgtaccggctaactacaaggtttatcagaccaaagatgtcaacgcctgggcgatggcaaacggctgtattcgtgtttacagcggtctgatggatatgatgactgacaatgaagtggaaggcgtactgggtcatgagatgggccacgtcgcgttaggtcatacgcgcaaggcgatgcaactggcatatgccacaactgcggcccgcaccgcagccgcctcggttggcggcgtgattggttcactgtcgcagtcgcagctgggtgaaatgggtgaaaaactggtgaatgcgcaattctcccagacgcaggaatcacaggcggatgactactcctacgacctgatgaagaagcgcaatatcgatccaatgggcctggccaccagctttgaaaagctggcgaagatggaacagggacgtcagagttcgatgtttgactcgcatcccgcctctgaagcgcgcgccgcgcatattcgtgagcgaattgctgccgacagcaagtaattccgcctctgagcgcgcatgcatccggcgtgcgcgcttagccgtgcgaagtccgctagcgcttaaatatctgatccaccatcgagcccagatccagcttattgtcatgcagcgcctgttcatccatgtgtccctgcggcgacattttatcaatcagctgcggcaatagcgcggccagcgtacccgatgcacctttcacatcggtgccgagtttgtcggccagtgactgcagttcatcctgaccaaaagcagactgaatctcactgtggccaaccggatggttatcgccggtgccgatccaggaaccaaacacctcacccagcccgccctgctggaatttttgcagcagcacttcaataccgccctgctcctgcacccaatgccagacagcctgtaactgtcccggcggatgcccttcactctggttgccatccagtgcgccagccagttcatcaagaaagcccatgattatctccactacgccatttttacgctgtaagtttagttgcagataggagttcgcgcctgacggttacccgtcggggtcagaagggaatcgatcggatcatggcaaagagaggaagatcacagcagcggcgtccgcccgatggacaggacgccgcgttcagcgcctgccggactgaagccggcaggcagcaggcatcagcctttgtttacagcctgaacatgcagcatatccagcgccagcgtagccgctgccagtgccgtcagatcagcatgatcgtaacccggtgcgacttccaccagatccatgccgacaatgttcatgccctgcaggccacggatcagcttggtcgctttatcggtggtcaggccgccaatcaccggcgtgccggtgccaggcgcatgcgccggatccagacagtcgatatcgaaggtcagatagaccggcagatcgccgacggtgcgtttcacttcggcgaggatatcgtcaacgctgcggtcgttgacctgcgccgcatccagcacgttgaagcccaggctcttgtcgaattcggtgcggataccaatctgcactgagtgctgcggatcgatcagaccctctttcggcgcggtaaagaacatggtgccgtggtcaaaggtcgggccgttggagtaggtgtcggtatgcgcatcaaagtgcaccagcgccatcttgccaaagtgttttgcatgggcgcgtagcagcggcagtgtgacatagtggtcgccgccaaaggtcatcatgcgcttgccattggccagcagtttttcagcatgggcctgcaatttgtcggagagatcctgcgaatcaccgaaggcgtaaaccagatcgccgcaatcgacgacgttcagacgctgacgcaggtcgaaatcccacggccagcggcagccttcccaggccagattggtggagatctggcgaatcgcacccggacccaggcggctgcccggacgacccgaggtcgcggcatcaaacggcacgccggtgataacccactcggcgtcgctgtcgtaaggctgaaaattcagcggaaaacgcatgaaaccaaaggcgttagaaaccagggagttgtcgtactgattgccaagcgtgttatacataattgctctctctatgtgcgtaagtcgggccagcccgcaaaccattaaggttgagatgaaaaaaatcccctccgcgtcgttaggcccgacgaggaagggattgagtgagtcagattatcgacatagttaacggcaactgcaatatgcgattaccggtcgccaggatcgattattcatcttctaaataggtatagccgtagaggccgctctcgaactcttcgaggaactgcgcgcgcagctcttcgtcgagatcggatgcctgaacctgattgcggaacagcgccatcagctcgttgggatcaagctgcacgtaacgcagcatgtccgccacggtgtcgccttcatcggagagctgcacttccacatcgccattttcgcgtgcgtagacatccaccgcttcggtgtcaccaaacaggttatgcatgttgcccagaatttcctgataagcgcccaccataaagaagcctagcattggcgggttatcaaggtcatattccggcatcggcatggtcgtcgcgataccgtcgccatccacgtagtgatcgatggtgccatcggagtcacaggtgatgtcgagcagcacggcacggcgctccggcttcttgttcagcccttccagcggcagtaccgggaacagctgatcgataccccacgcatccggcattgactggaacagcgagaagttaacgtaaatcttatccgccatccgctcctgcagttcgtcgatgattggacggtgtgcacggttgctcggatcgagatgctgctgaatatagtggcagatgctcagatagagctgctcagcccatgaacgctgcttgagatcgtaggtgcctgacgagtagccggtatggatatcaaacagatccatctggctgtcatgcagccattcacgcagcgaacggcgggtacttggctcgtgcatctcctgccaggtttcccacatgctgaggatcgggcgcggcgcatccgcatccggcgtttcaggttcgctgaactcgttgcgctccaccccaatgatgttggagaccagcaccgtgtggtgcgcggttaccgcacggcccgactcggtgatcaccgtcggatgctccagaccgtgctcatcacaggcagcaccaatcgcccagattacgttgttggcatactcattcaggccgtagttgaccgagcagtcagactgcgagcgcgttccttcgtaatcgacgcccagaccgccgccgacgtcgaaacatttgatgttgacgcccagcttggccagttcgacatagaagcgcgccgactcacgcacgccggtagcgatgtcgcggatgttggacatctgcgagcccagatggaaatgcagcagctgcaggctgtcgatgcgacccgcttcgcgcatgatctcaaccagtttcagcacctgggtggctgacaggccaaacttcgacttttcgccgccgctcgactgccatttaccggagccctgcgaagccagacgcgcacggataccaagacgcggcaccacattcagacgctctgcttcttccagtaccagccgcacttcggtcatcttctccagcaccagatagaccttatggcccatcttctcgccgatcagcgccagacgaatatattcgcgatctttatagccgttacagacgatcactgaacgggtctgaccggcgtgcgccagcaccgccatcagctcggcttttgagcccgcttccagtcccagcggttcgccggagtggatcagtgactcaatcacgcgtttgtgctggttaactttaatcgggtaaaccaggaagtagtcgcctttgtaaccgtaagattcacgcgcacgtttaaaggcggcgttaatggaacgcagacggtgttgcaggatctgcgggaagcagaataaagcaggcagacgctggccctgcgcttcgcgctctttgaccagacgagctaaatcgacgcgcacgtcaggacgatccggatcgggacagacactgatgtggcccagttcgttaacgtcgtaatagttgttgccccaccaggcgatgttgtacgtacgcaacattttgctcgcatcctgatcgttcattgcaacctcctgcatggagcggagtgtaccctgttcgccagctgacgaacctttgatattcttcatgtcgtcagacatcgcgaacctcaattttccgttgaaagatgaaactgttaaccggctttatggccgctaatctgaaaacctgttgccacattaaacgcaatgtcctgttcacctgacgttgccgtcagcgcgattcacgcatgagagttaagtgtaaaacacccgggccatctccgtttaaacagagaacatttaactgatctgtattgaccatggataacctgcgtcgtttccgctgcgcgtgcgcagagaagagacaaaaccgatcgagcagagataaagattagcctgcgcctgtgtcggtaaaattaccgcatcggacatcgcgtcggcaggaaagagaaacagatgggaggcaggagagagccagcgcagcgccgcagcgcagagaaccggaagaagaaaaagcgtggttcattacttgtatcacctccgcatatgccaggggcacatggaaaacaacctgggtgaaagccagaccagagtctgacaggcgcgacgcaaacagtggcgtcatccttgctgctgctatcaaagcagcggcgttttatacagtttacagccgtaaaatgcaaaaatattatcggggaattgcgtgtagcgtcagcaaattatgccgataacagagacaggttaaatgctgaaacagaaaaagggctggtaattggtttaccctctatcctaaaatagccgtccagatggttttccatctaaacaggttactatccaggcggtgttggcctgctgtgctgacacaacctcactgctcgcggctttgcctgaaggggcgtcaggtcagaccacctcactggcgctatgcagtcgtactcaaaccatatttaaggtaaagaacagaatggctaaacacctttttacgtccgagtctgtatcagaaggacatcccgataaaatcgccgaccagatctccgatgctgtgctggatgcgatccttgaacaggatcctaaagcgcgcgtggcctgcgaaacctacgttaaaaccggtatggtgctggttggcggtgaaatcaccaccagcgcctgggttgatatcgaagagatcacccgtaaaaccgtacgtgaaatcggctatgtccattccgatatgggctttgacgccaactcctgcgcggtattaagcgcgattggtaaacagtctcaggatatcaatcagggcgttgaccgtaccgatccgctggaacagggcgcgggcgaccagggcctgatgttcggctatgccaccaacgaaacagacgtgctgatgcctgcgccggtgacctatgcgcaccgtctggtacagcgtcaggctgaagtgcgtaaaaacggcaccctgccgtggctgcgtccggatgccaagagccaggtcactttccagtatgacgatggcaaaatcgtgggcatcgatgcagttgtgctctctacccagcacgctgaatccatcagccagaaagatctgcaggaagcggtgatggaagagatcatcaagccggttctgcccgcagagtggctgagcgcctcgaccaaatatcacatcaacccaaccggtcgctttgtgatcggcggcccgatgggcgattgcggtctgaccggtcgtaaaatcatcgtagacacctacggcggcatggcgcgtcatggtggcggtgcgtttctcgggtaaagatccatctaaagttgaccgctctgcagcctatgcggcacgttacgtggcgaaaaacatcgtagcggccggcctggctgaccgttgtgaaatccaggtctcctacgctatcggcgtggctgaacccacttctatcatggtggaaaccttcggtaccgagaaaatctctaccgaacagctgacgctactggtgcgcgagttcttcgacctgcgtccatatggtctgatccagatgctggatctgctgcacccaatctataaagagaccgcagcttacggccactttggtcgtgaacatttcccatgggaaaaaaccgacaaagctgccctgctgcgtgaagcggctggcctgtaaggttaccgactgcagataaaaaccctgccactgcggcagggttttttattgccttttcagccccattgctaaccggagcaattttgctcccgctacccttctgaacgaacaggccagcgcaatttctggtgagcgcgtgacgacaaaaaaacgcatctgcccgacatcttcttctctctgcagcaaattttcagttctcagctacacttcttttcgctttttctgacgactaaatgttaacgattacaaattgaaatgctttgtttatccgatatttaggaattaacgcacgtagttattctgctgaaaatgcgttattttcagcgtcgtctgatagccagtaaatagagcattgtcagaaacttaatgagtgctatacctcactggttaattaatctttccgggaaaaatatgctgaatttcagggtttcagcgtgtgtaagcgattacactgatgtgatcaggctcacttttttcccgcaaaaggttttttaacattgataaaaacaatgatggataaacctggaggctaaaatgcctggcaatacacacaaaagcagaacttcaaataaggcgatgaccttatttgtctgctttctggcggcccttgcgggtctgctgttcggtctggatatcggcgttatcgccggtgctctgccgtttatcgcaaaggactttaacgtcacccctcatcagcaggagtggatcgtcagttccatgatgtttggtgcggcggtcggtgctatcggcagcggctggatgtcatcccgcctgggccgtaaaaaaagcctgatggccggtgcgattctgttcgttatcggttcactctggtcggcgatgtcgccaaacccggaaatgctgatcagcgcccgcgtttctgctgggtctggcagtcggtatcgcctcttataccgccccgctttatctttctgagatcgctccggaaaaaattcgcggcagtatgatttcgctttatcagctgatgatcaccatcggtattcttggtgcttacctgtccgatacggcgttcagctttaccggcaactggcgctggatgctgggcatcatcactattccggcactgttgctgctggtcggcgttttcttcctgccaaacagcccacgctggctggcggcgcgaggcaacttccgcgatgcacaacgcgtactggatcgtctgcgtgacaccagcgagcaggcaaaacgtgagctggaagagatccgtgaaagcctgaagatcaaacagtctggctggggtctgttcaccagcagcagccacttccgtcgtgcggtctatctcggcatcctgctgcaggtgatgcagcagtttaccggcatgaacgtcatcatgtactacgcgccaaaaatctttgaaatcgcgggcttcaccaataccacccagcagatgtggggcacggtgattgtgggtctggttaacgtactggcgacctttattgccattggtctggtggatcgctggggtcgtaaacctaccctgattctgggctttatggtgatggcagccggtatgggcgttctgggtacgatgctgcacttcggcattcactcgccgggcgcgcagtactttgcggtaggtatgctgctgatgttcatcatcggttttgcgatgtcagccggtccgttgatctgggtactctgttccgaaattcagccgctgaaaggccgcgatttcggtatcactgtctccaccaccaccaactggatcgcgaacatgatcgtaggtgcgaccttcctgacgatgctgaatacgctgggcaatgcgaacaccttctgggtctacgcactgcttaacctgttcttcattctgctgacggtgatgctgatccctgagaccaaaaacgtctcgctggaacacatcgaacgtaacctgatggcaggtaaaaaactgcgcgacatcggttcacgcgactaactttacccggtaaaaaacgcggtaaaaaaaacggcggggtttccagagaaaccccgccgtttttatttgttcaacgccccactacgctgtggttacccgcgttacctgcaggggccgccgtatgcagcagagcgccagtgccataatgaaaatggtcgcggtctgattatagggcagcaccgaatcggtcagtccggtggtaaatagcgccaccatcggcagcgccacgccgcgcagatcacacttcttcatccagcccgccagcacagtcagatagagcagcgccagcgacgccgtacccagccagccctgcaatgacgtcacctcgaggaactcgttgtgcatgttgtatttaacgttggtgaagccttcaacattgagaggatagtgcgcagtgatgaactgacgcgcctcagtggttcgcgcatccagcgtcgcaaaaccgccatggtgctcaataaagttgaccgccccgccccagatggcgacacgtgcgcccagcgaggtcgaactgtttgaaccaaagttctcaatatcctgcactccctctacccagcggttgctggtcatcagaatcagcaccgccattacgcccaccagcagagcgctaatccgccagttagtcagcagcgacagccggtaggtctgcaccaggaacagcagccccactgcaatcagcgcaatcagagtcacacgggtgccgcacaggtagagcaaggcaaaggtcactgccagcacagcgatatcggccaccttccagtaagcgtgcgtctcatagcggcttagccagagccaggcacaatagataaacagaatcatgtaggaggacatggaggcggcttcggtggtgagcttgatgcggatattctcagtgtagagatgctcgtggataccaaagcccagcgtaatcagcaggccgataaggatgagcccttttccgacgcgtagcgtggtcagggagacccgatccccataaacagccagactgagcagcacaaaggcacccatcaacagccgcttcgcccccagcagatagttgcccatattagtgatggcatcgcttgagggcgcggtttcgatccccttcacgtgaatcgcccagaacagccgaatcagggcaaagataatcagcacagcaaacagggcgatataaaaaccgttctctttaaactccacccgcctgcgcaccaggccatacagcacggacgcgacagagagataagagaccagatagaatattttttgcggcaggccggtaacaaacatattcagcgacagcgccaggcagagcgcaataactgaaaaattaaccattaacgttaatccattgcgactgattttattcgtcatgcttaacctcagtaaggcggttaaacacactcatcaggtgcttcatataattttcctcataaaaaccggtgatgctcgctttaatagcctgatgatcggggaagtagaaatccccgctcatggcgttgagaatcgcggccagcgccatgctgtcatgggtgggatagagctgaccattaataccgtttctgaataatttccgccgggccgctgatacagtcggatgaaacacagtagacgccgcgtgacatcgcctcaagcaggatcaacgggaagccttcgaagttagaggtcatgaccaggcaggtgacctgtctgatatggcggatgacatactcccaggcattctcctgccagccatgccaggtgatgcgatcctggatgccgagttgcgtcacgtagtgctgacattgcgtcagatcttccccgtcacccactatctccagcgtccagggcgcatccagctgctgcagggcatcaaacagatctttaagctgtttctgccgctgataatggacgcgaccaatatagagaaacttcagcgcctggggtctgccgattaccgtgtcattgcgtttgatcgggttatagatcacgtcaacgtcagtggcgcgtgcgcccagttccaccagctgctctttaatctgattactgatcgcaaaatggtgatcggcccgcaacagataatggggacgataacgttcacgcggaggcaggtgcatccagctcgacaacacgattttacgtcctgaaagcgtgattgcccggcgcgtcatcaggcagggaatggtgttgagggtcaggacatgatcgggctgataaagacgaaagaaggcggccattctcagcgtatgaataagattttttattttcttattccgcagcgtgcagacgctctcagccagaacagcattggcggtccaggcgcgggagtggctctcctctccgctgttgataataaacagccctgcttcggtaccgggttccgcattcagggccttaatcaactgcccagtcacattttccatcccaccacgaccggccatcagatccgtcaccagcacaatccgttgtttcctgacgttatcattatttttcattggtttatccatgccctgtgccgttcgcttttcatccatccactctgcggtgaatctcattaatagaatattctaaaaaagcccataacaatatttaaaccagaaattttcccccagccagaaccacacttgtcgctggcgacgttgagttcctgcgcggcggcgattattctgagcgccatgaaaacgcctcgtctccccattgccctgcagcaggccgtaatgcgctcgctgcgccagtcgcttgaacgtgcgaatcaggcgctgaaaacccgttatccggaaccgaagctgctctaccagcagcgtggtacggcggcgggcaccgcctggctggcgtcctgggaaattcgcatcaatcctgtgctgctgctggaaaaccagcaggcatttatcgatgaagtggtgccgcatgagctggcgcatctgctggtctggaagcaatttggtcgcgttgcgccgcacggcaaagagtggaagtggatgatggagcaggtgctgggcgttccggcacggcgtactcaccagtttgagatcgcatccgtgcgcagcaacacctttgcttaccgctgtcagtgccagcagcatcagctgaccgtgcgccgccacaatcgtatactgcgcaaagagagtgaatatcgctgcgtgcactgtggcagcctgctgatcgcgggtgaatttgtcgcgtcctgagaagaatccccattccgccctattccacattctgttaccctgccgccctttttcgtactgagtagaaatctggaatatgtctcgcatactaagtctggcggttgcgctgctgtttgcgcccgccgctgacgccctcaacctgaataactatcatcaaaataactttcagcaggccaaaacctttgcggcggcgatcaacgccgatgcaccgggttctttttactgtggctgtaagattcagtggcagggaaaaaaggggattcccgatctcaacagctgtggctatcaggtgcgcaaaaacgccaatcgcgccgcacgcattgagtgggaacatgtgatgcccgcctgggagtttggccatcagcgtcagtgctggcaggatggcggtcgtaaaaactgcagcaaagatcccgactaccgccgcatcgaaaccgacctgcacaacctgcagcctgcggtgggtgaagtgaatggcgaccgtggcaacttcgcctacagtcaatggaacggcagcgagcaacagtacggccagtgtgagatgaagatcgactttaaactcaaacaggcggagccacctgcgcgggcgcgtggtgccattgcccgcacctatttctatatgcgcgaccagtatcatctgcgtatttcgcgccagcagacgcagctgtttaacgcctggaacaagctctatcccgtgacaatttgggagtgcgaacgcgaccagcgcattgcaaaggttcagggcaatcacaatccttatgtgcagcaggcttgccagcgctaaaatccctgccctacactagctctttttccaatgacgccgctgcagcgcggcgtccggtctcaggaaccttatgcgtatacctcgcatctatcacgccgggccattaagcatcggcagtgaaattaccctggatgaagatgcatccaatcatgtgggccgggtgctccggatgacggcaggtcagcgtctggaactctttgatggcactaatctgacttttgcagcagagatcacgcatgtagataaaaagcgtgtaaaagtatcggtcacagagagccagccggacgatcgcgagtcaccgttacatctgcatttaggtcaggtgatgtcgcgcggtgaaaaaatggaattcactatccagaaatcgatcgaactgggcgtgaatgtcattacacccttgttttccgagcgctgtggcgtaaagcttgatgctgagcgtctggcgaagaagatccagcagtggcagaaaattgctattgccgcctgcgagcagtgcggccgtaatcgcgtgccggagattcgtgaagcgatgacgctggaagcctggtgcgcagaagcagatagcggactgaagcttaacctgcatccgcgcgccagccacagcatcaacacgctgccccagcctgttgagcgggtaaggttgctgattggccctgaaggcggtttgtctgcggacgagattgcgatgacggcgcagcacgattttactgacattctgcttggcccacgggtattgcgtaccgaaactaccgcgctgacggccattacggcacttcaggtgaggtttggcgacctgggttaagcgatactttcagcggaaagagagcaggcatgatgtcctgaccgatcggcccactgcagaccgaaccagacgaggcggtaaatgccgcctcaccgaggagataataatgattaaacttggcatcgtgatggaccctatttcgtccatcaatattaaaaaagactccagcttcgctatgctgctggaagcacagcgccgtggttatgaaattcactacatggagatgcacgatctctcactgcgcggtggcgtggcctcggcccgcacccgcctgctgaccgtcgagcagaaccctgagaaactggtatcagttcggcagcgagcaggtgatcccgctggctgacctgaatgtggtgctgatgcgcaaagatccgccattcgataccgagttcatctatgcgacctacattctggagcgcgctgaagagctgggtacgctgatcgtgaacaaaccgcagagcctgcgtgactgtaacgaaaagctctacaccgcctggtttgccgagtttacgcctgacactctggtgacccgcagcaaagcgcaactgcgcgctttctggcaggagcatggcgacatcatcatgaagccgctggatggcatgggtggtgcgtcgattttccgcgtgaagaaagatgatcctaactttggcgtgattaccgaaaccctgaccgagcatgagagccgtttctgcatggcgcagaattatattgcggcgatcaccgagggtgacaaacgcgtgctggtcgtcgatggcgagccggtgccttactgcctggcgcgtatccctcagggcggtgaaacgcgtggtaacctcgccgccggtggtcgcggtgaagcgcgtccgctgagcgaaagcgactgggaaatcgcgcgccgtgttggtccgacgctgaaagcaaaagggctgatttttgtcggtctggacatcatcggtgataaactgactgaagttaacgtgaccagcccaacctgcattcgtgaaattgaggctgcgttcccgatctccatcaccggcatgttgatggatgccattgagaagcgcctgggctgagcatgacgccggggcgaagctccgtgatcaacccaataccggtgcggccgtcgcgtgccggttatttttttggtacatcgtgtgagaatgaatttacaacatcactttttgattgccatgccttcattgcaggatcctttcttcaaacgttccgtagtctatctctgcgaacataacgaagagggtgcaatgggactgatcatcaataaacccatggaaaacctgacggttgaaggcattctgaagaagcttaaaatctctgctgacgatcgcgatccggcgatcaagctggataaaccggtgtttaccggcggtccgctggcggaagatcgtggctttatcctgcactccgcgcaacgcacctttacctccagtattcgtgtttcagataacacgatcatcaccacgtcccgtgacgtgctggagtcgatcggtacggcgtctcagcccactaacgtgctggtagcgctgggttactgcgcctgggaaaaagatcagctggagaatgagctgatggaaaatgcctggctgaccacgcccgctaacagcaacatcctgttccagacgccgatttcagagcgctggcgcgaagcggcgcgcagtattggcgtcgatattcacaacatggccagcgacgccggacacgcctgatgtcaactcaaactctgttaggattcgacttcggcaccaaaagtattggtgtcgccgtaggtcagcaactcactggcagcgcccgtccgctgaccgccctgaaagcgcaggatggcatcccggactggctggtaattgaaaaactgctgaaagagtggcagcccgattttgtggtggtgggattaccgctgaatatggatggcaccgagcagccgctgaccgatcgcgcacgtaaatttgccaaccgcctgcacgggcgctttggcatccgcgtggagctgcaggatgaacgactcagcacggtagaagcgcgtgctggcctgtttgaacgcggcggctatcgtgcgctcaataaaggatcggtcgactcacagtctgctgccatcattttgcaggactggttcgaaaaccattactgacatcctcactcaatcagtccggcagcctgacgcgccagcctgctctgctcaaacgtctgcataccggcctgtgcgccggtttgtaacagcgcagggatctggtgcatcttgccttctctgatcagattggtgatgcccggtgtggcgatcagtacctcaaacagtccgatgcgcgaaccggcaactgatggcaccagccgctgtgcaattaccgctttcaggctgcccgccagctgagtacgcaccagctgtttctcctctgccggaaagacatcaaccagccgatccaccgcctgcgctgcgccacgggtgtgcagcgtcgccagcaccagatggccggtctccgcagcagtcagcgcctgacgaatagtgtcgctgtcgcgcagtttcgcccagcaggatgacgtcgggatcttcacgcagtgctgcctttacccccagcgagaacgaaccgcagtgcaggccgatttcacgctgctgtatcagcgactgctggctgtgatggataaattcaatcggatcttccagcgtgatgatatgccgcgcctgctggcggttcagcgcatcgaccagcgccgccagcgtggttgatttaccgctgccggtcgcacccgtcaccagaatcagcccatcctgctgctccagcagcgtcgggacaatggcgggcagttgcaggctcgcaagcgtcgggcatgccgtggcgatgatgcgcagtgccagtgacaggccgttgcgctgcataaagagattggcgcgcagacgctgaccatcggccaggctcagagcgaaatcgagctgccctgcgcgctccagttcctgacgctgcgggtcacttagccagcgggccataaactgcgccatccatgcaccagaaagcgggcactgctgcggaatcgcctccagccttccctgccgccgccagtagggcaaatgtccgctgcaaaggtgcagatcggcggcattatgctttacactaagccccaccatttcatccagattcataatttctcctgactatgacctcaatccagcagaacctacagcaagtgcggcagcgaatcgctgctgctgccgcgagttgcggccgcgcaccagaagaaattaccctgcttgcagtcagtaaaaccaaacctgcgagcgcggtcgaagaagcctttgccgctggccagattgcctttggtgaaaattacgttcaggaaggggttgaaaaggtccaggcactggccgcacatcctgagctggagtggcacttcatcggcccgctgcagtccaataaaagccgtctggtggcggaacatttcgcctggtgtcacaccattgaccgccagcgcatcgcgcagcggctcaacgatcagcggcctgcttcgctgccaccgctgaatgtgttaattcaggtaaatatcagtgacgagaacagcaaatctggcatcatgctggaggccgtttccgggctggcggagcagatcgctgccctgccgcaactgcggctgcgcggattaatggcgattccggcagcagagagtgattacgcgcggcagctggcggtgtgtcagcagatggcggaagccttccggcagctgcaacagcactatccgcatgcagacacgctttcgctgggaatgagcgatgacatggaggcggcaatcgccgcaggcagtacgatggtgcgtatcggcaccgccatttttggcgcacgagattatgcgcacaactcacaacaataacagaggaacttcatgttaacactgacgtttttagtaaaaacgctgatcgatctctacgtcatggtgctgctgttacgcatctggatgcagtggtcccgctgcgatttttacaatccagtggcgcagtttgtcgtaaaagtgacacagccgattgttaagccgctgcgccgtatactgccggcactgggaccgatagataccgcctcgctgctgctggcatttgtgctgactacgctgaaatacccgattttattgctgattcaggtgggcgtcttctcggtcgacccaaccaatctgctggtcggcctgctgtcgctggttaaatccgccggctatctggtcttctgggtgattattattcgctccctgatgagctggatcagccagggccggggtcctgtcgactatctgctggtgcagttaaccgagccgatgatggcacctgttcgccgtattctgcctgcgatgggcggtatcgacttctcagcgatgatcgtcatcctggtgctgtatgccctgaactttctcggcatggacctgttcccgggtctctggtatctgctgtaaatgaatcaaactggaactgttatgcaaaaagttgtcctcgcaaccggcaatcccggcaaagtgcgtgaactggcggagttactctccgcctttggtctggatatcgtcgcacagaccgaccttggggttgaatcggcggaagagaccggcctgacctttattgagaacgcgattctcaaggcgcgtcacgcggcacagatcaccggattaccggccattgccgatgattccggcctggccgtagatgcgctgggcggcgcgcccggcatctactcggcgcgctacgccggtgaagaggccagcgatcaacagaacctggagaagctgctgcaggcgctggaaaacgtaccggacggtcagcgccaggcacaatttcactgcgtgctggtctatctgcgtcatgcggaagatccgaccccgctggtgttccatggcagctggcagggtgagatcacccgcgccgccgctggtgccggtggttttggttacgacccgattttctttgtcccggcactgggtaaaaccgcggccgaactgagtaaagcggaaaaaggtgcagtttctcaccggggtaaagcattgacgctgttgctggaagcgatgcgtaatgcctaatctgccgccgttaagtctctatatccacattccgtggtgcgtacagaaatgtccttactgtgattttaattcccacgcgctgaaagatgaggtgccgcacgttgaatacgtgcagcacctgctgcgcgatctggagatcgatttaccgctgatcaatggccgggaagtgcgcacgatcttcatcggtggcggcacgcccagcctgctgagcagcagcgcgatgcagatgctgatggatggtgtacgggagcgtctgacgctctcgcccgatgcggaagtgaccatggaagccaatccgggcaccgtggaagcggaccggttcagcgcctatcagcgcgccggtatcaaccgtatttcgattggcgtacagagtttcagtccgcaaaagctgcagcgtcttggccgcattcacggcccggaagaggcggtccgcgccgctgaaactggcagagtcgctctcgctgcgcagttttaaccttgacctgatgcatggcctgcccgatcagtcgctggaagaggcgctcgatgatttacgtcaggcgattgcgcttaatccaccgcatctctcctggtatcagctcacgattgaacccaacaccctgtttggctcacgcccgccggtgctgccggatgatgatgcgctatgggatattttcgaacagggcgatcagctgttgcaggctgccggttatcagcagtatgagacctctgcctacgcgaagccgggttatcgctgtgagcacaacctcaactactggcgctttggcgactatctggggattgggtgtggcgcacacggcaagctgacgcaaccggatggccgcatagtccgcacggtgaaaacccgtcatccgcgtggatttatgcaggggaactaccgcgaaaaacagtatgacgttgccgatagcgacaagccgtttgaatatttcatgaaccgctttcgcctgctggaagccgcgccgcgcgacgagttcagccgctataccggtttgtcagagcaggtgatccgtccgcagatggatgccgcgattgccgcgggttacgtgactgaaaccgcggagcagtggcagattacggagaaagggaagctgttcctgaattcgctgctggagctgttcttagcggaagagtaacaaaagcgcctcagcccgacaggctgaggcgttgacctattttttcagtgcgccggtaagctgtttacgctgatcttccagcgaaataacgcgattacacacctcgtgaccgaagttctggaaatcctgctcctgcttgctccactcagcctgaatcgactgctgcaaaccgcccagattacccataatcgcctgcagcggattactgccgccgctgccctgcttactgcccatctcgttcaggctatcctgcatcacgccgcccagtgtcgactgcaccagcctttcaccttcggcgcgaacctgatcaatcgcctgatggtggaacgtcagcccatcttcacggtgttcaatgatgcggttcatctgctgtttcagctgaccattcagcgtggtcaggcgattacgcacgttgctgtcggtgcccagtttttcaacgatgacctgatccagtgccgcacgccctttctccagacgtgatgtcgccccgctgtcgatccacggcagatcgcgacgcagcgcattctgatagtcgatcgctttctggcgtccggccgtatcgagcgtgaccttctgtccattgaactgcacgtcgccctgcggcgagatttccatattgccgttggcaccgaccacctgcacgctctgcggcttaatcaccacatcgtcctgcggcttaacgctgcattcataggctgcctgagcctgggttgctgccaccagcagcacagcaagaagcgctttacgcatcatatctactccctaagatcgggtctgaaaccctttgatcgggcctcagcccgacactgtgtgacgacttagtcccaccagacgtcaaagagttcagtcatctgaacgtcctgcagcttgcgatcttccagccatttacgaaccagagcacgatgctcatcggtgcatttgccggttttctgcaggcaaaccagaccttcccacaccaggtaaccgctgccatcgaaggccaggccgttagggtcgatcacttcattgatgaactggttcagcgtctcatcaatttcgctttcgctggtgccttccgggaagcgccaggcaaccgagaagcccagttcctgaaactcatcaatgtgcagttttttacgtaaacggcggctgcgttgtgtggccattatttcaccctctcaaacattaaatcccatacgccgtggcctaaacgctgcccgcgctgctcaaacttggtcagtggacgcgtctcaggacgcggcacataattctgttgttctgactggttgcggtaaccatcgatgctgttcatcacttccagcatatgctccgcgtaggcttcccagtcggtcgccatgtggaaaacgccgcccagcttcagtttacgcatcaccagctcggcaaaaggcacctggacaatacggcgtttattgtgacgcgctttatgccacggatcggggaagaagagctgaaccatgcgcagcgagttatccggaatcatcttctccagcacttccaccgcgtcatggcacatcacccgaaggtttctgcacatcggcttctttggcggcggccagacaggcacccacgcccggcgcatgcacttcaatacccaggaagttctgatgcggcgtgttctgcgccatcgttaccagcgaagcacccataccaaagccaatttccagcgtcaccggggcttcgcgaccaaacagcgcgggcagatcgacaggctccggctgatattccacccccatgaccggccacagggtgtccagcgcctgctgctggcctttggttaagcggccctggcggcgcacaaagctgcggatccggcgtaatggccgcccgttctcatcaaattctggggtgatgacgtcattaatcatgtaaaagcctgctggttagcctgttccgggaaacgggcattatgcaaagttcataagcagaagcaagcctttgcaatcttccggtttacacccaggtgcgcatgtgctggaattcctgcctgagtgtagagtaaacacggaaaatttccttcttatgatgcaagcgccgcagttcgcgcaacaggtgctggactggtatcagcgctttggtcgcaaaaccctgccgtggcagctggagaaaacgccttacaaggtgtggctctccgaagtgatgctacagcaaacccaggttgccacggttattccctattttgaacgctttatggcgcgcttccccacggtcaccgatctggctgcggctccgctggatgaggtgttacatctctggaccggcctcggctattacgcccgtgcgcgtaatctgcataaagccgcaaagcagattgtcgaggttcatcagggcgagttcccgcgtaatttcgatgatgtctctgccctgcccggcgtaggccgctccacggcgggcgcgatcctgtcgctgtcgctggggcagcatttcccgattctggatggcaacgtcaagcgcgtgctggcccgttgctatgctgtcagcggctggccgggtaagaaagaggtcgaaaagcggctctggcagatcagcgaagaggtcacacccgccgagggcgtcagccagtttaatcaggcgatgatggatctgggtgctatcgtctgtacccgatcgaagccgaagtgcgaaatctgcccgctgaacagcggttgtgaggcgtatgccagcagcagctgggcgagctatcccggtaagaagcctaagcaggtgctgccagagcgcagcggctggttcctgatgatgcaggatggtgatgatgtctggctggagcagcgcccgcctgtgggcttgtggggcggcctgttctgcttcccgcagttcacaacggaagcggcgatgacagactggctggcggcccgcggcatccatgcaaaaccgcagcagcttactgcgttccgtcacaccttcagccatttccatctcgatatcgtgccaatgtggctgacgtggccttctgtcggggcggcgatggatgaagcaggcggtctctggtataacttagcgctgccaccatctgtgggattagccgcacccgttgagcgcctgttacacgagctgcgccatccccgacaactggctttgaacagttgtgagattaatgaggaagaataatgagccgcactattttttgtacttttttacagcgcgacgcggaaggacaggattttcagctctacccgggcgatctgggtaagcgcatttacaacgacatttccaaagaagcctggcagaagtggatggcgaaacagaccatgttgatcaacgagaagaagctcaacatgatgaatcccgaagatcgtaaagtgctggagaaggagatgatcaatttcctgttcgaaggtaaagacgttcatatcgaaggctatacaccgccagaagcgtaaacattccgggcctcatcgctgaggccggttatccaggtcaggcttgcactcccaatgaataaaaaattaatcgccctgctggtgatagcaccacttttggtttcctgttccgggtcaaagaaacagcagtcccacgaggagtgggtaaaagataccaacgcctttgatattctgatggggcagtttgctcataatattgagaatatctggggtatcaatgaggtcctgatcgccggacccaaagattacgtcaaatatagcgacaactattacacccgcagccacattaactttgaaagcggtaagctgaccatcgagacgatttctggcaccgatcctatggccagcctgcgtcaggcaatcgtgaccaccctgttgattggcgaagatccgggtaatgtcgatctctactctgacgccaacgatattgaaatcagtaaagagccgctgctgtatgggcaggtgctggataataccggtcagccgattcgctggcagggtcgcgcggaagcctttgctgactatctgattcagaataaattgcagcgccgcacctcgggtctgcatgtgatttacaccatttcgattccgatggtgccgaaccacctggataagcgtgcgcacaaatacctgccgatggtgcgtaaagccgccgatcagtatggtgttgatgcctcgttgattctggcgattatgcagaccgagtcgagctttaacccctacgccgtgagccattctgatgcgctgggtctgatgcaggtggtgcagcatactgccggtgttgacgtgttccgcatgaagggtaaatggggcaagccgagccgcagctatctgcttgatccggagaacaatattgatgcgggtaccgcttatctgtcgctgttgcagcgtagctatctgggcggtattcaggatccggtgtcacgtcgttatgcggtgatcaccgcctataacggcggcgcaggcagcgtgctgcgcgtcttctccagcgataaagatcgggcgttttcgatgattaacggcatgtcaccgagcaaggtttattcgaccctggcgaaccagcatccgtcggcggagtcgcgtcgttatctttataaggtgagtaccgcgcagaagagttatcggggattctgattggctcagcgcttaagcgggggagtgttcgctgcgcgaaacgggcttgggtgcagcgcctgaagctgggattgttcgctgcgcgaacaggctatgagaaggtttcgttcgcttagccgcgggtatgcactgagcgggttccgcccgccaggcgatcaggagtgaagcgcctgaagctgggagtgttcgctgcgcgaacaggctatgagaaggtttcgttcgcttagccgcgggtatgcactgagagggttccgcccgccaggcgatcaggagtttcagatcgcccgagcaggcggacgtattaaggggcggacgcccgccccttaataatcccggcgtccggctgcctgcgcgccccgctgtgcggggtaccttcgtcacgccctgcagccgacggaccgtccggactcgccatccctggctcgtgccgtcctttcgccgacgtcctgtcggctcatcctggcctccggttgttcctcagcgcttcggacgcctctcccaaaccccccgcctgtaatatcttttatattctgggatgaagtgtcgtctgctggcctgaaagccaaagacaatctcgaaaatcttcagcgataagttactgaatcttttgagaagagataacagcagggggtttagggaggccgtcctttcgccgcgtcctgtcggctcatcctggcctccggttgttcctcagcgcttcggacgcctctcccaaaccctcgcctgtaattatcttttcatttcgctgttgccgtgctgtctgatggtctgatagcgaagaccatcccggaaacttacagcgacagcgaacctgccataaaaaagcagagataacagcgaggggggtaaggaggccgtcagaaccgctgagcggatgagggatttcaggacgagcgacagggatgtcgcgaagaggcgggttcgcgccatggatggcgcgtcccgccggtccgtgagaaatcctgaagtagcgaagggaccgcgaagcggcggtgaagcaggccggagcccggggtcaagggggcgcggcgactggcgcccccttgtcggtcgcctgcagaggcgaatctgaaactgcccggcttaccaggcgaacgaaaatctctcatagcccgttcgcgcagcgaacccagggcctgccaggcgaaaccttctcagccccgtttcgcgcagcgaacaaaaaggcaggcgggccgctacccgcctctgcccacgctcagatcagcgccccactatcatattcgccaccagatacttccgtccctggtcatcctcttcggtgtaaacgccctgcagctctggtgagaagccaggcagcagattaagcccctcttccagcgccagaaagtaacgctgcaccgcgccgccccagacttccccagggactacgcacagcacacccggtggataaggcagtgcaccttctgcggcaacccggccttgcgcttcggctatcggcaccagctccacttcgccgcgaatataagcctgatgcgcatcctgcggattcaccctgaccggcgggaactccgcggcgcggaacatcaggcgctgcagatccttgacgttgtgactgacgtaaaggtcgtgcatctcctgacagaggcgacgcagggtatacccggcatagcgttcggcatttttgcggtaaatggtcggcagcacttcggccagaggcgcatcctctttgacgtgctgctcgaactgcgccagcatcgccaccagattggccatcttctccggactctctgccggggtcagcaggaacaggattgagttgagatcgcacttctccggcacaatgccgttttcgcgcagatagttcgccagaatggtcgccggaatcccgaaatcactatactcaccgctggccgcatcaatccccggcgtggtcagcagcagcttgcagggatccacccgatactgatcgcgcgcatagcccgcgaaaccgtgccacttcgcctgcggttcaaagctgaagtagcgcagatcgcgggcgatcgtctcagtgggcgcatcctgccagcgctggccatctaccgtctccggcacaaacggcaggatcatctcacagcgatccaggatcgctttacgcgcctcaatacccagcgtgacgcactcatcccacatgcgacgccccgcttcgccctgatgcattctggcgttgatatccagcgcggcaaacagcggataaaacggactggttgatgcgtgcagcataaaagcgttattcagccgcttatgcgggcagaagcggcgctgtccgcgaatatgattatcttttttatggatctgcgaagtctgcgaaaaacctgccagctgcttatgcactgactgcgtgacaaaaatgccgggatcgttctcattcagttgcagggtcagcggcgaacagccttccatcagtggaatgaactgctcatagccgagccacgcggaatcaaacaggatgtaatcacacagatggccgatgcgatccacgacctggcgcgcgttgtagaccgtgccgtcgtaggtgcccagctggatgatcgccagacggaaaggccgctcttcagccgcgcgctgcggagccacggccgcgatctgctcgcgcagataagcctcatcaaagcagtgcgcgtcaatgccgccaataaagccgaagggattgcgcgtcgcttcaagataaaccggagttgcgcccgcctgaatcagcgcgccatgatggttcgacttgtgattgttgcggtcgaacagcaccagatcgccacgcgtcagcagcgcattggtcaccactttgttggcacttgaggtgccgttgagcacaaagtaggttttatcggcgttgaacacctttgccgcatacttctgcgcatctttggccgagccttcgtggatcagcagatcgcccagtttgacatcggcattgcacatatcagaccggaaaacattctcgccgtagaagtcgtaaaactgtttgcccgccggatgctttttaaagaaacgcaccgccctgatgtccgggacaggcaaaggtgctgttctgcatatcgacatagcgggtcagcgtttcgaagaaaggtggcagcagcgccgcttcatacgcctgcgcagccgcttccagcgcgatccactcctgcggatcgccattcagctcaccgctgacgccgggcaggtgcatcacctcttcttcaaacgcgttagcgacaaataccggcaaattaaagccggtatgacgcagcagcgccagcacgccgctacgggtatccgccagcgagacgacaaccgccgccacatcggtgaagtcggtgttatccagcgtcaccacgtctcgcgcagtgttcagggtcagactgggcgccacagcggcgctggcagcaattttcagtggagtcataacagaatccctaacgtcagggaggaagtgccagaggcacaattatggggacagtgccccggcgaatacttaacagtcagaaggcgttacgcagcccgtggaaagcagatccatagccgctgcccggctggcctcaccgcatggtgaataacggagatatcggaaaagaggataacccggtgagcgccggaaaaagcgaacggtaatccgggcggatgcgcggtgaaccggacatggcgacgtcctctgtggcaaagaagcagggtcaaaaagtggcggtcataatgtcatctttttcaggcatggacaacccgaaccaggtaattattcagtcacatccttagcatgtaacaatatgatttttatagtttatttatcatgaaaaattcataatgcgactaattatctgaattatatgcagatttatgcacttaactcactgccgctttcagcctgtttttccgctcgtgtcgtcttcattgccgggagacggggccattgccctaccgcattgcatctgccaggcgtaaactgatcttctctttcccactctgccggaggctgcatgttcaaggcactggtcattgaaaatgacgaacaaggttaccgttccctgctgaaagatctccccgaatctcaactgcctgaccacgatgtcacgctcgacgtcagctactcatccctgaactacaaagatgccctggctatctgtaacaaaggcccgattgtgcgccacttcccgatggtgccaggtatcgattttgttggccgggtgacggccagccgccatcccgactggaaagaggatgatgtggcgctgctgacgggctggggcgtgggcgaaaaacagtggggcggcctggcacagaaagccagcgtcagtggcgactggctggtgcgcccgcccgccacgctgagtccgctgcaaaccatggcaatcggtacggcgggactgaccgcaatgctctgcgtgatggcgctggaaaaacagggcattacacctgaacaggggccggtactggtaaccggtgccagtggcggcgtcggcagctatagcgtcagcctgctggcgcgtctgggttatcaggtgatcgcttccagcgggcgcaccagcgaccatgcctatctgattgatacgctgggcgcggcatcggtcattgaccgtgaagaactctcccaacccggcaagccactggcaaaagagcgctgggccgccgcgatagacagcgtaggcagtcacaccctggcgaatgtgctggccgccacccagcgcgacggcgcggttgccgcctgtggtatggcgcagggactcgacctgccagccagcgtcgcaccctttattttgcgtggcgttaccctggcgggtgtcgatagcgtgatgtgtccgaagccgcttcgtcagcaggcgtggcaacgactcggtgagctgatggatagcgaacggctcagtaagctgagccgggtgatcccgctaagtgaagccagagaaggtgcgcaggcattgctggatggtaaagtgcagggtcgtctgattgtcgactgtcgctaatcctgtttaaaggcgcgtttcgcgcctttaacgatcggctcgctgcagccgttttatgagtccttccagcgcgaactgtgtcccctgctccatcaccgatttcggatcgccgctgaactgatggcactccgcttcgtctctgccgtcaggcaatacccagccaaaccagatggtgcccgccggtgtaccatcttcgccgccatccggtccggcatagccggtaatggataatcccactggctcgccagagcgggcgcaggcgccctgcaccatctcccgcgccgtctgtttcgctcaccgccgtatgctgtttcagcgtgtcagggcgcacccccagcagacggattttggcattttcgctgtaggtcacaaagccgctggtataaaagtctccgctgttttccaccgcggccagcgtcatgctgatcagcccggcggtacaggattcggcggtcgccagatgaagtccggaagagagtaaaatattacccagttgctcagcggtctgatctaatgattttgccattatggtctccttgaatctgtccggaactccaggtatagcgcaaaatcagcgaataaaaccgcgcaaggcgatgtttttaaagcgaaacggtctaaatgcgcagctggatatgcggctgtccactcccggcatgcgccactacctgcagatcggcctggtaccagcgcgtcagcgtcgattccgtcatcaccgtctgcggtgagccttgtgccaccagtcggcctgcgtgcagcagcagtatgcgatcggcccataatgaggcctgattaaggtcatgtaacacggtacagacggtgagatctcctgcgcgcgtcagctggcgtagtaaacgcagggtttgctgctgccagaagagatccagcgccgaagtcggctcatccagaaacagccagccgcgtggtcttccctcatgccagagctgtgccagcacccgcgccagctgcacccgttgttgttcaccgccagagagctggcggtaatcgcgctgcgccagcccttcacaaccggtcagccgcataacctcagccacaatctgcgacgtctgcgcctccggccagggcgcacggcccatcgccacgaccgactgcgcagactgtgaaaacgtcaggttgttctgctggcgcatcactgcccggcgtcgtgccagctgctcacgcggccatgccgtcagccgtcgatcgcccagccagcactcgccccgatcgggcgacagaaatcccgtcagcatccgcaatagcgtcgacttacctgcgccgttggggccaatcagcgccaccagctcgccacctgacagcgtaacatcgagattatcgataacagttttgccgccgcgcgcgagacacaatcccctggcctgtaaaatgtccatcactccagccctcgctgttgacgcagaatcagccagagaaaccacggaccaccaatcaggctggtcagcaaccccaccggcatctcggccggaaaccaccagagtgcgcgccagcgtatcggccagcagcagcagaatcgcccccgccagcgctgagccgggcagcagccagcgatgatcgccgccaaggcaaaaacgcatcacgtgtggcaccaccagtccgacgaagccgatcacgccgctgaccgagaccgccgtaccgaccagcaacgcactgaggatcagcagctgatgctgagtacgcttcacatcaacgcccatgtagtgcgcatcctcttcgcccgcctgcagcaggttaaggtggcgggcgcgagtctgtaacagcagcaaggctggcagaatcagcagcaggcagatcagcagtgcgggccactgtgcctggctgaggcttcccatgccccatagcgacagctggcgcagctgctggtcgttgctcagccatgacagcacgcctaccgctgccccgcacaacgcattaatcgcaatgccgaccagcaacagccgcgaaagattgccgcgcgccagccgactgaaactgaagatcagcagtgtaaccagcaggctgccgataaacgcggcgatcatcggtagccacaatgccagcggtgctggcaacgtcagcggaataatgattgccagcgccaccgccagtcccgccccgctgctgatccccagcagaccgggatcggccagtgggttacgaaaaacaccctgcatcactgcaccagagactgccagcgccatgcccatcaccaccgccagcagcacgcgcggcagccggatatccagccagatctgccagataagatcgctgagcggtgcctgccacagcgcccgcactgaaagcgacatcgcccccagatttgccgccagcaccatcgccaccagcaggaagatcagcatcagcaccaggccgcgcagcgcattatccttaatcatggttcagcgattccgccgcctgacgcaatttcacgattgcccgcggcgtatcaagaccaaaccccagcagtgccatggtgtcgatcaccagcagacgatgctgttgcccggcaggcgtcagcgccagacccggtaactgccacagctgcgcttcgccgcccagggttttcaggccatcctcgcctattaccaccagatccggcgcggcggcgatcaccccttcctgcgacagtgcctgatagtgcggcaccgggcccatagcattctccagcccggcgctgcgaatggcgccatcggccgcagtctgatttccagccgccatcgacttcatgccgctgttggccatgatgtagagcacttttaccggcagcggttgctgcggcaactggcgaatctgctgcgtcatttgctgcgccagtgcctgagcttcgctttcacgctgcagcgcctggcccacagtgataattttctgcggaattgcctgcaggctgctgtcgccgctgaccgtgaccaccctgacgcccgcgcgggcaatctgttgcagcaccagcgacggttgcgcctgcgcgctggcgatcaccagtgtcggtttcagtgccagaatgccttcggcgttgagctgacgcatataacccacgtccggcagtcgggcggcctgcgccggacgcagactggtgctgtcgcgagccaccagctgtgactgggcatccagcgcatagataatctgagtaacgtcaccgccaatcgacaccacccgctccgccgccagtgatggcagcgtcatcagcagccataacagcatcactcttttcatgccgccgctcccggcgtgcggagtgcgccaatctgctcgcgccagcgtgactgctctggcgtaccttccgtgcgctgaccgtagagctgggcgatctgcgtgccgtcggcggcaaacagttccaggctggtaacaaagccatcgcccgttggcttgcgtgttacccagctttcgctgatctgatcagccatcagatgcagggtgaactgcggattgaagatgttgagccagttttccattggctgcagcttctctaccctgccggtgaaaatctgagtacagccacggttgccgacaaaaatcataatttcattgcccgcctgctgtgccatctgtagcaggcgctcaagcgcgtcgttgccggtctgccaggcgagatcctcacccaccgcgcgaaacgcctgcggccgtgacacctggtgacgcttcagcaacgcgaaaaactgatgaacatcggtcatggcgcgccattcacggtcgatggcggtggcatcaatcgcctccgtcaggggagccgcggcaaccggctcaaccacgagcggcgtcgccgcggcgtcggtaaagtcggcgatcagcgtctgccacactgccatgttggtctgctccgtggcgtaaactttcagcaccgcatcgccatgacgatcaaaaatctgaatgctgtgacgaacgccctgcccggtcggctcctgcagagcaaaggcgctgcaccactgaccgacgaacaggcgcagatcgagcgcacggggattaagcaccaggccaccatgcgcgccaatctgcacattgtggtattcacccagatgttcatgtaccgcataagcgttacgggtaatgtttttggtttcgccgactgcgcccagtgccttcagcaacgccggaaaatcgcgtttcagcgccacggcatcaacgccgatgcgcgcttcacacaattccgcttcgctgatgccgatcagcgtggccaggtcgcgggcatatttcttcggttgttcacctttaaggacaagatagtgctgataaatcgggttcatgactcaggctctcttagtagtgccctgcatcagcgcagggctacggctatcaaaaatcgacgttaacacctaactggaaagtacggcccggcatcacggccagcgcctgatcgttgcgctcctgctgagtggcgctggtcagttcacggctgctgaggtaatcccggtatttgcgatcggttatgttgtaaagcccgccactcagcctgacgttgtgcgcgacgcgccagtaagcggtcatatccaccatgccataacccggcacccgcatgtaatcggtgctggagtcggccaggctgctgccgttgttagcgaagctttcgcggttagtcgcgctggcttgcttacctttgacaaaggtagcggtaacggcggcaccgtagccgcgcgcctcatcatcccaggcgagtccgacgatcgctttcatcggggcgacactctcaaggtcgatgtagcggtcaccaaggtagctcgactttgcagcgccctgcgtataaccaaacgccagattggcgctcagaccctcgacctcgctgaaccagctgccgaagttcactttactgctgatttcagccccgtagatgtaggctttatcgcggtttctccgcctgataggtggtgtaaatgttggcaggcacattgacgaactgacccggattagccgcccggctgtagcgggtaaaggcaataaagtttttatagtcgttataaaaagcggcagcgttaagcgtgacgccttttgccacctctccttttacaccccactcgtagttgttgctggtttcggttttcagatctgcattaccaatcagcgcatactgcgcggtgccggcatagctggagccaaggttccatgaaccataaagctgcgtatcgttggggaactgcgcgccacgggtatattgcagataagtcatcagctttggtgtcagatcgtactggaaggcgatcgacggcaatacctgcgtgtcgctgtttggcgatccatagagcgctgaaacttcgctggcgtcgagcacgctactgttcgtggtcagcgtcgccacatcacgcggtcgggtgttctgataggccacgcgcgcgcccggcacgatggccgcccgatgtccgtcagcatcgaagctgatggtatcctgcagataaccacccacgctgtagctgcgactgttagcctgcggctgcatgatcgcagtaaaagcactggctggcggtgactgacggaaaggtcgctcagtatccaccaggcgcgcattcagcccggcactcagttcatgtcgcccgacgcttttaagcgcgcgggtgtcaaaaccgtagctgtcgctgttgtagtcggaatagacggtttgcctggcggtggcactcgacggcatccgggtgttgtcatgcgcctgggtctgctgccagtaaatgcgggtcgtcaggctgtcgatcaggtcattgtaaggggtgtactcatccgccaggctgatgccccagcggcgggtatcactctgctgctgtgccgtcccccagactgtattgcctgaagtgctccagctgtcgtaatggctgtggtgggttttgtgatagtaatcgaccgtcgcgctgagcttatgagcatcattgggctgccagatgccggaggtcataaaggcgtcggagtgccagttagcgggatacgcatccagcgtgccgctgttattacgggtctgctgaccgtcgcggcggctgtaaacaaagatgccacgcagttcatcgtcaccggcagcggcggtgatgccgttatgccagctgcgactggatgagtcatagtcgctctgataactgaacgcggtcgcttttccgggatgcaggtaatcgtcgggagacttattacggaacgagacgttgccgccaatcgaggtgttcggctgttccactgctgtggcgcccttctcaatctcaatacggccaaacatataaggatcgatgtaatcgcggccaatgccaaagctgtcgagacctgcgcgtcctacatagctgcggccagtggcctgcggcaacggaatgccgtccacatccagaccgacgcggttgctttcgaggccacgaatgttgtagccggtataaccggcccgatcaaaaccgctcttaccggctgatgaaccaccacgggtaccggtagcactgatcagcggttcatagcgcatgatcgatccaaagtcagtggcaccacgctgttgcagatcgctggcagagagcgaggttttactgcctgccgtttttttgatttccggtgccgtcaccgtcattaccggttcggcactgctgccatagcggtcagaaagggttagcgtggcagattcactgcccgcagcataagtgcaggtggtattgatgaaggtggcgagcaacgccagttgagtcagacgcggttgcgtcaatctccgaaaacgtggtgacataggcgcgaattacctgattaattgttagtattcgctcacttgcttgctggcaacagtaaaacggctccgcataaaagccgtgaaaagtcagaacatcatgctggtgtaataattatcgcccggaatttaatgcaactgataatcattatcaatattatttacatttagatataaaccacagcgcacaaattgttaacccgaatgcattggcatttatcaacacgtaaaggaatagagttatggcgcaaaaacctgtggttgttattcactactgtatgcaatgcaactggctgatgcggtcagcgtggatggcacaggaacttctgcatacgttcgctgaggatctggcggaggtaacgctgaaaccgggcaccggaggtatctttgagattacgctggatgagcatctgctgtgggaacgtaagcgggatggtggcttcccggatgcgaccacgctgaaacagcgtgtacgggacatctgcttcccggatcgtacgctgggccacatcgacaaacacaaaactgaagtcagctaactccgcgattagctgagggtgattttttctgccgcgtcgtgcagcgctttaatcagcgtctgcagcgcggcttctgagatatcttcctgcgcaagccgccggttcagcgcgaccttcagcccatgaatcgcctgctcaacagcaggaatgctgcggttattgaccagaatcgccagcgtagagagacgtgtaatcaggctgctgaccgtttcacggtttctctgccagatgcgcctctcccgctgccgtcaggcggtaggctttacgcgttgcctgcgcatccaccacctgaatcgcctccatctcttccagcagcgtcaggttggggtaaatgatccccggactgggcgaatactctccctttgacagctcctcaacagacttgatcagctcatagccgtgcgcggcattctgcgccaggaaatggagcatcagcaggcgaatctcgctcgcttccagcatcttttcacgtcgcttgcgccgtccgctgcaactgcctgcgcgcgcagtttgatcgtcagatgaagtggaagtcggatgctgtttcatggcctgccctgctgcgaaaaagtgggattgatggtagtgcgccgcctggcaaaactcaattgccttagcgacttacttctggtgccagtaggccaccgcccgtacgaagtcactgttgaggccgcgctgcaccgtgaagtagtcacacagcgctttaacaaactcaccttcgccggtcagccagacaaagtaatcttccgtcgggatagtgatctgatccagccgggcaatcagctggctgagctgcgctttctgcatctggccgctgccgagccagtttgtcgtcacatcagccgtatcagataaatagtcgcggcccgtcgcttcatcggtaaaggcatagagatgcagcgcctgcgcccgggcgtcacgctgacggcgcgcaaaagccggcagcccggtttcatcacagacatagagctggaatgcgtaatcggtcggcaccaccagcgagccgcgtggcccgccgacaatcaaccgatcgccaggctgcgcctgagttgcccagtcactggctacgccctgctcatgaatatagaaatcgagggtcagtgaagattcaccatcgaattccagcggtgtgtaatcacgcgcctgcggacgcaccccttccggccagacaatccccgcatcggtgatttgtggcagagccagtgtggctccttcagcggaagggaagaaaaccttaatgtggtcatcaaagcctggcgacgtaaagcccgccagatcgctgccgctgaaccggatacgccagaatttaccggcaatgttagttttactcgcgacctggatatggcggaaacgcaattcattacggacgcgctgtggtacacgctgatcggctgatacaggcaaaatttctctcctgaaacgggatggatgcccgtgactcaagggcatgctgataataatggaataacaatcattctcatctgaagtgccaagattagctatgatatatcttcactacaagaacgaaaaatgcgatccagcggcttaagatatattttatgccggtacgggtgtgcgtagtgcagacgaagagcggccctgataagagcattcagagagaggtaagcagcaggtgcggcgtgtttacgggggcaggcagagaaggcggaaactgtccggctcctgacgagccgggcatgatgttgcgccgcacattctggcagcgcgtgaccacttacagtgtgtcgttgaatcctgagagggaaggattgctgctggtgtgttccggcagctcaccatcacccagaatttcatgctgggtggcctgagagtgcggatgcagtccggcaggaggtgaaaaaggttcagcctgttgtgccatcgccatgacaggcaatgccaggatcagtgaaatcattaagcgtcgcatagttgtcttcgtttgtttttttgaccagaaaaggcctgaaatgcaggtaaatattccagccctgacacagatgcacgatgattcaggcatggcagggtttcgggagaggattttacgccagaacggcgagttattttataaaatcgtgcggtttgtcacggtttaccgcacgaattatgcattaacagggtcgggagtcactcgccctgccctgctggcgtaatgctgatcagttaagattagatttataaaagctatcacggtcaaacgtggcagcctttttttccgggcgagcgagccgcagtgcgggccagagcaggctggtgccgggcaggagcaggcaatccgcagcgctgaacagaatgagtctgccaggagagcccgcaggacgcgggcgaaaggcggggcggcacaggatgtgccatccccggcggtccgtcaggcagaggaatgacgtgaaggaaccgcatagcggcgcgaggaccgccagcccctgcccggcaccagactgcgttatcacctgtcgcttaactgactggcattatgccctgctggctacgcctgcatcaccggaatagaaaaaacgccgctcagccagtcgggcttacagtgcgcaaaatcgagacgcaacagatctttaccgggacgacgtgacacacccagtgctggcagatgctgatagtagatatcctcgataaagcgtgtcagctgctccgggctgccgctccagcggatcgacgcatagagtccactaacctcgctccagctggcggtgttgtcacccagcagcccggcatgttgcggctccagcgcctgaaacaggctgatattttgctgatcagcagagctatggcccgggccatactgaaagcctaaccagccatgcgacacgcggccgcccgccagcgccaccagttgccgcgcctgttcagccacccggtgatcgcgatcggcaatgtaatcgccaaacttacactcccactccagcgtttctccgcacagatgcagctcttcctcacgctccaccagcgttgcacgctctgccagcgatcgcaccagaatgcggccatggaagtttttaaccggcaaatggggaatacggcgaaacgcgccaggcgtcagcgaaaagtgacctttgaatacccgggtaaaattttgctggttatcaaaaccaaaacgtacggcgatatcgatcagcgtcatgcgggtcagacgcagcgccatagcggccatcgtcagacgccgtttacgggtgtaagccgccagggtctgtccggtcatctccttaaacatgcgctgcatgtgccatttggaataacctgacttgagggtaatctgatcgatattaagatcgtcggtgagattggcttcaatccactcgaccagatcgttgatgtgctgttttttaatggcctgactgagcatgatggcgatttacgacgcgggttaggactgggatttcagttacaaaaggataacaaaaatcgcaaatcggtgtaaggaaagggtaagcattgcgcgcccgtttcagggcgtttccgcattaattgcttaggttactaactaaaaaaggctgacttacgtcagccttctgattattgataaaaactgcgccggatagctttaagacggagcctgcgacaactaatgactgcgcattccggccgctgtcatcatcatgcggaacagcgaggcgacaacgcccagcgccagtacgctggcggcatagataaacaccagccacatcacacgcttccaccatggcgctttcgtttcttgattgtgattgtggtctttcatgctgctgaggcttttcatatcaatgatatcctgcgtctgctttgatttttccacggaacacgtagtagctccagaaggtgtagcccaggatcatcgggataatcagcaggctacccaccagcataaaggcctggctctgcggcggtgaggcggcagcccagatggtcactgatggcggaataatgtttggccagatactgatgcccagcccggagaagcccaggaagatcagcgccagcgtcagcaggaacggtgaatagtgcgcctcgcgcttaatggcgcgcacaatgccccacgaacagagcagcaccaataccggaaccggcaggaacaggaacaggttgggtttgctgaaccagcgatgcgcgatatccgcatgcgcaaacggtgtccacaggctgatgatgccgataatcactaacagcgcaatcaccagcggcgtagccagcgcagacattttacggtgcagctcattctcggtcttcatgataagccatgtgcagcccagcaacgcgtaggcaacaaccagacccacgccgcagaacagcgggaacggtgccagccagtccattgcggaaccggcaaaacgacgtccctcaaccggaataccatccagcaacgcacccacggccacaccctgactgaaggtggcgatgactgaaccggcaataaacgacttgtcccagaacgcccgatggccttctaccgccttgaaacggaactcaaaggcgactccacggaaaatcaggccaatcagcatagcggtcagcggaatcgacagcgcatcggcaatcaccgcataggccagcgggaacgcgccaaacaggccagcaccccccagaaccagccaggtttcatttccgtcccagaccggcgcgacggtgttaaccatcatgtcgcgctcgccagcatctttattgaacgggaacagcagaccaatacccaggtcgaagccatccatcacgatatacatcagggttgcgaaaacgataatcgcaaaccagataacggaataatcgatcatcttagtggtctccatccttaaaggtggcagcggaaagcggacgcgccggggttttcttctgaccaggaccaccctcttcagtgatatggccttcgccggtaaccggtccctgcttaatcagacgcatcatgtagtgataccccacgccgaacaccgagctgtagaccagaataaaggccagcaggctgatgctcatgtgcatatccccatgtgccgagaccgcatcaatcgtgcgctgcacgccatagaccacccacggctgacgaccgatttcagtggtaaaccagcctgccagaatcgcaatcagacccgacggccccatcaatagcgcaaaccacaggaaaggacgcgactcatagagacgccctttaaaacgcagccacaggctgactacgcccagcgtaatcatcagcaggcccagcgccaccatcacgcggaaggaccagaagatgaccgttgaattaggccggtcctctttcgggaaggacttcagcgccgggacctgcttgtccaggctatgcgtcagaatcaggctgccaagataaggcacctccagcgcatacttggtacgttcctgctccatgtcggggatcccaaacaggatcagcggtgtggcttcacccggtgggttttcccagtgcccttcaatcgccgcgattttggcaggctggtgttccagcgtattcagaccatgagcatcaccaatcatcgcctgaatcggcgcgacaatcagcgccatccacaacgccattgagaacatcttgcggatagcgggattgttattccccttcagcagatgccaggccgccgacgatcccacaaagaaagcactcgccaggaacgccgctacggacatatggaacaggcgataagggaatgaggggttaaagacgattttgaaccagtcctgcggaaccacgatgccattctgaatgatgtagccctgaggcgtatgcatccagctgttagaggccaggatccagaaggtggaaatcagcgtaccgagggcgaccatgcaggtggcaaagaagtgcagcccgggacccacgcgattccagccaaacagcatcacgcccaggaagcccgcttccaggaagaacgccgtcagtacttcataggtcagcagcggaccggtgatactgccagcaaactccgagaagccgctccagttcgtcccgaactgataagccatgaccagtcctgataccacacccatgccgaagttaacggcaaagattttcgaccagaagtggtagagatcgcgataggtgtgatcgcgggttttgagccacataccttcgagcacggccagaaagctggcgagaccgatggtgatggcgggaaagataatatggaaggaaacagtaaatgcgaactgaatcctggccagatgaaaggcatctaatccgaacattgcttacctctttgccacatagaacaccatgtatttacttataattaacaacttaagcctgatgcgcctggttctctgcgcttattgaaattcccgccgcaaatttaaaactattcgcggcgaggaaatagaaacagtggggttaatgaaaactataacagtctttattgattctgatcattgtttttgacgggaattatttatttaaaaataaggcctaaaggttaatcagagcgtgtttatgtgtcgttaatgttacggtaatttgtactttaaaaatcgatagcgctaaagcgaaccttgcctgaaaaatgccttcaacaggctgttttcaggcactattttgttataaaccctgattgagtaaaggtcaaattttagagcctccaaattaaatacccttattttttaacaggttaaaagagtaaatagttacctctgccgctttgtttgcttttttgcttttgcctggctaatgcagctataacttctgacagaaaaaacgcagaacggcgcttttaagcgccatcagagatgttaataaaatgagtcaaaaagaaggtatgaattaacagcgcgctgcgggtagtcgattattccgggccagagattcataaaacgatttaataaccagcaaccgtgcgaaaagatcgactggattatttgggctgccgttacgttatcgcgctttcaggaagtgagataacagacaaatggggtcagaaattttgcagcgagtatacccatgccgtcacgttatgacggctgatacagggtgattttactctgccgcagatttttcgcgctgtgccagaatccggctcaggttcagctccagccagtcagccagccccacaacctgttcaccgacttcgcgtccaagcggggttaagcgatattccacgtgcggtggcaccacatcgtaggcgatacgctgcacgaagccatcttcttccaggtagcgcagattctgcgccagcatccgctcgctgacgccaccgaccgtccggcgcaacgcgctgaagcgcagcgtctggtcctgcagggccagcagaattaatacgctccagcggctggttacgcgtttcagcacgtcacgtgacgggcagttgacgttgagcaattcgccgcggataaatttttcactcattttttcagacatttaacttatccacctcaaactaacaattctgtaagtacttactaaaaattagtctatacactagtctgaatttcaccaacagccacaggagtattaacatgattgcagttacaggtgccaccggccagctgggccgtttcgtgattgatgcattactgaaaaaagtcccggcgggagaaattgttgccgccgtccgtacgcctgccaaagcggccgatctcgcagcgctgggcgtcattgtccgtcaggccgattatggtcagccagagacgctggaggccgcttttgcaggcgtggataagctgctactgatctccggtagtgaagtgggccagcgtgaagcgcagcataaagccgtcattgaggctgctcgggcggcgggcgtgggctttatcgcttacaccagcctgctgcatgcggatacctcgccgctgggcctgggcgttgaacaccgcgcaacagaagcgctgctgaaagcctctggcatcccgttcgccctgctgcgtaacggctggtacagcgagaaactacgcagcgagcatcccaccggcgctggcgcatcatgcgtttattggcgcagcaggcgaaggtcgtatcgcctcggcagcgcgtcaggattacgccgaagcggcggcagaagtaatgacccgtgaggatcaggcgggcaaagtgtatgaactggcaggtgatgacagctacacgctggcgcagtttgctgcggagattgccgcgcagagcggtgaaaaggttgattacgtcaatctctctcagagtgagtttgcggcggcgctgaaaaacgcaggcctgccagaaggtctggcggaaatgctggcggattctgatgccggtgcagagaaaggcggtttgttcgatgactcccgtcagctaagccagctcatcggtcgccccaccaccacctggcaggcagtcattcgcgcggcgctggcaaatcgttaattctgtcgttcatgagcggacaatcgggtccgctcacctcactctcctgtccgaattcccgttgggtatgccactttctgcactctttgcggctgctgtttcttttacaaaatgtgaataaacgccagttttcttcagcttaaatttttttattcaggtcgctaagagattcatctgaaatgcgttttttgtgaacagcgctatatttggttgaattgtctggaatttatccaaaaacctcgattaatcgacaatatttattacgttcatagatattctgcattgttgttccgggggaggagaggtctataatttgtcctttgtgcaaccacgaccgctcaggaggccgttattaatacccatcgccagcaacaaaatgcacttgaagaggttcgtgccggggcggaagttgagtatcaatacgatccccatgaactgaagctggatcgcatgcaggattctgaaccggagccggagctgattgaaggcttgccggcgccggatgcgctgacccctgccgatcgttatctggaactgtttgaacatgttcagatgtcgcggattttcgaggacagcaaaaccttccccgactgttcgcccaagtacgatccgctggatgtgctgatgcgctatcgtcgacagaaacgcagcagtgatttcgacctgtcgcgttttgtcgccgatcacttttatctgcctggcgtaaacgaaagcttttatgtctccaacccggataaaacgctcaatgagcatatcgacgacctgtggccggtttctgaccaaaatgccgcagcagcatatgccgcactcatcgctgctgccattacccaaaccctatgtggtgccgggcggacgttttggcgaaacctactactgggactcttacttcaccatgctcggcctggcagaatcgggccgcgacgatctgctgcgtcacatggcggataactttgcctggctgatcgataactacggtcatgtgccaaacggaaaccgtacctattacctcagccgctcgcagccgccggtgtttgccctgatggttgagctgttcgaagaagatggcgtgcgcggtgctaagcgctatcaggaacagctgatgaaggaataccagttctggatggacggtgccggttcactgatgccgaaccaggcttatcgtcacgtagtgcggatgccaaacggctcactgctgaaccgctactgggatgaccgcgatacgccgcgtgatgagtcgtggattgaagatgtggaaaccgcccgcgaatcgaaacgtccggccagcgaagtgtatcgtgacctgcgtgccggagcggaatcgggctgggattactcctcgcgctggctgcgtaacccgaaacggctgtcgagcatccgtaccacgcagtttattcctatcgatctgaactcgttcctgtacaagctggagctgatgatcgccaccctgtcgcacgcgaaaggggaagagctgaccgcactggcctggcagaaaaaagccgaagcgcgcaagcgtgcgattacccgttatctctgggacagcaccgccggtgtgttccgtgactacgactggcgtcgggagcgtttcggtgcctttaccgtcgcctccgtggttccgctgtttgtcggtcttgcaacgccgcatcaggcgcacctgcaatcgatctcgctacgccatctgctattgagcaacggcggcctgctgacctcaatggtggaaagcggtgagcagtgggatcgacccaacggctgggcaccgatgcagtggatggcggttgttggcctgaataattacggtgaagagacgctggcgactgaagtggcagtgaactggctcaacacggtcaacaacttctatcagttgcaccataagctggtagagaagtatgacatcagcggcgagcgcgctcgtcctggtggcggtggtgagtatccgttacaggatggattcggctggactaacggcgtcacacgtaagctgatgacgatgtatgggcatttaatggctgactgagtagcgcagccggtaaacctttaaaacgcaaaaagccgggctatcccggctttttcatgtttcatgcaggctattcagcgctacttcttcgcttcagtgcctggttgtgacgcccgttgcaggaactgctgtgtcacttcaggcaggtgctgcagcagccactccgccatcgccacttcctgatcgcggatctcattcagtatgcgtacgccctgcgcatcaccgacctgctcagccgcggcgatcaggctggtgtagctggcgatctcggcattttcgaatacatagccactgatagcgcccttcaccacttcatctgagttaaacatgccgcccacggcctggccggtggctgccattttgcccatcgcatctttcattacagagtgatcgataccgtggctgtcgagcagctgttccagcagagtcagctgatgtttagtttcatccagatgttgcgccagacgctgttccagcgccggatagtgttcaagacgacctgacatcttgctcagcatgctttctgcttgtttttccatcgcatgcgcatcgcgcagccagtcgtgataatgttcaatcgcagtcatgtgttgctccttaagagacggtaatagactcagctaccgaggtgagcttctcatccgtttgcttctcttcattcagggtttcttccagcagctgcgcggctttggtgtaacccagcttcagcgccagcgcatgcaaagtgccgtatgtagcaatctcatagtgctcaactttctgcgccgcaccgatcagcccctgatcgcgaatctcgcctttctcgaccgagtcgataatttcctgcgcttcttcaaccagaccttccagcgcatggcatttcattcgtttgattttgacttcaggtgttacttccaccagtttcgtcgagtcgttcaatctgagcacgggtctcttccagatgctgattaaacgcagcgataagattttcgtcactggctgcacgcgccattttaggcaatgcacgggttatctgcttctcagcgctgtatacatcggataagtcatggatgaacagatcgtttaacgttttcactgtcataagatagcctcattgattaaaaagctgcgtctgtaataacgcagcgccagtcatatcgttgacacctgaaaagtctagtggagattcttaatatcgcacgcagcatcagtatgaatttaagacaaaagtggcatataaaatgcattttcctttttacagcaaagatttagctgaataatgtttttatcgttgccgcttcgttagctgcgctggattttgtacaaagtaataaatcgttgtatacattttttaagattaactgcataaaaaagtaccagtcaaaaacttacctgtacaaagttgtatttaaccgtatagctttaatcgatcggaaataaaaaaccggaagggtaaacccttccggttcaattaacagctcccgccattgccaatgatggagcaatgacataattcagggtgtaattatcttcacgaggaactaaacagattcaaaatgcccggctaacagagtaaccctgccgtcacagcagtgttaaagacgttcagctccggcggctaaccttacctcccttgcgccccgcttcaatggcacgttcaggatcgttcttgaagttaccgccgcttttctggcctcctttgcgtcctgcttcagcagcacgctctttgtcggccgcaaaattcccggccccaccgcgatattgagtcatatgcgtcctctttgaattttaaaaattggaatttgcacagttaacgcttcatcaggccgattcagcaacataaatgtagacagaaaatcggaccgatcaagtgagataaataaaaaacccgtcacagttctggcttaatgatcgtactaccctcaaccgaaatgataacggattccaaccatcgctcttttcaattcataaaagagccgcggcatgaaaaacctttataacgaaaatcgccgcgccctattaatcgatctttttcaaaaaaagtccaattgaaaaaaatataagcgaagcggtaaatagatagattaatcaacaccaggtagtgaagatgatcaacaaacgatcaatttccccaagcgaagcgctaaatagaaatttaaaaccctgcttttacgtcaaaaataagcgaagcgtgacgcattgatggcaccagttaaaaatagccggaatcgatcaataaacgatcaactctgctgatttaatgaaaatttttattaaaaagagaggtcagatttagcgatgaaatttgaatctaagcgaagcgaatgaatttctgcttcctgagggcaaaaaacgggttttcggaatagtactaaaaagcattttctgcggggatacgcataaattttgcatgcctgcgaaaaggggaactcaacgttatgaatgagatagcgcaaagccatgaggggggagattgtgcgttaatggcaggcaaaacatatgccctgttcagcagagtcagagggagtcgggaaaagtggaatcaaaagcgacaccgcgcttgccatttttcttgatgcggtacatcgcttcatcagcacgctgcagtgcagtatcaaagtcatctttgtcctgcgcctgagacacaccgacagacgccccaatgagggcatgcccgtttgccatatcaaaaggtgtcattaccgcgtcaagacaggcgtgcgccagtgtctttacccgcggatggttcagcgccaagggtattaacaatacaaactcgtcgccgcccagtcggccaatgatcacttctgccggagagagttccgtaaaccgctgacttaactggatgaggacttcatctccgctgcggtgccccagggtgtcgttgacgtgtttgaagttatccaggtcaataaagaccacgcagagcggtccctgagctttcatttcacagaaataattctgcagagcatgacgattgttgagcagcgtaaggggatcgtgcagcgccagcagggcgagctgctcctcatattgcttctctttggtcatatcgatgtgagtaccgatcactttaaccggctctccgtacgcattccattcgctgacccggccccgatccagcacccacgtaatgctgccatttttggcgatcatgcggtgcagagcctcgtaataaggcgctttcccggcgatgtggtcgttgaatgcctgtagaaacgtcggcggcatcatcgggatgcaggctctctttccaggattcaaagttggcgtcggtctctttcggctggaagcccagcatcgccccccagcgccggttgaagatcaccagtttgccgctgggaatatccagctgccacaggaacaacccggtaccatccagcgccgcattgagttttgtgcgggcgtcatgcgctatacgcttcagacgcgcattgtgctttttgaggttctgtatctgcagacgcagcgcttcttctgacataaccgtgtgagaggaggaaaaaggggtattgtgcctgtcaggctgattctgtaaagggtggcttataaaacacgattagccgcggtcaattgcaggctggacaggatatcaggcggtgccagtctggcaatgcagcacagaggcaaacctggcaattggtttcgccatgaaatctgtttgtgttgctacagggttgagaagtggaatgggcgcgggagaggcgaaattcggaatgttcgggaatggcgggagtctgtcgaaccttcgataacgggttcgccccataaacgcaaaaacccgccagaggcgggttctttaaagatggtgcccgaacccggaatcgaaccagggacacggggattttcaatcccctgctctaccgactgagctattcgggcaacggggcgcattaaaccaaagcggcccggcagcgtcaaacgcttttcaccaaaatcaaatcgactgaccgcttttccatcaacccaaagagtgggtctgacctgccgccataaacctctctgttggccggatatattttagtcagaaagcaggcagagtctgcattgtgacgcgaaattgccgatatagcatgcgagaccaacactaataataaggatcgccatgttttccaccattacatcaggtatcgcttcccgtcacagctggcagaagcgttcacactcagcggcaacgctgagctctctcaacggctccatcgccatgattgaattctctcccgatggctccattctcagcgcgaatgcgctgtttctggcgcgcatgggctacacgctggcggagatcgaagaccagcaccacagcctgttttgtaccgcagagcagcttaagtcgcgggactatcaggatttctggctgcgactgaaccggggcgaaagcttcagcgataagttcctgcgcgtggcgaaaaacggccgaccggtatggctcgaagccaactatgtgccggtgcagaaccgccatggccgggtgattaaaatcgtcaaactggcaaccgacatcaccgatcatatcaacgatgcgcaggagcagcgcgccatcaccaccgccatagaacggtcgatggcggtaatcgcttttaacctcaaaggtgaagtgctgaaagccaatgacaacttcctgaaaaccatgggttatcgtcgtgaggaggtagaaggtgttcaccaccgccgcttctgctcgcaggcgctgcgcgacagccgcgaatatagcgagtttctggcagcagctgaaccgcggcgaatttgtctcaggtcagtttccccgggtcaataaacggggcgagactatctggctgcgcgccacctataacccggtgtttgacgaacagggcagactctacaaaatcgtgaaattcgccactgatgtgaccgcgcaggtggaaaagaatcagcaggaacatgatgcggcacagcgggcttatcacaccgcgctgcaaacggatgaaagtacaaagctgggtgccgatgttatcgccagcagcgtgcagaccatgaacgccctggcgggtgaactgcaggggatctccggtgatattaccggcctgagtgaatcctcagagcgtatcggcgcgattgtagaaggcatccgccggatagccgatcagactaacctgctggcgttgaatgccgctattgaagcggcgcgggccggaacccatggccgcagctttgcggtagtggctaatgaagtccgcacgctggcagcaaacatcaatcgcgccaccaccgacatcgaaaatcggatacagcaaaaccatcagctggcgagccgggcactgaaagggattgaatccaacctgaagcgcgccgatcagggcgtacagctggcccaggaggcgggcggcgtgattgcggaaatccgtgaaggcgcaacggatgtagtacgcgccatcggccaggtgaccaaaacgcttaaagtctgacgctctgcgggggcaaccgcccccttttaaggtgttgcctgaaccggcgcttctggcaccggcgggataaagatatgatccagaatcgcccgcattacgggtgccgcagtaatcccttcgttgccaccattctccagaattaacgctaccgccactttcgggtcattaaagggcgcaaaggcggtgtagaagatatggtcacgtaaccgtaccggtatcatcttcgcgttataggtctggttctggcgcaggctgaacacctgcgacgtcccgcttttcgcagcgatgccatagggtgccgtgtggaaatatttatacccggtgccgttgggtgcgttagccatgccaaacatcgcgtggcgtaccagcgaccagtaaggtgaatgaggatcgccaatctgtgcttcatgctgctgcggatgatagttctccaccagcgtgccgcgctgggttttctccagcagatggggagcaatgacccgaccgttattaatcagcgccaccatcgctttcaccatctgaatgggtgtcgcaatccagtaaccctgcccaatgccaaccgacactgtatcaccctgataccaggcctttttatgcaccttctgcttccactcacggctcggcagtaaaccgctgtactcctcattcagatcgataccggtcgatttaccatagccaaactggctgagcatggtgtgaatgcgatcaatgcccatcataaacgccacctggtagaaaaaggtatcggcggactcttcgattgcccgcgtcacatccagcatgccgtgtccggtttttttccagtcgcgatagcgccggtccgtgcctggcagcgtccaggtgggtgcgccaaagaattgcgactgcggcgtaatcacatgagtcagcagcgccgacatcgccatgtaaggcttcaccgtggaggcgggcggatagagtccctgcgtgacgcggttaatcagcggcaggtctttatcctgtagcagctttttataggcctgatagctgatgcctttcacaaacggattgggatcgtagctggggctggagaccatcgccagcacggagccgtcgtgcggatcttcaatcagcagcgccgcacgctgccccgccagcaggctttccacatactgttgcaggtgcagatccagcgtcagcgtcaggtttttacccgcgaccggcggtacctctttcagcacccgcacaatgcggccatgattatccacttccacttcctgataacccggcttaccgtgcagcagcgcttcgtaataaccctcaatcccctgcttaccaatgttatggtcagccgcatagttttcggcgatgccttccgcatttagccgtttatagtcgttatcgttgattttcgacacatagccgatcacatgcgccagatccgcgccatagggatattcacgatcctggtaggtctcaatgctggcgccggtgaagtgaaactgattgaccgcaaagcgggcgacctgctcttcagtcagctcctctttcagcaccaccggcttgtaacggctggtctgcttcagcgcatggcggaaggtgtcgatttcgtccggcgtcagattaacgatcggcgtgagtgcccgcagcgtggcgtccatgtcgctgattttgtaaggcgtcagcgtaatggcgtaccagctgacgtttcgcaccagcggaatgccgttgcggtcataaatcagcccgcgcgtcggggcgatggggatcattttgatgtcgtttctggttagagcgcgtctggtaatagccatgatcacgcacctgtaagcgaaaaaggtttacgccaagaatggtgaaacagagacagaccagagcaaaggctattgcagcgcggcgggcaaacagcttctcttcagcttggaagttacgaaagttcatcagggagcattatcaggcgattaattattatctgttattgcgcaccatgataaagcgcgatcgcgggcgtgccagcgcgaagatgcacaagcctgagcaaaagtgtgtcatttgatgtgaatgttaccgggacggcgaggcgggaaaatgcagatcccccggttaagggggatctgcgcaaggggatcgggcagcaggcgtcaatgcctgccacgctgattaatcacccagcagaacagactccagcgcaatcttgatcatgtcgttgaaggtggtctgacgctcagcagcggtggtctgctcgtgcgtacggatgtggtctgatacggtgcagatggtcagcgctttagcaccgaactctgcggccacaccgtagatacctgcagcttccatctcaacgccgaggatgccatatttttccatcacgtcgaacatctgcggatccggggtgtagaagagatcggcagagaagatgttacccacgcgcgcttcaacacccaggtttttcgccgcatcaaccgcgttacgcaccatgtcgaagtcagcaatcgcagcaaaatcgtgatctttgaaacgcatacggttcactttggaatcggtgcaggcacccataccaatcacgatgtcacgcagttttacatcggcacgcacggcaccacaggagcccacacggatgatctttttcacgccgaagtcggtgatcagctctttggtgtagatggagcaggaaggaatacccattccgtggcccattacagagactttgcggcccttataggtgccggtgtagcccagcatcccgcgcacgttgttcacttctaccggattttccaggaaggtttcagcaatgtgctttgcacgcagcggatcgccaggcatcagcacgacgtctgcgaaatcgcccatttcagcattaatatgaggggttgccattgtttaatccttgttaaattgctgatttacagcatgttcttgccatagtccatctcggacaggccaaaatagtgtgcaattgtctgaccaatatcggcgaaagtttcgcggtaaccgagtgaacccggctcgactttcggtccgtagataagaatcggaatgtgctcacgcgtgtgttcagtaccttcccacgtcgggtcacagccgtggtcagcggtcaggatcagaatgtcatcttctccgactaactccatcagctcaggcagacgacggtcaaacagctccagcccgcccgcataaccggcaacatcacgacgatgtccccaggttgagtcgaaatcaacgaagttagtgaaaacaatcgcctgatccggcgcagttttcatctcctgaatcgtggcgtcaaacagcgcatccagaccggtcgctttgacctttttggtaatgccctgctcagcatagatatcggcgattttacccacggagatcacatgaccgcccttctcatccaccagctttttcagcatggtggcggatggcggctcgactgccaggtcgtgacgattgccggtgcgctcgaactgacccgctttgtcgcccacaaacggacgggcgataacccggccaatgttgtagccaccttcggtcagctcttcacgggcgatttcgcacagcgcatagagacgatccagaccaaaggtctcttcgtgacaggcgatctggaacaccgagtccgcagaggtatagaaaatcggcttgccggttttcatatgctcttcgcccagctggtcgaggatcaccgtacctgaagagtggcagttcccgagatagcccggcagatctgcgcgctcgaccagtttgtccagcagtttcctgagggaagctgttctctttgtcgctgaagtagccccagtcaaacagcaccggcacaccggcgatctcccagtggcctgacggcgtatctttacctgacgaaagctcgctggcgtaagcgtacgcgccggtgattttcgcctcaggatccagacctgccgggaagcggccggtcgacagctctgcggctttgcccagacccagcgcggttagattaggcagatgcaatgggcctttacgtcccttgtctgcttcacccctgaaacaggcttcggcgatgtgacctaaagtatccgaacctgcgtcgccgaatttatcggcatctttactggagccaattccaaaggaatcgagaaccataataaaagcacgtttcatgcaagtctcctgcgcattggcgcgtgacaagtcaaaaaaaagcgatcagatcagtatacccgaatgcatcgcagctggcaccggttaccggtcagttagctcatatcgctcacacgacgatagacaaccggcgtctcagccggggcggaattaccgagcaccagcgcggctttgaccgcggcggcggcctgctgccatttgtcttcgctgctggcgtgaatgatcgccagtggacgctgcgcatcggcacgttcgcccagggtgatcatgtcgcttaagccgacgctgtaatcaatactgtcgctggcacgctgacgtccgccgcccattgccaccaccgccagacccagcgcacgggtatccatgctgctgacgatgcctggctggtcggcatacaccggcttgctcagcatcgcctgcggcagataagcgtcgtagcgttccacgaaatcggcaggtccctgctgggcagcgaccatacgaccaaatacctcggctgctttgccgttatccagcaccgtcatcagtttctgacgcgcttcggtgtcgctggcggccagtttgccggagaccagcatttcgctgcagagcgccagcgtcacttccagcaggcgcggattccgctcttcgccggtcaggaagcgaaccgcttcacgcacttccagcgcgttaccggctgaggaggcgagaaacctggttcatatccgtcagcagtgcggtggtctggcagcctgcgccattagcgacgccaacaattgactgcgccagactttctgacgcctcataggttggcataaacgcaccggaacccactttgacatccatcaccagtgcatccagcccttctgccagcttcttcgccagaatcgaggcggtaatcagcgggatcgaatcgacggtggcggtgatgtcacgcgtggcgtagaaacgcttatccgccggtgccagcgagctggtctggccgataatcgccacacccacctgcttaatgatctcgcggaagcgatcatcgctcgggaagatatcgaagcccggaatcgcttccagtttatccagcgtgccgccggtatggccaaggccacgacccgagatcatcgggacatatccgccgcaggccgcgaccatcggccctaacatcagcgacgtcacatcgccgacgccgccggtcgagtgcttatccaccaccgggccattgagattaagtgatttccagttcagtaccgtaccggaatcacgcatcgccatagtcagcgcgacccgctcaggcagcgtcatgtcgtggaaatagatggtcatcgccagcgcggcaatctgaccttccgaaacggtgttatcacgcacgccattgatgaagaagcgaatctcctcttcagtcagcgcatggccgtcacgttttttgcgaattatttcttgtggcaggaacaaggtaaccccctggttcagggaaatcaggatggggaacaggcggtcagcgaccgcctgaaggatcagtaacccgctttgctggtgtcgctgtcatgacccagggtgttgagcaggctcgccagcaggcttgatgcaccaaagcggaaatgacgcgcatcggcccagtcggcacccagcgtctcttccgccattttcagatagatcgcggcatcttcagcggtgcgcacgccaccagcgggcttaaagccaacctgctggctgacgcctttatcacggatcacgttcatcatgatctgcgccacttcaggcgtggcgttaaccggcactttaccggtagaggttttgatgaaatcggcaccggcatcaatggcaatctcagaggcctgacggatcagcgcttcctgcttcagttcaccggtttcgatgatcactttcagcagcacatctgcttcggcacaggcggttttacaggctttcaccagatcgaaaccgacctgactgttaccggcgatcagcgcacgatacgggaacaccacatccacttcatcggcaccgtaggcgatagcggcgcgggtttctgccagcgcaatatcaatgtcgtcattgccgtgcgggaagttagtcaccgtggcgatgcggatctccggggtaccctgctcgcgcagcgttttacgggcaatcggaataaaacgcggatagatacagattgcggcggtgttgcctgccggggatttggcctgatgacacagggcgatcacttttgcgtcggtgtcgtcgtcattcagggtggttaaatccatcagtttcagggcgcgcagggcaaggtctttgatatcggtcatgaggctctccaaaggatcggggtgcaacccaccggctcgccggcggaatgttataataataacactctgatgccgcctgatatgtgccaggagtcacataggaataagaaattagtgcaacattgccacgtttactgtgactaacattacagataacagggcttggtggttattatacgccagcgggtgcaatgttactattatcacatttaagcgcgaaggctgcaggtcgggtgagacgcgggcggtcagttgcgcagcgccgggaaagcgggatcgagctgaaatagctgctgactgttgtgccacagcgcatcggcaatctcctccggtgactcttctcgcaggctgcagagcacctcccacacctgacgcgcccgctccggacgattaggctggccctgaaagccctgcagcggcatatcgggtgcatcggtttccagcagcagcgaagagagcggcagctgcgccacggtctggcgggttttgctggcgcgttcataggtaatggtcccgccgatgccaatcgcataacccagcttaataaaggcctgcgcctgctgcagactgcccgcaaaaccatgcaccacgccacggcgcggcagatcgtaacgacgcagaatctgcgccagtttgtcatgagtgcggcgcgaatgcaggatcaccggcagctgatacgctttcgccagcttaagctgctcctcaagaaagcgttgctgcttatcaaactgcggatcgtcgcgatagagatccagcccgatctcgccgatcgccaccagcttacgcggccgctgttgcagtaaggtttccagctggtcgagatgggcctcctgatgattttcgatgacgatcggatgcaggcccagcgcggcatagagcgccggttgcgccgcggctaacgcgcagacccgctcaaagcggctggcatcgatcgccggaacgataatcttttccacgccagcttctgcagcacgtgccaggctgccagagatatccccttcaaacggcgggaaatcgaagtggcagtgcgtatcgataaacttcatgccagcgatcctttgtcgtaatcagcatcattatccgccagcggcggtgtgatgatgaggcgggtatcgggtgcattggctaccggagcaggcggcgtaacgatacgcgccgtggtcatcggttctgcatcactcagccactggcccagcgtggcgaggaaatagcgaccgcaacgccgtcccagatgataatcctgattcagtgaagcgatgcggctccccagcgcactgctggccagcgcatgcggcggaaagatttctataatgcgcaaatcatcgggaggattctcaatgaactgctgaatttcccgatagctctgttcatgcttattcagcacgttgatcatcggctgcagtgcgccggtgctgagccagcgttccatccgcttaaaccatttcggggtgtagaacatctgcgagggcacggtgcggatcaccacaatggtatcagcgccacggcgggcggcttcacgcaccggaatcgcatcgctgatgccgccatcgagatagctgatcccttccagactgacccccagccggtaaaaaccgggaatggcactggaggctttgatcagatccagccagttatcggcggtcgggttgaagtagccgggcgtgtagtcgtcactgcggcaggcgcacatataaaactcgcggccgctggagaaacagctgctccgcgctgctcatcgccagcggaaattcactgcgggtaatatctatcagccagtcgaggtcgatcagattgccaccacgcacaaagcgcagcggatcaaaaaagagtttactggtggtatagcgggtaatcacacgtcgggcatagccgggctgaccacagacaaaggcagaaagattttgtgcaccggcagaggtgccgagcatcagctgaaaggggttgaatcgggcacgctgaaattcatctaacacgcctgcggtgaaaatgccgcgttgaccgccgccttcacaaaccagcgcaattttctgagatttaaacggagtcagggccagaggttcaatggcgccgagcgtgacaggaatgcgtatacccactgtgcgaacctcaaaaagcggttccgggtctgctggaggatcgatccgttaaagacggcagcattccggagaaccagtcatatgttcctttaaccggcaggccagcagggctggcttgccttgcagcgatgtgaaggtgtccctctcttcacgtcagtcgctacagatgactggtctccgctctatgctttgcgttgcattacactgcaggactcatcggctaaagctttttacggccggtaaacaggctgatgaggaacaggataataccaacgacgaagacaactttagctgcccatgctgctgtgcccgctaaaccgccaaaacctaacgctgcagcgatcagtgcgatcaccagaaaaataatgccccaacgaaacataagcctctccttaccctatttaaaaatcgaatattttaaaatcgatctgcttatttcatccccggatgggtatcttttattcgtacggccacagaagtggccgtacgcaagcttaagatttaaccgtcaggtcattcttaacgcttttcacgccttcaatggctttagcaatgctttctgcacgatctgactgtgcctgattagcaacctgccctgaaagctgaacaacgccgtctgtggtctcaacttttacgttgcgcgacggaacaatgtcatccgctaatagcttagctttaatttcgctggtcgtggcggtatcgcccgcataacctttcattgatgatgctttgctgtctctgacgtgtagtttgtcactgacggatttaacaccttcgattttctgcaccacagccacagccttctcagcctgatcctgtgaggtgacgaaaccgcttaaggtcacgacgccgctatgcgtttttaccgagatatccgtgcttttaattgcgtcatcatctaccagcgccgctttggctttggcggtgatgccgctgtcatccatataaccatcgacttttttcatagaactatcgatttttgaacccgcgctgtcggctgtctgtgacgctttctgcgacattgattcgtcagccagtgcgctgccgctgatcagtgctgagccaatcatggcggccatcagggttttagcaatcttagtcttgttcatcgatatcttccttctatcagttaactcacccaaaaactgtgggcgcaacagaggcacaggtgccgctgcgttacaggacgtaaggacaagagaagtctcttccgccgtccgatagagtaatcatagacggcattttgcaatttgcctggctaactggttgatcacacgtcaaaacagaagaaaaacggggtttttaggaggagtctggaaggaggaaaacagggccactcccagctggaatggcccggaaacaggcgattagtgctcgcgcgttttgcggaaacggacgtcagggtaacgttcctgcgtaatattaagattaaccatggttggcgcgatataagtcaaattattaccgccatcgagtgccaggttaacttcgtttttgcgctggaagtcctcaaactttttcgcgtcgctgcattcaacccagcgcgccgtagagacgttgatcgcttcgtagatcgcttcgacgttatattcgcttttcagacgggcaaccaccacatcgaactgcagcaccccgaccgcgcccacgatcagatcgttgttatgcacgggacggaacacctgtaccgcaccttcttcagacagctgaaccagccctttaagcagctgtttctgcttcagcggatcgcgcagacgaatacggcggaacagctctggcgcgaagttcggaataccggtgaacttcatgttttcaccctgagtaaaggtgtcgccaatctgaatggtgccgtggttatgcaggccgatgatatcgccaggatacgcttcttcaacgtgcgaacggtcgcccgccataaaggtcagggcgtcggagatcaccacatctttgccggtgcgcacctgacgcagcttcatccctttttcatatttaccggacaccacacgcataaaggccacgcggtcgcggtgtttcgggtccatgttggcctggatcttaaacacgaaaccggtgaacttctcttctttcgcttctaccgtgcgggtgtcggtgtcacgcggcatcggacgcggtgcccatgccaccaggccatccagcatatggtcaacgccaaagttacccagtgcggtgccgaagaagaccggcgaaagtttgccgctcaggaaggcttcctgctcaaactcgtgcgatgcaccctgtaccagctccagctcttcacgcaactgtgccgccagatcgtcaccgactgcggtgtcgaggtccgggttgttcagccccttcacgatgcggacatcctgaatggtgtggcctttaccggtctggtagagataggtctcatctttgtagaggtgataaacccctttgaacagcttgccgcagccgataggccaggtgatcggtgcgcaggcaattttcagctcgctttccacctcatccagcacttccatcgggtcgcggatgtcacggtcaagtttgttcataaaggtcaggatcggcgtatcgcgcagacgggtaacttccatcagcttgcgggtacgatcctcgacgcctttagcggcatcaatcaccatcagacagcagtcaaccgcggtcagcgtacggtaggtatcttccgagaaatcttcgtgacccggggtatccagcaggttcaccaggctatcgcgatagggaaactgcatcaccgaggtggtaatggagataccacgctgtttctccatctccatccagtccgacttagcgtgctggttagagccacggccttttaccgtaccggcggtctggatagcctgtccgaacagcaacactttttcggtaatggtggttttaccggcatccgggtgcgaaatgatcgcgaaggtgcggcggcgtgccacctcttctaaaaagggattagacatggaattcttctcaataggcagcgcaatttactggcgctgctgataaatcacggtggccggcagaaccttaccggcgggtaaacggtgccaaaaacgatctttcatcgttggcgggtcagcgcgaagttacattggcgtgaattccggttacctggtcagctttaaggcggcatagcatacaatattttgcgcgcgcggcctacagggagaggggcaggatttcaggggcggggaatcggggaacggtggatgccacaacaaagcgggacgggtctgcaccctccccgcctccgttatcccagcacctttctgacgcaggctttgaagatctgcacaccaatctccagcgagtcgagatcaaaatgcatgtcgggatgatgcaatccgggcgtcaggttggtgcccagcccccagaagcccgcttttacacccggacgcttcaccggatagtagaaaaagtcctcgctgcctggcgtggtccgggttgacagcgcgccctcttcgcccagcacctcgacgaccgcggcgcggatcaccgccgtcgcctcatcatcaatctcggcggcgggcatctcttttaatacgcggacctcggcgctggcacccagtgccgccacgctgtgagtaatggcgcgcgtgacctgctctttcagcagcgtcatcggcccgtttctcctgcgaacgcagatcccagactacgcgggcttcatccggcaccgagttggtgacaccggcgtcgcacaggaagcgggtcgctttgacgctccaggtcaggccgggcgagaggtggatggcgttgaccgcctgaaccgcctgtacggcagcatccagcgcattcacccccaggtgcggacgcgccgcatgggcgggctggcctttgatggtcgcttccagcgtgctgcaggctgagtagagcaccgcaggcaccgcctggccgaccacgcactcctccagcggacgcagatggaaccccagaatcatctccacatcatccagtgcgccaccttcgatcattgagagcgcaccggcgcccagctcctcggcgggctggaacaggatctttagccggccacgtttcaccgcgccctcctgcagcagagccgtcgccgccgtcagcacgaccgaagagtgaccgtcgtgaccgcaggtgtggcgcgcacacggcacgccatcaatgatgtgccccagcgcatccatatccgcgcgcagtgccagcaccggacccggcacaccgctgtcgatctcggccacaatgcccgtggtgttattgatattgcgcgtcaccttcaggcccgctttctccagctgatcggcgatgtaggccgaggttttcacctcctgaaaacccagctccggaatttcgtgtaaatagtggtaatgctctaatacctcagacacagcgttactcctgaataaacagacgcataacagacattgcgatcagcgcgttgatgatgctcaccagcatcagcagcggccagtatttttttggcacatcggccacgcccagcagccgtcccatatattgcagctgcgatcccatcaggaaaatcgccggggccagaatcgtgatatccgcgccggtcagcagccctttggtcagcagactcaccgctacgccggtacccgccgacgatgagagccaggcggtgagcagcaccgtaattgcctcacccggcaggccgaacagccccatcactggcgcaaaaacgtgcccgagaaactgcatgatgccgagcagattgagcacttctgccagcacataggccatcaccacatttggcatcaggttgtgaatggcaatgtgaaagcctttacgcgcgccggtcacaaacacatcaaagggattactgctggtcgtgattttattttccatcggcgaaatccttcttataaacactgtttaacacagcgcgcgttatcgccgcaccgacaaatttcagcacgaacattaataacagcggaataataatcggcagcgtcattgaggcgaatagcgcggagccgatggcgaagtaattattgattaagccggcaccggaatattgccaggcactcatcaccaccacctcttttttaccgatctgtttctggtcggccatctctttggttaatgccgcgcccgcgtcggtactttgcaggtcggtgattaacgccagaccgcaatggcccggcagccccatcagcggcttaagcagcggcgtcagcaaccgatgcgccgcgcgaatcgcgccgtagtgggtgaagatttccagcacgcccagcgccagcatcaccgtgggcgtcagcgacagcgcaaacaggaaacccgctttggcactgagtccgcctgcgccaagaaaggtgttgctggcgggatctttcatggtgccaaagctgccgcccagcgtggtgaagtcaaaggcgccaagccatgaaagaccctcgacgttataaaacagccctgagaaaaacaggatggcaaaaattaacgcgacataactgcctttggtcgccgtcatttttaccggactaataacactttcatctgacattattttctcctgataacctggcttgccgcctgttccctgccgtggcaagtttcaatatatggaactgagttctaagcatgatttatgccagagccgatcggcgcgcgatgattaatgaccctgctgtcacctctgggcgtttaatccacgccatgcctgttatggctctgcgaaatatctttttctgacggcaacgtgatatttccggcgcgtcatcagatgaccgctatttctccagcttcagcggcgattgcaccagcaggatagcgaccgggcgcactatcatggtgctgaaattctgattttgttgcccgataaggagtgatgcagaatgagaatcgctcgtattcaatttgtgaaataattctatttaaatcaatcagataaattagctgtttttgcggaaaagccttcgctttactaacatatttgatgcataattcaccgactatacctgtttatttaacatcttcttaaaaggactcggccatgctgactgctgaaatgactgggcgtttaaacgaccagctgaacctggaatttttctctgccaatctttatctgcaaatgagcgcctggtgcagcgacaaaggctttgagggtgccgcttccttcctgaagatgcattcacgcgaagagatgcagcatatgcagcgtctgtttgattacctgagcgataccggcggcatgccggtgctgggtaccatcgctgcgccgccagtttctttcacctcgctgaatgaaattctgcagcaggcgctggagcatgagcagctgatcaccagtaaaatcaatgaactggcccatgccgccatgacctcacaggattactctaccttcaacttcctgcagtggtatgttgccgagcagcatgaagaagagaagctgttcaaaaccgtgctggataaactggcgctggtcagcaacagcggcaacggtctgttcctggtcgataaagatctgggccgcatgagcaccgagaaaccacgcagaataatgtttatcggccccttttcggggccgatcttattgccgtcttgctgacaccacggcaccgctattccagccggtaattcgcggctttcccgccattgacccatagttcacggctttcacccgcaggcagtaacagcgcgatctcccgccaggctggctggtaatctccacgtttttccaccgtcaggtcgatacgcgtggcgctgctgcagagcgtccagcgaagccatagcgcattcccctgctgccagccgtggctctcgccatcgtcatcaaacatttcgccttgtgtctgcacgccttcgggggcaggccatagctgccattgccgcaccgtatcacgccgcgcatcggtggtgctttcgcactcgcccagcgggatcaccgcaccggcccgcaccagcagcggcagccgatccagcggcgcatccagcgtgatggtctcaccgcccgcaaacgccttgccgctgtgccagtcataccagccgccgcggttacggggcagatagacttcacgactgcgcgcgccctgctccactacgctggcgaccagcagatcgcgccccagcataaagtcatcacactcctgataggtcagcggatcctgctcgtgatcgaggaaggtcgggcgcagcatcggctcatcttccacactggcctgccacgccaggttatagaggtagggcatcaggcgatagcgcagccggatcgcctcgcggatcatcggcgtgacctccgggtacatccagggctcgtttaccgtgtgatcgtcattccaggagtggatagtaaagcgcgggtgcataacgccattctgaacccagcgcacaaacagctcggcatccggcttatcgcccgagaagccgccgacatcgtgcccgacgttaaacagcccggagaggctcattcccagtcccatgcggatgttgtagcgcagggtttgccagctggtgcggttatcgccgctccaggtctgtacatagcgctgcatcccggcgcagccggaacgggagatcagataagggcgtttgtccggtgcaaattgctgctgggcttccattgaggcgcgcatcatcagcaacggcattaccggccggatatgcttgatggcgatcggctgaccaaaaccgtgacagcgcgcttcgccatcccacacctcatattcgttgttgtcattccaggtggaatcgatgcccttttccagcagctgccgggtgacattttcctgccaccagcgcaccgcctgcggatgagtgaagtcgaggtgcgagccttcatcgtcccagaacaccgaacgctcaggacgatcctgctcagagtcacgaataaacagcccctgcgcagccacttcctgatagcgcggatgatcctgcagcaggcagggtttgatgttggccgccagcttcattccggcagtatgaaacgcgtcgctcagcgcattgggattcgggactttgtcgtagttccagttgaaaacgtagcgcttgttgttaatcgaggtgtaacccgatgagagctggaacgagtcgcagggaatttcatgctcgcgacacagacggataaaggattgcagctgctgttgcgcgtcgggcgcgtcggtatagtgcatggtggacccgctgtagcccaggctccacttcggctgaaacagggtgcgaccggtcagacgcacaaaggctttggtgacgtcgagcagcgtcgggcccagcatcatgtagtaatcgagatcgcccgcctcggcgcggtagcgacgataagggagatggtagttatccagctcattccccagatcgagccagctgctgctcaggttgtcatagaacaggccaaaactgacgccatcgcgctgcgtcagggtaaacggaatatgtttatagagcggatcggtgctggcggcgttgtagcccatggcgtccagattacgcatctcaaaacggcggttaacgcggttcaggtcgccgctcttctcgcccaggccataaacccgatcctgcggctggcgacgctgatagtgctcgaccccatcgccgtgcgcattgagcagataggcaccggtgtgacggtcggcggccagcggctgccagctctcaccatcaaactgctcccagctcaggcagagcggctgatgcaccgtgacacgcagccgttgcgtgctgatgcgcaactgctgcgcatcgtgttcaaccttaaatgccggcagcgtaaagccatccagcgcctcacgatcccgcccctgccagggcacgtcgttgacaggcgcaatgctccaggtgcggttcagcgccagctcaccgtcgcgcttcagcagcacgcgcatcagcttatcctccagcacgtaaagccgcaggaagtgacgatcttcgaccttgagttcaacaaagtgatcggcctgctgatgcatcgtccagttcttcagggttttcatcgcgatatccttatgggttagcagggcgctggcggcgtttcggcgaccagcatcaccaggaaaacggcaccaatcaggtcaaagaagcccatcgccacaaacagcggattgaagccgatggtatcggcggtgacaccgataatcagcgagaagataaagctggcgatccaggcgcaggagccgcgcatgccgttgaccgtggccatctggcggcgatcaaaacgctccaccaccagcgcgctcagcatgcaggagatcacctgatggccgaagccaccgacggagatcagggcgatcgccagccagggatcttttaccagcgtcatcagcgccagggagaccatcagcagtgcgccggtcaccgaactggcgacaatcgaattcacacgggtgagaccaaaccagcgcacatagattttggtcagatagccgctggcgacgctgccgaggtcggcggccagaaacggcagccaggcgaacatcacgatctgtttgagatccatgccgcgctcattggccagatagagcggcacccagaagctcagtaccgcccaggccggttcggccagaaaagccggaatggcgatgccgtagaatttcttctctttaccaatcactttcagcgcggtgaagaacggcagtttttccccgatcgcttcgttgtcctgattaataaaggcccgctcctcatcagagagacgaggatggctctcgggcgagtgatagccccaccaccagagtgcaacccacagcaggcccagcccgccggtcagcagaaaggcgccctgccagccaaacgttatgtgtgcgacataaataatcggtggtgccagcatggcaccaatcgaaaagccgacgcccgcccagcccgccgcgaccggacgctcctttttcggaaaccagtcaccgatcgctttggcgttcgcgggcgttgccgccgcctcagaggcgcccatgacaaagcgcagcaatgccagatgcagccagcttcccgcgccggcgtgcaacagacaggtcaccgaccagatcagcgcacagatcaggaagcccatcttcagtccgatcacatctatcagccagccgcagattggctgaaacagggtataggccagctgaaacgccgccaccacccaggagtactgttcggtcgtcatgtgcagactgtttttaagttccggtgccagaatgccgagcgagttgcgggtgatgtagttgacggttacacccagcaggaacattcccagcatccaccagcgtaaatttttaatcacgcgcaccgtgcgggatgcactgatgggtttggttgttgattcgaggctcattgtgccactcctgattgccattgatgacgcacaccgcctgctggcgtaccgcgtgtcctgtaacgaacttagaaaagtgcgaaacgtgggtacagacacttttttgcaacgcttttcatggcaggctgaatcccggcagaaaatggcactgaaacgcttatctgacgcgattcagcatgttatgaaaaatttttcatcagcagatttgaaggcgatcacagaatgaaacaaaggctgaaagtaagcgaaattgcggcactcagcggcgtctccatcagtacggtgtcgcgggtgctggcgggtaaagccaatacccggcccgccacccgtgacaaagtgctggccgtggcgcagcagcagggcgtgctaaacaacctgcacagtggtcgcctgctgctgaataacctgatggtttttgccccgccgcgcgcctttgatgtacgcagtgacatcttctactacaaagtgattcaggggatcagccaggcggtggagccgcatgaggtgcggctgcgctactgcccgctggaggaggtggaaagtgatgcggcgctgtttatcgataagatgcagcagaccgaagcggcactgctgatcggcattgatgatgagcatattcatcagctggcggcggagatgaacaaaccctgcgtgctgattaacgcccgcgatcgccgaatgcgtctgccttcagtctcgccccatcatcagctgattggtgaattctcagcgcgctatctgtttgagcagggacaccggcagatcctgtcgctgcattgcttacgccgctacaccatggagcagcgattgcagggggtgcgcgacgcctggcatgccatgaacctgcggtttgacagccgccagcatctgctgaccctgaacagcttcagcagcaatgaagcggcggagcggctgagtgaatatctgcgccactgccctgatgcgctgcgcccgaccgcgattctcgccagcggtgattatattgcggcgggcgccgtcactgcgctggagcaggccggtctgcgggtgccgcaggatatttcggtgatgagtatggatggctttaacctggccgctatccacgatattccgctgacctcggtgcaggtgccacgtgatgagctgggcgcagcggcagtgagaatgttgcaggagatgcgactgaatcccggcacacccactggcagcctgctgctgaatggcaggctggtggtgcgcgagtcggtgcggcgcattcgcgataatctcagccatgcgccggtccagcagcatggcctctatgattaacacggtatggattaacacggtatggattaacccggcgcgggttaacccagcgttttcagccgcagttccgacggctgaggccgtccgaaacaggaagccctggaacagggtacagccctcatcgcgcagcttagcgaactgctcatcgctctccaccccttcggcagtaatctggatatccagactgcgactcatgccggtgatggcgcggataatcgccagcgcctcgcggctgtcacccatatcattgataaaggatttgtcgattttgattttgtcgaacgggaaagatcgcagatagctcagcgacgaatagccggtgccgaaatcatccagcgcaatctgcacgcccagtgccttgagattttgcagggtacggatattacccagcgaatcatccagcagcaccgattcggtgatctcaacctccagccgcgccggatcgagacccgactctttcagcgcgccttccaccaccggtaccagcgagctgtttttaaactgcagcggtgagaggttgaccgagaccgactgctccccttcccagctcgccgcttcgcgacaggcttcgtagagtgcaaacgcccccagcatatggatcaggccggtctcttcagcgatcgggatgaagtcgttgggcatgatcagcccgcgaatcggatgatgccagcgcatcagcgcctcatagccaatgatggtgcggttatcgccgttggtgatgggctgatagtagagccgcagatgcccgccgctaatcgcatcgcgcagatcgttttcaatcaggcgtcgactgcgcgccacatcatccatctccagcgtgaaatgctcataacggttgcgaccgttgcgtttggcttcatacagcgccatgtccgcacagcgcagcagctgctccggcgtattggtgatggtggtgctgagcgcaatccccacgctgagcccgaccgacagattatggccttcaacgttgaccggcgggcgaatcgcctcaatcagccgctgcgccacaatgctcgcctcttcattactggccaccgaaggcagcacgatggcgaactcatcgcctccgatacgcgccagagtatcctggtcacgcagcgcgttacgcagacgcttagccacactgcgcagcaactcgtcgccaatctggtggcccagcgcatcgttcacatttttaaagttatcgagatcaaggcagagcgcggcggtctggcgctgtatctgaccggcagtgcgcaaggcttcactcagacgctggcggaacagaatgcggttcggcaggctggtgaggttgtcgtggtgcgccatatggtgaatacgggcatcagcagcgcgctggtcagtgacatcttccaccagcagcatcaggtagttacgtcgcgcatcctgaccgttaatcgcggtggcgcgggtatgcagaatgcgttcgccgctggcggtcatcagcaactgctcacgttcatgcatgccctcactgcgcagcgcaacatccgccagattattaaagtaatcgctgagttcgggcgacatacattcatgcgggcgcttgttgacgatcagcgatttcgacaggccaaacagctgctgagtgcggtcgttaaccagcaggatctcgcgggtgatcgcatcttcaacaatcacgcaggagggaatgttggcgatgatattatccaggaatttagagagcgcggttttctgggtgctctgggcttcagccagatcccgggcgcgcagcacctgctgctcctgctcacggcgttccgtgcggtcgcgggtgatcttagcgaagccgaccagcttgccgtcatcatcgtggatcgcgtcgatgaccacatgcgcccagaaggcgctgccatctttgcggtagcgccagccctcatcttcaaaacggccggtcttaagcgcgataccgaggttcgcttccgggatgcggttcagccgctcctgggaactgtaaaacagcgagaagtgctgacccaccacttcatccgctttgtaccctttggcacgctgcgcaccggcattccagttcaccaccacgccgtcgacatcgagcatatagatggcgtaatcggtgaccccttctaccagcagacggaaacgctgctcctgctcccgttgctggctgcggacgcgctgctgttcggtgcagtcgcgggtgattttagcgtagcccagcagcttaccctgatcgtcgcggatcgtgtcgatcaccacatgcgcccagaaggcgctgccatctttgcggtagcgccagccctcatcttcaaagcggccggtgcgataagcagtttgcaggttctgctccgggacacggttcaggcgatcctgggcgctgtagaagcgggaaaaattctggccgacaatctcttccgccacatagcctttggcgcgctgtgccccggcattccagttcaccacgttgccgtcatgatcgagcatatagatagcgtaatcggtaacgccctccaccagcaggcggaagcgcatctcctgctcccgctctttgcgctgctgctcctgctgctgagtacaatcgcgggttatacaggcgtatcccaccagcagaccggcgtcattgcgtatcgggtcgatcgtctcgtgtgcccagaaagcactgccatctttgcgatagcgccagccttcgctttcatggtgtccggcagtggcagccatatccagcccacgctgcggcaggccccggcggcgatcttcttcgctatacaacagggcaaagctgcagccaatcatctcgtctggcgtatagcctatcgtgcgctgagcaccctgattccagctgccgatgataccgtcaggttttagcatagtgatggcgtaatcattcacgctttgtaccagcatgcgatagatgacctcagagttattatccattgtgattagcctgctgctctgtagccggatgacggcttaggaatgttcttaatagcgtgcgcagactacagccgaaaagagctgagatgacaagcgcattaagaagattaatcagtgtttataaggggtttatcggcagcggcgagtaaatgttcaatgactccgcggtggcggcgcgtcaggcgacccgctcccagcgcgaggagagcgaataacggtgctgccagcagagcattgccggactttggctcatcagctgctggcactcttgcggcgcgacaaacgccgggatcactttctgggccgccgtctgtctgatcagcgccagctgatcgtcgagtggcggatgcacattccacggcagccagcgtgccatgccggattgcagcatctcaaaggcacgagtgccgctggaaacgtgactgctgaagatcagacgaaagtcgggctgatggctgagctgcgccgccagcccgctgtcagccaccgcatccgccgcgacaattaccgtatccggtcgccagcggtcgggtgttgcgacgcgtaataaccgggccagcgccagcatcgccgcggcgggcaggctgttgagcgccagcaactgcgccacctcttcgcgcacctggggacacatcaccaccggcagcccgcgagcgctgagctgcagggccatctcagggccgcgcccgtgcagcggcgcggtgaccacggcgcccccttgtgccgccagggccagcgcgtcgatctgctgcgccagtcgctgattgcggtcgccataggaaccatcggtaatcaacagccgtgcgcgtggcgggcaatcaaacggcaacagcagcgattcgcgactccagtcgcccatataggtgatgccacccgcaattggcagatgaaaccagatcgatcctggcgaatgcccgctgcgaccggtaaagagattcagcggccccagcgcgcactggccgcgcaatggcaggatgcgtcgcgcctgagccggcacgccagcctcgcccagctgctgccaggtaatctcactggcatagaccggcggtgaaccgatgtcggcccagctatccagcgccgccgcgtgatccacatgggaatgggtcaggcagagcgcatcgacctggccgatggcgtccattgcgggccggacgcccggctccggcccggcacctaaatcccataacagacgatatccctctatctccagcaggaaagcggcaggcagttttccgccgacgccgctgatcaccctcaggcttgccatggcaggactccctgcggcagacggcgcgtcagtcgtgaggccagcagcattaagcccagcacgatcccaatcatcaggcatccgaccgccgccgccagcggcgccgatccgccttcatccaggaaaataatggtcgggccaagcgtctgggtttgcgcggtaaccagcagcactgaaacctgtatttcattcagcgcggtgaggaacaccagcagcgcaccggccagcacagaaggcgccgccagcggcagcaggatgtcagtcatccgccgcatcagacccgcgccgcataagcgcgccgcctcatccagtgacggttcgatttgcgcgaacccggccagcgtcggccttaacaccagcgccaggaaattggccagataggccgcgagaataatccacaccgttccgtaaagggaaaatcccagcagcggcagcggtcgcaggaaaaacagcatcgccgctacgccggtgacaatgccgggcagcgcataggtcagctcactggcgaatcccagcccccgcaccagccgggtacgatgccagctgagaaagaaagccaggaacagtgccatgacgctgagcagcagcgccgtcaggccggtgagccacaggctggtaaagaaacgcctgccgtatcgccggatagccccatagcgcctgctgaaaattctccagcgtcagggtttgccagttcagagcctgaccgaaaccgcgggttaaggcggtggtgagcaatgcgctgagcggcagcagcaaggtgatcaccatccacagccaggcgatgatttcgcccggcagtcgcgcgcgccgcagcggctggtgccagggtcgtggcgatccgctgacccggacatcgcgtcgtccgcccagccagccgctaatcagcatcccggcgagggtgatcagcgcaatcagcatcgagtagacggcggtattgggcagcgcaccggggccgagggtattgagctgctgataaaccagcgtaatcagcgtcggcacccgcgccggaatacccagcatcgcctggataccgaaattcccgaccgcagcgacaaacgccagcgccgccccggcgaagatcgcggggcgcgccagcggcaggatcaccgtgaacagaatttgccggggtgatgcgccgctgatgcgggccgcctccaccagttcggcggggagtcgacgcaggccagcccgcaccgtgaggaacaccagcggcgcattgtgcagacccagcagcagcaccatgccggtcgcggaatagagcggttgctgaccgggtgccagccacgtcccgcccagcgcattcaccgctgtggccagcagactgcccggtgccagcgcctgtatccaggccagcgcagtcacctgcggcgggatcatcagcggcaggataaaggcaaatacccaggccgctttggcacgcaaatcggtgagcgccaccagccaggcggccaccgttcccagcagcagcgacagcaacgtcgcgctgatgccgatcgccagggtattcagcgtggcactgagtacccgccggctggtcagcaatctcagcaggcgatcgctatccagtatgccatccggtgccagcgcggttcccatcagccgggcaaagggtgccaccgacagcaggccgatcaccagcaccagtatgcccagcaccagcggttccgcccgccatctgcgatgcctggcggcctggcctcttcgccattcgttgcccagcacgctcacgatcagccgccaaacagttcagtaaaggtttcgcggacctgagcatcctcggccaccgcctgggccacgtccggcgtcagcagcgtgatttgctcaatcggcgcaaagccaccgggtgccgccacgcgggcatcgaccggccggttgccctgcttcgccaccagctgctgtcccgcttccgacagcatgaaatcaacaaaggctttggcggccggcagattatgcgccgacttcatgatcgccaccggctcggtcacataggagacgccctcctgcggatagaccagatcgatgggcgatccctgctttttggcgcggataatatcggcatccgtgatcacgccatacttatccatgccgctggcaaccgctttcagcgccggtccattgccgccctgtggcgcaatgccgatggcggccagttgctgatagaacgcccagccaatcgacggggtatggatatcggtatgcagcttatagagcgccgcaccggaatagaggggactggggaccgcaatctggcctctgttttcttctactgccagcgctttccagctactgactggcttcgcacgctgggtgttataggcgatcaccgtggcgataattttggtgccgaaaaaggttttatccacatcgtaataggcaggcttcaggtggctgaccggggcggccggatatgaatagagctgcccctctttcttgagcgcgcccagattgatcgcgtcggccaccagcagcacatcgggtttgacctggccgctcatcatctccgtgcgcagcacgttcatcagttgagtggtgccgttgcgggtccactccacctccaccgccggatacgcggccttaaacgcatcgatggtctgttgcgcaatttcaggtgcctgcgacgtgtaaaccaccagcttgccgccgggcgcgtcggccgcctgcaacagggttgaggccgccaggctcgatagcaacaacagcgcgtgaagcggagtacgaaaagccgttttcatggtttctgaaaccctttatgcaggaagaatccagccgtcatcgacggcgacgccgacggtgtcatccaccgccagtaatgcagcatcattaagcgtcagcgacaggctgacatccggttgattaagcggtcgaaggttgatctgatggtagccaccgcgaaagatgatgcgctcaacgcgggcggcaaactgccgctctccctcagcggcgaggtgaaaactgacgctgtggaagctggctttgccgtgtggcagcgggcgctggtgaggcgagcagcgcagcaaaacccgcagcccgcagagcgtggcggttgcctgacccggatcgagcggctcaatgtcgctgaccggcagcacccgcccctcatcaataaaggtcgccaccatctcattagccggttcgcgccacagggtctgcgggctggcgaactgcatcactctgccgtgttcgagcaccacgatgcggtcggccagtgccatcgcttcgcgttgatcgtgggtgatatagagtaaggtggcgccactgtggcgatggaagcggcggaaactcctcttccatggtggcgcgcagatggacatcgaggttagccagcggctcatccagcagcaccagcgtcggccgtgccaccaggcagcgagccagcgccacgcgctggcgctgaccaccggagagatcggcgggtcggcggtcggcgaagcgatccagcccgaccagcgtcagggcctgggtggtgcgcagttcgcgttctgcgcgcgccacaccgttcaccttcaggctgtagccgacgttctccgcgaccgtcatatgcggccacaaagcgtagttctggaacaccacgccgagctcgcgggcttccggcggcaggtgcagcccgtctgcggcaacctgccgttcaccgatgtggatttcaccgctgtcgagcgtttcaaagccggccagcaggcgcagcagggtggttttgccgcagccagaaggcccaagaacagcgacaaactcgccctggttaatctgtaacgaaaccgcgtccagtaccgggtgcgcgccgaacgctttgctcagtccggttaacgatattgccgccatcttactctgcctttgccgttaacatgctgggcaaaacgctacgacagtttgatgacagcccggtgacagccaggcttacgggacgcgaaagccgggctggcggagcggcatcggggcgtgctcgccccgtggcttactgctgggcggtgagcgccgcaatcggctgccagatctcggttaatgcgccctctttgccggtaaagggatcctgcgtcggcaacggcactttttttacctgctcctgggccattttcagcttcgcgggttcatcgcgcagcgtctccggcgacatcccgtgcggataggcgccaatcaccataaaatcttcgctggcgctgacctgccgatggccgacacccgccggaatcaggactgcatcgcctgcgcgcagggtcaccatccggccactgtcgccgccaaacagcacttccgcccagccttcagcgacgcccagcagttcatgggtattaggatgataatgggtatatgggaagatcggatagcgccaggcgggtggccagccgttctcctcgaaagttttttcaaaccacgcagcgatctcctcctcttccggcaccacacgcggccagataatcagaggtaacgggttattgggtacaccgcccgacgggctggcaagcatcagatgctgaggattgtcagaggccccggccgagaaggtgccagcggcaaaggacatcattaatagcagactggaggatgaggcacgcatacaggttctccgatgtttttctaagtgtggcaaacccgcggcacaatgcaatgtgcgccagacgacacaattgagataattgactgatattgctgactaaagccaaatgtgtcgttaactatagggtcggagtgtgcctgcgcgacggcggatagcggttcttactgcggcaaagtgttgcaaaatgtcaggcggaaagtcacacaggcgcagcagcccgacgccccggtcactgtcgtataaactgttatataaaaaaagcacagatctgtttctgatatgcttgactgttatctgttgtaatagctaacagatgacagtgaggtaacaaatggacgctattaaacaaatcctgattgacgagatcgccctgcttaaccgcgaagaacgtcgcgacaatttgccgcgtttcagcctctcgtttctgaagaaccaccctggtctctgggcagtaatgtacctctgctacggcctgtgcgtggcgctgattttcaccaccgagatgctcggctggcccgccttctggtttgccaccgtgtttgtgctggtgatgagtgtgctgatgctgctggatatcaacccgaaatatcgctttgaagatatcgatgccctcgatctgcgtgtttgctacaacggcgagtggtattacattcagccggtgcgcgaacaggcaatctcacgcattctgtcgctgcctgagacaccagaaacgcgtgaagagcggtatccagcgtctgctgacgcaaaaaggggaagtcgacttctatgatgtctactacctgacctggggccatcaggaagcggcgcgggtttaatccgtctgcccttccgccatcagctgacccagcttcacgattgccgcctcggcccgactatcccacggccaggcggtatttaacctgaagcagtgcctgaactgctcacctgccgaaaatagctgccccggtgcaatactgatcccctgagccagcgcccgctgatagagccgggtcgtattgatgctttccggcagcgtcacccagagaaaatagccgccacgcgcttcgctgaccgtagcctgcggcggcagcaccttcattaacgcctggcgcaccatctgctgtcgcttcgccagaatctgccgcagccgcttcagatgggtgtcgtaacgccgcgtggcaagaaaatcggccagcgccagctgcatcggcgcactggtagagagcgtgctcatcagttgcagccgctgaatacgctgcgcatgctgtcccgccgcgacccagccgacgcggaatcctgccaccagcgactttgaaaatgagccgcagtgcagcacgttcccctggcgatcccaggctttcgccggcagcggcggcgcatcacccgcccagagttcggcatagacatcatcttcaatcatcggtacctgataacgcgccagcagtgcgaccagctgctgtttgcgttccggcgttaaggttacgctcagcggattctgcagggtggtcatcagccagcaggctttcaccggccagcgctgcagtgcttcctccagctggacgaggtcgatgccatttctggcatcgaccggaatcgccagcgccttgagcttaagccgctctatcgcctgcagcgcgccataaaaactcggctgttcaatcaccacataatcgcccggctcggtcagagattgcagactgaggttcagcgcctccagcgccccgctggtgatgacaatttcatccggcgacagggtgatgccctgacgcgcatagcgctgcgccagcagctgtcgcagtgtggcgttgccgggcggcagattgtgcagcgcatcggttggggtcagatgatgagagacgttagccagcgagcgcatcagctggcgctgcggaaagagtgcgggatcgggaaaggcggagccaaacggcacgatggccggatcgcgcgtggcctgcagcacatcaaacacaaagtcgttgatatcgacctgttcactgatcgccacgctcagcggcgcgggtgctaaggcacgcggtgcaacgtagtaacccgactgtggacgggagacgatccagccctgactctccagcaactcataggcatgcagcaccgtcatcaggctgacgccctgctgcgcgacctgctgacgcaatgacggcagacgggtgcccggcagccagatgccggcctcaatctgctgctgaatctcatccatcaatcgctggtatttcgccacgggtgacctctccttgtttgaccgtgaatagtctgaccgcgagactttaccacgcacggcgaccaatgacaggcggcgcgaatcgctttatccgattgcgctgattcttcacggcttcaggcaggtcagatcacagcgacctgcggcgtcagcggctgcccggcttcggcttcggcattaagactcacttccgcaattgcctcttcaatttctgccaccacataatcagccagctccggcacccgctccgggggaaccggcttgcccagcagatagccctgcagcgtattacagcccaggctggtcaggaaggcctgctgctcagcggtttcaacgccttcggccaccactttcaattgcagcgactgcgccagcgccactatcgccgacacgatggtggcatcttctgtgtgatgctgcagctcgttcacaaaggcccggtcaatcttgagttcactggccggtagccgtttcagatagagcaggctggagtagccagtgccaaagtcatcaattgaagctttcaccccgagctgggtcagctcagtcagaatacgcacgctctcatcgggatcgcgcatcgcggtggtttccgtcacctccagcgtcagcagttcggccggaatctgatgtttttccagcgcatccaccaccgtcttcaccagattcgattgctcaaactgcaacgccgacaggttcaccgccaccgaccagtgcggatggccctgcagatgccactggcgcagctggcgacaggcttcatggattacccagttgccgatattgactatcattcctgtcttttctgccattggcagaaatttatcgggcgacagcaggccgcgctgcggatgctgccagcgcagcagcgcctcaaaaccgagaatcggaccgctcggcgcgcaatattttggctgatagaacaggcgcagttcatcatgatccagcgcctgccagagatcgttattcagctgaagctggctctgggcctgaatgttcatagaaggctgaaagaaggtgtagccgttgcggccattatttttggtgtggtacatcgccgcatcggcgttgaacatcagttcgcgctcatccacgccatcgccgggatagaccgcgatgccaagactcagcgataccaccagctcatagcgtgagatatcaaacggacgatccaccgctttgaccagcttatcggcgatggccgccgcatcattgggatcgtcgatctctaccagcagcacaaactcatcaccgccgagccgcgccagcgtgaagtagccggtcatctgctcgctcatgcgctcggtcacgccgaccagcagactgtcgccaatgtggtgcccgaaacgcgtcgttaaccgccttaaacccatcaagatccataaacatcagggcaaactgcctctgctcacggttcgctttgttgatcgcctgctccagccgatcctccagcaggatgcggttgggcagccgcgtcaggttgtcgtgcagcgccagctgtgccagctcgcgattggcttcagccagtgaactggcgagaatcgaggtacgcgcctgcatccgcgcatccagcatcgacaccagcaaggtaatgcccagaatcgaaatagtgaccaccgtgaccagaatcgccagccagttgctgttgacgccctgcccgaccggatgactgtagacgggaaactctgccgccatcatgccggtgtagtgcatgccggcaatagcacagcccatcaccaccgatgcgccaatgcgcagcagggtgacccggctggtctgtccttcccgcaggttaaacgccagccacagcgcggtgccagaggcggccagggcgatcgccaccgacagcgctacccagctccatttccagacgataccgggggagaacatcagcgccgccatgccggtgtagtgcatcgcgactacgccgctgccgaggatcagcgcgccgcctgccaggcgcggcaaaggcagatcgccattgcagaccagccacagcgcaaatatcgacgcacaaaccgcgatggccgcagaaaaggcggtgagcccggcgttgtagctcatgaccatctccatgttcatcgacagcatgccgataaagtgcatcgcccagatgccgatgcccatggaaaaaccgccgccgaacagccagaccagcgcaactttgccggttgaatgcaccacccgtcccgccatatctaaggcggtaaacgaagccagcatcgcgacaagaacggagacgatgacgataaaagagtcgtatgaggtcgctaacatagtgcattcccgcgaaagcagagcttgtggttgggcagagggttttaaaattattctcttagttatcggcacagcccggcggttaatgagccgcgaaccctgcatccttccactcattctgagtgatgaaatctatcgttgctgtcagcgctatcagccggacagtgacgccaccggctgtcgcagtgagggaaaactcagcgcctcaacccggtccgctggcgtcggcttgcccagcagatagccctgcaacgcatcaaagcctaagctggtgagcaaatgctgctgctcttcagtctccaccccttccgccaccatgcgcagattgaggctctgcgccagggtcagcatggcgctgactacggtcgcatcttcactgccgggccgcaggcagttgataaagctgcgatcaattttgagttcactggcatccagatctttgagatgcagcaggttggcatagccgatgccgaagttatcaatcgcgacgctgacacccgcctgctgcaattcacgaatgcgctgctggctgaaagcgggatcgcgcatggcaatcgcttcagtgatctccagcatcagcgcgctgcctggcaactggttacgcgccagggtctgcgtcaggatagtcagcaaatcacgctggtgaaactgcaacgcggagagattcaccgatactgtccagtcactgtggccctggctgtgccatatcctgagctgacggcaggcctccccgatcacccagttacccagcgcaataatctgaccggttttttcggcgcgcggcaaaaacagctcaggcgtcagtaaaccgcgctgcggatgctgccagcgcaacaacgcttcgaatcccattaacctggtgccgccggaacagaatttcggctgatagaatagccgcatctgctcgcgctctatcgcctcccacagatcgttcgccagctccagctgatgctgcgtcgcggcgctcatggccggttcaaacaggcaccagccgtttcgtccgctgtgtttggtgtggtacatcgccgcatcagcattaaacaatagctcctgccggttgcgaccgtgcagcggaaagatcgcaatgcccgcgctgagtgaaacgtgcagcacatagcggtcaagttcaaacggcgaactgataactttaaccagtttttgcgccagctggcgggctgcgctgatatcgcactcagccatcagcacaaattcatcgccccccagacgcaccagcagcatcgtgttgctgagctggctgcacagccgtttccgccaccgccaccagcaaccggtcaccgacgtgatgtccccatgtgtcattgaccgctttgaagccatcgagatccatatagatcacggcaaagcgatgctcattaagcatcgcctgtttaatggcgagatcgagctgctgctccagcattacacgattgggcagcgtggtcaggttgtcatgcatcgccagctgacgcaattcctggttagcgcgattgaggcgggtcgccagacgcgcggcgcgtagctgcgcatccagcatcgaactcagcagagtgatacccagaatagtcagggtaatcagcgttacccacaccgccaggcccgcattactgacgccgtgcggctgcatcatactgctgtggctgaactctgctgccgccatacctacatagtgcataccggcgatggcgatgcccatgaccagagaggccagcccgcgcatcagcatcagatgatgatcgccctggcgcagatgaaaggccagccacagcgccaggccagaggccgcaaacgcaatcagcacagagagcgccaccagcagcgcattccactccggttgcggttcaatcagcagggcatacataccaagatagtgcatgaccaccacacccgcgcccaggatcagcgtgccgcgcagcagccgctggcgggtgagatgcaggccacccaccgtctggccaaaagccagcacagacgccaggatcgccaccagcagcgagaggatcgtcagtcgcgtgtcatagcgcatcatcatcggcatcatcatcgccagcatcccgataaagtgcattgcccagacgccaatccccattgcgatgccgcccaccaacagccagaaccgggcgctccagccacgggataccgctacccgtccggcagtatccagggctgtaaaagaggcaatgaacaccacgatcagcgaaacgcagatcaggacgctatcccaggtgacaggcaacatgtgtaactcctcaccacccgcggagaaacgggtgctgtgtacagtctgataagtgatctgaaaacacccgatgggtgaaagtgattaaatttcggtattttctggtcctgaaggtcaggcaaaacgcgcccgccgacgctggcaatttataacctgcatcttattaaccgcccccagagcaagccggtaaaccgttattatgtctgattggtacaggaacatatcaccgaagcagaaagcatgccagataccgaaaaaacaaagaattttgttttatcgcctcgtcttcgcgccttgctgttactgggttatcggccggggtgacgttttgattaatcaaaaataaatagcaaggcttcgcgtaacgctttaactgatctatagtaagtaaaactgatataaatcagcattcttaagtctaagatttttcttaagatagcggcactgcctcccttgttattttatttcctttattttgggttgaatcgttaataaacaccgggtgaaaaagcactgactctggataatccgtaaggaaatattatgaaactcaagctttttctgtttgccgctgcaggattaactgtcgctattccgtcattaacccaggcggcgacgacctcgggaaccatcaatgccacgttaaccctgaccaccggttgtctggtgaacggccagtcggctacggcgggcgttaacttcggtaccctgaactttggtagcagcgcagccacgttcgataccctgaacgccacactggtcggtgcggctggtaacggtatttttgtgcgctgcaccaccggtcaggattacaacgtggtggtcaccagcagcaatgctgcgccagcgaccatctacggcaccgcctctgcatcgccgcgttatctggtgctgggatcggataatgcgcagggcatcgcctataccctctacagtgacgcctcctttaccacggcgatcgccaacaatacgcctatcgccgccagcggtaccaccgatccgacgctggggaccaactacgccatctatggccgggtggtcggcggcggctttaaccccctgatccctgccggaacctataccgacacgattaacgttgccgtgaactattaactgctgtcgcaggtaaatacgggtggttctctggcgatcctgcctgacgatcgcatgcggtctgcccctgctgacagggagtatcagcgcctggagtctgccaaccagcaccttccaggttaccgcgtcgattgtggcaggctgcgtgatatccggtaccaataccggcgtctttggcacgcttaatttcggtacgcagtctggcgtggcggcgaataccgtcaacgccagctatctgcagagcacctcgattaatctcgcctgtacaccgggcaccacgctgagcatgagcattaatcagggcaacaatttcaccacgacccgtaacctgaagctgcccaatttcagcaacaccgttccctacacgctctttagcaacgccagccgcaccacggtgatcccggtgaaccaggcggtgccgctgagttatagcaatgccaataacattacgctgccgatctacggtcagctacaactgcccggcactgcgcgcgccggcgtttataccgacacgctgaccgtcaccctgagctggtgaggtgatagaaaacaaggatatgatcatgaagccactgcgcgccctgttgctgctgctaagttccaccctgctctccccggccttcgccgcgaattcggtcatgatctggcccatcgatcccgccattaatcctgaagagaaagccagcgaactctggctggagaatcgcggtaacagcaccaccatgatgcagatccgcgtcttcagctggcagcagaaacaatggccaggagcagtatcagactcagcagcaggtagtcgccagcccgccgatggtgcggatggagccaggccagaaacagctggtcaggctgattaaacagacgccgcctgcggccggtaaagaactggcctatcgggtggtgctggatgagatcccgaccccgcgaaatcccggcgagaatcaggccgggctgaccttccagatgcgctattcggtgccgctgtttgtttacggtaccgggctgaacacagacagcgctcgcccggctctgcgctggcaacagatcagcgagggcggcaggcgctggctccagttaaccaacagcggcagcggtcacgcccggttgagcaatgtggcgattggcggtcgcaaactgggcgaaggcttatacggctatgtgctggctgacagctatcaccgctggccgctcacctcgccggtgagcggcgaactcaccgcagaggttaacaagagccagtggcgcagcgctgcccagaagtaagcgctgaatgagaccgttttccctgcatccctgcgcgctggccgtggccagcgtcatttacgctgttacgccggatcctgtgctggcggagacttactcatccctgcccccgccacccagcctgcagaccagcagcaacggtcagcaatatatgctggagctggtgattaaccagcaggagaacggcaatattgtgccggcagagcagcgcgacggtcatttctggattcgcagtggcgatttgcagcgtgccggcctgccagcggataagctgggccagcagccgcaggtcgatgtcagcagcctgcaacccatcaaagtggagtatgacgctgcgcgacagcgtctgctgctgaccgtaccgcctgagtggctgcccggtcaggtgattggcgaggcgaagaacggaccgcgctatccgggccgtaccagcagcggcgcgctgattaattatgatctttacgccagccgcacggataacagtggctcccgcctgtccgcctggaacgaactgcggctgtttggtgatgccggtcatttctccactaatggcgtctggcaacagcagctggaaggcagtacgacttatcaggatgatggctatatccgctacgacacctggtggagcaatgaagatgagaatgcggcggtaagctggcgggtcggcgatctggtcaccgactcgctggcctggagcagcagcgtgcggctcggtggcatccgcgtcggtcgcgacttcagcgtccgtcccgatctggtgacctatccgctgcccgccttttccggtcaggccgccgtgccttccaccgtcgatctgtttattaatggctatcgctccagccaggcgaacgtgcagcctggcccctggtcgatgaccaatgtgccattcgttaacggcgcaggtgacgccgtgatcaccaccaccgatgcggttggccgccgtgttaccaccaccatgccgttttacgtctccagtaatctgctgaaatcggggctgtcggactacgccttctctgccggggcaatccgcgaaaactacggcataaagaacttcgattatggtgaggcagcggccagcggctcttatcgttacggtatgaccgactggctgacgctggagagccacgccgaaggcagcgaaacgctggcgatgggcgggctgggtggtcagctgcgcgtcggcagctggggcgtggtcaacggcgcggtggcgcaaagtcagctcgatggcgagagcggcaggcaatatagctggggatatcagtacaacaaccgctggttcaacatcggcactcaacagacccagcgcagcagcgacttcggcaatctggcgctggtcggcagccgtgccggtagccaggcggatagccgctacgcactctcacgccgcagtgctcagtacagcgccagcgtctcgctgaaccgctttggcagcgtcggtgctgccttcatcgacatcaccgacggtcagggcgatcgcacccggctgtggaacctctcatggagtaaaaatctgtggggtaacagcagtctgtatgtttcggccagccgcgatcagcaggagaaaagctggaccggtgcaatctcgctggtgatcccgtttggcgaacagggcagcgttgccctcagcaacgaaacgcgaccagcgtggccgcgacagtcagcgcgtttatgcctcacgcgccatgcccagcgacggcgggttcgcctgggatgcctcctgggcgaatcagagcggagacagcggcgattatcgtcagggcagtctgcgctatcgcaacaaccagattgacacctcggcgggcttctatggcgatgatgataacctcacccagtgggccgatctctcgggtgcgctggtgttaatggacaacagcgtctttgccgctaacgagatcaacgacgcctttgtgctggtgaagaccaactatcccgacgttaacgtgcgctacgagaatcagtcgatgggacgcaccaatcaacagggctatctgctggtgcccgccatcagcagctactacccggccaaatatgatatcgacaccctcgacctgccggcagatatgaccacgccacgggttgagcagcgctttgcggtgaaacgccagagcggctatctgctcaacttcccggtggagaaactgcgctcagccagcgtaatcctggtcgatgcgcagggccagccgctgccggtatcaagcctggtgcagcgtcccgatcatcccaccgggtatgtcggctgggatggcatcgtctggatggaagatctcaccgccagtaacccgatgcaggtggtgacgcccgatggccgccagtgcgaaaccgaactgcgcatcgccagcggtcagccgcaggcgctgaaaacttacggccccctgacctgtgcgctgcccgcacctgccgcaggcagcgccccctctcccgctgaatcttttacgtccggaaaccgaccatgatgaaatctgtaatactggctggcctgctgctgttactgccgtcgctgggctacgcagcctgcgccctgcccgcatcgaccgccagtttcggttcagtcacaacctttgtggcgaacaccaccgtcagttccaccaccacgaatgccaacgtcaactgtggcgcgggtgccgggctgtcgctgctgggcaataaccagatcacctttcagctgacgggcgcgactaatagcaacggcacgcgcggtacgctgaaacgcagcggtgataccggcagcgataacgtgccggtgcggctctgcaccgacacggcctgcgctactgaactgacgattggcggcacgccgtttgtctatggttcgcagaccctgatcaacctggcgggtttgctcggcagccttaacttcgccattccggtctatctgcgcaccgttcccggtcaggtggtcgccgccgggacgtaccagctgacgctgaatatggctgtgacttatcgcatctgcaccagcgttgcgattggcaatgtctgtttaagcgagcagaacggcagcggtgtcatcccgattaatatcaccgccattctaactaatgactgcaccaccattaccgcgccgaatatcagctttggcagcgcgccgctggtcggcagcttctccgccgtgtcacagaccatcaatgtgttgtgcagcaaaggcagcacctataccgtcgggctgagcaatggcagttatccggtgggcagcgtcaggaatatggcgagcggcgcgaatcggctgagctatgaaatttataaaagtaccaccagcaatcgctggggatcggcaggcactgaacgctggagcagtaccacctcgacggcggtatccacggatggactgacgcgcggttttaactacaccgcgcgcatcctgaccacgcagaacacgccgccagccggaaactacagcgacagcgtggtggtcgatttgtcgttttagagtgaagcactgaccggcgtgccgctgtgacgggtctgatactgcttcaccatccggccaatcagcaacgtgccgattaacccacagactgcggcaaaggtcagccagacgccaggcatcgctttgtcaccggtggcgtgaatcagatagctggagatggcaggcgtaaagccgccaaacagcgccgtcgccaggctgtaagccatagagaaaccggcggcgcgcacttcagcaggcatgatctccgccagatagaccaccatcgcgccgttatagctggcatagagaaacgacagccacagttccgcttccagcaggtgagcgaagctggccgatcccaccagccagtgcagcaccggccaggtggtgacaatcatcagcagggtaaaaatgatcagcagcggacggcgaccgacgcggtccgacaacgcccccatcagcggcagccagatgaggtttgagacaccgacacagagcgtcaccaggaaacgcctgcttgtcactcatcatcaacaccgttttaccaaaggtcggggtaaaggcggtgatcatgtagaacattaccgtggtggtgaccaccatcagcatccccgccagcaccagcgcccagttgctggcgactgaccgcatgatttccgtcatgctgggatgatgtttacgtttgctgaacgcctcggtctcttccagcatccggcggatatagaacaggaacggcacaatcagacagccgaccacaaacgggatacgccagccccactccgtcaccgcctctttcgccagcagatgattcagcatcagacccagcagagcagcaaagatcaccgcaatctgctggctgcccgactgccagctgacgaaaaagcctttgcgtcctttgggcgcgacttcggccagatagaccgacacgccacccagctccacgcccgccgagaagccctgcaacagccgtcccagcaggatcagaatcggcgctgccacgcccagggtggcgtagcccggcaccagcgcgatggtcagggtgcccatcgccattaagcccagcgtcagcaacagccctttacgacgaccatgatggtcgatgtaggcaccgaggatgatcgcccccagcgggcgcatcaggaagccggcaccgaaagtcatcagggtcagcatcagggaggcaaacgggtcatcgccgggaaagaaggtttttgaaatggcagtggcgtagtagccaaacaccataaaatcgtacatctccaggaagttaccactggtgacggtgaagatggttcgggcggcacttttcggcggcttttgtaaagagggggtgtgactcataacggcttcctgttgttttttagccgttttagcctgcctgatgcgggattaatgtgacctggctcaccattgcactttacaaatctatgtacataagtaacaaccaattaacaattcagctcaggcagcataagtgattaccctggccctgatttacctgattttatagggctggagagcagccataaaaaaaggcgacctgaacagtcgccttttttctgaaccggataacccgctatttcttcacggtttccatgcccatcagaccaattttcagatagcccgccgtgcgcagcttatccatcacgctcatcagcgtttcataatcgaccgacttatccgcctggaagaaaatggtggtctctttgttgccctgggtctggttagtcagcacgttaaccagcgactccggcgtgacctgatcgttaccgacataaagctgcttatccgctttaatcgacaggtaaaccggcttttccggacgcggctgcggcgcgctggttgaggcgggcagattgacgcgtacgtcgaccgtggccagcggcgcggccaccataaagatgatcagcagaaccagcatgacgtcgataaacggcgtcacgttgatctcatgcatttcaccatccgtttccagatcgtcgtttaatcgcattgccataagaacttaccctaagcgcagtttctgagccgtcgcaggacgcggaacatcagtggcgacggtgcccagatcgatatcacggctctgcagcagcatcacctgagcggcgacatcacccagcgaggctttgtagttggcgatcatgcgggcaaagacgttgtagatcaccaccgccggaatcgcagcgatcaggccaatcgcggttgccagcagcgcttcggcgatacccggtgcaacaaccgcaaggttcgtcgtctgggttttagcgatgccgataaagctgttcatgatgccccatacggtgccgaacaggccgataaacggcgcaaccgaaccgatggtcgccaggaagccattgccccggcctgcatggcggctgaacgcagcgacgcggcgctcaaggcggaaactggtgcgatctttaatcccgttggtatcttccacgccagccgacagttcaagctcattctgcgcatcattcagcagcaccacactgtggctgtgaccggtaaacgactgggcaatgcgggcggcgtcattcagattgcgggcttcgcccagcgccagatgctcgcgcttcaggcggcgcttagcggcgctgagttcggcatatttgccgaagaagatcgcccaggtcaccactgaggccaataacaggccaatcatgaccacctttaccacgatatcggcatgttgatacatgccccaaacggagaggtccgtttgcatcaaatcactggctaccacgctgcttctccaacttctgattcagggatgcgagacaagcgcgaataatagcaaaacgacggcgaattgatagtagttctcattagtatttacaaagctgatcgccgccatttacccgcaattgaccaggtttaaacacttttgacaaggatgtttcgaaaatgtgaagttgcatgaaaatttattaaaacatcgtttcaaaatgtgatggcattcattcaatcagcattgccgcattttactggcgcgcgttttcactatgctggctccacacggttctctccggttagcccccgacgccggacgccgtcctacctcagcgggagacaaaataatgagaatgacgaaaacatgcctggccagtgccctggcggtgatgatgatgagcgccaccgccacggcacaggtgatcaaagtggctgaagtccagcctgccggttatccgaccgtggtcgccctgcagcacatgggcgacaaactcaaacaggccaccgatggacggctggagatgaagctcttcgccggtggcgtgctgggggacgaagatcagacgctgcaacaggtgcagctgggcgcaatcgacatgatccgtgtgtcgctggcgccagtcacctcgatcgccccggaaaccagcgtgctgaccctgccctacattttccgcgacattgaccacatgcacaaagtgctggatggcgagataggccgcgagattgccgacaaattcgataaagatcccaacgcccgcatggtgttcctgggctggaccgatgccggtgagcgcaacatgatcaccaagaagccgctggcaaaaccggaagatctgaaaggcatgaagatccgggtgcagaacagcgccatctcattggcgacgctgaaagcgatgggcgcgaatccggtggcgatgggcgtcagtgaagtgttcagtgcgatgcagaccggtgtggtcgatggcaccgagaacaacccaccgacctttgtcgcccataactatatgccggtggcgaagtactacaccctcagcggccactttatccagccagagatgatcctgttttcaaaacgcgcctgggatcgcctgaaacctgaggatcaggcgctgctgaagaagctcggcaaagaggcgcaggatgaggagcgccagctctgggcgacctataccgaagagtcgatcgccaaaatgaaggcaggtggcgtcaccttccagcagaccgaccgtgactacttcgtcaaagcgacccagccggtgcgcgatcagtttggcggcaaatatcaggatctgatgacccggatcgctgaggtgaaataacccttccgcgccacactcccgtgtggcgtgcttaatcaggtatcaattatggctgcttatacacgtctgatggatgggctctatctgctctgcatgctggtggccgccgtggcactgatgattatggtgacggtgatcccgatcgggatcttcgcccgctacgtgatgaacggtgcactctcctggccggaaccggtagccattatctgcatgatcatttttacgtttattggtgcaccggtcggactgcgggccggaacgcatatctgcgtttccatggtcaccgatcgcctgtcacccgcccggcagcgcctgatgctgcgcgtcagcgatctgctgatgatcatcacctgtctggtgatctttcaggccagttacagcctgtgcgaagcgatgtgggtgcagacgctcgcttcattaccggcagtgacttacggcgagatgtatctgccgattccgattggcgcgatcttcaccctgctgtttgttgttgagcgattgctgacaggcgatcagagccagcggccgattgtcacgctgggcggcacccactaacgcggagcagaaaaatggatgcattgatcttgataggcagtttgctggtgttgctgatggtgggttttccggtcgcctttgcggtggggctgagcgcctttattggcgcctggtggatcgatctgccgctggaagcggtggtgattcaggtgaccaacggcattaacaaattttcgctgctgactatcccgttctttattctcgcgggtgcgattatggcggagggcgggattgcccggcggctggtcaacttcgcctatatctttgtcggctttatccgcggtggcctgtcgctggtgaacattgtcgcctcgaccttctttggcgcgatttccggctcatcggtggccgataccgcctcgattggctcggtgatgattccgcagatggaggagaaaggctatccgcgtgatttcgccgccgccgtcaccgccagcggctcagtgcaggcggtgctgacgccacccagccacaactcggtgatttactcgctggcgaccggcggcatggtgaccatctcctcgctgtttgttgccggtatctttcctggcctgctgctgggtggctgcctgatgataatgtgcctgggttttgcccataaacgcggctatcccaaaggagaacgtattccgtttcgtcaggcgctgaaaatcttcttcgacgcgtttctggggcctgtttaccgtggtgatcattatgggtggtattctctccggcatctttaccgcctcggagtccgccgcgatcgcctgtatctgggcctttttcgtcaccatgtttatttatcgcgactttaaatggaaccagctgcatatcctgctgttccgcaccattaagactgtcaccatcgtgatggtgctgatcgccttcgcggccggattcggcgcggtgatgacctttatgcaactgccgacgattatcaccgaggcgttcaccagcctctccgataacaaatatgtgatcctgatgtgtatcaatatcctgctactggtggtgggaacgctgatggatatggcaccgctgatcctgatcctgacgccagtgctgttgccggtcgccaccgcgcttggcgtcgatccggttcacttcggcatgatcatgctgactaacctcgggatcggcctgatcaccccgccggtcggtacggtactgtttgtcgccagtgcggtcagtaagcagaaaatcgagcaggtggtcagagccatgctgccgttttacggcatgctgtttatcgtgctgatgctgattacctatattcccgccatctccctctggttaccgcgcctgatgggcgtgatgtagcgtcggcaaaatcgggtccggtggcggacccgattttcatcctgcgaagcactctgataatcaccattgagtctcaaccctgctggtcgtttcgtggtaacgtgagggcttagtcagaagcggcaaaggcgactcatgaccaccagaaaaattgataccacgctcgtcagtgcaggacgcagcaagcgttatacccagggctcggtgaacagtgtgattcaacgggcctcctcgctggtttttgatacggtcgcggagaagaaacgcgccaccgccggtcgggcaaaaggcgaactcttttatggccgtcgtggcaccctgacgcactttgcactgcaggatgcgatgacggagctggaaggcggcgcaggctgtgtgctctacccctgcggcgcggctgccgtggcgaacgcgattctggcgtttgtcgaggcgggcgaccacgtgctgatgagtggcgcagtctatgaaccgacccaggatttctgtactaagatactgactaagctgcaggtttcaacgggctggttcaatcactgcatcggcagtgaaatcggtgagctggtgcagcccaatacccgggtcgttttcctagaatcaccggcctctattacgatggaagttcaggatattccggcgattgtggcggcggttcgcgccaaagcgcccgaggcgatcatcatgatcgacaacacctgggcggccggtattttatttgatgcgctggcgcacggcatcgatatttcgattcaggcgggcaccaaatatctgattggtcacagcgatgcgatgatcggcacggcggtcgccaatgcgcgctgtatcgatcagctgcgcgagaactcctatctgatgggtcagatggtcgatgccgataccgcctacatggcgagccgggggctgcgcacgctgggcacccgtctgcgtcagcatgaagagagcgcgattcaggtggcagagtggctggcagcgcgtcccgaagtggcgcgggttaatcacccggcgctggcacagagcaaaggtcatcagttctggcagcgtgattttaacggcagcagcggcctgttctcttttatcctgcaggaaaaactcagcgcgccccagctggcggaatatctcgatcacttccatcatttcagcatggcgtactcctggggcggctatgaatcgctgatcctggcgaatcagccggaagagctggccgcgattcgtccggcgggtggagtcgatttcaccggtacgctggtgcggctgcatattggtctggagcacgttgacgatctgctggctgacctggacgccggttttgcgcgcctgacgcgttaataaactcaggcaaaagataaacagacgctaaacagaagatgaaccgggtagcggccacccgcagagtttgccgggctgctgctcatttattgttaaaatttatcccagaccgttcaggtcatcagtgaggtcgctgcatttattgcgcagcgccgcgaccgattgcctgaatgcagacggatagttccttgtgacgtgatggaatagcaaatgggtgttttacacgagattgtccacgcgctctggcatcaggattttgccgcgctggcaaatcctgatgtggtgtgggtggtgtacggcgtgatgttcctgacgctgtttctggaaaatgggctgttacccgcctctttcctgccgggcgacagcctgctgctgctggcgggtgcgatggtggcaaaaggggtgatggattttgtgccgacgatggtgatcctcaccaccgccgccagtctgggctgctggctgagctatctgcagggtcgctggctggggaatacccggctggtgaagagctggctgatgcatctgccagcgcagtatcaccagcgcgcctggaatatgtttaaccgtcatggcctgatggcgctgctggtcggccgttttctggctttcatccggacgatcctgccaaccatggcgggcattgcgggcttacagaatggtcgctttcaactgttcaactggctcagcggcgtgctgtgggtcggcatcgtcgtgacgtttggctatggcatcagccaggtgccgttcatcaagcgtcatgaagatcaggtgatggcgatcctgatgatactgccgatggtgttgctgtttctcgggctgtttcggcagcattctggttatctggaaaaagcgtcggcagaaacaggcctgacgtcagcgcgtagcatcaggatccgccgccactcaggcggacggatccgctaccgtctgccgcacacgattcacctcttcccctggcgtcacgccaaaatagcgcttaaattcccgcgaaaactgtgaaggactttcatagccaacccgcaccgccgccgcactcgctttcagtccatcgtgcagcatcagcaatcgcgcctgatgcaggcgatatcgcttgagatactgcaggggcgaggtctgcgtaaccgctttaaagttatgatgaaaggctgaaacgctcatgtttacttccgccgccagcgcatcgacgctgaggttttccgcatagtgattctcaatccgtcgcaaggcacgcgcgatcaggctgaattgcgtctgtcggctcaccagtgagagcagcgcaccaccaatcgggccagtcagcacgtagtagataatctcccgcacgatgtgcggccccagcacccgcgcatcgcgtggctgggtcatcacatcaagcagccgctcagcggcacacagcatcggttccgtcagccacgccgagtggatccccgaggtctgcggctgcggctggaactgatcgtcatcgccgatttcaatcagcagatcctgcaggctggcggtatcgacattaagacacaacccggcaatcggcacctctggcgaggcccaggtttcgcactccaccggcagcggcaccgtgagcatcaggtacttgctggcgtcatactgaaacaccgtgctgccgagatagccggttttgctgccctgaaacaggatcacaatgccgggctgatacatcatcggcgtacggggacgatattgattagcgtaaatcagcgacacattttcgaccggacaaagacggtcgtgaccatgggtcattaatgtgacgacctgctgcgccagccggtgacacagggcatcgtgcgccatagcgactccttttacgggcaaaaagccagtgtgccgtgcgaatgcctgaatcaccagcagcctggagaatcaggcaagaaatttaccggatcgggcatggcggcagaaccactgttgttgcctcagctaagcaggctgagaattgttggctagacttaagcacagtgaaatctcacggattaaccgcaacggaaaggagcaactatggcagaccaacccattatcaaactgcgcgatggcaatatgatgccgcaactcggactcggtgtgtggcaggccagcattgaagatgcacgtcatgcggtgctgaaagcgctggaggtcggctatcgctcaatcgataccgccgccgcctataagaatgaagaggcgattggccaggcactgcaggaaactgacgtgccgcgagaagagattttcgtgaccaccaaactctggaacgacgatcagcagaacgttcagcaggcgatggaaaccagcctggagaaactgaaactggagcaggttgatctctatctgatgcactggccgtgcccggaaaaagacaattatgtcgatgcctggaagaagatgattgaactgcagcagcaggggctgaccaaaagtatcggcgtctgtaacttccatgaggcgcatctgaagcgactgctggatgaaaccggtgtcacgccggtggtgaaccagattgagctgcacccgatgctacagcagcgcacgctgcatgcgtggaacgcactgcatcagatccagaccgaatcctggagtccgctggcgcagggcggcaaaggggtcttcgatcaggagatcatcaagtcgctggcgaagaaatatggcaagacgccggcacagatcgtgatccgctggcatctggatagcggcctggtggtgattccgaagtcggtgacaccagcccgcattgaagagaactttaaggtgttcgacttccgtctggacaagcatgaagtgagcgatattgcgaagctggacagcggcaatcgtctggggccggatccggaaacctttaactaaggctgggcgtcaccaggtgagctcaccttatctgccctgcggctggggcagctaacgattaacgcggtcaggcgggctctccctgcctgaccgcgctgttatgcgctgggctgcaccaccagctgaccggcagtaccgcggtcggccagttccagcgtctgactgtagtagacgaacgggaagtgatctgacgaactttgcgggaaagtgaccatcagttccacgctgccatcgacccacaccgtatctttccagccacgatcttcgcccatcggctgtgcaccattcacacttttaatcaggaacatcacgccctggatatgcagcgactgtggccggtcagcatgcaggatccagcgctcaaaggtgccctgctgtgccgtggtgtcaatgcggctcatatcccagatcgcgccgttaatgcccggcatgctgtcaccgatgcggaattcacgggtgcgaaccgccacgccatccagaatctgatcggccagcagccgcatcggcagattatccgtcaccagcggcagcaagccggttggccgcagcgtcaggatcagggttgacgtcagaatggaggatggctcaaagaagccgcgcagccgatccataatgcccgccgccgtacctgcggtaatcgacacttcatcgccctgcgacatatccaccagcacttcgcggcgttctcccggcgccagtgacaggcgctgcaccgcgaccggcgcaggcagatagccctgatcgctggcgatgaccataaacgggcgattgtcgctgagcaccatctcatagcggcgcgcattcgaggcgttcagcagacgcagacgcacccagccgcgtgacacctccacaaacggattgcgtacgccattcaccagcagcgtgtcgcccaggaaaccaccatcctgcggcgggtcatagaccggcgtggcaaagttatcgagccgcttgtcctgaatgataatcgggaagtcatcgacgccgtaatgcttcggcaacggcagctgcctgccaatatcatcttccaccagccacatccccgccagtccgttatagatgtgcggagccatgcggttcggcgtgttggcgtgataccagcaggttgaggccgcctgacgaatcggcagcaccggcgaccagtcgacaccggctgacatcatacgcggcgcgccacccatcagcgcgcccggcaactgcaggccgctgatagtcatggagaccggctcgttcagacggttgctgtagatcagcttaacgtcatcgccgctgtaaacccggacggtcgggccaagatagaggccattaatgccccacaccggcactttgttgttgtcgccattaaaagaccagtggctgcgctgcattgtcaggaacagcggctggccgcgacgggattccagcaacggcggaaccggaagtggcgtgtcgccattagctgaagaagcggcacgcgccgcatgaggtagtacactggcgctaagcgccgctccggcagaaagctggatgaactgacgtctgctgaaagacataaaacttctgaccctttacgcgtggcgctaagcgccgaccctgtttttattgatctgtttttgctgtgctgcgttcacggcgggcggacgtgccccgccgtgcggcatccctgcaggatagttcggcgaatggttcgccggtcagatatttccgtttttttcgcgttctgcgacttcggcgttcagctcttccagctttgccgccatcagttcgcgacagtgggtcgccagcttacgcaccgacgacgactcgaaagcctttacatcaatcggtggcagcatctcaacgattaccagcccgtttttccagcgattgaggttgatcttgccatgcgtgttagagaccacaatcggaatgatcggcacacccgccgccacagcggcgtgaaaggcaccggttttaaacggcagcaggccacggccacgactgcgcgtcccttccgggaacatccagatggagatgcgcttactgttaaactcatctaccagctgacctatcgtgccgcgtgcttttgcacggtcatcgcgatcaatcagcaggttaccggtcagccagtagagcaggccaaaaaacggcacccacaacaggctcttcttgcccaccgtcaccgtacagggctgcaccattttagccgcggtgaccatgtcgtagttgttctgatggttcgcgatgtagatcgcattaccataattctcagcaccttccggtctgcgcagttctactgtaaggccaaataccgtcgacagtttgccgaacagatggccaaatgtggcgacgtgacgcggattgcgcggtgaaaacagacaccagatacagccagatatacagactaagatcgaatagatgaccacaataatggcacgcagaatcagtaacatagttccctcattgagccacggctgacgcggtgtcagccgggtagtttacgcttcgctatccgggctcgccggacgcgcaggcgcatccagttcaacacgatcaattttttgcaggccgcgcggtaacagcgtaccgcgacgtccgcgatcggcgcggaatttttgtagctcttcactgcgcagcagcattttacgcttgcctacgtgcagcgtgatagcgctgcccggcggtaaaatcatcagccaggccagtttgtcctgaccggcggccgcttccgcggatggaatcgagatgattttgttgcccttgcctttcgacatctgcggcagctccccgaccgggaacatcagcatccgtcccgcctgggttatcgccagcagcatgtcatcttcatgatggacggccatcggcgtcatcacgcgggcgttttccggcagcgtcagcagcgctttaccggcgcggttgcgcgacaccagatcgctgaaggtacagataaagccgtaacccgcatcagaggccatcagcaggcgctgatcatccggctccatcagcacctgttcaactaccgcacccggcggtggcgtcagcttgccggtcagcggctcgccctgcccgcgcgcggaaggcagcgacgttggatccagcgtgtagctgcggccggtggagtcgataaaggccaccggctgattgctcttgccgcgtgccgcagccagatagctgtcgccggctttgtagctgagtccggctggatcgatatcgtggcctttggcgctacgcacccagcccatctgcgacagcacaatcgtcaccggttcagacggcaccagctcggtttcgctcagggctttggcttcttcacgctcacgcagcggcgaacgacgatcgtcgccgtaactggcgctgtcagcctgtaactcttttttcagcagggtattcatcttgcgttcagaggccagcgtggcctgcagctgatcgcgctctttttccagctccgcctgctcgccacggatcttcatctcttccagttttgccaggtggcgcaacttcagttcgaggatcgattcggcctgggtttcgctgatgccaaagcgtgacatcaggaccggcttaggctcatcctcagtacggatgatctcgatcacttcatcgatgttcaggaacgcaaccagcaaaccttccaggatatgcaggcggcgcagcacgcgatccaggcggtgattcagacgacgtttgaccgtatcgcggcggaacaccagccattcggtcaggatctcatgcagatttttcaccgccgggcggttatccagcccgatcatgttgaggttaacgcggtagctcttttccagatcggtggtggcgaacagatggttcatcacctgatcgagatcgacgcggttggagcgcggaacgatcaccaggcgggtcgggttctcgtgatccgattcatcacgcagatcctccaccatcggcagctttttattgcgcatctggttcgcaatctgctccagcacgcgcgcgcccgacacctgatgcggcagcgcggtaatcaccgcctcgccctcttccttcttccagactgcacgctgacgaatcgagccgcgaccggtctgatagattttgcggatctcgtcacgcggcgtgatgatctccgcctctgtaggataatcaggcccctggacaatatccagcagctgttccagcgtggttttcggcgagtcgatcagcgcgatggcggcctgagccacttcgcgcaggttgtgcggcggaatatctgtcgccatacccacggcaatcccggtggtgccgttcagcagaatattgggcaggcgcgccggtaacatcttcggctcctgcagcgtgccatcaaagttcggctgataatcgaccgtcccctgacccagctcacccagcagcagctcggcatatttcgacaggcgggattcggtgtaacgcatcgccgcgaacgacttgggatcatccggtgcaccccagttaccctggccatcgaccagcggataacggtaggagaacggctgcgccatcagcaccatcgcttcataacaggcgctgtcgccgtgcggatggtatttacccagcacgtcacctacggtacgcgccgattttttgaattttgcgctggcgctcagtcccagttcggacatggcgtagacgatacgtcgctgaaccggctttaatccgtcgccaatgtaaggcagggcgcggtccatgatgacgtacatcgaatagtttaagtacgcattctcggtgaatgtgtgcagggcaagacgctctgcaccatcctgagtcagttcactcattaatttctcatcctcacatcgtggcccacaacggcgggacacccggcggtggtttggcgaggatagtaccttattcgctggtgttagtcacaggggaagcgcgggagagcaggcgtcccgccgcgcgattttatgtgccggaggcacgccggattcagaccggcaagtgtctgacctgtctgtggaagtggctcagggctttgcacccatccactggcgggcaatgtcacgatattcgccagtggcggtgctgagatgcagccactgatcgacatagagcttccagctgatgtcgtcacgcggaatcatgtaagccttctcgccatactgcagcggtttgtcgggattgatcgcgcagagcgtcgggtaatgctgctgctgaaaacgcgcttcagaggcatcggtgatcattacatccgccttgttgtccaccagttgccggaagatggtgacgttatcgtggaacagcgtcagtgaggcctttggcaggtggctgtgcacaaaggcttcgttggtgccgcctgccggttcaatcagccgcacgtcaggccggttaagctgttcgatggtctggaagcgatctttatcgctgcagcgcaccagtgggattttgccatccacatccagcggccgggcgaaccaggcggtctgctggcgtttcagcgtgacggagacgccgccgacggcgatatcacactgctttgccagaaaatcgggcatcaggtttttccagctggttggcacccactccactttcgcgccgagcgaggtagccagcgcgttcgccatgctgatatccagcccttcatactgaccatcgggtcgcaggtagctgtaaggcttgtaatccccggtggtgcagaccttaagcgttttagaactgaggatggtgtcgagatgagattgtgcctggacagcaccggtggccagcagcaaagagaggacaatttttttcattttgcgtttttctataattgtttcacagtgagtttgcctgccgatggtgccataaaccggcgcattgttgcttccacagcaaaagtgttgtgatcaacctcccatttttctgcgaccgcagcgcgcgtaagctaagcgccatattcaggaaatgaggcaaacaattcatgagcaagattttaattatcgatggcggcaaaacctttgcccactctaaaggcgaactgaaccacacgctgaccgacgttgcggccagccagttgcgtgacatggggcatgaggtgtctgtgaccctggctgacagcgactacgtggtcgccgatgaagtgcagaaatatgtcgatagtgatgtggtgatttatcagatgcctggctggtggatgggcgagccgtggaccgtgaagcgttacatcgatgaagtctttaccgaaggccacggctcgctctacgccagtgatggccgtacccgtttctgatgcggcgaagaaatatggttccggcggtctgctgcagggcaaaaaatatatgctgtcactgacctggaacgcgccgctgcaggcctttaccgacccggagcagttctttgaaggcgtcggcgtcgacggtctttatctgcacttccacaaagccaaccagttcctgggcatggaagcgctgccgacctttatctgcaacgatgtgattaaagcgccggacgtgccacgcgatattgccgcttatcggacccatcttagtcgcgtttttgcgtaagatggctgggggacaccccctattttcccacgaaagaggaattcgcgaatgttaacagtcgttgctgaaatttgtgtcaaacccggtcgccgtcaggccgtgctggatgcggtgaaaaaactgatcccgctggttttagaagaagaaggctgccatcagtatgacgcgctgctggaccatcaggcgcaggtgccgtggaagcagaactcgccggactccatttttatgctggaacagtgggaaacgctgcgtcatctggagcagcatcagcagatgccgcacatggatgcgcatcgcgccatcattaaagatgatgtggtggatgtgaagattctggtgctggaacccagcgcctgattcgtgctgaaggcttaaccccttttcggtaaacggggtcaggctgctgacaacctcaaacctgagtgcctctggcagcaatgaattagctcaacgcgaagggaacacggtcagaagaggaaagcgtcccgcgccagggatggcgcgggtagagcgaccagggactggcttgagcgcctttccgatctgaccgtgttccctgtgcaagcacaatctcacagcgaatccggccagacttgccagcatctccaaacccctgccctatgacaggggttttttattatggcaggagagatcatagcagctgacgccgatcaatctcggtgcggagaaaatccaggaagcagccgatacgcgaagagagcgtggtgttgcggtaatagaccgcatgcaccggcaaccgcagctcgcgggtttcagcggggagaaccggcaccagccgtcctgccgcgcaatcttcccggctgacaaagtcggagaggcgtgcgatcccctgtcctgccagcgccagttgccggatggtttcgccgctggaggcagagattgtgggcttaatgcgcatgaaatcgccatcaggctgccagatcggccagacgttgtgcgcctcaagatggctgaagccaatgatttgatgctgcgcgagatcggccacgctctgcggggtgcccgctttcgccagataggccggactggccatcagccggatcgcactgctgccaagcatccgggcgcgcagcgtagagtcgcgcagtttcgccgatgcgaatggcaatgtccgtttgctgctccagcagatcgatcaggatatcgtcggtattcagttcaagctggatcagaggatagcgggcgcggaaatcgtccaccagcggcacaatcacatgcagcataaaaggggtggcggcgtttacccgcagccgccctgacggcatctcgcgccgcagggctatctgctcttcggcctgctcaaccgaggccaggatctgtcgcgcatgctccagaaaaacctgtccctcttcggtcagcgccagccgtcgggtggtgcgatgcagcagagtggtctgcagcttgctctccagccgcgacaacgcccggctgatgcccgaactggtctgcgccagctgggatgccgccgcggtaatggaaccgctgtccaccaccgccacccaggcgcgtaattcttccagggtaattttcacaaggattactgtctctgctctgaatctgccgggttctccggggatgtgctggctgaagcacaaagagaacaggacgctttcgcgtcctgtttttttacacttcgatatcggccttgtcgcctttttcctgcaaccagttacgccggtcttcggaacgtttcttcgccagcagcatatccatcatgcgcagcgtctgatcgatatcctcttcactaatggtcagctgtaccagacggcgggtattcggatccagcgtcgtttcgcgcagctgtaaggggttcatctcgcccagccctttaaagcgctgaacgttaggtttgccctttttgcgtttcagctgctccagcacgccctctttctcatcttcatccagcgcgtagtagacctcttttccgagatcgatacggtagagcggcggcatggcaacatagacgtgtccgtttctgaccagtgaacggaaatgtttcacgaacagggcacacagcagcgtggcgatgtgcagaccatccgagtccgcatccgccagaatgcagatcttgccgtagcgcagctgtgaaagatcttcgctgtcgggatcgatgccgatcgctacggaaatatcatgcacttcctgcgacgccagcacctcatcggaagagacttcccaggtgttcaggatcttgcccttaagcggcatgatcgcctgatattcacgatcgcgcgcctgcttggccgagccgcctgccgagtccccttcgaccaggaacagttctgttttattcagatcctgcgcggtgcagtccgccagtttgcccggcagagccggaccgctggtgagctttttacgcaccacttttttggctgcccgcatacgtcgctgggcgctggagatcgccagctcagccagttgctctgcgatctggatattctggttcagccacaggctgaaggcatcttttaccacgccagagacaaaggctgcgcactgacgtgaagagaggcgctctttggtctgcccggcgaaactgcggatcctgcatcttcaccgacagcacataggcgcagcgatcccagatatcttcagcggagagcttcacgccacgcggcagaatgttgcggtattcgcagaactcgcgcatcgcatccagcagcccctgacgcaggccgttgacgtgagtcccgccctgcatggtcgggatcaggttaacgtagctttcagttaacagctcaccgccttccggcagccacaacagcgcccagtcaaccgcttccacatcgccagcaaagctgccgacaaacggtttttccggcagcgtcggtaagccattcaccgcttcgcacaggtagtcagtcaggccatcttcgtagcaccaggtctgttcggtattgttcagcttgtctttaaagacaatctcaacgccagggcagagcaccgctttggctttcagcagatgtgataagcgtgacaccgaaaaacgtgggctgtcgaagaagctttcatcgggccagaaatggacgcgcgtgccggtgttgcgtttagccaccgtgccggtaaccgtgagatcctggactttgtcgccattctcaaacgccatgtcatagatttcgccattacggcgcaccgtgacttcgacgcgttttgacagggcgttaaccaccgagataccaacgccgtgcaggccgcccgagaactgatagtttttattggagaacttgccgcccgcgtgcagacgacacaggatcagctcgacggcaggcacgccctcttccgggtgaatatccaccggcatgccgcgaccatcatcaataacttccagcgactggtcagcgtgcagaatcacttcaacccgcttcgcgtggccgcccagcgcctcatcgacgctgttatcaatcacttcctgacccaaatggttgggtcgcgtcgtatcggtgtacatccccgggcgacggcgaacaggctcaaggccagtcaggacctcaatggcatccgcgttatagttagattgactcatcgtaaatgtctgattagaagggtgaaatggggtgcgatttccgcattactcagggatgattcagaccgagaaagtccagaatctgcgggaaatggcgctcgaatccagtaaatgcatgatttccgccctcttctaccgtgtgacggcacgcgctgtaatagtcgagcgcctgacggtaatcgagaacttcatcgccggtctgttgcagcagccagagtaaatcgggcgcttccagcggttcaatctgcattactttcagatcgtaaatgtggcgtgactctaacacatattgctggccggtgtagggattctgattttcgcccaggaaatccgccagcagctcaaaaggccgcaccgcgggattgacgaccacagcaggcagcataaagcattgcgacagccaggtggcgtaataaccgcccagcgacgagcctaccagccccagcgtttcgccactgcggctcagtaccagatcttccagcattgcggcagcatcggccggaaacgtcggcagctggggcacgatcatttcgatctccggatgctgcgcctctaaccattgccggaaactgcgtcgccttagccgactgcggcgagctgttaaaaccgtgcagatagagtaatgccgccacgcgtcagtatccttctgagtctaaatcgggacgaaaagcgtcggtgtcgagccggttaacctcggtctcaaggccgccatccggatacagcgtgaaccagcgccagcctggtgccacggtatcgatcgtaaagctggtgcagtgcggtttgaactgaacgcaggttgaaggggtggccagcacacgacgaccgtgccactcaacatccagctcctggtgaatatgaccacagaccagcgtccgggctaacgggtaatgctgtaacaccgcatcgagctgatgtgagttgcgcaggctgtgctgatcgagccaggtacagccagaggccagcggatggtggtgcagcaggaccagcgtatgacgttgcggatagcgggccagcgcgttatcgagccactccagctgataatcgctcagcatcccgtgcggcacacccgagacctggctgtccagcaacacaatttgccactgctcacccaccagcacctgtttgtgggcattgatatgagctgctgccagcgtgtcgaacatcgcgggctgaaaatcatgattaccgggcagccagacgcagggccgcggcaaacgtgagatgccctcagcaaaatgctgataggcttcgatagagtgatcctgggcgagatcgccggtggcgataatcaggtcgtagtcgcgatgttgcgcaataatcgcatccagcaccgctttatagctcgaccaggtgttcaccccaagcagcgattcatgttttcccgcgaacaggtgggtatccgtgatttgcaaaatcctgatttcggaaccgttcgctgcaggaagagttagcaggctatccaaagcgtttccttcgtctccacgccatttactgcattatacgcatcagcagaccggaactgccatcgcaccatgtgccaggcagtagcgcagccagtctgcgagaaactggtttatctgatgtttttcatcgcgctgatgcaattttttattgggataatcatagcgcgctttgaaacgatagatctgttgagttgaacacacttcggcgaccatcgcatcgtgatagagccttaccgacatcgagggcagactccagtaactcacggcaggcgcgacctggcggatctccaccagcgtggtgtagcgtgtggactcctggatcgtcagctgataacgggcgccactcacctgatagatcaccgattctcccgcctcatcgttacgcggcagcaggcggcgtaactgggcgaaattggtttcgcagagccgcatcatttcgggaaagtcaggggtatagcgctgtttcatttttgtatccactcttcgcgtagtttctcatggtgcaacgccagccattgcagggcgatgacagacgccgcattgtcaattatcccctcttccacccagcggtaagcctgttcgcggctcaccacatggacaagaatatcctcattctcttcctccagaccatggcatccctctgcctggctggcatccacttccccaatcagcaccgacagacgtttcgctggtgccgccagggctggccagatagttaagcatgggcttaatccggccgacctctaatcctgcttcttcaacggcttcacggcgcacgacctgctcgacagattcaccgggctcaataatgccggcgaccatctccagcagccagggcgaagcactgctgtcataagccgggatgcggatctgttcaatcagcaccacttcatcgcgtaagggatcataaggtagcagcacggcggcatgtccgcgctcaaaaacttcgcgctgtacttccccactcatttcgccgttaaactggcggtggcggaagcgataacgtacgacggaaaaaaaaccatcatagacggtttcgcgtgcaataatttctacatcgttttttgtgaaagtcacaggggattttttttcttccggcatcatcgggttccttatgcagattgaggtggagcgaaaaaagcctgtaaccgtgctccatgtaagtggttctttctgaattatttacgtaaattagggggagaaggcacgttcagccaacttatctcacagttgccctctgctagaatcggcgataattttttggcttacccggcagcgcacccactgcaatttgctgcaacaaaaggaatgcaaatgaaaaaactgctcccattttttattgggctgagcctgggcggtttcagcttcgccagccaggccgaagacctgcttcaggtttatcaacaagcacgtctgagcaacccggatctgcgcagcgccgctgccgatcgcgattctgcctttgagaaaatcaacgaagcgcgtagcccattattaccccagctcggcctgggtgcagactacacctataacaacggctatcgcgacagtagcggtctccattccaacacgaccagcggctcgctgcaattaacccagactattttcgacatgtcgaaatggcgcgcactgaccctgcaggaaaaagctgccggtattcaggatgtggcctatcaggtggcgcagcaggatctgattctgaacaccgcgaccgcctacttcaacgtgctgaaagcgattgataccctttcttacaccgaagcgcagaaacagtcgatctatcgcgagctggatcaaaccacccagcgctttaacgttggcctggttgccattactgacgtacagaacgcccgtgcgcaatatgacagcgtgctggctaacgaagtgaccgcgcgtaataacctcgataacaacgtggaaacgctgcgtcagatcaccggcatggactacatgtcgctggcgtcgctgagcattgatcgcttcagaaccgataagcccgaaccggtcagcgcgctgcttaagcaggcggaaagccgtaatctgtcgctgctctctgcgcgtctgaaccaggatttagcccgtgagcagatccgctccgctgaagctggtcacatgccgacgctgggtctgacggcctctaccggcatgtcgaaacagcaaatatggcggcagccgtgcgaaccagagccaggggtctactgactccattaccggttctaaccaggtgggtctgagcttctcactgccactctatagcggcggcagcgtcacctctcaggtgaaacaggcacagtacagcttcgtcagcgccagtgaatcgctggaaagcgcgcaccgctctgcggttcagacagtacgatcatcgtttaacaacgtgaatgcttctatcagcagcatcaacgcttataaacaggccgtggtctctgcgcaaagctctctggatgcgtcagaagcgggctatcaggttggtacgcgtactatcgttgatgtgctggatgcaaccaccgtgctctacaacgctaagcagcagctctctgatgcgcgctatagctatctgattaaccagctgaatatcagctatgcgctgggtacgctcaatgagcagagcctgcagaaactgaacagccagctgggtaaagagatcccgacctcaccggaaacggtagcaccggaaaatgcacagcagaccgcgcgcgtggatagcggtccggcagcaaccggctcttctgaggcagcacgtcctgcggctcgccacagcagcggtaatcctttcggtaattaatgagcggacgggctgctttgcggcccgtctctctgttgaacgtataactaagtaaagatccctgttgtatcaggcctccagcttcaattttacccccccatcccctattctatgcgctacctttgggcacaggataatcataatgaaacgcacaaaatctattcgctatgccgcttttcgcaaaagctggcaggcacgccatttaacgcccgttgctatcgccgtttcggcggtatttatgctggctggttgtgaacagaacgacgaaacagtttcgatgtaccagaatgccgatgactgttcaaaagccaatccgggccagagtgcgcaatgtactaccgcattcaatgaagcgaaaaaagaggcggaacgcaccgcgccaaaatatgccacgcgtgaagattgtgtcgctgaatttggtgaaaaccagtgtcagcagacaccggctcaggcgggcgtgggcaccactaatgccgaatcgcagcagagtggcggcagcttctggatgccactgatggcaggttacatgatgggtcgcatgatgggcggtggttcgggctttgcacagcaaccgctcttctcaccgaaaaatgcccgcagcccggccaatggtcagtttgttgatgcatcaggccgtaattatggtgcagcaacatccggcaaaagcatgaccgtgccgaaaacggcgctggcaccaaaaccggctaccacctccaccattacccgtggtggctttggtgaaaccgtcgcgaagcagaacagcatgcagcgtagcagcgccagcggcacttccagccgctcaatgggaggctaacgccccgatggaacgcattgccatttcagagcgcccaggctggcgcgaaaaagccaccgagttcggttttcgttttcacaccatgcatggtgaaccctactggtgtgaagatgcttattatcagttcacgctggcgcaaatcgagcatctggaagaggtgaccgctgaattacatcaaatgtgcctgcaggtggtggaaaaagtggttaacagcgaagcgttgctggctaaattccgcattcctaaacacacctgggactttgtgcgcgattcatggcatcagcgtcagccttcgctttactctcgtctggatctcgcctgggatggcaaaggcgatgtaaagctgctggagaacaatgccgatacgccgacctcgctgtatgaagcggcatttttccagtggctgtggctggaggaccagcttaacgccggtcagctccccgcaggcagcgatcagtttaatagcctgcaggaaaagctgattgaacgcttcgccgcgttacatcagcagcacggcttcaactggctgcacttcgcctgctgccgtgacaccgacgaagatcgcggcaccgtgcaatatcttcaggattgcgccaccgaagcgggactgccgagtgagtttctctacatggatgaaattggactgggcgagaaaggggaatttaccgacgcccaggatcaggtgattagcaacctgttcaagctctatccgtgggaattcatgctgcgtgagatgttctccaccaagctgggcgatgctggcgtgcgctggctggaaccggcctggaaaagcatcatctcgaataaagccttgctgccgctgctgtgggagatgtttccgaatcaccctaacctgctgcccgcctggttcgcggaagatgacgtgccgcacatggacaaatatgtggtgaagccgctgttttcacgtgaaggtgccaacatccgcatcgtggaaaatggtcaggagatcgcccgcgtcgatgggccgtatggcgaagagggaatgatcgtccagcagttccatccgctgcctaagtttggcgacagctatacgctgatcggcagctggctgattgacgatcaaccggccggtatcggcctgcgggaagatcgcgacctgatcacgcaggatctttcccgtttctatccgcacgcttttatcggttaatgcaccgcgataataacaggccagcttctggcctgttttcttctggcttccctaacctacctgaaccgacaacatgctgatcgcacccatctccatgccatcaaccggaatgctgatggcgtcatccggctgacgtgcgccaagtacatagagcagcggcagatagtgctcaggtgtcggattagaaagcgccgcaccaggatgatccataaagttaaccagcggatgagaagcagcatcgctctgcaccgccaggttatcgcggacgaactgttcaaaactgctggcccatggataaacttcgttgttgccatcccagcgcactttacgcaggttatgtaccacgttgccgctggcgacaatcatcacgccctgattgcgcagtgcagccagtttctgacccatctcaaagtgccatgccgcaggtttggtgccatcaatgcttagctggaccaccggaatatcggcctccggatacatcttgatcagcacaccccaggaaccatgatccagtccccactcgtgatccagcgtcaccgcaacgggcgctaactgctccaccagctgctgcgccagtttcaggcgatcccggagccggatagcgcgtatcaaacagcgcctgcggaaagcccccaaaatcatgaatggtctcaggctgtgccattgccgtcacggcggttccgcgcgtataccagtgcgccgaaaccgcaataatcgcgcgtggacgtggcagagtatcgcccaggtgacgccacgcggcggtatagcgattctcttcaagggcattcatcgggctgccgtgacccaaaaacagcgctggcattcgtaactggctcattcgtgatccccgggatcgagtatttgatagccattacgatacgcgcatccgctgctttatcacgcggataaccatgatggtgatcatcaggaaatttgaatgaaatttaacgtggcaggtttaacagcgtttcgacatgaaggaaagaggagtagtcagcggtcaggccgcgccattccgggtatcaggaagaaaaacaggcccggggggcctgtttatcgcggcagccagattagctggcgtggcgtgtttcgtgcgcgcgacgccaggcgatcagatcttcgatggtcaccaccggcatgttgtgctgacgggcgaacgcaatcgcttctggcgcatgggccatggtgccatcgtcgttggtcagtttcgcacagcacacctgcgggcttaaagccggccagggtgactaaatcaatagtcgcttcggtatgcccgccacgggttaatacgccgccttcgctggcacgcagcgggaagacatgaccagggcggtgcagatcggtgggtctggcattgtcggcaatggcggcgcggatggtggtgatacgatcctgcgcggagacgcccgtggtgacgccttctgcggcctcaatggtcacggtgaagccagtgccgaaagagctggtgttgttttccaccatcattggcagatcgagctgctggcgacgcgcttcggtcaggcaaaggcagacgatgccgctgccgtgacggatagtcagtgccatctgttcaacggtcatggtttctgcggcgaagatcatgtcgccttcgttttcgcgattttcatcgtcgagtaccatcacaccgcgtccctcacgcagggcggcgatagcacgttctacacgctgttcaggcgtgccaaattcagaaagtagcgtctgattcatggtaataaaaaccttaaaatgtatgggttaccagaatcagggcgtgcttaggagtgacgtcaaaaagacgtggcaataacgtgaagcagacacaattgtccgacagatgtcgttaccctctcccatccggactgtaaccgtcggccccggaattacaccggatctgctgacctttacctctcttttcattaagataaagcgctcgcgggctttcagccgaagctgatttaccgccggtggggaattgcgccccgccctgagaataagcactttaactataacgccgatcgtttgaggcggcaatcatcaatagcgcaattgcttttgcatttcctgcgttaccgatttgaggtttatccttttcatttctggcattacacttaacacttattacgttggtaaacacgctgacacagctccccgtaaccaggaaatcatcatgatcgacacgaaaaaaattgaacaacttgcccgtcaggttcacgaagcgatgcctaaaggtgttcgtgagtttggtgatgatgtcgaaaagaaaattcgtcaggttcttcaggcgcagctgacccggatggatctggtcaaccgtgaggagtttgatgtgcagacgcaggtattactgcgtacacgtgagaagctggcggcgctggagcagcgtctggcgcagctggaaagtcaggggtcatcagccggtacgccgccgacggcaaccgcaccagtaacatctgctgccgcgaccacaccatcagccgccgtagcgacctcacctgcagcctcgccgtcaccggttgcggacgtggtgaaacctgttgtggacaacaagccagaataagcctttaagcgggagcgcggctcccgcttacgccgcgctttagctgccgcggatggttttgataatgttggtagtggagataccatcttcgaagttcagcacctgaacgtcgccgccatttgcccacacttctttgctgcccgcgatatcttccggcttgtaatctccccctttgaccagcaggtcagggagaatgcccgcaatcagccgctgcggcgtatcctcttcaaataccaccacccagtcgaccgcttccagcgcgcccagcacgatcatccggttttcctgtgggttcaccggacggctttcgcctttcagacgtttagtcgacgcatcgctgttcaccgcgacaatcagtcgatcgccgagcttgcgggcatttgccaggtaggagacatgaccggcatgcagaatgtcgaacacgccgttggtcatcaccactttttcgccacggcggcgggccatctcaacggcggcttttaactgcgcttcggtcatgatgccgaaaccctgttccgggcgggcatgaatcgcattttccagctcaacggtgctgacggtggacgtacccagtttacccaccaccacacccgcagccgcgttggccaggaaacaggcttcttccagcgaatcaccggccgctaatgccgccgccagcacgccaatcaccgtatcgcccgcaccggtcacgtcatagacttcctgtgcctgggtgggcagatgcagaggcgctttgcccggctgcagcagcgtcatgccattttctgaacgggtcaccagcagcgcggagaggtcaaaatcggcgatcagctgggtgccgcgcgccacaatttcctcttcgtttttgcatttaccgaccacggcttcaaattcagagaggttcggcgtcagcagcgtcgcgccacggtagcgcgcaaaatcggtgcctttcgggtcgattaataccggtacgcccgcttcgcgcgccagagtaatcatggtctgcacgctggagagcgcgcctttggcgtaatcggacagcaccagcgcacccgcggcggccagtgactcacgcattttctggtgaatcggctccggatcgacctgatcaaagccctcttcaaaatcgaggcggatcagctgctgattacgggaaagcacgcgcagtttggtaatggtcggatggcttttgatcgccacgaagtcacaatgcacgttgacgtctttcagcgtgttactcaacacacgcgccgcatcatcttcgccagtcaggccaatcagtcgcgacgcggcaccgagtgctgcaatgttcatcgccacgtttgccgcgccgccagggcgctcttcaaccgtgtccactttcaccaccggaaccggcgcttcaggggagatacggctggttgggccataccagtaacgatccaacattacatcgccaacaaccagcactgaggcttggccgaaacgcgggcagagtcactttcattccagacactccagactgcattaaaaatagtgcgcggatgatagcacagttgcgatttgtgctatcagcatcacgccaggatagacgcaggcgttatcagccagcgctgccagctgctcagaaccgtctgccgctccgctgcataggcctctggctcaacgtggccgggctgttcctgcagggcgcgatggtgcaatgcgtcgcgcagcgtcacataagcctgcgtcagcgcctgtgcttcatcggcgggcattttatggtacttcgccatcagctcgaaaatgcgcacattgtcagaccagcgcgtcagttcaggctgctcagcggcgtagcgtaagacaagatattgggcgatgaattcaatatcggtgatgccgcccgcgtcggctttaatatcccagcgacctttatgtttgttgctgaggtgagcgcgcatcttttcacgcatctcacgtacttcagtttgcagcgcttcggcggcacgtggcagcgacagaatcgcctgacgaatcacgctgaaacgttcacccagtgccgcctcgccaaagacgacgcgtgcccggaccagcgcctgatgctcccaggtccaggcttcactgcgctgatactcttcaaaggcctcaaaggtactcaccagcatgcccgccgcgcccgaagggcgcaggcgcgcatccacttcatagagaatgccggaggaggtgcgggtactgaagagatgcatgatgcgctgggcgaggcgcagatagaactgacggccatcgatgctgcgctccccttctgtcaccgcatctgccgggcagtcatgcaggaacaccaaatcgaggtcagaactgtaacccagctcccagccccccagtttgccgtagcccagtacggcaaaaccgcggtcatgttcattactcagatgcgaaggacggccgtaacgctgcaccatcatattccacgcctggcgcaccacagattcgataatcgcttctgccagccaggtgagatgatcgctgactttcatcaccggcagtgttccggcgatgtcggcggcagcaatacgcagatgctgtgcctgcttaaactgccgcaccgcttccagctgctgctcttcgtcctcggtagggatgcgcagcagatattgtcgcagctcatcgcgataggcatcggtggcggttggctgatagagcgtggcgggatcgagcagttcatccagcaataagggatgacgcgccagctggctggctaccatcggtgaggcggcgcacaggcgaattaagtggcgcagcgcaccgtgatattcggtcagcagctccagataggtgctgcgggtcaatacgccgatcagcagcggcgtcaggcggccgagcgtcaccgccgcatcttcacgcgggcagacttcgctcagcagacgcggcatcagctggtccagcgcctgacggccacgcgggccgatggtgcgccggttgatatcctgacgaaacgcctccagcgtctggtgcagcgtaagccgctgctcgtcactgagctgcggcaccagcggcgccagttcgctatcctccagctggtcctgccacagcacctgaaactctgccagctcacgctgatcgccaatctcaggggtatcttcgccaatcagctcgtcgaagatagcgcgcaccgccgccatctggccgtcgagccgggtcatcagagcaggccagtcggcacaatccatcgcccacgccagccggacgcgatgcagttcatcctctggcagggtctgggtctgctcgtcgcccaggctttgcagcagattctccagccgccgcaggaaacaggtaggcaacacgcaacgcatcgacctgttccgcgggcagcagggccagggttttgatcgcctccagcgtcggcagcagtgaacgcagctgcaacgagcgctcacgtccgccgcgaatcagctggaatacctgcacgataaattcggtttcacggatgccgcccgcgcccagtttgatattgtttttcagcccgcgtcgccgcacttcgcggctgatcatccctttcatgttacgcagcgactggatcacgctgaagtcgatgtagcggcggtaaacgaatggccgcagcatctgctgcagctccaggctccagcgatcgtggtcatcacccatcagccgcgccttgaccatggcgtaacgctcccagtcgcgtccctgctcctggtaataatcttccagcgcggcaaagctcatcaccagcgggccgctgtcgccaaacgggcgcagtcgcatatccacccgatagacaaagccatccatggtgggttgatccagcactttgatcagccgctgccccatgcgggtaaagaactgagcgttgtcgagttcacgccgtccgccacgcgttgtgccgttttccggccaggcaaagatcaggtcaatatcagaagaaaaattgagttcgccgccgcccagcttgcccatgcccagaatcagcatcggctgcgcgtcgccgtccgcattacagggcgtaccaaaatcacgacagcaatcctgataaacccagtcacgcgcccggctgatcagcacttcggctaatgcgctgagctgttgcaggctctgttcggttgtagcgtgctgcagagactgcatccaggcgatgcgtaccagcatacggcgacgaaacagccgcagttcacgcatcaggctcgcttcactgtcgatgccgctaagcgcctgattgagccacgcagagtagtgttgccactcatcaggctgcggcggctggtcgagcatcgcctgccaccagtcgggatgttgttgcaggttttccagcacaaaatcgctgaaagccagtccggcagcctgctccgggcttaacgaagccagcggaaccccaatctgtcgggcggcgtcttcggcctggtcgcgtagcaacgcgggaagtgctgacaacataactccctccttgatggcgtgacggaatgcccgttagcggccagcgccgctggtgagccagaacggaggctgtttcagcgcctgcatcgccagccaggctaacccggacgtctgtttttcatgaattgccgacagcagctgttgccacgggtcgagccagctgacgaccacctcagacggatagaatcccgccagcaggtggacggtaagcaattgacgcgccagacgggtagctttgtcctgatactcgttgggttgttttaccgtgatgaacgtttctctcagatcggcattgacgcggctcagcataatgtcgctgaagcgtttataggacccctgcagcttggcttcccctttggcatcgatccactgacgccactgagattcagccagccagtgtgtcagcgccagctgcgtctcaaccgagagggaagataagcagaaagtggcagcatcctgctcttcattcaccagcgtctcttccagcgtggtcagctgctgacgcagcgcactgctggctttacgcggtaccagcgcaccaaacaggctgaacgcctgacgcagcagatccagcgcttcgcgcaccgcatcctgggccgccgcattgccgcgcagccagacttcttcatgatattgccagtgatgaagtcctgccgacatcgcggccaccatgccctgctctacggtggctttggcgcccgctttcagcagcgggaaaggctgtatctggcgcggcggattaccctgcgccagctgatagccgcgggcagctttgctcaggctgcccatacgcagaccgcccagcgccaccagctgctgtgcgaaggccagcagatccaggcgtttcgccacgtttcagctccagctcgatctcgcacagcggttcgctgagatcacctgccgtgacctcgccctgatcaaacgccacttcaatttcactgttgcctgtggtgatcagccagatttcgcgctggaaatgggtagtgaacaggggctgcaagcgcggctgcagcgccgcgacatcggtgccctgcggccagatctctgccggcaggcgtgtaatgtccagaaccggttcgctgagctcaacgttgtattccgggcgctgatgcagtccgccgagcgtctgccccgccgctttcagcgtcatttcataacgctggtcaacgccgcggatacgcaatcccatatcccagcgtcgtagctggttgtcgtcggtttcaaagtagatgttggtcagctcgcgagcagcctgatgctgatgcggcagagtggagagcagttcagccagtttcccggccgcctgtggagttgcaatgaactttagttcgatttcgatggtcataattttttattcactacgccgctggcacttaagagggtgtttcctgcatatttcaggcgattatcagcaggttactcaagctgtcgcctggagggcaaggggttatcaggcgaagattaatgcacagaagccgcgctgtctctgctttctttgctctttcgcagaccttttcgcactctcatgagaccaggatagttctcattcagatttatgcgaggcctctccagactgtgccggtaaatttttagtcagactaagccaaacgaaatcgaatgaaaaaaattactctcgctggactcactttgcttgcccttagcacccttgcacctgcccatgccgacgaaaaacgctatgtttctgatgaactttctacctgggttcgcagcggaccgggcgatcagtttcgcctgctcggtaagctgaacgccggggaagaggtgcagctgttacagaccaacaatgacacgcattatggccagatccgtgattcggaaggccgcaccacctggatccccctgtcgcagctcagtgctaatccgagcctgcgcacccgggtgcctcagcttgagcagcaggtgaaagatctgactgccaaactggataacatcgacaacagctggaaccagcgcacggctgagatgcagaacaaagtcgccagcagcgacggcgttatcaacgggctgaaaggcgagaatcagaagctgaaaaatgagctgatcgtcgcgcagaagaaagtcagcgccgctaacgttcagctggatgataagcagcgcaccatcatcatgcagtggtttatgtatggcggcggcgtgctgggcgtcggcctgctgctgggcctgttactgccgcacatgctgccgcgccgtaagaaaagcgatcgctggatgaactgacaccatttagccggatttgagcaggggatcgcaggatcccccttttggcatgtctgcaatccggggaatctgtgcaacaataaaatgatatgcaccgctgatttcaggcgcgggacgcgcccggcgtgcaggtcatttctttttctctggagttttgcgtgaagacgtttcttgttggcggtgcggtgcgtgatgcgctgctgaatctgccggttacagacaaagattgggtggtgacaggttccacgcccgaagccatgcttgagcagggctatcaccaggtcggtcgcgattttcccgttttcctgcatcccgtcagtcgcgaagagtatgcgctggcacgtaccgagcggaaaaacgggaaaggctacaccggttttgtcacctggtccgcgcccgacgtgacgctggagcaggacttacagcgccgcgatctgaccatcaatgcgattgcgcaggatgaaaacggtgagctggtcgatccttataatggccagcgtgatattgccctgcgcctgctgcgtcacgtctctgacgccttcagtgaagatccgctgcgggtactgcgcgttgcgcgctttgcggcgcgttttgcccatctcaactttcgtattgcccccgaaacccagctgctgatgcagcagatggccgaaagcggcgagctgtcgaatctcactgctgagcgggtgtggaaagagacggaaaaggcgctgagttcccgtaatccgcaggtctattttcaggtcctgcgcgactgcggtgcattgcaggtgctgtttcctgagctggataatctgtttggtattcctgcgccgattaagtggcacccggagatcgacactggcgtccatacgctgatgacactggcgatggccgccgccctctccagtgagatcgaggtgcgcttcgccacgctgttccatgacgtcggcaaggcgctgacgccgcctgagttgtggcccagccaccacggtcatggtctggcgggcgttccgctggtcgaggcgctgtgccagcgactgcgggtgccaaacgcgattcgcgatctggcgctgatagtgaccgaatttcacgacgtggtgcacaccattgaacggcaatctgccgcgtcgctggtagcactgtttgaccggatcgatgcctggcgtaagccacagcgcgttgagcagatggcgctgaccagtgaagcggatgcgcgcgggcgagccggactggagagcatgccttatccgcagggcgactatctgcgtcgtgcttttgcgctggcgcaggcggtgccgaccaaagcggtggtcgaagcgggatttaaaggtgcagaagtgcgggaagagttgacgcgacgacggattgacgccgtcgcgcagggtctggcgattacgcagcctgactagcaggctgcgtgggctttacatgaagaccatgtaaaccgcggctgccacaataaagcggtagatcgcgaacgagacaaatgagatgcgtttgatcagctgaaggaaggctttaatcgcaatcagcgccacgataaacgccgtgacaaagcccaccgcgaacatcgggaaatccgccatcgtcaggaagccgatgctcttgtacaaatccagtacggttgcacccatcatcattggcactgccaggatgaaggagaaaactccgacgcggcatagcggctcacgcccatcagcatgccaccggagatggttgcaccggaacgtgagaagcccggccacagcgctaagcactggaaacagccaatcatcaacgcctgacgataggtaatatcatcgacgcccaccgctttcggctgttttggcttaaggtactcagctgccagcagcagcacaccacctaccaccagggcgtacatcacgttgattggattaaacagcgttttgatctgatcgtgcagcaccagacccacgaccaccgccggtaccatacccagcaggatatggatcagcgacagacggccagtgccgacgccttcatgtttgacttcgccaaagtggatgccgatcaggccaaacagacggcgccagaacatcactactacagccagaatcgatcctaactggatcacaacttcaaaggtctcggctttttcaccctcaaagcccagcaggtgacccactataatcatgtgccctgtggaagagaccggtaaaaattcggtcagtccttccacaacgcccaggattgcagctacccaaagctgatgaatatctgccatcaaatgtttcctctatccgtttcaaaaccattaaaaaggcggtagcgcgtggctatcgcctgaaatcatgccgctatcagcctgaattaaaccttaaggtctacaccatttcgcctgctgtaacgaaacggtacacgctatgacagacagtaatttggtttggtttcattgtgatggcaatcacatcgtatttatttaggaatagtcccgcgctcaattcgcacgccaacctgtgctgcctgggctacagcccccggtttgcttacctttatgcggacgccaggcgaattgaaacggttcatcaacagatccgcgatttcttcagcaacccgttcaaccagcgcaaaacgactgccggtaagatgcgtcagaatcgccgaggagacatccgcatagctgagacaatctttcacatcgtcgctgctggccgccagacggttatcccaggccatttcgacatcgagcaccagcttctgctgtatgccctgttcccagtcgtaaacgccaatagtggtgaagaccgtgagttgttctataaatacgatatccatgatgagagtctctgtttttggctaagccggataccacttccggctgattatgcgtattatccacggttaaagagatcaaaacgaccctaaagggaacggtacggtgttatgagtgctttcgcgcttggtatgattattttcgcgtatctttgcggttcgatttccagtgcgattctggtttgcaaactcgctggcctgcccgatccgcgcacacacggttccggcaatccgggtgccaccaacgtcctgcgtctgggcggtaaaaccgcagcagccagcgtattagtgtttgatgtgctgaaagggatggtgccggtctggctggcctatctgatgcacgtgactccgctctatctcggcctgaccgccattgccgcctgtctgggtcatatctatccggtgttctttcactttcgcggtggcaagggtgtggcgacggcatttggtgcgattgcgccgattggctgggacttaaccgggctggtgactggcacctggctgttaacggtcttactcagcggctattcctcgctgggtgccatcgtcagcgcgctgatcgcgcctttttatgtgtggtggttcaaaccgcagttcaccttcccggtttctatgctctcctgtctgatcctgctgcgtcatcacgataatattcagcggctgtggcggggtcaggaaggcaagatctggaagcgcaaaaagaaatctcagccataaaaaaagccggcaagccggcttttttcacatcagatggcgggcagttccgccagcggccagcgcggtcgcacgctgacgcttaactctccccgcgttccgccttttaaccgcaccatgcccgcatacgcgatcatcgcaccgttatcggtacagaactccgggcgggcgtagaacacttcaccgccgcgcttttgcatcatgatcgccatctgctcgcgcagtgtgcggttagcgctgacgccaccggcaatcaccagacgcttaaagccggtctgatccagcgcacgcttacatttgatcgacagcgtatccaccaccgcatcttcaaaggcgcgggcgatgtcagcacgggtctgagcatcatcatcattggcgcggatggtattagcggcaaaggttttcaggccggagaagctgaaatccaggcccggacgatcggtcatcggacgcgggaaggtaaaacgtcccgccgtgccctgctgcgccatcttcgacagcattggcccgcccggataattcagcccaagcagcttggccgttttgtcgaacgcttcacccgcggcatcatcgatcgattcacccagcagcgcgtattcaccaatgccggtgacgctaatcagctgcgtatgtccgcccgacaccaggagtgcgacaaacggaaattccggcggattctcttccagcatcggcgccagcaggtggccttccatatggtggaccggcacggcggggactttccaggcaaacgccagggcgcggccaatggtggcaccaaccagcagcgcaccgaccagtccagggcctgctgtgtaagccaccgcgtcgatctgctgcggctccagaccggcctctttcagcgcagcctgaatcaacggcacggttttccgcacgtgatcacgtgaggccagtttccggcaccacaccgccataatcggcgtgcagttttacctggctgtagagttggttagccagtaatccggcctcgtcatcatagattgcgatgccggtttcatcgcacgacgtttcaatacccagaattcgcattgcatcacctcattcttgcggcgcgcagtttatcacagcaattggatgtgcagcgcgggcatccaccgtaaaaagtcattttctgtcggctaaagagtgcgctatactcccgcccctggaaaaaccggcagccgcacaggcaaacgctcctgttggtttcaaattatccatggtgctttacaaaccaacttgagttggagtaaaatgctgcaccattttgaaatgtgctggcgccgcagtcagcagcaaaaaccgaattttatcgaggtgagagttacatgccggtaattaaagtacgtgaaaacgagccatttgacgtagcactgcgtcgcttcaagcgttcatgcgagaaagcaggcgttctggctgaagttcgtcgtcgtgagttctatgaaaaaccgactaccgaacgtaagcgcgctaaagcgtcagcagttaagcgtcacgccaagaaactggctcgcgaaaacgcacgccgcactcgtctgtactaagtcgttccggaggcccgcctccaccgcgtgattcacgcagacagagtcaagtaaaaggccgtgctttccgaaaggaagcgcggcttgttgccgtttatgagctgaaaatctggggcgtatggctggacgaattccacgcgtatttatcaacgatttacttgcccgcacggatatcgtggatcttatcgatgcccgcgttaagctgaaaaagcagggtaagaatttccatgcgtgctgtcctttccataatgaaaaaacgccctctttcaccgtaaacggcgaaaagcagttctatcactgtttcggctgtggtgcacacggcaacgctatcgactttttaatgaactttgatcgtctggagtttgtggaaagtattgaagagttagccacttcccacggtttagacgtgccttatgaagcaggcagcgggcccagccagatggaacgccatcagcgccagagcctgtatcagctgatggagaacctgaacggtttttatcagcagggtctgcagcaatccagtgcgcagccagcacgcgactatcttgatcgtcgtggtctgagcgccgaaatcatcaatcacttcgccataggttacgcgccagccggctgggataacgtttctcaagcgttttggtaagcaatcggaagatcgcgagtcattgatggaagcgggcatgctggtcagcaatgacaaaggccgtacttatgaccggtttcgcgaccgcgtcatgtttccgattcgcgataagcgtggacgcgtcataggttttggcggacgcgtgctgggtaacgatacgccaaagtatctgaactcgccggaaacacctattttccataaaggccgccagctctatggcctttatgaagccgttaagaaccatcctgaacccgcccgcctgttagtggttgagggatacatggacgtggttgcgctggcgcagtacgggatagattatgccgtcgcgtcattaggcacctccaccactgctgaacacattcagttgctgtttcgcagtaccgacaccgtgatctgctgttacgacggcgacagggctggtcgtgaagcggcatggcgtgcgcttgaaaccgcattgccttacatgaatgatggtcgtcagctacgctttatgtttttacccgatggtgaagacccggatacgctggtacgcaaagagggtaaagaggccttcgaagcgaggatggagcaggcgatgccgctctcttcgtttttatttgatagcctgctgccgcaggtggatctgagctcacgcgacggaaaggcgcgcctgagcacgctggctttaccgctgattacgcagatccctggtgagaccttacgtatttatatgcgtcaggaactggggaataaactgggtattcttgacgacaatcagcttgaaaagctgatgccgaagctggccgcaagcggaacgacgccggtagcaccaccgctgaagcgtaccactatgcgcgtgctgatcgcgttgctgattcagagtccgcagctggccaccctggtgccttcgcttgatgggctgtctgagtcaaaaatgccgggtttaccgctatttattgaattagtgggccgttgtaatgagaatcctggattgaccaccggtcagctactagagttatatcgcggaacaaattttagtcagacgcttgaaacactggcgatctggaaccacatgatagtagatgaggaagccgaagcggtgtttcaggactcgctggccagcatctacgactctgctcttgaagagcgcctggagtttttaattgcgcgtgaacgcacccagggactgagcgccgatgaacgccgggaaactctggacactcagtcaggcgtttgccagaaagtaactgttttcagcacgctgcccgttctgacagatgaaagggcagattgcctgtttagtgctgccagctgtttcactaccgtgaacagtccgggatcgaaatggcccgcagcaccaggtttaaaggcctctggcgtagagccgggtccttagcacacattttaaaggccgcaggcgccgaagtcagtctggtcaccgccagcgcacagcttccggagcgtactgaagtacgtatggaaagcgagcactgccggggataagaatggcgagtaagccaggcccgcagcacatagttttaaggccgcaggcgtcgaagccagtctggtcaccgccagcgcacagcttccggagcgtactgaagtacgtgaggaaagcgagcactgccggggacaagaatggcaagtaagccaggcccttagcacagagtttatacaagcggcttaagtgccgaatactgatgggcaaagcccacgccgcgacgaaggcagcggcaagaattaaatgcctttactgctattgttggctcgctgccgaccgacaccaatctaatttaacagaagtgtggataccgtcttatggagcaaaacccgcagtcacagctcaagcttcttgtcacccgtggtaaggagcaaggctatctgacctatgctgaggtcaatgaccatctgccggaagatatcgtcgactcagatcagatcgaagacatcatccagatgattaacgacatgggtattcaggtggttgaagaagccccggatgccgacgatctgatgctgaacgaaaacagctccgatactgacgaagatgccgcggaagctgccgctcaggtgttatccagcgttgaatctgaaatcgggcgtaccactgacccggtccgcatgtatatgcgtgaaatgggtaccgttgaactgctgacgcgcgaaggcgaaattgacatcgctaagcgtattgaagacggtatcaaccaggttcagtgttctgtagccgaataccctgaagcgattacgtatcttctggatcagtacgacaaagttgaagcaggcgaatcacgcctctccgatctgatcaccggtttcgtcgatcctaacgcagaagaagatatcgccccaacggcaacgcacgtgggctctgaactttctgaagccgatcgtaaggacgatgaagaagaagatgaggaggatgatgacagctccgacgacgataactcaatcgatccggaactggcgcgtgagaagttttctgacctgcgtaagcagtatgaaactacccgcgcagtgattaaaagcaaaggtcgcagtcatgctgccgccgttgctgaaatccagaacctctctgatgtcttcaagcagttccgcctggtaccgaagcagttcgattacctggtaggcagcatgcgcaccatgatggaacgcgttcgtacgcaggaacgtctgatcatgaagctctgtattgagctttgcaaaatgccgaagaaaaactttatcacgctgtttaccggcaacgaaaccaatgaaacctggttcaaagctgctctggccatgaacaagccgtggtctgaaaaactgctggaagtgcaggacgacgtgacacgttccctgcagaaactggcgcaggttgaagaagagaccggtctgaccattgaacaggtcaaagacattaaccgtcgcatgtcgatcggtgaagccaaagcacgtcgcgccaagaaagagatggtggaagctaacctgcgtctggttatttcgattgccaagaaatataccaaccgcggtctgcagttccttgacctgattcaggaaggtaatatcggcctgatgaaagcggtagataagtttgaatatcgccgtggttacaagttctcaacctatgcgacctggtggatccgtcaggctatcacccgctctatcgccgaccaggcgcgtaccatccgtattccggtgcatatgattgagaccatcaacaagctcaaccgtatttcacgccagatgctgcaggagatgggccgcgaacctacgccggaagagctggctgaacgtatgctgatgccagaagataaaatccgcaaggtgctgaaaatcgctaaagagccgatctctatggagacgccgattggtgatgatgaagattcacatctgggcgattttatcgaagacaccacgctggagctgccgctggattctgctacctcagagagcctgcgttctgctacccatgacgtgctggctggcctgaccgcgcgcgaagcgaaagtgctgcgcatgcgtttcggtatcgatatgaacactgaccatacgctggaagaagtgggcaaacagttcgacgttacgcgtgaacgtattcgtcagattgaagccaaagctctgcgtaaactgcgccatccgagccgttcggaagtgctgcgcagcttcctcgacgattaagtcagacaaaaaccccggttcgccggggttttttatgcctgcctgttactgcctctcccctgccctgcgcagattcattcgttccccgcatgcagttccacatagagctgacgatacgcctctaccatctcgtccagagatgcgcgattaaggccgctgggattcggcaatacccatacctgcgttttccccatacatatgggctgtttgccccattcgactttactctgcttaaaagcacgacgaaacgcatccttacccagaatcgccagcgcagccggctggtaatccagtaccttttccatcagccgtttaccgccatcgcgcagctcatcaggcgctaactcactcgcctgtaccgtaggccgctcaaccagcatggtgatgccgcagccggtctccgttaagcgctgctcctcttccggcttcagctgctgctgggtgaatccggccagatggatcactttccagaaccggttgccgggatgcgcaaagtgaaacccctgatgggcggttgactgacccgggttaatgccacagaacagcacatcaagaccggaggtgatgatgtcgcggatcgcgtgttcactcatgccgccacctccagcgtgcgctgcttcagcgcatcgcggctgcgttgcagcatctggctggcctgctcggcatccggacaggcacgcgccagcgccagcgcaccaaccatctctgcgagcatgctggaggccagcgcttccgcatcgggcagcctcagttcacgcaatatctgcgccagaccggcatgcatcgcgttaaagccctgtgcgaagatctgccgcgttggctgtggaagatgagctacttcactcaccagagcggctaatggacagccctgcgccggtgcattgcgatgcgcctcggaaagatagctatcaataaaatctgccagctgctgcgctggctgggtcacggactccgcgggcttgaaggtatcggcttcagcaaacatatgcttcagtacctcctcaaccagctcctcgcgtgaggtaaaatgcgcataaaaaccgccatgtgtcagaccgacccgcttcatcagcgccgctacaccaattccttcggtgccggtttcacgcatcacgcgcgccgcctcatcaaggatacgccgccgcgtatgcgctttgctgctctgcttctccatctcatctcctgcggtatctgttacgtagcgtctggctattatagtaattattacggtcatcatattccagcttgacgacagatatgatgatcgtcatattgatagctattatgacgaccatcatacgaggaaaaagagatgtcacaatcaggcacagctttaatcaccggcgcatccagcggtatcggtgcgacctatgcaaaacgactggcagcacgcggttatgatttgattctggttgcacgcgatcaggggcggctcaccaccctggctgacgcactggcaaagcagcacgatattcgggtgacggttatggcggctgacttaacgcacgagcaggatctgcaacgcgtggagtcggagctcgcgaacaacgcacagattacgctgctgctgaacaacgcgggcatgaacgttgagggagagtttcttgaggcggacatcacacgcattaacagtatgctggcgttgaatattctggcacccacccgtctggcacaggcggctggccgggctttcaaagcacgcggaaatggcatcattatcaatatcgcgtcggtgctgtcgctggtgcacgagatgttcaacggcgcttataacgccactaagtcttacgtactgactctgacgcgtgcgatgcagcgtgaactcgcagagagcggcgtgcaggtacaggcggtgttgcccggtgcgacccgtacggagattttcgaccgcgcaggccagtctattaatgacattccggctgaaatgctgatggacgttgatgagatggtggacgccgcgcttgccggactcgacagcaaggagacggtaactattccggcgctggaagatctgcagatgtggcacgactacgatcaggctcgtggcacaatggttccccacctttcacggaatcaatcagcatcccgttatcgtcagagctgagccagccatcagccataatgactgaagtccggtttcactaaaggcacggagaagcattatccgtgcctgtttgcgacttcgggatcgcggttcgacagttttgttatagaaatcagcaggtaaatcactgctgcttatttcagcaaccggtggctgagtgctggattgccctgaagagatactttataatccccgctccgctggccccttagctcagtggttagagcaggcgactcataatcgcttggtcgctggttcaaacccagcaggggccaccaaatttcaatataaaaaacatatagataagccgctcattgaagcggtttttttgtatctggcttttcgagtggcggtaaagtggcggtgcattttcctcaacagccttatcatgccgctgctgattgctttaagcaggtggaacaagactactaaacaaagcaaaaaagctcagaagtatgtaaagtaactcgcttatcaatagggagaagctctgatagttttttccagccaaataaaattaccgtctgtatcgtaaatctgccacaatgccggtgtctgaaatggtgaatagtcgatactcatacctgttcaccatcaacgataggctttatgccatttgtataaatcgttggggctttcaaagaattaatcgtatgttcataacggctgaaaagtgtagtagcgatccgattcttcacttgctaccaatcttgtaacaaggagcacgtcactttaattcaagataatgaataatattaccagctaatatagataggatttataaactgtataaaatagagggacaagtaaatgcatcattttcttgaaatgctctcagatttgcttaccaattggcctgtaacagcagggaagcgagagaaaaagccaagaaaagacagaaagaaaatatcaactcttcactacaaacctatatgcaagatcacgactgatcgaaaaagtaacgatataccgaagaaagatgaggccaactaagaaaaatatttatatttacaaaacaagtcttattacttgtaaaaaatttcagtggatataattaagatcataataacagcatctgctgctgacctctgcctgggtatgacgagccgtctttagcattaccaggcaatgtgataatttcgacatcgccttatggaatttaaaagtgtagctataaaaggtttaaaaatgaaagttctgtggaatactccttctcattcaagtacctaatgagacgccggatgaagatatcaagccattaatgagtagtaagcccccagcaatcctgcacaaactcaatgtcatagcgagctattagtagcgctcataccaatatcaacctctgttatactcagtagttttaactactttccttttggctattttaatttcatatccaatcttttaattttaaaaaaatgaacactcttttctactgcatcacattttagtaaagccactcccccgcttcagctgaattaatcagcatctgaacagtcaaaggctcaggttgatgatgatcggtgcgcaaatattttggcaaaatagcgttcggcaaaaaagggattcctgtagccgggaaatagagacgaaaatagaatcgcttcatatcaacattaaatatgttcagcatattcttcaaaaaaatcaaaagcctcttcaggcaaaacgcaatttttacctgtactcagggatgcatcagctggcatttcccaaaagtatttctttatcagacgatgaacatcttcaactttactcataaccagccttatcctttttcacctgtaatcagcttatagcgatgaacaacattgcgggtaataatcgaaagatcatatgcagttaacacagcgccaatccagggcacccaacgtccaacatatgccccgacacttgttgtatattcccattcaccgtgcagcatgcttttccatgtaatagtacgactttttttctgaaaacgctggcgaataagcattcggcttgcgagagaaagcggtctggttccacgtgtatttttttgaggatccaacttactatagtctcagcttccccgatcaagcttctgcagaggataattttatgtttaacgcctgtacggtttatacatactttctccattacgtaagcgatgcttttaaccgaagcagtaataatctacgtagcccatgcataattcgttaataaaaatctaactaatgatatgcatcactctgactttgttagtcagctttatagttttattgctttttttacaaccataaagaaggccataatctgtgtcacggccttgttgtttgatagcttaattacggataaaaacacataccgatcatgcttctccttttagcttatccagcaggtaagcaactaagtaggccagcatgaagaacccgaagaaaccaataattttccatagccagccatcaagtaaaaacaaagagaaaaatgcggcaaatgagcaaatacccgtagaaatggcttcaacaacatttgtggtttgtataccaatgaacttaacgaattttagaagaaatgattttgcagagttcattttgtatcctttcacaaattaatctatggctgttgatataaatcagatagggttcgagtggcctctctacgaggaaatagaccatatccagattcattcgtgaaacctttgaataggtcattggaaatctattttgcatccgtcttgatgcgactgaagcctcttcaatcaatccttgcaccatgagaatgttcaacgaaagcgatgaaccaactctgacaaaccgcttaaaggcctcaactgtcacgatacgagttagtattcttttagcaataaattgggccaagaaaaattgtgaaccaatccttccccccattctgccagcaccatagcccagcttactatcgatagcttgtttgctttcattatcgagctttgcgtagaaatcgttaatcacaatagtaatcagttgccggatgggttcatgtctgtctgcagtggctttgattaatcgcataaaccgttcagtttccctttgatttcggttcttcagatcgctcccggcaagaccgcttccctcccatgtttcttacaactccctgatacatgcctgaagggatagatgacataccctccacgattccataggcaatttgctttgcatccatacttattccttgtaagcaaataatgttcaaggctgagaatatctaatctgaagtagtaattccattagcactctatttaagttgtttatgcgtcagtcattcttttgatctactgattactagcgttatttattgattcaattaataagtacatcaaatgttcgcgatctatccaaaaaattcatgattaagtttattttcaataataacaataagttagattctttttcagaccattctttaagattaaatcactaaaactctttttaattttttagtttggttttccgataaaagcccaatggcagtgcggactgtcgatgtagtttgtagcaaaatgaaactgaaaatttttatgttcagaattgcactgccgggagcagtgtagccgccgtttttgtcttcaggacgattatttgccggtgttgacccgcagtcagtgccagactatgcggatactctctttgtggttatcgtgctcgtagtggcctcgcattagcgtggtgctgcgtacgtttggtgctctctggtgatggataatcaaaaacccgctgcaatagcgagttatcagtgtggattatttgccaatcacgggcaaatgtctggcattaagcacggcggccttctggccaatctacgcaatgtcgctgctattaactggctggccgcggatcaaagggctcgtcttgctggccagcaaactgctgcacaagctccaggatatcgctcatcaactgagccacgctattctttgctaagccaatccattagcgcacttatcttctgccacgtcccgacaatgctcttactaacctggccgattttttcagtcagcgcatgccagaccgtaatcaccgcgctgccgtcactcatcttaagcacctgcacgccttggtgaaaatcactcagccggttactccgtggttagtccgactcagccagacgtgcgatctcgtcatcagctgcaatgctgatatcaaccgcatccagtagcggcgtggtggtccgctttgcctcatcggtcgcggcggcgagtcaggtgatagccttcagcactgcattttcagcttccggtacctggactaaggtttcacctctcctttccctgattaacctcacactctcatacccactattttccctgtaaaagacaccgctaatcttcactctgataacccgactgatatcctggagtcactttttaaccctgcagagggtgtatcagattattttcataaacccgctatgtttacggatatgaacaaatgcagtccagacgggccaattgaaatctgcacaacgtgtgcgctgaggtcagattcacaattctgcagattaatttattgaacagaagagtatgaatagattagaggtttatcatgaaaagttcatcaagtgctgaactctgctgccgggtaattcgtggaagaaccatcatgccgctgaagaaagttgcgttgtatcaggtcgaatttgaaaatggcagatttgctgtgttacgcattaataaccttctgacgcttcaggaaggcgatattatctcaagagttaatgaagtgtggtctgcaggaccagatattattcaactgtcaccattcgaatttctcgaccagggtgaatcaaagcgttatttcaccgagtacgaaagataatgcagagttatcagcacattgaaattaatgttacgaagatattgcctcaatgagggataaggttaaacagtatgacttgctgctgcctgttgatcgcaacataaaaagacggcggactttatataacatacaatgacttacagtgagggcataagactgcctgtcctttattctttttagctacagactgtctggaaaactttttacacaccggacactgtgtattggtttcgctgctgtgtagcgcgtcgaagagaaagctcaaccaggtcatgtcgttatcctctgaaatgtttccctcagcgtaacacagtggaggtaaattaatttttttatctgtcggctctgatgttaaacagggctaaggtgaggagaaggcagctgtttattttttttaactttattttatcgccataaagaaacgccagccggttaatcaggatagctacgaataacggaaacaggactataatcaataccatctacacctgtttatcacctccagcccttcttttggctacttttttgtcatcctttctttttttccggatccagctgctgcgtaagcgcaaggaaatgagtgtgaaaataaaactgacgacgtggttcagccgggaaagtgaattacccgatgagcattttcctttgttcccgacagaaggtatttatcaggcccaccggccagatattttttcggctgaacaaatggataactacggcgaaaaattagcgaaaacgcataatctgtcgggtggaaaatggtcctaccgactgttgcagcagctggcagataatgaactgtcattgacgcgcagcgcagagatcctgagtgaaggcgataagcgcagccagacaccggcggccgtctggatactggataatttttacatcattgaagagcagatccgcctggtccggcacctgttaccggcaaaattcggtaaaggactgcccatgctggaggagtcggctcattacctgcgcatccaggctatcgccgaggagatgattaagcacagtgatggcagactggaaaccagcgtcctgcatccttttattgctgcctaccagcgcgttacgcccctgctgctcggcgaactgtgggccctgcctgccatgttacgttttgcgcttatcaacaatctgtcccggattgcggctgacgtggccagggtacatcaggaacgtaataaagcggagcagtggatcagcgatatcctctccactgccgccgaagatgcgtcaaaagttattctggtcatcgctgatatggcccgccagaacccgcaggtttccggcgctttcgtcgctgaactcgaacggcgattaagtggccagaacaataccctggcgttaacctgggtcgaacaacagctggaaaataccggccggaaaacctcggaagtcattgagcagttcaaccggcagctggccctgagtcagctctctgtcagcaacagtattaccggcctgcggcaactcggcgaaattgactggcaggcctttgtcgaatccgtcagcctggttgagaaagtcctgcagcaggatcccaccgggacatacccgctgatgcattttgacagtcgcgatgactaccgccacgtgattgaacgtctggcgcggcacagtcggtttgatgaacgtgaagtcgcccaggctgtgctgacgctggccagccagcctgatcttcccctgcgtcagcagcatgtcggctattacctgctggataaaggatttcagcaactggaacagcagcttgacgttaaagtgacgtggctgaacaggagccggcagcatctgagccagactcctttactctcctggttaggcagccttttactgctgacaaccgcgtttaccgccgagatgctctacagcacccatcaggcgggcatggcgtctttactctggttgctggtgctgcccgccatcattgtcagcagccagctagccttgcagttgctgagcgagttaaccacccgtagccgccatccccttcccctgccccgactcgattattctctggcggtaccggagcatgaccgcacactggtggttatcccctgtttactcagcagcaatgagggaacagacgccctgttgcgctctctggaaatctgctatctcggtaacgccttagcgaatatcagttttgcgttactgaccgactttaccgatagcgccgaacaggatcatcatcatgacgccgcgcttatccgttacgccgtgctgaaaacggaagcgatgaatcggcgctacagcgggggtaaatcggacattgcgctcttctccctgttacatcgtgaccgcacccataatatttctcagggcgtctggatggggtatgaacgcaagcgcggtaagatccatgccctgaatcgctggcttcagggtgaagaaaacgccttcagcgtcactgtaggtgccacgcagacacagctgcacagcgttaaatatgtgattactctcgacagcgacacaatactgccgcgtgagactgcgcataagctgattggcgtcatggcccacccgctcaatgcgccggtattcgacgatgtcaaaaatcgggtagttgaaggctatgccatcctgcagcctcgtctggctgaagagataccggttaacggtcagagccgctatgcccggctgtgcagcagcattccggggaatgatgcttactcctcactctcatccgatatttatcaggatctgtttggtgaaggctcatttgtcggcaagggtatttacgatgtcgctgcctttagccgggcgatacgcaatacctgtccggaaaatctggtgctgagccatgacctgcttgaggggtgctatgcccgctccggtgtggtcagtaacgtcgtcctgtatgaacaatatccggatagttatctgagcgatgttgcccgacgatttcgctgggtgcggggcgactggcagctccttaactggctacggttgcaggtgcggcaggaagattgcagtcgtcaaaagaacccgctcagtgcgctttcccgctggaaattaacagacaacctgcgccgcagcctggtggcgcctgccctgctgatgctggtgtttatgctgtgcacgatagtaccgaacccggcattctgggtcggatgcatcatgctctttctgctgcttccgggactgccagcgttggtaatcgacggggtgacgaaaagtaaaaagcgtgcctggcggcagcatttatccatgctggtcaccgatgcctttaaccgcctctcccgcgctggcctggcgctggccatcctgcctcacgagagttactggtcgctgaaggcgattatcgtaaccttatggcgcctgactatcagccaccgctttctgaacgagtggaaaagcgcttcatcacagaaacctgtcgagcctgatgtgcgccatttctaccgccgcatgtggattaatccggtagcaggcgcggctctggtattcctgaccagcctgagcatgccgttgatgacgcatgtcgcactggcgctcgctttattgtgggcggtcgcccccgcgttactgagccgcatgagccagcctaaacgcgctcagccaggcagcctttcagcggaacagcgcatctttttgcgtcgcaccgcgcgtagaaaacctgggcctggtttaacgaatttgccagcagtgataacaaccatttgccgccggataatctgcaggagattccggagtcgcgggtggcccaccggacctcaccgaccaacattggcctgtcgctgctggcaaacctgacggcctgggattttggttatatcagccagaatcgggtcatcagccggacgctcgacaccctagatacccttgatcgaatggagcatttcagaggacatctttataactggtatgacacccagacgttaaaaccgctgaacccacgctacgtctcaacggtagacagcggtaatatggcggctcaccttgtgacccttcaggctggcctggcgcagtggaaataccagccggtgatgtctctcccctgtatcctggaaggtctctccgataccttctcactgcttaaagaccaactgagcgacacccgcagcgacattgtggaacaaatcgcagctaagctaagcctgatgcagcgcgcttcacccgccgattttcacgccgggatgcaggctctgctggcattaagcgtggtagcagaacaggcttatcttccgacaacgcgggtaaactggccggcgcttttccagcagcagctggtcgattttactcaggagtggtccctccttttcagctgggttagcccggatgcgccactgcctgccgacattccgtcattgctgtggctcgctgagttgaacctgaaccgccccggactcccggaaaaacaggcagagacggcaatatgggccgcccgcgaacggatggctgccctgctggagctggacagccgcctcagcgatcacgccagtatggacttccgctttctctattatccggccacgtctttactcagcgtgggctataacatggacagcggtctgctggacgccagcaaatatgaccttttcccttcagaagtccgcctgacgcactactttgctatctccaccagtcagcttccggccaagagctggtttgtactgggtcgcctatttactcaactgaataaccagcccgccgtgatgtcatggagcggctcaatgtttgaatacctgatgccgcacctggtcatgccggtttaccccgacacgctgctggaaaagatggcgttatcggcggtcaggcaacaaattgtctcgggtaacagcaccgatacgccctggggcgtttcggaatcgggttacgctgcgtttgacgtcaatcataactaccagtatcgggcatttggtacgccggaactgggtctgaaacgcggcctgaatgacaatcatgttgttgcgccctatgcgacgctgctggcgctgatggtgctgccgcaggaggcgacggctaatctgataagacttaaaaaaatgggtgccagcggtgactacggttattacgaagcgctggatttcaccgcggatcgactggctcccggtcagccatttgcgatcgtcaaatcgtatatggctcatcaccaggcgatgggattgctagcactctctcaccagctgctggatgcgcccatggtcgcgcgctttatgtccagcgcactgtttcagtcgtcgcgtttgctgcttcaggaaaaagtgcctgatgatattgagctctataccccacgccgcagttttgtcgaaaacagtgaccctaaacagcagcgcagcattcccgaccagcgtgaattcagtggttcagatccgcgccagccacaacttcagctgctttccaatgcagattatcatctgatggtgacgcacgcggggacaggctacagccagtggaaggggctggcactcacccgctggcgtgcggatagcaccagcaacaactacggaacgttctgttacgttaccgatcagcaatccgccgaagtgattgctcacagctatcagccgacctgctgcgagcgtccgcattataaaacccgtttcaatgatgccgggattgagtttgacgcttcaggcaccaccttcagcattcacacgcatatcgtggtctccccggaagatgatgtggagatcagacgcatcacggtcactaaccgtttcccgtcagacccgcccgttcgatatcaccagctacaccgaagtggtactggcaccagcagccagcgatatggcccaccctgcgttcagtaatctgttcgtccagactgaaatcgttgacaggctggaagcgattctggctcaccgtcggccacgtgaagagaatgaagtgacggcatggatgtttcacgcgatggcgatacatggcaataccggccgccagacctcttttgaaaccgaccgggctcgttttctcgggcgcggcaggacaccagccgatgctcaggcgctgatgccgggcagtgaattaacgggtcagcagggggcagtgttagatcccgtgttatcaattcgccagtcagtgacgttaaaagcgggagaggccgtcaccatcgatatgctttacggtgtgacacttcaacgtgacaccactattgcgttgattgagaagtaccgtaaccacatcagcgccgatcgggtgtttgaactggcgtggtcccacagtcaggtcgccttgcgtcagttgaatattcgcaccgaagataccagcctgttcaatcagctggccagtgccatactgttttccagcgccgaaatgcgtggcgaatcagacgcgctgatgcagaaccggctgggccaggagtcattgtggcgtcatgcgatttcgggtgatctgccgattcttctggttcggatagaaaacattaatcagctcgacctggtcaccaccctcattcaggcgcaccagtactggcgacaaaaagggctgacggtcgatctgctcatcctgaacagtgaccagggcgggtaccagcagaacctgttcaatcagctcacgaccctgatccctgccggagatgaacggcagcaggcggacaaacctggcggcatatttatccgcaaaagcgaaagtttttccgctgacgatctgcaactgttgctgagcgtcgcggcggtcgtgctggaaggccggaacggcagcctcgccgatcagctcagcacgctgttaaaaccggtgcgcaccccgcctgcatttgcgtttccatcgatcagtaagacgccgccgcctgcagccgtcaccttttcgccggagcggttgcagttttttaatggcaccggtggcttcaacgaagacggcagcgaatatcacatcattctttccggccagcagcagacgcctgcgccgtggtgcaatgtgctggccaacagccagttgggcaccgtcatttccgagagtggccagggctatagctggtatgaaaacgcgcatgaatatcgtctgacgccctggcacaacgatcccgtcagtgacagctctggcgaagcgctttatctgcgtgatgaagagacgggtgatgtctggtcgccgacgccgcttccggttcgcggcaagggggattatctgacccgtcatggcttcggttacagcacgtttgaacacacggagtatggcatcagcagcacgttaacggtgttcgtggcagaggaggcgccggtcagactttccctgctgacgctgagtaacctctctggcaaaacgcgtaatctttcgattaccggatacgtcgaatgggttctgggtgagctggcgagccgctccgcaaggcatgtggtgacgtcccctgccgctatcgccacaggcagcgcggttctggccagaaacttttataacagcacgggctctgcgcggaccgctttttttgccgtcacaggtacccggattgcgtacagcggcaaccggcttgagtgtctgggccgtaacggcaccacacggcagcccgcgatgatgaatgttcgtggtctgtcgggtaacaccggggcaggaatggatccctgcgccgcgctgcagacgctgacgacactgattgacggcgacagccgcagctttgtttttgcccttggcgtcggggaagatgagagtgcagtgacagcgctaatgcagcagtttcctctccaccggggaggctcagaacgagctgaccagggttaaacagcactggcaccagctactgactaaagtgcaaatccagacaccggcaacggaggtcgatttactggcaaacggctggctgctgtaccagacgctggccagccgtttgctggcgcgcagcggatattaccaatccggtggtgcctttggtttccgcgatcagttgcaggatacgctggcgctgactcacgcggccccgcagcggctgcgcgatcagctgttgttgtgtgcatcccgccagtttatcgagggagatgtacagcactggtggcatccgcctgctggccgtggcgtcagaacccgctgctccgacgactacctgtggttgccctatgcgctgtgccgctatgtgcaggcaaccgatgatattgcgctgctgtcacagcctgtcagctaccttgaaggtcgcctgctggcagaggacgaagagtctgtctatgagcttccgggcgtcagtaagattaatgaaccgctatggcagcactgcgttcgcgcggttaaccacgcccttaatttcggccagcacggcctcccgctgatgggctccggggactggaacgatggcatgagtaccgtcgggattgccggcaagggtgaaagcgtctggctcggcttcttcctctatacggttctggaccgctttgccgcgctggctgtgcggttcggcgataccgataccgcccgccactgtcaggagcacgcgcagacgctcaaaaccgcgcttaaccatgcggcctgggatggcgaatggtatctgcgcggcttttttgacagtggccagacgctcggttcacatgctgacagtgagtgccggatagacgccattgcccagagctggtcggtactctctggcgcaggcgaggacgccagatgccggtcagcgatggcggcgctttatcagcatctggttgataaggataaccggctgattaaattactcactccgcctttcgatggcgcagggccgaatccgggctacattcgcggttatttaccgggggtccgggaaaatggcggccagtacacccatggcgctctgtgggcgattatggcctttgcggcgatgggtgaaacagagcgcgcctggtccctgctctcgatgattaatccggttaatcatagtggcaatcaacaggatgtgaagatctacaaagcggagccttatgtgatggctgcggatgtgtatgcggccgaaggccatggagggcgaggcggctggacctggtataccggttcgtcaggctggacctatcagcttatcagtgagagtctgcttgggataacccggcgcggcaatgctctgtctgtccggccacagcttcccgcggcctggacagagataaaaatcgtctaccgtgagggggaagggatctacaacatccgggttactcgcggtgacagcacttatcagctgtggctggatggcaaacggtgtgacggtgacgaaatagcgctggaaagccatagccaggaacatcaggttgaagtcaggctgggctctgcgtcagattaagttaaacctgacaacccgcctgcatcagcttaaagaggatattcagtggcctttgcgagcgggccgttgagctgccagccgcgtcaccacgggcagctcaacgacagcgatctggtgaatggcgagggttaatcgcctgctcacaattatctgtcgccctgccctgttttccctcgcgaagcccatgctatcttgtggttttgattttttcagtgggcaaaattgatgacaaagttgcgggtagggatcgtgtttggcggaaaatcggctgagcatgaggtgtcgttacagtcggccaaaaatatccttgaggcgatcgacaaaaccaggtttgacgtggtgttgctgggcatcgataagcagggacactggcgtcttaacgatgcttcaaacttcttgcttaacgctgaaaatccggctttgatcgcgctgaatcacgccgctgaagatgtggcgctggtgcccggcacgactcagcagcagatcatcacccgtcataacgcccatccactgtcgcagatcgacgttatcttccctatcgtgcacggtacgctgggtgaagatggctccctgcagggcctgttgcgtatggcctcgttaccttttgtcggttccgacgtgctgggctctgcggtcagcatggataaagattttaccaaacgcctcctgcgcgacgcaggcctcaacgtcgcgccgtgggtgagcgtcacccaggcccagcgtgcacagctggacgccagcgcagtcattgcccgctttggcctgccgctgtttatcaaacccgccaaccagggttcatcggtgggcgtcagcaaagtggatagcattgaagaatttgatgccgcgctggcgctggccttctcctttgaccgcaaggtgctgattgagcagggtatcaaaggtcgcgagatcgagtgtgcggtgctgggcaacgatgcccctgaagccagcccctgcggtgaagtagtggtgcatgacgccttctattcatatgacaccaaatatatctccgagagcggtgcgcagacggtggtcccggcagccatttcaccggaaaccagcgatacgattcgtgaggttgccatcaaggcctttaccgcgctggagtgctttggcatggcgcgcgtcgatgtgtttttaactgacgacggcgaaattatcgtcaacgaagtgaataccctgcccggattcaccaatatcagcatgtatccgaaactgtggcaggcggccggactcagctatcaggatctgatcagtcgcctgatcgacctggcgattgaacgccaccagcaggccagtaccctgaaaagcagcgtcagctgacagaaacccggcggcgtggcgttatgccacgtcgctggtgatggcacggtagttaaccggtgaggtctgattgcggccattacgtttcgacagatagagatttttatcggctgcggagatcagccggttgatgacgcggtgccactccgtcgcctcaccggcattgccatgcgccagccccagactgacggtgaccgtggccgtactgccctgcagccagaacttctctttcgccatcttctgccggatgctctcagcaagaaagtagagcttttccggattctggtcgaacagcaccaccgcaaactcttcgccgccaaaacggcagatgcgcccctctttacccacgacgcgctgcatacggcgggcgatctcttccagcacgctgtcacccgcatcatgaccaaaattgtcattaatcgctttaaagtagtcgacatccagcaggatcacgcccgcccggcggtccgggaagattggctcagcacgcagactttcatagaggccggaccgcgacagcagccgggtcaggaagtcatagttggctcgcagcgccagacgctggttgagctggcgaatcgcatccatgctcaccgccacaatcagcgggctgatcgcaatggtcgccacgcccagccgtgccgaggtcagatgggtgatcggcagcatattatcatcgccctggatattcatcacgccgtgcgaaaccagaatgatttcgctaatgccggtgagcaaaatcaccagactggtgagcggcatcggcagcacgatggcgcaccagaccagcgccggaaccgggaacgtcaggctgcctgcgccgcccatcatcgcgccaatcatcagcgaaaaaatcacggcgacaaccggtgccagcttgcgcatctgcataaactgccggggcgacagcgacgcccagtcgcgcgtcagcaaaaagggcagcagcatcagcccggttgagaactgttcgctgaaccattcgccccaggccgtcaccagcccgctgttaaaatcggcctgctgcgccagcgccccccagctggcgcaggccagtccggccagcagacaggccggaaaaatgcgcagcacgctggttatacgctcgctgccggagtcgtgctgaagatgttttaccagcagcgtcaccgccaccagcacaaacagaagattcgccatgttgagggtaaaagcagagagcgcccagcctgaaaaaacgatgtcgttaaacaccatcgcagcaaaggtggccaggtaatagcgggtctgatgcagaaaaggattccggacgatcacgccagtgacgatcgcgttgaccggccagaacagcgacagctcctgtggaaagcgcaggtgtccgccgataaagcaaaacagcaacgtgattaaaaacagtgaaaatgcgttcttcttaacgttgtgctcttcaaacagctgtatgcgcatacatccggaccttgtcacagagaggctggctgtccacgccagcctggacaggcgcgtggtgtcagaatgattaaatcctgaatatcctcaatgtcatccggcgataaaacctcgtttcataggctaactcagaaaagttaccgttttgaggctaaacccatcagatgacagcaaaaactggggctctattatgcatcgcaaataaaaaaatcggatatccgagatatccgatttttgctgttctgacgactttaccgttgcgctaaacgctattttacggcaaccggccactgactcaggcgaatgccgcgtttgtcggcattatcgccaaaatctttcagcaccgctttgacgtcgggatcgatatattccgcattgtcgttatcgacgatgacgacgctgttctccgggatctcatccagcaatccctgcagctttggattgtgcataaaggtcaggttctgctgaaagcgcagcacgtagtggtcgtcatagcgggtgagctgcagcgcgttgcgatggcttttatagatgctatagaggatctgcgtggcgatgccgataccaatcccgaccagcatgcccagcgtgataataccgacgatggtggccagaaacggcacgtactgctgcgcgcccatccggaactgctcaacaaacaatttgggtgtcgccagcttgtagccggtatagagcagcacggcagcgaggctggccagcggaatggcgttcagcatctcactgaaccacataccgcaaatcagcagcagcacaccgtgaatgaagatcgacagtttggtctgcgcgcccgcactgacgttaaccgaaactgcgcacgatcaccgccgttatcggcatcgcgccaaggaaaccggccgccaggttaccgatgccctgcgcgaacatctctttgttaggcgatggcgcgggcgtctgaggacgcagttttttcagcgcttcctgactcagcagcgtttccagactggcgaccagggctaaggtcaccgcaacgacccagacctgcggattttgccaggccatccagtcgggcgtttccagctctgccatcagcgcggaaatgctgtcaaaagcgggcaatgaaatgcgcgccagaccgctggtcatctccgggaacagccgtccacccacgacggtagcaaggcagcctatcagcacggcaatcagcggcccagggatccaggccagcgctttgatccgcttcaccggtgcggtagtccagagacataaaatggccaggccgacacccgctaccgctaccgcaggcagcgagaaggtcatctcaccggtcaccagtgaaaccagctccgcatcgcccgcggctcccagcgccaccgggatctgctgcatgatcagcagcaaaccgatcgctgccagcatccctttgatgacgctgcccggcaccagcgaaataaaccgtccggcacgcagcaggccaaacagacattgcagtgctccggcgataatcagcgcggtgagaaaggcggaaaaactgcccagagacgccattgaggcaacgacgatggtgaccaggcctgccgccgggccgctgacggcaaaccgggacggactcagtgatgtgaccaccaggccgccaatcacaccagtcagcagaccggcaaacggcggtaatccgctggcctgtgcgatgccaagacagagcggtaaggcgaccagaaacaccaccagacccgcaggaatgtcgcgacgcagggtatcgaggttcataatgaaggttcctctgcagattgatgaatcagctctttaagatggccggagcgcaggtcatacacacaaccaaacacctccagtttcctggcccgattgccagatttgccggaccggttcagatttcaccagtctggcgaattgcgccttaacgttggcctcaaccagccgatcgagctgttcacccggctccgcgtctgaaggggggctttccgccaggccatgctgaatgtcatgacgcagcgtctgaatgcgtctcgccagcgcgctctcctgcccgtccagcacgctacccggcagattctgcgcggcttccaccccaccgcagccatagtggccgcttaatacaatgcgttttacaccgagaaagaagagcgcgtattgcagcacgctcagtaaattgtcatcgtcctcaatcaccatgttggcgatattacgatgcacaaagagttcgccaggatgggagccggttaagacttctgccggaacgcgactatcagaacaacctatccagagtgagtgcggcttttgctgatgaaggaattttttaaagtagtctggattacgctggcggcgctgtaatgcccaactgcgatttttcgctaataagggtttaagtgtcgtcacaatcatcttctctctactaccgggatgtcgcatcctggctaaccacaaagtgtatcggctcacaaataaagcgtgagccgccaggtaaataagaactgagtcacagaaaaaggttatagccgctaaccattaccaatgcacgagcaatatttcacagcactttaacatcatgctatttgtcaatctggcgtcagtaagagtcaggggtaagtaaatttaattaagcagcagagaagtgaaataattagcggaaaccattttaagatcaataatatcaatagattaaaatataaaagataataaactaaagttattgctgacaaaaaaatacaatcattaaccaaggggatattcactgccataccaaccggcctgctttttaccaggaatactcttaattaaaaaattaaccattagcacgatcaaccggcttaattgctgatagccagtcagatatgcctgattttagataagaatgaagcaagagataattaatttaatttgcagcaaaatagtgacgggagaaagtaaatcaggaccatgttttaacagagcctgacacggtcaggctctttttcttgacgaattatttaccgttccagctttgcaggcgcgattcccgcacagacagctgctgttcgggcgtcagtttattgtagttttccgccattccgctctcccagtcgccgtagagcggattcggcagcacgatgaactgcgttccaaactgctgatggttaagattcacaaaatcacgacgcgtctgattaccctgatgccaggtcgcgccaccaaaatcgttgaggttatcgccaacgtagagcaccacgttatagccggcatttttaatggcatcgaaacgcgcctgcttattggagctgtcagtattcagacgtaccgttttatcgctgacgttggggaagccgagctgctgcatgttagcgaccgtggccgcgtaatctttctgatcgcggttcgacacatagaacagcgtgccgccattctgtgtgacatgacgcgcaaactctatcgcgcccggcaccgctttcgcctgccgcgcctgtgtccaggctgaccaggttttgctgctgaacggctggccgtttcttcgcctgccacgcgctgtaggcactgttatccagcatcgtctcatccagatcgacaatcaccgctttgggtttgccagtcagcgagggggcctgatcaaacgccatacgcgcggtattaaatgcctgccaggtcagcgcctgatattcaccagactgctggaaccagtttaccgccagcaccgattgctggccgagttgctgttgcgcggtctgatgtgacgacgaggcgcagccggtaagcagcagcgcgaccagtccggatgcagccagttttgcggaggttttcatcatttcatccttaaggtgagaaaggtctgaggagaagcttcaaaaatgtagcagttaacgtaagctgtgggcagcccaacgcacgctgttataacaggagattcctatggccgtgatcccgcgctcgccattgctcgattcgctggagtggctcgaatatgcgtttcagccagccggagagccaccacccgctgaggccgcctatggacatcagcgccacagcgcgaccgtggtcaccgatattgagaacatcccacccaaaagctgcgagtctgatggcgtgattggcagcgggacgcgcccggtggcggtctacaccgccgactgcctgccagtgctgttcgccgatcgccagcagcggatcgtggccgcggttcatgccggactcaaaggtacgctggtgggtgtgctgacccgcgcggttgaaaaactgtgcgagcagggctgcgagccgcagaacctgatggtggcgatcggtccggcgatgggcccctgctgttatgaactggccgaaccgcagctggcggagattgcgcagaacccggcattggccagcgggctgcgctggcaccagaaccagccggttaatcctctggcgcaacgcccacaggccgctgcccgccagcagggtgtctggttcgatctgcctgcgctggcgacgcagttgctggtgcaggcgggtgtgccggctgcgcagatcgataacgtcaatgtctgcacctactgcatggccgaaagcggttcaagctaccgcttcaatactcaccacggcagcggctatcactcccgctattcgtggatccgtcgacgttaatgggttttctggcaccgcgctgacagcagataacggaacctgaactgcgacgggcgctgacgcctgtcgcaaagctacgcgggccacggatggcggtcttaacctctttgcgcaaggcacgggctagctccgcccactctttgttactcacctcactcccctgccgttgtttatgatttcactcacaccctgacattctttcacttttttttaacgcagaagtggctagagtgaactcatccgaccactttaccgtgagtgactatcatgtccgtcaatcctgactatcctgcgctgtttacgccgctggaccttggctttacccgactgaaaaaccgctttctgatggggtcgatgcacaccggactggaagaacatccggatggtgcagcccggctggcggctttttacggcgagcgggcgcgtgaaggcgtcgcgctgatcgtcaccggcggcatcgcccccaatgcccagggtgtcaccaccgcgcatggcgcgatgctcaccgacgagacgcaatgtgactggcaccggcagatcacggaggcggtgcatcagcatcagggcaaaatcgccctgcagatcctgcataccggtcgttacagctatcagcccgatctggttgcgccctcggcacgccaggcgccaattaacccgtttacgccacaggcgatgagcgaggcggcgattgaacagaccattgatgactttgcccgctgcgcccgactggcacagcaggcgggctacgatggcgtggagatcatgggttccgaaggctacctgattaatcagtttctggtgaagcacaccaatcagcgcaccgatcgctggggtggcgacttccggcagcggatgcagttcgcactggcgattacccgcgccgtttcgcgccgcgaccggtgacgcctttatcatcatcttccggttgtcgatgctcgacctgatcgaagagggcagtacgctggaggagacgctgttgctggcgggcgagctggagcagtgcggcgtcacgctgtttaataccggtattggctggcatgaggcgcgcatcccgaccatcgccacctgcgtgccgcgcgcggcctttgcgtgggtgacgcagcgcctgcgtgaacaggtgaaggtgccggtcatcgcaaccaatcgcatcaaccatcccgccgtcgccgagcagctgttgcagtccggctgcgccgatatggtgtcgatggcgcgcccttttctcgccgatcccgcctttgtcactaaagcccagcgcggtgaaccggacagcatcaacacctgcattgcctgtaatcaggcctgcctcgatcaggtgttcgccggtaaaatcacctcctgcctggtcaatccgcgcgcctgccatgagtcgctgatgccggtcatcgccagcaccgccccgcgcaggctggccgtagtgggcgccggtccggccggcatggcgtttgcgctacaggcggcgcagcgcggccatcaggtaaccctctatgaggccgcgccggagataggcggccagttcaatcttgcacggctgatccctggcaaatcagagttcagcgaaacgctgcgctatttccggcatgagctggcggccgcaggcgtgacggttcagacaggcagtcgggtgacggcggatcagttgagtgacgccgatgaagtggtgctggcgaccggcattcagccgcgtacgcccgatattccgggcatcgaccaccccagcgtgctgagctatctggaggtgctgcgcgataagcgcccggtaggtaaacgggtagcgattatcggcgcaggcggtattggctttgatgtggcggagtatctgtcacagccatcccatgacgaagatctggcggcgttttatgccgaatggggcatcgaccacagcctgacgcagcgtggcggcgtgatgaaacccgagccgcctgctgcgttacggcaaatctggctgctgcaacgccgatcgggaaaaccgggtgccgggctggcaaagaccaccggctggatccatcgcgccagtctgcaggcgcagggcgttgagatgtggggcagcgttgagtatctggcgattgatgacagcggcctgcatctgcggcgcaacggcgaaacgctgttgctggaggtcgataatgtgattatctgtgccggacaggagccgcagcgcgaactggaagccgcgctgcgtgcaaaaggacagagggtgacagtcatcggcggtgcagatgtggcgcaggagctggatgcgcgccgtgcgattgcgcaggcgacgcagctggcattaaccgtctgactagcgcattttcaccgcgcgcagcaccacgaacttctggttagaggcgatcagcgtacagttaccaaacagcttcttcagcttgtggtgataatcgaggtggcggttgccgacaatacgcaactcgccgccatactgaaggcagcgtttggcatcacggaacatctgccatgccaggtgatcggtcaccgcgtgctgctgatggaacggcgggttgcacagcaccgcgtgcagccgatctgacggatagccgctcagcacgttgttcaccaggaactgacagcgtgacagatcctcaggacggttcacttccacgttaagcttgctggaagcgaccgccatgtaagactcatcaaggaaatgcacctcggcctgcgggtttctgctccagcgccaccagtcccaccacgccgttaccacagccgagatcgacaatctcgccctcaatgttttccggcagatgctgcacaaagagccgtgcgccgatatccagcgaagcgcgcgagaagacgttggcgtagttgtgaatctgataaggggtgccatccagcggccagaccagcgtcggcgtggcctcacgcagttcaggcttgctgaactggctgtagatcagacgcgcttttttccacgccagtgaggttttggtttcaccaatgatctgttcgaacagctgcagcgtagagttatggatctctttggcgcgcgccgccgccagaatcaccgtatcaggcgtgacgacttcgcggatggcgcgcagctggtgctccagcagcgccagggttttaggcaccttgatcagcacagccgcaggtgaagcaggcagttcagccaggctatcaacaaagtgaacgtcgctgtcatccagcccattaaaggtcaggttctgacgggcggcctgctggctcagccaggagtcgctgacgtgccagacggtacgcggattcagggcgcaggttaatgccccgaaactgtcgttgaagaccagcaccggcccctctggcagcgcctgctgtaacagatattcatcagccgcatcccaggcttgcaatggactttcgtcacgcatctgcgggaagcgatgcaggatcagtgtgcgatcgttcagttcaagttggctcatgaattctccggcgtggtacactttggttgatttttcgccccaaaatcgggggcgcagtatactgtctttcgcctggaatccctaatgtcctcactgatctaccttcagggttatcctgccccccttcttgagcaggttcagtcgctgatcgtccatcagcgcttaggtgcgtttctgcaggaacgttatcccgacacccacgacgtgatgagtgataaagcgctgtatgactacacgcaggcgctgaaaaatcgctatatgcgcaatgcgccgccgatcagcaaagtgatgtgggataacaagattaaggtgatgaagcatgcactcggactgcacacagccatctcacggattcagggcggtaagcttaaggcgaaagcggaaattcgtatctcgacctttttccgcctcgcgccagagccgtttctgcggatgatcgtggtgcatgagctggcacaccttaaagagaaagatcacgataaggcgttctaccagctctgctgccatatggagccggattatcaccagctcgaatttgatgcgcgactgtggatgacggaccaggcgatgcgcggcaacgcggcttaaagaaactcctgcgctttctgaatcaggctggttttggtcagcgcgcccagaaagcgccgttcctgcggattgttgagcaccggcaaccgctccagcgtcaccgccgcaaaggcttcccatccctcacgcatactctgattctgatacaccaccgggaaatcctgatccatcacgcactgcaccggtgagtcgagggtgatctcctgggccagcacccggcgcgaaatttcatgaatcgagaccacaccgaggaaagcgcccgcggcgttgatcacataaacatagcgttcacgcttcagggagctgaccgccagcgcctgccccaccgactcctccggctgcaacgccgcacccgcaataatcagctcggcaatgcgcatgttatcgaaatcatatttcgcttctgaacggctgaagtgatgactcacgaccggataagtactggcggattgcaggcgatagaccaccatcgacgccagcaccgtggcgatcatcagcggaaacagcaggctgctgttgagtgtcatctccagcaccatcagcatcgccatcaacggcgcctgactgaccgccgccagcaccgccgccataccaatcgcggcataaagcagcacattgccgagcggcagatgcagcgccgcccccaccgtcgcgatgatcacccccagcagcgcgccaatcagcagcgaaggggtaaagagtccgccgacggcgtttcgaccctaccgacaggctggtagcgagggttttcagcaccagcaacagcagcagacccggcagcaggtagtgccctgccatcactttgacgatcacctcgtagccgttgccgaggatatcagtggagatcagcgccagtaagccgaccgcaaagccgcccgctccgaggcgcagcggcagggaggcgacccggctgaacagcactttgctgcgggcgatgcatttaatcacgatccagcccgccagaccggcgcacagaccaatcaccaccgtcatcagcaggctgctgagatccatggcgaagttcgcgtctgccagcggatagagcgcgctgcgaaaacccagcgtccacatggtcatcaccgccgtggcggcagcgatgatcagggggatcagccgctgcaacgcagaaatgccgaaggcgatttccgccacaaaaatcgccgacgccagcggcgcatggtaaaccgacgcgaggcccgccgccgccgccatcgccaccacgtcactgtttttcaggttaagtgaggccggtaacaggcgaccaatcgcactgccgcatagtgccgagagctgcaccatcggcccctctttacctatcgacgcgccgctgccgatactggcaatcgacgataaggcgcggaacagtgaggtccgggtcggcaccgcatcgagccgggcgttgatcacttcaaggtaatccgttttcaccgtctgctgctgctcaatggcaacggcataacgcagaaaatagcccgccagtacgccgcccgcccccaccagcagcggccagaagatccacggccagagatgcagggattcggttatttcgccactgcgggcaaacagcagatggttgatcagttcaatcacgccgcggaaagccagcgtcaccagcgacgccgcacacccgaccggaatggcgatcagaagtgtggtccagtttaatgcgtgcttacttgctttcacctgcgctccctggttggtacataaacatcatcgctttcgcatattattggaatgcggatcgcaggatcaatccctgcccgcccggcaccattgcacagcgtgggtgagatgttactctgccgctttacagctgccggagagatgacgtgattcgttttgccattgtgggaacaaactggattacacgccagtttattgatgccgctcatgaaaccggagcgatgaagctctgtgcggtctattcacgcagtcagcagcaggctgaggcctttatcgccgattatccctgcaaacagacctttacctcactggaagcgctggccgccagtccggagatcgatgcggtctatctggccagccccaacgcactgcactgccagcaggcgctgctgtttatgtcgcacggcaagcatgtgatttgcgaaaaaccgctggcctctaatctggcagaagtggaacaaatgatcgcctgcgcccgtgagcatcaggtggtgctgtttgaggcgtttaaaactgccagcctgcctaatttcctgcggctgcagcaggcactgcctgacgtgggtaaactgcgaaaagcgctgctgaattactgccagtactcctcacgctacccgcgctatctcaacggtgagaaccccaatacctttgatccgcgctggtcgaatggctcaattatggatatcggttattactgcctggcctcggcagtgacgctgtggggcgagccagatcgcgtgcaggccagggcgactttgcttgcgagcggcgtggacgcgcacggcgtggtggtgctgagttacggtgatttcgacgtgacgattctgcattcgaaggtgagtgattccagcctccccagcgagattcagggtgaagcgggcgcgctggtgatagagaagttatcggagtgccagcagctgacttttgtgccgcggggcgcggaaaagcagacgctgagccagccgcagcatatcaacaccatgctgtatgaggccgccgcttttgcccggctggttgagcagcgccaggtggaccacccttcgcttgaggtttcgcggattactgcatcgctgctgactgagatacgccgccagaccggcgtgatcttcccggccgaccaggctgctgtgtaaatatttctaaatatgtctgagaggtgttgcttcctgtgcggctaaaccgtaacttaccctcctgcaaaggggagtaacttgtaagctgattgatcgtcattacgatgcgaaagcatccggtcatcaggcaacccggaatcaatttctgtgttgtaagtgagaccttgccggaaggcgaggtttgcttacacaaaaataagcggctgacgtcttctgacttcagccgttttttttatttttcggacaggatacgaatatgcaaactgtgggtacgcctttactgtggggcagctttgcggttgttgtgcttatcatgctggctatcgacctgctgttgcagggacgccgtggcgcgcagaccatgtctttcaaacaggcggccgtctggtcgctgatctgggtttcagtctcactgctgttcagcgccgccttctggtggtatctggagggcagcgcgggacgtgaagttgctaacacgcagacgctcgccttcctgaccggttacgtgctggaaaaagcgctggcggtggataacgtcttcgtctggctgatgctgttcagttacttctctattccggccaatctgcagcgccgggtgctgatctatggggtattaggcgctatcgtgctgcgtaccatcatgatcttcgccggtagctggctggtcacgcagttcagctggatcctctatgtgttcggtgccttcctgctgttcaccggtgtgaaaatggcgctggcgaaagaggatgacagcgcggtgggcgaaaaacctgtggtgcgctggctgcgtaagcatctgcgcatgactgacgatctcgacggcgagaagttcttcacccgcaaaaacggcgtgctgtttgcgacgccactactgctggtgctgatcatggtggaaatcagcgacgtgatctttgcggtcgacagtatcccggcaatcttcgccgtgaccactgacccgtttatcgtactgacctcaaacctgttcgctatcctgggtttgcgtgccatgtacttcctgctggcaaacgtggcggaaacggttctcgatgctgaaatatggcctggcgattgtgctggtgttcatcggctttaagatgctgattgtcgacctctaccatatcccggtcggtatctcgctgggtgtggtcggtgccattctggcatcaaccctgctgattaatgcctgggttaaccgcaaaagagaccagaaaaagctcgcaccataattacctgcaggggcatccgatgcccctgttttattttgtggcagcctgtcacgccatttcatccctctgtcacacttccactatccagcataataaaaatctgacctgctccacagtgacagaactttctcttttctcgtccgatcttttccttatactccgccgggcaaaccgttttagccgatgcaaaacatcgcgtctgaaactacatccgcgacaaaatatagaaaatattatgcagaaaactctctccgcacgtctgggcacgctgctcgccggaagcctggtgaagcaaatcatgattgggctgatcgccggtgtggcgctcgcctggatttcacacgatgccgctatcgcggtcggtctgctgggtgaactgtttgtcagtgcgctgaaagcagtcgcgccattgctggtactcatgctggtgatcgcctcgattgccaaccaccagcagggccagaagagcaatatccggccgattattatgctttatctgctgagcacctttttcgcggcggtggtcgcggtagtcttcagccatctgatcccgcagacgctgacgctggcggtgggcaccacggaaatcacaccaccatccggcatcaccgaagtgttacgcggactgctgatgagcatggtgtcgaatccaatcacggccctgatgaacgccaactacatcggcattctggtgtgggcaattggtctcgggctggcgttccgtcacagcagtgacactacccgcgcctttctcaatgatgcctctcatgcggtgacgtggctggtacgctgcgtgattcgctgcgcgccgattggtattttcggtctggtggcctcgatcctcgcgtctaccggctttggcgcactgtggcaatatgcgcatctgctggcgctactgatcggctgtatgctgctgatggcgctggtggtgaacccgctgctggtgttctataaaatccgtcgcaacccctatccactggtcttcacctgcctgcgcgaaagcggcgtgaccgccttctttacccgcagtttctgccgccaacattccggtaaatatggcgctggcgaaacgtctggatctggatgaggatacctattcggtgtcgattccgctgggcgcaaccatcagtatggcgggggcatcgattaccattaccgtgctgacgctggcggcggtgcatacgctggggatcagcattgatgtgccgacggcgattctgctgagtctggtggcatcactctgtgcctgtggtgcatctggcgtggcgggcggttcgctgctgctgatcccggtggcctgtaacatgttcggcattccgaatgatctggcaatgcaggtggtggcggtcggctttattatcggcgtcctgcaggattcggcggaaaccgcgctgaactcctcaaccgatattctgtttaccgcagccgtctgtcaggcagaagcggagcgcgaaaccagccgggcttaacctttcagatagctcaaaagctcaaagagtgggtggcagagtccgaagagcaaagcgtcccgcgccagggaaggcgcgggccgagcgagcagggatgctttaagcgactttgcgatcggactctgccacccacgaagggcacaggattaaccgacggtaataacaacatcaggatcgccattgtttgcctgacaaactatagcgttacaccgcttttgaaaatcgccagctcgcggaaatcgttcttctcgttgttggtcggctgaccgctggcaatcgccacaatgctgtcgacaaagtcttccagcatcgcatccatactcattccctcgatcaaccgtccggcattaaagtcgatccagtgcggtttcttctccgccagcggcgtattggtggccagcttcaccgtcggcacaaaaccgccataaggtgtgccgcgtccggtactgaacagcaccatgtggcaaccggctcccgccagcgcactggtggcgaccgcatcattgcccggcgcactcagcagattcagccccggcgtttttaaccgttcgccatacttcagcacatcgaccacctggctctgccccgctttctgggtacagcccagcgacttctcctccagcgtggtgataccgcccgctttgttgcctggtgacgggttttcgtagatcggctgctggtgatcgataaaatactgtttgaaatcgttgatcatcgccaccgttttgctgaaggtctcctcgtcgcgacagcgactcatcagaatccgttctgcgccaaacatttccggtacttcggtcagtacggtcgtgccgccattggcgatcatctggtccgagaaacgtcccagcaacggattggcggtgatgccagacaaaccatccgaaccgccgcactccagaccaaacttcagctcgctgagtttgcccggctcgcgctggtcgtgacgcattttttcatacaatgcgtgcagccgctccagcccggcttccacctcatcgtcatgctgctggcacaccataaactcgacccggtcgctttcaaacgcgccgagggtatcacggaaggcatcaacctgattgttttcgcagccgagaccaatcaccagcaccgcgccagcattaggatggcgcaccatattctgcagcatggtgcgggtgttttcgtgatcctgccccagctgcgaacaaccgaatgtatggctgaacaggaacgcgccatcgatgtcttctgcctcctgcgtctctttcaggaaacgctgcaggatctgacgcgcaatgccgttgacgcagccaacggtcggcaggatccacagctcattgcggatgccgacctcgccgttagcacgacggtagatctgcacctcacggtcacccggctgcggcggtagcgtcacaaactcgggctgatacgcatactgatccagatcgctgagattggtgcgggcgtttctgcgaatggattaactcaccggcggccacaggctgcgtggcatgggcaatcggcagcccatatttgatcaccagctcatcctgcgcgataggctgcagggcaaatttatgcccgcgtccgaccgcctgttgcaccgccacacgcagtggcggcagctctatcatggcgcccgcgtctaaatcacgtaacgccacggcgacattgtcgcggggatcaattttaattgcgtcttgcatagcgttatctcagttggctcagcgcctcacgcattccgtgggcgatgatattttgcaggtgttgggtgacagccgcagccagtccgggctgacgggttaaatcttcaccccagtgttgcgcgtcgctgagtacgccgttcaccagctgttgcggtgacagctgatccgcatcaagtgctttccaggcgtcggcgtagcgctgtaaccactgcggctcgtcctgcaatggccagctcttgccggctgactcgccgcgataaaaagcgatcagcgcagccagcgcaaaggtgatgtgtgccggccactcgccggtttgctgatgcgcggcaaggagtggcgtcagcagacgggtgcggaatttggtcatgccattaagggcaatcgacagcagcgcgtggcgaataaacggattgcggaaacgacgctgtaccgcatcggcaaacgcgtgcagttcatcggcaggcagatccagcgtcgggatcacttcgtgacgcagcaggttatccacaaatccggcgatagccggatcggccatcgcctctcccacactctcaataccggccagaaacgcgaccggtaccattgcagtgtgcgcgccattgagaatggccactttttgcgctttatagggcgcaatgtcatccacatgccgaacctgcggcgacagcgccgccagcttcagttcattaaacagcgccgacggcccctgaatcacaaactgatagtagacttcgcccgccaccagatagcgatcttcataacccagctcgcgttgtagctgctcgctttccgccgggaagccggtgacgatgcggtcgaccagggtgttatagaacgcgcagtgctgatgaacccaggttttaaattcggagggcagatgccactgatcggcgtagcgcagtaccagatcgcgcagcgtatcgccgttatggtcaatcagctcgcacggcaccaccagccagccccggtcgctggcgccgttgaagaaggaatagcgcgcccacagcagctgcgtcagtttgccggggaaactgctggcgggctgatcggtgagctgatccgtgccgacaaaggcgatgcccgcttcggtagtattggagaagaccatgcgcagatccggattacgggccagcgccataaactcgccgaactgctgccagggctggatttcacggttgaggctgcggatcagccgggtttcgctgacctgctcgccctgatcgttcagcccgcggatcagtgtggtgtagagtccatcctgctgattcaggctgtcgctgacttcacggttgcgcggccgcaccaccacgatcccggcatcggtgccctgatgttcattgagccagtcgatctgccagtcaataaaggcgcgcaggaagttgccttcgccgaactggatcacccggtcgcgataaaccgcgcccggaaagtcgtgacggtttagccttttcattatcaggctcccagctcgatgccgaagtaatcgcgggcattgttgaagcagatgttctgtaccatctgacctaacagtgcttcatcggctggcgcttcaccctgctccacccagcggcctatcatctggcacagtagccggcggaaatattcgtggcgggtgtaggagaggaagctgcggctatcggtcagcatgccgacgaaacggctcagcagaccaatctgcgccagctgcgtcatctgacgctgcataccatccagctgatcgttaaaccaccaggctgaaccaaactgcatcttgcccgcctgaccttcgccctggaagttgcccgccatggtggccaggacttcgttgtcgcgcgggttcaggcagtagagaatggttttaggcagcgcattattgagattctgcgcgcccagcaggcgtgccagcggttcggccagcggctggtcgttgatcgaatcgaagccgacatcaggccccagcagctggtactggcgcggattggtgttgcgcagtgcgccaatgtgatactgctgcacccagccacggcgggcatattcgctgcccagccagaccagcaccgccgttttaaactgtgccgtttcctgcgggttgggtacggcaccgctgcgacgacgcgccagaatcgcatccagcgtggcgtcatccgcctcggcgtagcagaccacatccagcgcgtgatcggagactttacagccgtgcgccgcgaagtgatccagccgctgatgcagtgcgctgcgcagatcgtcaaaacgctgcacgctgatatccgtcagctgctccagcgtctcgatccacggcaggaaggtttccgcttcgatattaaacgctttgtccggacgccagctcggcagcactttaacgctgaagctggcatcgtctgccagcgcgcggtgatggcgcaggtcatccagcggatcgtcagtggtgcccaccatcttcaccttcatctgctgcatgatgccgcgcgtggtaaagctatcctgcgccagcagttcattgcagcgatgccagatgctgtcagccgttttctcagaaagcagcgtatcggtaataccgaaaggccggcgtaactccaggtgggtccagtgatagagcgggttgccgatagtgtgcggcacggtacgcgcccaggcgtcaaatttttcacgatcgctggcgttaccggtacagaaacgcctcagccacaccgttggcgcgcatggcccgccacttatagtgatcgcccttcagccagatgtcataaaggttggcgaagcgataattttcggcaatctgctgcggcggtaagtggcagtgatagtcgaaaatcggctgatcctttgcatagtcgtgatagagacgacgggcgaattcggtatccagcaaaaaatcttcggtcatgaaacgtgacatacatgcttcctcatcgactgaaccacggatggcccaaagttatcataccaattttagtccgttacggatttatttgcgatcctgctcacataaacggcggtagctggctgccgttatggacgtttttgtcgtccgcatcgcgctaaatggctgtcattacgcaggtttccagtatcccacagtgcagaaagggtttttgtgatggctctcaacttttaaagttgtataacaagttaggctctcgccccatcgtgaggtcgttagcgactcacaaatggcaaggtcataacagggttgctcatacagaacctgcgggcgtgagcagagctacatcacgtgctgtcccgctccagataacaacagcggcaagaccgcatacagaactggaagaggtagaggatgcgtaagatcaaagggttacgctggtacatgattggactggtgacgctcggtacggtgttggggtatctgacccgtaacaccattgccgtggcggccccgacattaatgtcagagctgcatatcaccacgcagcagtactcctacataattgcggcctattcagcctgctacacgctgatgcaaccggtggcaggttatgtactggatctgctcggcaccaaagtcggctacgcggtgtttgctattatgtgggcgattttctgtgccgctacggcgatggcgggcagctggggcggactggcgctggcacgtggcgcagtcggtgcggctgaagcggcgatgatcccggccggactgaaagcgagcagcgaatggttcccggctaaagagcgttcggtcgccgtgggctactttaacgtgggttcgtctatcggtgcgatgctggctccgccgctggtggtctgggcgattgtggcgcacagctggcagatggcatttatcatgaccggtgtgctgagcatggcctgggcactcagctggctggtgttttacaaacacccgaaacagcagaagaagctgagcgatgaagagcgcgactacattatctccggccaggaagcgcagcatcagaccggcaacacccgcaaaatgtcagcactggagattatccgtaaccgccagttctggggtattgccctgccgcgctttctggcagaaaccggcatggggaacgttcaacgcctggattccgctgtttatgtttaaggtttacggcttcaatctgaaagagattgcgatgttcgcctggatgccgatgctgttcgcggacttcggctgcatcctcggtggctatctgccgccgctgtttcagcgctggttcggcgttaacctgatcgtctcccgcaagatggtcgtgacgatgggtgcggtgttaatgattgcgccgggcaccatcggcctgttcaccagcccctacgtcgccattggtctgctgtgcatcggcgggtttgcgcatcaggccctctctggcgcgctaatcaccctctcctcagacgttttcggccgcaatgaagttgccacggctaacggcctgaccggcatggcagcctggaccgccagcaccatgtttgcgctggtggtcggtgcactggccgatacgctgggcttcagcccgctgtttgccgcgctggcggtgtttgatctgctgggcgccgtcgttatctggacggttctgaaaaataaacccatttcagagctgaatgccgaagccgttattccgcaggccagcgccgttcgcagttaatctgccgggctggcgcaagccagcccatttcctcgcacctcctgaagtggtataacaacttatctgtctgctaccaggattgtgctatggacttcactgaatcccgtcgactttatcaacagctggccagcgagctgaaaagccgcattgaaaccgggatctatccggtgggtgacaaactgcctgctgagcgcctgattgccgaagagatggaagtgagccgcaccgtcgtacgtgaagcgatcatcatgctggaagttgaaggctatgttgaggtccgcaaaggctcgggcatccacgtcattgccagccagcagcagaaccgcatcgcttccaccagcagtcagctggagtttgccacgtttggccccttcgaaactgctccaggctcgtcagctgattgagagtaatgtggccgagttcgctgcaacgcaggtaacgcgtcaggacattatcgacctgatggcgattcaggaaaaagcccgccaggaggatcacttccgcgactccgagtgggatatgcagtttcatgtacgtatcgcgcaatccacccagaacagtgccttagccgccatcgttgaaaaaatgtggctgcatcgcctgcacaatccctactggctcaaacttcacgaacacatcgaccagcgcagcattctcagctggtgcgacgaccacgatcagattcttaaagctctgatgcgcaaagatcccgccgccagcaaactggcgatgtggcaacatctggaaaatactaaacagatgttgtttaacgcgacggcggatgattttgaatttaacgtggatcgatacatgtttggtgagaatccggtcatcctgcctgatgggtccaataacgcccgctaaaagtgcctgaaaatgccctgagatggtcagttaatctgcaatagtgtcaggtcatgtaaagctcctttttacacgccgtttcacaaggtaaaactcctgttcgccagagagttttcctgtctcagacaggcgatttttgttacagttatcgcccttttattaccctttgcgactgggggttataaagtcgctgatttaacaatcaattctggaaggatccggaaaatcccgcccaggctgcgctcctaaaatttataacgaaatgccggtctgcgtttaagtccctgtgggacatgtttaacaatgatgtttaggaatgaattgatggatattttgcaatcgttgctgcatgccctctggcagcaggactacgaaaccctctccgatcccacgctggtatgggccatttacggcgtgctgtttatgattttgtttttagaaaatggccttcttcccgctgcatttctgccgggtgacagtctgctgattctggtcggcgtactgattgctaaaggcaccatgagcttccccctgacgattctggtgttaacgaccggtgccagtcttggctgctgggtgagctacttacagggccgctggctgggtaacacgcctacggtgcagaaatggctctcccatcttcccgcccagtatcatctgcgcgcgcacagcatgttccatcgtcacggcttatctgccctgctgattggtcgctttatcgcgtttgtgcggactctgctgcctaccatcgccggattgtcaggcctcagtaatgcccgctttcagtttcttcaactgggtaagtgcgtttctgtgggtggtgattctgaccgttatcggcttcgcgctgggtaaaaccccgattttccgtcgttatgaagatgagatgatgttcttcctgatgatgctgccgctggcgctgctggtgtttggtctggtgggatcgctggtggtgatatggcgtaaacgtcaggcgaatcagaatgggaaagccgagtaatgaaactgctgcaggctattcctaaacggtggttaccgtggttgatcgctggcgtctttgcgctggtcgcgctttgtgtggtccccggtctgatgaagcacgagacggtggtgcagattcgggtttcccatgctggcgccaccctgcccgatggtttttatctctaccagcaattaagtgcgcagggtattcgtatcaaaagcattacgcctgcgggtgatgcactgatcatccattttgatagcgaagagcagagcctggcggcccagaaggtgttacgccgtctgctgccacagggctttattgtggcgcagcacgatcactctcagcacctctcactggcgtaatctcccgactcccctctccttttcagaccgtcgcgccatcgctcggcggtctgaaaggcgctctatctcccggtcttctttgaactttttactatgggtgtctatgcttaagcgagagtcgattcttagcacccgcagccatatgattacgcgggtgatgatggatcaggtcgcaatggaagggtccaggaccaatgaaatatcaagtattactgggagtcgcgctgttttcgctgtcgggttcgctgctggcggcagaatcgctgtgtgagcagaaagagcaggatattcagcgtgaaatcgggatggcgcagaagcataacaaccagcgccgggttaacggtctggagcgcgcgctgacagaagtccgggccgattgcagcgacaaaaagctcgaggccgcccatctggaaagaattaacgctcagaagcagaaagttgctgagcgtgagcacgcactcagggaagagcgtgaagagggccatgacaaggagaagattgctaagcgacaacaaaaactggatgaagcgcgccgggagctgaaaaagttacaggcggagccctattaatcggaactaaccaactgatgttaaaggagtattttatgtctaaagacacatcatcggaacatttgcgtgctgaactgaaaaacctggccgataccctggaagaggtgctgagcagcagcactgaaaaatccaaaggcgagctggataaacttcgcaataaagcgcgtgtggcgctggatagctcacgtgaacgtctgggcgaatcaagcgagcgcattgctgcgaccacccgcgaagcggcgcaaaaagccgaaggctacgtgcgtgaaaatccatggcatggtgtgggtatcggtgcagcgattggcgtcgcactgggcatgctcatttcgcgtcgataattatggctgactcacagcataaccacggcccggctaaaggggtcattaacatcggccagcgcattgttaccacgctggttggcatggtcgagacacgcgttcgtctggcagtggtggaactggagcacgagaaagctaacctgattcagctgctgttgatggttggcctgacaatgctgttcactgcatttggtctgatgagcctgatggttctgattatctgggcagtggatgcgcagtaccgtctgatggccattggcatcacgaccggcacgctgctattgctggcggttattctggggctctggacgcttcacaaatcacgtcagtccacgctgttgcgccacacgcgcaaggagctggaaacagaccgggatttacttgaggaccagcgctgatgagccgccgcgagcgtgaagaacgcatccatgaactgcttaagcatgtgcagcagcagcggctggatttaagcgctgcgcggcgtgactggctggaaggcaccgcccattacgatcgcggctggttcaccttcctcagcttgcgccgctacctggccattggcagcagtgcgctggctatctactccgttcgcagtcccaacatgctgttacgctgggtaaaacggggattcggcgcctggagtacctggcgcatgatcaagtccgctctgccaccgcgttaattttgctaaaagccggtcctgaaaaggccggcttttcttcatcagaatttctgaaaaacactgacagtatatctcgcttacaacctttccactccgcgactatcatctccagctatcaacccaatgaacgcaatactgctttcagcgggcataaaccttgcgggcagcttgccctgcatccctgatagcgctggagtaaatgatgaaaaaattcgaagacgttggtttgttactggctcgcatcctgatgccaatcctgttcattacggctggctggggcaaaatcaccggttatgcaggtactcagcaatatatggaagcaatgggcgtcccgggctttatgctgccgctggttatcctgctggagtttggcggcggtctggctatcctgtttggtttcctgacccgtttcactgccctgtttactgcaggcttcaccatcctgaccgcgtttctgttccacagtaactttgccgaaggcgtgaaccagctgatgttcatgaagaacctctctatcgccggtggtttcctggtgttaggtctggtgggtcctggtgcgtacagcattgatcgcctgatcagcaaaagaaaaacacagccagcgattgcgcgctaatctcacatagagcgtaatgccacatatacttagcagggcggggacatttccccgccctgtttgcattggagccattatgggacagttaattgacggtgtctggcatgacacctggtacgacaccaaatctaccggcggacgtttcaagcgttcagagtcggctttccgcaactgggttaccgcggatggcagtgctggcccggtgggtaaagcgggatttgtcgccgaacgcgaccgctatcatctttatgtctcgctggcctgcccctgggcgcaccgcacgctgctgatgcgtcagctgaagggtctggatagcattatcgatgtctccgtagtgcatccgctgatgctggagaatggctggacgttcgatgatagttttcaggatgcgaccggcgataagctctaccagaatgagttcctctatcagctctatctgcacgccgatccgcaatacagtggccgcgtaaccgtgccggtattgtgggacaagcagcagaacaccatcgtcagcaatgagtctgccgatatcatccgcatgttcaacagtgcgtttgatgctgtcggtgcccgtgccggggattattatcctgttgctctgcacgaaaagattgatgaactgaatagctggatctacgacaccgtgaacaacggcgtttacaaagcaggctttgccacttctcagtctgcttacgacgaggcagtcactgtgctgttccattcgctgtcgcggctggagcagattttaggccagcatcgctatctcaccggcgatcaattgaccgaagcggatctgcggttatggaccacgctggtgcgatttgatccggtctatgtgacccactttaaatgcgatcgccatcgcattagtgactacagaaacctgagtggtttcctgcgtgatatctatcagatgcctggtatcgcagagacggttaatctgccgcatattcgtcatcactactattgcagccataagaccatcaacccgaacggcgtcatttcgctgggcccggcgtttgactgggacgagccgcacggccgcggttaagctgcctgcatatcgcgcagggagcagatacaatctgaccgcaatgacaatctaaaagcgaagggaacagggtcagaagaggaaagcgtcccgcgccagggatggcgcgggccgagcatgtcagggatgacggattttgcgactttccgatctgaccctgtttcctttgcaggcgcgatctcaccgctgaccttcaaaccaccgcgcgtcacaaagcaaaaaccccgccgaagcggggtttttgataaaaagtcgaagctgaccgttaagccgggttctgtcgtggacagtcattcatctaggccagcaatcgctcactggctcaagcagcctacccgggttcagtacgggccgtaccttgtgaacccctatttggccttgctccgggtggagtttaccgtgccacgaactgttgccagtcgcgcggtgcgctcttaccgcaccctttcacccttacctgatcccatttctgggccatcggcggtttgctctctgttgcactggtcgtaggcttgcgcctcccaggcgttacctggcaccctgccctatggagcccggactttcctcccctctgcccgtctccccacaagtgaggacgacgacaaagcggcgactgtctggtcagcttcggcgcgggataataggacattcgccggcgtttgtcacgcctcttgctgctccagcgcatacttataaagcgcatttttcttcacgctgtggatctcagcggtcagcgcagccgcgcgtttcaacggcagctctttttgcagcagcgccagcgtacgcagcgcatcggctggtaacgcatcttcatcatcggtcttgtacccttcgacaatcagcaccatctcgcctttgcgacgattctcatcttcttttacccacgccagcagctcgccgaccggtgcaccgtaaatcgactcccaggttttagtcagctcgcgcgccagcaccacgtagcgtttcggcacccagctcactcaccatatcctgcaggctgtcgatcagacggtgggtcgactcatagaaaatcagcgtgcgcggctcctgcaccagggcccgcagggcgtcgcaacggcctttggttttggcgggcagaaacccttcgtaacagaaacgatcggatggcagtcctgcagcacttaacgcagcaatggcagcacaggcgcccggcagcggcaccacacgaatgcccgcttcacggcagcgacgcaccagatggtagcccggatcgttgatcagcggcgtgccagcatcagaaactaaggctatgctttgaccctcctgcagcttcgtcagcagcagttcagccttgtgctgctcgttgtggtcatgaagtgagaagagtcgcgcattgatggcgaaatgttgtagcaacagtccggtatgacgtgtatcttccgcagcgaccagatcgacgctcgaaagcaccgtcagcgcccgctgggtgatatcacccaaattaccaatcggggttggaacgatgtagagcgtgctggcagaaatctctgcccgatcgagttgtttcattgtttcatccgaattgccgatttaatattgagcatcttgaaaaaaacatcactggatacagtatgcttccttcaaaagtcgttcgtcataaagcaggacgctttctgcctgtcattcttgctgggctgattttagccgcatgtagcggtcaggggccgcaaacctcaaccgtcaatattcaggggcccgtcacagccagctccgcttactatctgcagcaagcgcagcaaagcagcgatgatagcaagaccgactggcaattacttgcaatccgcgccctgctgaaggaaggaaagtatcctgaggcgactcagcaactgagccagttgccgcagcagctctctgagacgcagcaacaggaatccctgctgctgaaagcgcaattgctgattgcacagcagaagatcaaagatgccgaaccgctgttagcggcagtgaaaaccggcgcactgtcgcaggatcagctggcgcgttactacagcctgcagatcgccagcgcacagggtcgcccttcactctcgctgctgcgcaactatattgcccaggagccgctgctgaaaggcaccgatcatcagggcaatatcgacgccacctggcagacactgacccagatgccgccgcaggaagtcagcaacctggtcatcaatgccgatgaaaatgtgctgcagggctggctggatctgctcgcagtctggcgcgccaacacgcaggatgctgagatgctcaagtcaggcatcaaagactggcagacccgctatccgcagaacccggcggccaaaacgctgccgacgcagctgagccagatgcagaactacaccaaagcttcaaccagcattattgcgctgctgctgccgctgaatggccaggctcaggtgttcgccaacgcgattcagaaaggctttaatgatgcgaagaatggcatctccgcgccggtcgctcagcctgcggcagctcagcccgccgctgctgatgcaactgccagcacccaacccgctgccgctgctggttcttccaccgatccaatcagcgcgccgcagcagcaacagcctgccgacgcgacgccacagcctcaatcacagcctgctgccgcggaaccggccagcaacgcacagatcaaggtctatgacaccagcagccagccgattgaacaggtgatgcagcaggcacagcaggatggcgccaccatcgtggtcggtccgctgctgaagagcaacgttgagaaggtcgccaacagccagacgccactgaatgtgctggcgctcaacgagccggaaaagatccagaaccatccgaatatttgctactttgcgctttctcctgaagacgaagcgcgcgatgcggcgcaccatatctgggatcagggcaaacgccagccgctgttgctggttccgcgcagcggactgggcgatcgcgtcaccaacgcctttgctcaggagtggcagacgctgggtggcagcaccgtgatgcagcagcgctttggttcgacctcagagctgaaacagggcattaacagcggcgcgggcatcagcttatccggtacgccagtgaacgctgcacctgccgagccgcagggtgttacgattgcgggcctgactatcccggcaccgcagcagaacacgccagatgtggtcagcaccagcagcggcggcggtgtcgatgcggtctacattgtctcaacgcaggacgaaactgcagctgatcaaaccgatgattaccatgcgcaccggcagtcgtagcaatatctcgctctacgccagttcgcgcagcgcgcaagccggtgccggcccggacttccgtctggaaatggatggcctgcagttcagcgatattccgctgctctccggcagcaatcctggcctgatgcagcagacatcaaagtcattcaataatgactattcgctggtgcgtctctatgccatgggaatggatgcctggacgctggcgaatcactttaaccagatgcgtcagtcacctggctttacgctggacggcaataccggcaagctcagcgccgacacggattgtgtgatcaacaggaagttgacatggaaccagtatcgtcggggcgaaatcgcaccggccaactaaatcggcgtcagactggcgccaggtatgaagaagatgcccggcgctatctggagcaggctggcctgatatgggtcgccagtaatgttcactttcgcaatggtgaacttgacctgataatgcgtgacgggcactgttgggtgtttgttgaagttcgctaccgacgcgatgcgcgttatggtggcgcgctcgccagcgtaacccggaataaacaacaaaagctgctgcgcgctgccgctctctggctggcgcaacgcggcggcagttttgaaacagtgaattgccgtttcgacatcatcgccattaccggcacggcgctcgagtggctgccgaatgcctttaatgcagacgtttagaaccaggtggtcgtgtgcaggacagaattaaagcgtgttttaccgaaagtattcaaactcagattgccgcagccgaagcgttgcccgatgccatctcccgcgccgctatgacgctggtgcagtcgttactgaatggcaataaaatcctgagctgtggcaacggtgcctcatccgccaatgcacagcacttcgccgccagcatgatcaaccgtttcgagaccgaacgcccaagcttaccggcgctggcgttgagcgccgacaacgtgatgctgaccgcgattggtaatgaccgcctgcacgatgaaatctatgccaagcaggtgcgcgctctgggacacgcaggcgatgtgttactggctatctcaacccgtggcaacacccgtgacatcgttaaggccgtggaagcggcggtaacacgcgatatgactatcgttgcgcttaccgggtatgatggcggagagctcgccggactgctgggtccgcaggatgtggagatccgcattccgtcgcaccgcagcgcccgtattcaggagatgcatatgctcaccgttaattgcttatgcgatctgatcgataacactctctttccccatcaggaatgaccgaaggagcacgaatgaaagcattgaatgctatagctattctgttaaccgccatgctgctgcagggctgcgttgcggttgtggcgggtggcgcagcggttgccactaaaacggccaccgatccacgctcggtgggtacgcaggttgatgacagcacgctggagctacgcgtgactaacgcgctggctaaagatcagcagattaaaaccgatgcccgcattatcgccacggcctatcagggcaaagtgttgctgaccggtcaggcgccttcgcaggagatcgccggtcgtgccaaacagatcaccatgggcgttgatggcgcaaccgaggtctataacgagatccgtatcggccagaaagtgacgctgggcaccacgtcgtcagacacctggattaccaccaaaatccgctcgcagctgctgggcagcgatcaggtgaaatcctccaacgtgaaggtgacgacggagaatggcgaagtgttcctgctgggtctggtgacaccgcaggaagcgcaggcagcagctgatgtcgccagccgcgtcagtggcgtgaagcacgtcaccacggccttcaccatgctgaagtaatacgcaaaacgcaaaaaaggcggccatggccgccttttttattgcccgatgttcagaccggaatgtcgatgaccagtgcgcgggtcgccgttttcgccgtcagttgcaacagcttctcttcctgcaaaaaggcaccatcgccacagcccagcttctcctgatgatccgtgccggacatcgcttccagcgaaaccgtgaatcgactgcagataggctcgcggcccctgtaactgcagcgaatgcttttcgcctggtgccagctcgacctgatgaatccacacctgctgacgcagttgcagactgtcgtccatgccatccggcgaggcgatcagctgggacaaccggccatccgtcagggcaattttctgcatccgcggattttcgcgctccggacaggcggccagccagagctgcatgcgtgtcagcggtcgatctttgctcaggttcatttcggtgtaactcacacccggctgggcagagagcagcagcgcctccccttcccgcacgctgatggtgttgccttcgctgtcgcggtattcagcttcaccctgcagcacgatgttcagcacatcaacctgtggataggtgcgcggctgaaaagcggcacccggcgccagcacttcctggttcagtacgcgcagtgacgcgtaccccatcagtttgggatcaaaatagtggccaaaagagaaactgtagcgcgcctgtaaccagccgaaatcggcctgaccacatgcggacgcactgcgtgtcgttatcattgtttacctccagcatccggtgacgaggatcggccacggactatatgctcccatggtaaaagtctggacgccggattgttagccagttaatctgccgggcatgttcaaatttcctgacagagaaccgggatggctaaagagcgtgcgttaacccttgaatctttacgcgttatggatgcgattgatcggcgtggcagttttgccgcggcggcggatgaactggggcgcgttccttccgccctcagctacaccatgcaaaagctggaagaggagctggatgtggtgctgtttgaccgttccggtcaccgtaccaaatttactaacgtgggacgcatgctgctggagcgtggccgggtgctgctggaagcagccgataagctcaccaccgatgctgaagcgctggcacgtggctgggaaacccatctgaccatcgtcaccgaagcactggtacctgttgatgcgctgtttccgctggtgacgcgactggccgacaaggccaatacgcaattttcactggtgacggaagtgctggcgggcgcatgggaacggctggaacagggccgggccgatatcgtgatcgcccccgatatgcacttccgcgcctccaccgagatcaatacccgcaagctctacaccatgatgagcgtctatgtcgccagtgctgaccacccgattcataacgagcctgaaccccagtctgaagtgacgcgggtgaaataccgtggcattgcggtcgcagataccgcgcgtgagcgtccggtgctgaccgtgcagttactggataagcagcagcgcctgaccgtgagcagcatggacgataagcgccgtgcgctgctggctggcctgggcgtggcgaccatgccctattcgctggtggagcaggatattgcggaaggccgtctgcgggtggtgagtccggaatatacccgcgaggtcgatattattatggcgtggcggcgtgacagcatgggcgaagccaaatcctggtgcctgcgtgagatcccgcgcctgctggcgaagaaaaactaaagcgccgattcagggcgagggccaggagcggctcaggcaatccatcgccactgccctgaagagggtgaaatcggtgctgtcccgcaggcgggtcatcgccctttcacgcaggaacgtcacaaacagatcgtatatcgccatcgcctcttcatattcacttttgctgatcgccagcaggaaaatgacataggcggtatcgtctccccaggcgatgccgtgcggcgccagcaccgtgtaaaccacggttttctttgccagcagccccagcgagtgcggcagcgcaatgccttcgccgagcatggtgctgacaatcgcttcgcgctcttcaaccgacggatagaacgccgcatccacaaatccctcctcctccagttgatcgcacagctggcgaaacagttcagactgggtcatcggcctgtcgacgatatgaaagtgttgggcatcaaaaaatttcgccagcatatagggccgggtacggtccaccagcaccagcttgccaatctgttcaagctgaaaaccggtgggaaacggcgacatcaccaccaccggtttctctttttcgctgagccggatggtagagataacaaaatcttcgtcgatgcggctgcgcgcctcatactcgcgctgggacaggcgggccgtgacctgcaactgcggatatttgcgcagcagcatcgcctcaatcattcgcagcgtagagttaccgctgtcgcagaccagcagcacctgcggatgacgctgataaccgacgtcatagtggcgctccagcccgacaccgatatgcagcaccagaaagccaatctcattctcggtgatcacgtaaggggtatattttccccagctggtcaccgccgctaaggtgacatcataggccatgggatagtgctgtttgatgttactgagcagcgggttgggaatatgaatctgatagcgcacccgcgtaatcatggttttgatgtgggtgagcaggtcagcacgcagctgctgatcgttttgcagattgaagttgtaatgcgtgttgataaagctgagcagataatccaccagcgcgtcggcgtcatcagcattgatggcgctgggagcaatcgcctgaatgcgtcgcgcggcgatattgacccgcagccagttctcttccgccggtgaaatcggtttgctgaccagcggacgcatcagattaatcaggtgatgggccgcttcacgcacctcatcaccaatctcctctgcacccggatcgttaagcggatagccttcactgatgcgccgcaccgccacggcgcagtaaagccgcagatagcgttcaccctcatcgctgagccgaatgttgtgctgagcaaaacagctttgcagcagcgggcgcagcgtctccagcatgccgctgttcagcgcttcgattgtgagcagcgggctctcgggctgcgcctgatcaatttgccataacaggtcggtcaggcaggtacgaattgccacttcgctgccaaacagcttcatgccgtagtggggcttgctctcaatggtgaggtgatagcgccccagccattcgcgcacctccgccatatcattctgcagggtggcgcggctgacaaaccactcttctgccagctcttcaagtttcagggaataggcggcggtaagaaagcgggtcagcaggtagcgaacccgatccggcgaggtgcgcggcacccgcagcggcgacgcggtatgctgttgcagatgctgaaagcgctgagcatcctcaatcttcagctgatagcccgcgccgcgattgaggacaaactgcgcgccatgttctgccagcagcgcattcagcgccgtgatatcggtacgcacggtgcgtgtcgagacggcgaaacgccgcgccagctcatcctgaggcagcgtttcgttttgcatggcatcgaacagttgcgcaaggcgctgattgggaaatctcacaagcgttacctgtttgcagacagaaatagggaacatcagcctacggagatcgtctcgcaacgtccatgttgcgcgatctgcctgttgcaggcagatcgtgttgatctctaagccagcagcgttttacagatggccagcaactgcttcacatcttcaacgcgggtctctccgctggctttgtcgatgatcgaactgtagacgtgcgggatcactttgctgacgcccgactccagcgctatgcgcacgatctcaccgaaattttccagatcgatgccgccggttggctccagccagaaatctagctttgcacaggcttccgccacagcgcgatactcatccaccgcctgcagaccgcccatcgggaaatattttaccgagctgccgcccatatcctgcagcatcgcgatcgccgtttcgacgggcacgatcccgtcacgctgttttgagctgcgcggtccggtggagattttcacctggcctggcgtaccggtgggcgagatcagaccgttcactatcgtctgcgactgccccagcagcgcacggcttgtggcgacgccggtaaagacctgattcacatgctgcggttgcagcactgccgcaatctcactcaccatctgtgactggttgggatcgcccgcaccaagaccaatcgagagcgcattatcgatcagcgcggcatactcgtgcatatcggcgatagcggcttcattgctggcgtagtttttcgacagcacgccgaccagcacatgcccttctgccgcctgccagatggcgcgcgcattctctttcgatcccgccagtacgttaaggcagagacgatcctgatagaaattgggggtcagcgtcatgcgtttttctctccgtttaacagtgcctgaatgcgggtgaaaatagtgtgcagttgatcggcgctgacgctgcgcacgtccgcctcaatgatcccttcgttggctttgtagccacggaagtagatcgcctcctcgccgtttttcagcgcctgcaccagatcgccggtgcgctgctgaatcgcggcttcgtcgaacttgatctcagcacgggcgatgtcgcgtccggctgcgtcccacactacccgggccgtcacgccattcagactgttgagctgttcaataaacggcgtcattttttctgccatctgcgcgccgctgatttttggctgcgtcagatagttttcaatcgcctgggtcagccccaggatcccctctttgcccactttcatcgcgcggccaatgccgttggtctggcgtttgacccactcaacgtagtggtttcggccaatcaccagtccgctggtcggcccttcaatcgcttttgctccgctgtagatcaccagatcggcacccgcctggtagtagcattgcagatcctcttccgctgccgcatcgacgatcagcgggacgccatgctggcgcgcaacggctgcggcctgcgccacatcgagatggctcttctgcacacagtggtgcgattttacatagaggatcgccgcggtctgtggggtgatcgccgccgccagttgggcgggtgagcactcgttgctgtaacccgcttccaccagttgtccgccacccagtgccaccatgctgccgaccggtgcgccatagttcacgttgtgccctttcggcaccacaatctggtgcgggacagtcagcggcgcggcatgcaggttatccaccagccagtcgttgtctttcacaatcaccgccgccacgctctgggcgataccggccgaggcgcaggagaccaccagcgcgttctccaccttcagcagaccggcgatataagcaccggtcttatccaccagatctttcatttcgaagtagtgatcgaggccatatttcaccgtatcgatcacctcactcgatggcgtagagacgccgaggatcgtcatacggccagaggcgttaatcaccggcttcaggccatacttttcatacaccgaggtcatgcgctattccttcttcagtcgcgatccacgtaccagcaacgacggccgccagcgggaccagatgcttctcacctgcgacctgttcaccttctgaatcgatgaatggccgggtttcctctttgacgctaaacacagtcagatcggcgtcgtagccgactttcagctggcctttgcgctgcaggcgcagtcctgccgccgcattgagcgttacgcagtcaatcacctgcggcagcgtcataccgacactgaaaaatttcgacatcacatgcgccaggttgtgaaccggtccggccagacgattgcggcagtagatgtcagagctgatggtgtcgggcagaatgccctgcgcaatcgccgcgcgggcgacttcaaagctgaagctggcactgccgtggccgacatcaagtttgacgccacgcgcgatagcctgttttaccgccgctttgagttcgccctgcggcgtcaggatacggttgggtttgccgttaaagcagtgcgtgatgatatcgcccgtggtgagcagatccgcaatctggtcgagattgggcggattattgccaatgtgaaccatcagcggcagcccgccggtttcctgctggatcgccttcgctttaatcagcggctgcacaccattctcgcccaccacgctgctgctgatgcgcgccttgaggccgacaataaaatcgggcagccgcgccaccgcctgctgcaccgcctcgccatctatctgcgtcatgtcagccagctcattctgggtgacgatgccggtgcgggcgatattgatcagcgcataaacctgggtctgtgccgcgcgtgtcagccggtaaaagtcatcaatgtgctctgcgccggtgctgcccgcatcgacaaccgtggtgacgccatgcgctacgccaatcgcatccgcttcatcatgataaattggtgatttgggatagcagtgaacgtgggagtcgatccagcctgcgctgaggtagtaacggccagccagatcgcgctcgtgctgcgcgttaccctgcaccttgcctatggcggcgatacggccatcctgcagcgcaatgtcgaccacctgctcatcgctgagacgcgcaccgcgaataatcaagtcgtacatggtttctccttaacggcagcccgctgccgggctgccggtgagatcagagagcaatcggaaacagtgccccaaggatcatcgcgccgaggatggcgccgccggtaatgggcttgttccagagatagaagagcagcgcgcccagcagcgaacccaggccaatcggaatggatgccgccatggctgacaggatgatcagcggccccagaaagcgccccgaggcattacccgcacccatcatcacgtctgcgccgtaggttgagtcgctctgattgatggtgaatttacgcgccagaataatcaggtagccaatcgccacaccaatcaccaggcccgtcgccagcgaggcagcgaagttcgccaccgggaagacaatgcccgcacccagcagcagtgccggaacgcccagcccgacgccggtctgaatcgccccgccgatatccagaatgcccaccagcgagccttcgatgatacgggcgaaacaggaagctggcaccaaaggcggcgaccgcgccgtagacgccggtctccatgcctgcgcgcagcatcgacacaaacgccacttcgttgaacgcgccgatgccatagaggtaatacatgtgtgtcccggcaaagacgccagaagagagcaggccaacaaagatcgggaaagaccagtcggcgtaccagaagcctttattttcgttcatcgcatcgcctcttatttgccgctgactgagttgtggatcatgtcgagccagccgggaatgccgagctggaaggactgcagcagcttcatgtcgaaaccacggaagaagccgctcagcacaaacagcagcacgatggcggtcatcatgactttggtgacccggttccagccgctctcttccacgcctttaccgatcaggatacccagcaccagccccggcacggcgttgcccatgatcagctgcgccagaccgccaaaaatggtggcccagaagcctgactttctgcccgcgtcgatcgccgccagccagaagatcaccggcatgacggtgttcaccagcaggttagcggcgggcaccagcactttgaccgccgtgacctgcagcgcagccggaacagccgaggcggtggagttgaggaaggcgaccacgatcatgccgatgatgccgcaggcgatggccatttttttcggatcgtgcagcgtctctgccacattacgattcttcaccattaaggcggccgcaccccagtttggaatgatgcgatgatccacatcctgagtgaatgaaccggctgcaaccgacgatgcccaggcattgaaaaagaagccaagaccaaaggagaagtgggatgccggatcgccctcgcacgagttcagctcgcccagcgtacggaaagcgcccatgccctgagtggttggcgcgtggaacatgcgcgcagcacccgcaccgacgccgacccctaccagcccgccaatgatcaacgacttaaacaaaatgattaaaaacatgttgttgtaccttgttgtcgtttttacctgccctatccacgccgccgcatcgcccacgcctgatcatcgcgatgtcgcgacagcagagcatcgggcaaacggctggctggcgttaacaggctctgttttacgatgccgccgtgaacaccacctgttcggtgtcgaaaacggtgacgctgacggtgatctccagcgtgacgctgaagctccgccgttggcgcgccagaaagaagaagagaaacttctcggttttgacgctctcctgcgcgcgcagcacccggacatcctgaggttcaatgcgcagcagaattttttgcgtcgcgcgcagaacctggttctgcacacgactcagggcatcggcaaaggctttcgctttggtgtcgcctttgccctcgaccgtcacctgggtaacgtattgttctttcataatcagctgccgtgcttcttgttccaggcctgcaccagccgctcgcctaactcttctttatccataaagccgaagcccagcaccgtggcaccttcattaatggcggtgacgccttcgtcgacagaaacgcatgccatgctttgctttgtagccatatttgttctgagcggtgatagcaccggcgccgccgctgccgcagaatgagatgccgaaatcggcgttttccgccttcatcacgtcacccagtttcatgtcagcggcgacacctggcaccacgacggcacggccacccgctttttcgatgcccgccgccactttctgtcctttacctaaacgatcaccaatcactactgttaccatcttatgttcctctctggttgtttgatcgcgcgacttcaatatgcactgacagcagccaggcctcttcgcggggcagattgccaaacagatcgacgacctgctgcgccagcgctaacgtttccggcggaatatcctcaaacagctccgcttccacttccggcagcggctcaccgctcagcgagcgtgacgccatggcaccgacatgcgattgcagcatctgctgctgaaccgcattgggctgaataccctgctgctgatagatcgcagcaatctgcgtcatcacgctgtcagccagctgttgcactttctcaggtgccgcttcatacaccgggacgccgttattactcaccttgctactcctgttaaaccggataattcgcgttaaaaacaaattagcggtcatcgccccggctgtggagaggcaacatttccagcagcaagtggaaattgaagtgaaggttgtgcgtcagatcgcaggctgcatgcttagtgcgacacgcgtcgcagaatgcataatttgatggatttaaccgagaaaagcggtgatgttgtgcggcgacaagccggaagcgctggggttcagggtacggtgataagcagaagtgatggtaaaaaaccgccggcctggctggccggcgatctgattaacggaatttcttatggttggtattgcggatgtcgtcgaacttcgctgcttcgcgtttcgccccgtccacattgttggctttcgccagcgcgctgaccacatcgatctgcgcgatcagtgagtcgataccggcatggaaatctttcacctgtgggctgtcagccggctggccttccagcttatccggcgtgccctgtcgcgcatcctgtgccgcggcacgcattttggttagcgcctgctgcatctcctgggcattgtcactttttttgacgattttcaggttcgcattcagtgtatccatatcctgctccagatccgccgcatagagactgacgctggagaacaacagagaagccgacaacattgcaatcacatgcttacgcattattacttcctttttattgtgatgaaaaaaaagcagccaaccggctgcttcaggaatccatctttattgtcccgctatcttcatctcaggcagtaacactgaaccgcactggatattgctgcgggtttcaatatcgtcaccgatggtcaccatattgcgccacatctctttgagatttccggcgatagtcacttcgctgaccgggtactgaataacgccattctcgacccagaaacccggccgcaccgcgtgagtaatcaccggtaatggcgctgaccccctgtcccatcagttcggtcaccactaacccggtgcccatctgcttcagcaggtcgtcaaagctgtggccctggcccgcaatgcgccagttatgaatgccgccagcgtgaccggtgctggtcaggcccagtttgcgggctgagtagctggttaacagccaggtctgcagcacgccatctttgatgatgtcgcgcgcctgggtacgcaccccttcgctgtcgaatggcgtggaggcgagccctttcagcagatgcggctgttcattgatggtgagccactccggcaggatctgctgacccatagaatccagcaggaaggtcgatttacggtaaacgttgccgccgctgatcgcgccaaccagatgaccaaataagccggttgccacttctgaggcgaaaatcaccggggctttcatggtcggaagtttacgcggtgccagacgggagagcgtgcggcgcgcgcactctgcaccgacccactccgggctcttcaaatcttcaaacgcgcgcccaatggtgtaggcgtagtcgcgctccatgttgccatcctgctcggcaatcacgctgctggagagcgagtgacggcttgagcagtagctctgtaacataccgtggctgttgccaaagactttgatgccgacgtggctgttgaagctgccaccttcagtgttggtaatacgcttgtcggcgcgcagtgatgcctgttccgcctgcgcagccagttcaatggcgcggtcagcatcaatctcccaaggatggtagagatccaggtctggcgcatcataggccagcagctctgcgtcggccggaccggcaaagggatcgggcgaggtatagcgcgcaatatcaatcgccgcctgcacggtgcgtttgatcgcgtccgggctgaggtcggtcgatgaggcgctgcctttacgattctgatgatagacggtgatgcccagcgcaccgtcgctgttgaattcgacgttttccacttcgccatagcgggtgctgaccccgatgccggtggttttactgactgccacttccgcgctgtcagtgcttgctttagccagttcaagtgcctgcgcaatggcctgctccagtacttttcgctgttctgcaacctgagtagatacgttcatcgacctgccgtctaatcttatgtgtgaatgatttgagtctatcagagtcagagaacaatttcgcagtcacccgataaactggtaggattagcctcttttttttgggagcccggaaatgaccaaacagcccgatgagtggctcgacgatgtgccagataatgacgaagaagaagatgaagagattatctgggtcagtaagagtgaaattaaacgcgatgcagaagagttaaagcgcctgggtgccgaactggttgatctgggtaaaaactcgctggataaaatcccgctggatgagcgcctgcgtaccgaagttgaactggcacagcgcatcaagaaagagggtcgccgccgtcagctgcagctgatcggtaaactgctgcgcagtattgatgtggagccgatccgcgttgcgctggataagctcaataatcgccataaccagcaggttgcactgttccataaactggaaatgctgcgcgatcgtctgattgaacagggtgatgaagcgatgggcgacgtgattgcgctttatcccgatgccgatcgtcagcagttacgcagcatgatccgtaacgcgcagaaagagaaagcgggcagcaagccgccgaagtctgcccgtcagattttccagtatctgcgcgaactggccgaagcgaagtaacgccatggcgggcagcctcgcccgcctcccggaagcgcatttatcgatagatatagagaataccggtgcgcaaccgcagctggcgttcgctcgatgtcgcagaaacgtccgatatcgccaaaggtgacgtaaggcacccagacgcgatcgttgccaagcgcataatcgaactgtaactcctgttcgtaatcatcatgtttattggcaaagagtttcgcatccgcgtgtttatacaccagcttataggtggtggtcagccgatcgcttttatttcgcagatagagatcaaaacggttggcagtgcgatgccggtcagtatcgcaataatcaataccgccggtacggcattgatcgtcatgcgcataatcggtcagctcaagacgataaaggccaccgagagaccagcgatcattaaatttataccagggtgccacaccaaatttccattcagtgcgcgaggagttaaactctggctgaataaaaggcgacagtgtccagttcccccagtaatacgacttcagaaaggtcacctccactacgtttaacacggtgtcgttataatatttgtcttttggatcggcgccgccggttttgaatttggtttcgacgccgagaaacatattgtccggcagcgtggtgctcagacccagcttgtcgtagtgcgtgcggtcgcgaaggcggtactcatgccggtaatcaacggtggccgtggccagcgccgcagcagaaactgcataacaacgcggcgcccagcaaaaacgacaatgaattattatttcccatatgaacatccttattagtggtaatcagagcaatgaattatccgaactcattcgtttaacccatagttaacttatatttaaaatcctcatcaatataagatcgcgcataaagagagactgttatttatccctttaactttaacgcgttaattattattcctcagtcactacagggatgatgctagaaataaccggcgagagcggcctttctgtttcagacactaataagaaaaatatggcaacggcaggaagagtgagcagatcgaattcaaaaatatgcgggatttattgagggaataatatttccggggataatgcttttaaaaaagcgcccgaaacgggcgcctgtgacattatgccagcctgtccagcagcttctggtggatgccaccaaacccgccgttgctcatgaccagaatcgtgtcgcctggctgagcggctttggccaccatttccaccagggtatcgatatccgcgctccagtgtgcaggcggaatgcacgcttctgcgacatcagatacctgccacggaatatggtgcggctggaacagaaagacctcatcagcacgcgccagcgacggtgccagatcgttcttgctgacgcccatcttcatggtattagagcgtggctccagcacagccaggatacgcgctctgccgccaactttgctacgcagggcagccagcgtcgccagaatcgcggtcggatggtgggcgaagtcatcatagactttgatgctgttcacttcgccgcgcagctccagccgtcgacgcgcattgataaagctgttcagcgcctggcctgcatcttccggcttcacacccacatggcgcgcggcagcgatcgccatcagcccgttgtgcatattgtgttcacccaccagagcccagttcacttccccgactttttcgccgtcgagccagatttcccagtgagacgcatcgttggtgagcttcttcgcctgccagcgcccgtgctcgccgacgtttctcctgttcgctccagcagcccatcgccatcacctgtttgaggttaggatcatgttccggcagcaggatcttgccctggcccggtacgatccgcaccagatggtggaactgcttctggatcgcgcgcagatcgtcaaagatatcggcgtgatcaaactcaagattattgaggatcagcgtacgtgggcagtaatggacaaacttggaacgcttatcgaaaaacgcgcagtcgtactcatccgcctcaatcacgaagaatggactttttcctaattttgccgagacatcgaagtttccgggcacaccaccaataataaagcctggctcaaggccgcaggcctcaagaatccacgctgccatgccggctgtggtggttttgccgtgggttcccgcgaccgccagcacccagcgatcgcgcagcacgaaatcgtgcagccactgcgggccagagaggtaaggaatgttgcgttccagcaccgcttccacgcaaggattaccccgcgtcatcgcgttgccgattatcaccaggtcaggcaccgggtcaagctgactggcgtcgtaaccttctgttaattcaataccttgctgttcaagcagagtactcataggtgggtaaacgttggcgtctgacccggtcacctgatgaccaagtgaacgggccagcatcgccagaccgcccataaaagtgccacaaatcccgaggatgtgaatgcgcattacgtgatccattactcaaaagttcggcgcacagtgtaacgccgctcgcagatggaagaaacggattaggactatggtttttgaagttcaatcggctaaactgcgtacgcatccgttggcagactgttacgcgtgctgccactccatcgaagattcagggaatgtgttatgaaaacgttgggcgaatttatcgtcgagaagcagcatgactttccgcacgctacaggtgaactgacagcgctgatttccgctattaagctgggtgccaaaatcatccaccgcgatatcaacaaagccggtttagtggatattctgggtgccagcggcgtcgagaatattcagggtgagcagcagatgaaacttgatctgtttgccaacgagaaactgaaggcagcactgaaagcacgcggcatcgtcgccggtatcgcttctgaggaagaagacgagtttgtgatctttgaaggtgaagaaaacggtaagtacgtggtgttaatggatccactggatggttcttctaacatcgacgttaacgtttccgtcggcaccattttctctatctaccgccgcgtcagcgagccgggtacgccggttgttgaagcggacttcatgcagccaggcaacaagcaggtcgctgccggttacgtggtttacggctcctccaccatgatggtttataccaccggtgcaggcgtgcatgcgtttacttacgatccgtctctgggtgtgttctgcctcagccacgaaacgtatgacctatccaccaacgggttacacctactccattaacgaaggtaactacattcgtttcccgcagggtgtgaagaaatatctgaagttctgtcaggaagaggatctgccaacgcaccgtccttatacctcacgttacatcggatcgctggtcgcggatttccatcgtaacctgctgaaaggcggcatctacctctacccaagcactgccagccatcctcagggtaagctgcgcctgctgtatgagtgcaacccgatggcgttcctggcagagcaggcgggcggtaaagccagcgacggtcagaagcgtattctggatattccaccggtcacgctgcaccagcgctgcccgttctactgcggtaacgaggcgatggtgaacgacgttgagcgtttcctggccgagttcccggattgccgtcagggttaatccggcagtggtataaaaagtcatataaaaagcaagggcgcgattttcgcgcccttgctgtttttacgccgtctgcaacctgaactgcgccatggttgcctgaagctgatcggactgcgcttccagcgactgggtcgcggcggttgcctgctccaccagcgccgcgttctgctgcgccgccgcatccatctgtgtgaccgccagattaacctgctcaatgccacggctctgttcgtcggaggccatcgagatctctttcatcagtgccgttacgcgcatgacctcaccagaaatctcatccatggtttccccggcccgcgtcgccatctcgctgccctctttcaccctcgactgtgaatcactaatcagcgtacggatctctttggccgcgttagcgctgcgctgtgccagcgtgcgcacttcatttgccactaccgcaaagccacggccctgttcgcctgcgcgcgccgcttcaacggcggcgttgagcgccagaatgttggtctggaaggcgataccatcaatcacgccaagaatgtcgccgatacgattggcactgtcggtaatctcatgcattttttccatcacatagcagaccacctccgcgccgcgatcggcagtatcagagaccgcgttagccagctggtgcgcctgctgggcattgctggcgttaagccgcacggttgccgtgagctgctccatgctggcggcagtctgctccagcgaggcggcggactcttcggtacgctgcgacagattgacgttgcccgcggccagttcacggctgccgatgtcgatctgcatactcgcttcgcgcacctgactcaccgaggtacgcaacgactgctgcatcccggcgagcgcatgattaagccgccccagctcattgttgcccgacggtggcagcgcctgcgagaggtcgcccgccgcgacctgctcaagatggagaatggccaggttcagcggctgcagcagcatccggcgcagcagttgccaggcgagcaccagcagcagcagtgttaataccaccgccacggcgatcaggattttcattttggtttcgttgtaggccgcctgcgccagctgggcctgggtgatctgatcggccagctggctgaagtccgtgacggccttgttgtagctggctgccagcgtcgccaggttgccttccagcaactggtaatactcgtcggtatattgcttatccagggcgttcatcatcggtttgatgccctggtcgagataggctttgtaactggccgaaactgcatcagccagctttttgccgtgcgccgtcaccgtttccggcgtctacaaagcgcttcaggctttgctgtgatgagaccacatccgcctgcgacagttttgttactgccgccccctcttccagtaaaccaatttcaattttacgcaccgccagcgcggcgttagcgcgggcccgcatcagatcggcattgctctggtaaagactgttcagctcgatcccctgaatgcggttgatcacatccagcgagcgattccctttgttaattgccacgatacccataaaactcaccgccaacagcagcagtgtcataaatgccagcaatgccagcaaccccgtgcgaagtgataactgtttcatccagatagtttccgtgtatgtgaaaaggcaaattttccagcggccctaaaacggatgaagtatcggcagtaacggcgcgaaactttaaccctgattagtgttaacaacttgatcatcacgggaacatccatcaagctaatcgccgcttatccgttatccggagaaaagaatgaaaccaggattacttctgatgctgctgtgcctcagcacggcggcgctggcagaggatctgccgacagacgcctcgcccgatcgctgcctcaatgacgcctctactacccttgccatgaaccagtgctacgctgcggctaatcgggcctgggatcaggagatgaataagcagtacaacaaactgatgaaaaccctctccggcgaacctaaaaacaaactgcgtgccgcgcagcgcgcctggctgagctaccgcgacagctggcttgaggcgagccgcagccagctcagtacacaaggctcgctgggcagcgtggcgctgagcgctcagagcctgagcctggtgcgcaatcaggcactgatgctgcagtcacttggtaaaggcagctgtgctaaccccgatgactgctgatcgataaccggcttttgcgctgactgaagtcagcgcactcattaaccttcagggagaaaccatggctgcttacgcctcgaccatcattctgatttgcctcgccgtgctgagttatttcgttcacaacaacgcggtcacgatttcgattctggtgctgctggcgattaaaattaccccgctggctcagttcttcccctacgtagaaaaacagggcattaccttaggcatcattattcttaccgtggcggtgatggccccgctggcaagcggctcactgcccgcctctgcgctgatcaagtcgtttgctaactggaagtcgattgtggcgattctggtagggatctttgtcgcctggctgggcggccgtggcgtgaactttatgagcgtccagccttcggtgattggtggtctgctgattggtacagtgattggcgtggcgttcttccgtggggtgccggtaggaccactgattgccgcaggcattgtttcgctgtttgtggcggctaagtagcgtttgggcgcattccgaaacgccaaaaagggggcatactttcagagtcagttggctataatagccgacactcaacatacgactactgaaggaatgccagatgagtttgaaccaggtgccagcaggtaaagacctgccagaagatatctacgttgtcattgagatcccagcgaatgctgatccgatcaaatatgaagttgataaagagtctggtgccctgtttgtagaccgtttcatgtctaccgccatgttctatccgtgcaactacggctacatcaaccataccctttctctggatggtgatccggttgacgtactggttccgaccccgtatccactggttccaggctcagtgatccgctgccgtccggttggcgtgctgaaaatgaccgacgagtctggcgaagatgccaaactggttgccgtttccgcacaccaaactctctaaagagtacgatcacatcaaagatgtgaacgacctgccagaactgctgcgtgcacagatcacccacttctttgagcactacaaagatctggaaaaaggcaaatgggtgaaagtggatggctgggataatgccgaagccgctaaagctgaaatcatctcctcttacgagcgcgcacagaagaagtaattctgctgccggtttgtgagtcgaaaaaaaaacaccgtccggatggacggtgtttttgttcaggcctctggctcctcatcgcgcttcagccagtcaccactcatgatgcgctggcgtcctgccactgagcgttgatagacataaagccatgcactgccaaacggcgtctgagtcagataacgtttgtactctccccctttggtgcgaagcgcatccagctccgcaagggttgaggcatcaatgcggtacacctcacaatgtaccgctccattgccctcaatcacgccgggataatggcccagactgtaaagctcaaagccttcaatctggtgatcacccagccactgcgcattcgtcatccagtgactgtttccctgtttgcgccgtaaactgccgtagacaattattcgcattgctaaaactcaaactgatagagcaaatcgagagcctgatccacaccggacacggcttccagatagagtttaggcatcaggcggtaacgcaaggttaacgtcgccagtgaatcaaatatgccaacaccgtattttacctgcagacccggtagcacatagccgctgacctgcacctgctggctgtcgccaacaccggcagtatcaacagcgagattgctgacaccgaatgtctccccgattttacccacaacctgcccactttgtgcaacccctaagccaacaagtgctgaagtgagggcgttactgtcgccgtcgctgcccaatccctgaccgcgcagcagataggaaagcgcttcctgttgcgacatcgccggatcggagaagacttccgcttttggctcatccgccaggccagtgacgcgcagacccgcggtgacgccatcttcggtggcatccgggttacggatggcttccaggttgacgtaaggctgatccggcggaccggcaaactgcagctcgcctttacgcacgatcagatcctgaccataagcgtggaagcgaccggacggaatgttgatctgaccgttcaggccgagtcctgacttatcctgcaccattttcagatcgccattcagcttcgctttcaggccaaacgcagagagtcgcacatcgttgccgacgtggatcaccagattgctgttaatcggaatcgcggcggtttgcggtgcaatcggcttcagctgtttatccagcaacacctcatccgacgaaacgccagtggcgctttccggcacttcctgcaccgtgatgcgcgcccatggaatatcgacccggccatcaaggttaaaggccgctggcgtcgcttcaaacaccagatccggcgagacatccatgcgcaccatcggcggcacggtgacgcgaacccggctgccctgtgccgcaatgcgcgcacgccagttgtcgagctggctccagtctgcgttaccgctgaggttgatattgccctgcccggtctgcaccagcccgttcagggtagagctcatgccgttaaacaccagattcaggttggcactggtcaggtcaaccggcataaagttgccatccacatccacacccgtcaggccaagctgaccaaatacctgcggctgctgcacgctgccgcccaggcgcaggctgctgttcaggctgcctttgatcttctcgccctgcatcagcgccggattgagcatcgccagcgagacattgcggatgttgacgttaccgcccagcgtgcggcggttttgcggatcgtcgatctgcacgttaccatccagctgaccgttattggcgatgcggatcagccagtcgagctgggcgcgtccgtttcgcagcgcggcattgaggttcagcgtgtcaaaggcgatcggcagattgttgccctgcacatcctgcaccactttcacgccgttgcccttcagcgccacggtaccggtcggcaggctgccatcggcagtccagttgacgcgcacgtcaccgctgaacaggccgctaagctgagtcgcatccggcataaacggcttcaccatcgccaggtcaaagcgattcagcaccacatgcgccttgcctgccgggcccgcttcaaccggctccggcacacaaatttgcgcattggggttctgccagcagtgtgggccgatggtggccgtctggcggctgttcagatagtcgatggccatggcgcgggtcagacgccactcaccgactggcgtatcaaagtgggtgtcgttcagcgaccctttccagcgctccgtctggcgatcaaagctgccgttcagcgccagctggccagagaccggtttgccctgcacattgagcttcagctgatgctgatgctcattgccgtccgcgttcagcgttagcaggctgatgttcagcgcatcctgcttcagctgctcgacgcgcagttgcagtttacccgccacctgctcgccggaacggacgtcgccattcagggtgacgcgattgatctgcatctgctgccagcgcagaccacgggcattaagatcggccagcagctgcggtgccttcagggtaccccgcgcttttattgtgccgttgatgacgccgcccagacccggcagcgcattgtcgagctggggtgcgtcgatactggcatcgagatccagactgtcgcccagcgcgcctttaacatccagatggttgcgtcccagcgccagcttaatgcccggcaccgtccactggttgtagctgttaccggtcagggagccatcagcggtcacggcgtttctgtttcacattgcctttcagctgtagctgcggcacgctcagttgccagctgccaccatacagactgccgcgggtggtgattttgccatccagccgtgctggccagtcgggatactgtttagcggtattaattcccgccagcgtcagctcactgcgccagcttatcgccttgctccagtccaccagcgcggtgagatcgatattgccctgcagcgcagccacgcgcaggcggtcgaggctgaactgctcaacgttgcctttacccgtcagcgagatcgtcgccggtggtacagattcacccttcacggcagtctgcagcgacatcacatagtcggtggctttgcctttgaactgatagtccaggttatccgcctgatacgctaccggaccggtcagcggccagcgtaactgcggactggtcagcttcagtgacagcggcagtcccgccaccgccagctgggtcgtggcgtccagctgcgcattcaccggaccggagaggttcagccccatcttcagctcgtcgcgcatcgcgccattaagtttcagcgcgagcttttcgcctttaatcggatcggtattcactgtgccgttaagggagaaatcgaccggccagttatccgacagcgtcgcctgaccgctacccttcaggttgccgaggttcgagtccacctccagcgtgctgagctgcatctgacgatcggcggttctggctttcagcagcaaccggctgacggaaatatcggtgtcgccggtaatgcgcagctgttcacccagaatctgctgcacctcaatatccagcggcagacggaaatcaggcatctcaggcagcaggggttgcgcaaacatcgcctgcagcgtttcacccagcggtttttcagcgggatgtggctgctggactttcggctctaccacctcgtcattgaccactttcgccgctttcggcagcgcaatcagcaggctttgaatatgggtcgggttcagcgtcagcgcacgatcctgccactgcaggccggtggtgaagtcgagcagcgatattgcggtgtcatcaactttgacattgatattgtgcaggccaaagtgacgcagcgtgatggggtatggcgtgctgaggttagagttgccactctcctcttccggcgctggtgccgctggtgtcattttcttgctgtcgaccaccacgctgatatcgcgcagggagacatcgttaacgcacacggaggagtgcagcaggcagttgagatccaccgccagatgaatttgcccggcatcgacgctgaccccaggcatttcgtaacgcagaccgttaagggtcaggttacgccagccaccatcgacctgtttgattgacaggcccggcacccagcgcgacgcacctttcagcactaaatgcagcccaggcgtggtaccgattaaaaatgccaccccacccaacagcacgaccagaaagatcagaatgccgatcaggacctttttccacagcttcatagttctggccccagccctacgtaaaattgtaatccatgctcttcgtcatccccgatgggtctggcgatatcaaatttgattgggccaaccggtgaagaccagcgcacgccgacgcccgcaccggttttgacgttactttgcttgatgtcgttaaccgcttcgcccgagtcgacaaacaccgcgccccaccatttcccggtgacgttgtactgatattccagcgatccggtggcgagttttgatgcaccggtgagtttgccgtcatcatcgcgcggtgaaatatttttgtatttgtagccacgaatactgcggtcaccaccggcaaagaagcgcagatccggcggcactttttcgaagtcgttggtttcgatccagcccagattgccgcgcgccacaaagcgatgactgtcgccaagggtacggatccagacgttttgcgcctgcaggatcaggaagtcgacgtctgaaccccaggtggtatcagagacgtctgccgaatagcgctgtgaatcgccccaggtcggcatcaggccgccacgggaacgggtgcggtttacgctgacgccaggatagagcagcatagtggtgttggtcacgctgccctgagtaaagtgatccaggctccagcgcaggttgaccgtcttctgccagccgctgctgctgtcccagttgcgcgacatcgcaagcgtcgtggtatccgctttggtgtcgttgaggtcggtgcgcttcaggccgccggagaaggtgtagtactgctcaagcgggcttttcagcagcggtactttatagctgagatcgacctgctgttccggcgcggaaacgtaggcgctggccgccaggctgtggccgctgtcgttgatccacggttttttccaggtccctttcaggcgcggaccgacgtctgtggaatagccgacgccggtttcaatggtgttttcggtgcggggtgacattactgcgctcagcggcagcactttggtctgtcgtcccttgctgaattccggcgcgaccaccaccgaattaaaccagccggtagcggagaggcggcgattcagctcggctaaatcgcgggagctgtagtagtccccctctttaaacggcaccaggttttgcaggtactcttcgcgaatttgcgatccctggaaagtaacgtcgccgaagcgatagcgttcgccactgtcgtagtcgatatcccagaacgcttcacgccgctcaaccgagacaccaagctggctttttttaaacgtgccgtcgaaatagccgttacgcagtgcgagattagagaagccgcttttgaatttgtcatattgcccgtggttaagctggctgcccacttcagggcgtccctgcttcacccaggctttgtaatccgcgtcattgcgcgcatcgccttcgaccacaatcgtgctgccgccgatttttaccggttcaccaggcgttacgtgtgccactaataccggtcgtccaccctgcgcaggcgcggggcgggattcgaaatcgatggtgggctcgtaataaccgagcgcgcgcagcccctcttttatcgcaacagaaacgcgcgcgcgaaagcggccatcattagagacctcatcgctgccgatggtggacagacgcgctctgacattcttttgcagatccccggataagccgtctacctgtaatcgcactgtcgccgcctcaagggcgggcgcggcaagcagcaggccagccatgcaataaacataaaatcgtggcacctgtactcctgttaatcatgccggccccttttccgcggggcgcttattaatcttctttgcccgcactaccgcaacggcaacatcctcatcatagccgcactttatggcaaacggcggagcaacactgacatctaagtcaaataacggggctattgtcggtaaatggggtgagcgatacaactcctgcgggtcggaatgatcagtccgatatgactcactcagataaatccgagtctgtaaccggccgctctggctgctaatgcgcccttaagcagcggtttgccctctggcggcgcaatgagcgctcctgctataatcggccaccacaggcattccgcctgttttcatttctgccccgacatgtcgtttgttgtcgaactggcgcagacatttttggcacggatagctttgtttcacggataaaccaactctgtttgcgcttacccacgctgcccaggccaaaaatgacaagtggataaccctttggatctcatatgttagatagcttacttgtcattctgttactgatcgtaatcagtgcctttttctccctgtcggagatctcgctggcggccgcccgtaagatcaaactgaaactgctggccgatgaaggcaacgtaaatgcgcagcgcgtgctgaaaatgcaggaaacgccgggcatgttcttcaccgtggtgcagattggcctcaacgccgtcgccatcctggggggtattgtcggcgatgcggcgttttcgccggttttcagcggcctgtttaaccggtttgtctcgccggaaactggcggagcagctcagctttatctgctccttcaccatcgtcaccagcctgtttatcctgtttgctgacttaaccccaaagcgggtcggcatggtcgcaccggaaaccatcgcgctgcgcatcatcaacccgatgcgtttctgcctgctgataatgcgtccgttggtgtttctgtttaatggcctggctaacgtattcttccgtattttcaagctgccgatggtgcgtaaagatgacatcacctccgacgacatctacgcggtggtggaagcgggtgcgctggctggcgtgctgcgtaagcaggagcatgagctgattgaaaacgtgtttgagctggagtcacgtaccgttccctcctccatgacctcacgtgagaatatcgtctggtttgatctgcacgaagatgagaccagcctcaaaaccaaaatcgcccagcatcctcactcgaagtttctggtctgcagcggcgatatcgaccatatcgttggctatgtcgactccaaagagctgctgctgcgcgtgctgggtaatcagagcatggcgctgaacagcggcctgcagattcgctcggcgctgatcgtgccggacacgctgaccctctctgaagcactggaaagttttaaaaccgccggagaagatttcgcggtgatcatgaacgaatatgcgctggttgtgggcattattaccctgaatgatgtgatgaccacgctgatgggcgatctggttggtcagggtatggaagagcagattgtggcgcgtgatgagaattcatggctggttgaaggcggtacgccgattgatgacgtgatgcgcgtgctggacattgatgatttcccgcagtcaggcaactacgaaaccatcggcggctttatgatgtatatgttgcgtaagattccgaagcgtaccgattttgtgaagtttgctggctacaagttcgaggtggtggatattgatagctatcgcatcgatcagctgctggttacccgcatcgatgaacgaccgccggtgctgagcatgacaaaaagcgaagaagagtagaatgaccagcagcctggacatggacagcgcggaacaaccggaatgtgacgtagtctgtgagaattgttggcactgctcaggttcagagtgacaaataaaatggcctgactggccagacactaagggcgccatcggcgcccttatgattagttgaactcaagtttgagacgaacgacctggcggttaatttctgacatcacgctcaggtgctgtttgtctttgacgcgcgggattaatactttccctttgtcgaactcgaacgcgccgacgtccttgatatacaaccttcctttgaacagcgtttttacatatttcgctatttgtagcggattatagcgctggaagatcttcatactgactaactcctgtacatttttaagcacgcttcgccgtttccaaatttggttccagcccatgaagcgcgaattcgcgataactatagaacactcaaacctactaatgttcctaaaagtgattttttttactgaattgacacatcattacagaacactctgttatcaggctcacacaacacagtataaaccttcgttggttaaggaattgtggcggccataacaaacctgacacctttccaggacaggcgcatcatccctgcttactattgcagtaaaatgactaactggtctgatcactcaaggaaatagcaatgcgaataattctggcagctgtagcgttgtctttactgatactggcaagcgtgatggctcatgacctcaggcaggatatgcgggtaccggccgttggcgtgaacgacaaaggcgagctgttattgcagcaggataagtttagctacaaaaactggaatagcgcgcagctcggcggaaaagttcgcgtggttcagcacatcgcgggtcgctcatccgctaaagagatgaatgccgcattgatcgaggcgattaaggccgcgaagctgccgcatgatcgctatcagaccaccaccatcgtgaatacagatgatgccattcccggtacgggcatgtttgtgcgcagcagcgtcgagactaacaagcagcaatatccgtggtcgcagtttgttgtcgacagcaagggcaatgtgcagcatgcctggcagttacagccgggcggtttccgccattgtggtgctggataagcagggtaaggtgaaatttgtgaaggatggatcgctgacgcaggatgaagtgacaaaagtgattacgctggtcacctccctgctgaaggattaatcgctgaagccccggtggggagagcatcgcccgccggggtttcagccttcagcaggctgagcgctcagacagcgttaaaacagtgatacgcggaagccaggattaaggaaggattcgcgcggcgcgtagtccagagttttaccctgccagtcgtgcacatgcgcgcccgccgccatcgccacggcatggcccgcgccggtatcccagatgttggtgggtccgaaacggggatagagctgggcttttccttctgccaccaggcagaatttcagtgaggatccggtcgcgacggtctgatgttcacctaactgcttcaggtactctttcatctcatcgtcgtcgccatgtgaacggctcaccaccaccagcggaggacgcgcatcacggacatgaatctgttcacgctgaccgccctcctctttccacgctttgccgtctgcagcggagtacatcacgcccagcactggcgcatagaccacgcccattaccggcttgcctgcttcgattagcgcaatattaacggtgaattcgccgttacgcttgatgaactctttggtgccatccagcggatcgaccagccagtagcgctgccagtgctgacgcacctcccaggctggcggatcttcttctgacagcacggggagatcaggcgtcaactttttgaggccagcgaggatcacctcgtgtgcagcgatatccgcggcggtcaccggcgaatcatccgatttgtgagaaacgtcaagcggcgcggcaccgttatagacctgcataatcgcgtcgcctgcttcgcgtgccagttggcagatttgctctaacatttttcacctcattgtgtctgtctgctgcaggatcagctcatcgtcagatagtgacattttagcagttccgcctgaagtacccatttacaggcactttggcgattcaatttatagatatatcaatatcatagttacccatttatcgccacgcctgtgccgctacgcctccatcgtttaagaatccgtcgctgaccgatgcgccaaaacgttatacccatcacgatttaaaatgactatctgtcatgcttttacattattttgagatccttatttattttgcagcaggagcaagcatgttaaagcccggaatgatgttactggcactgagcgtttccgtcgccacccaggcggcgacggtggatttgcggatactggaaaccaccgatctgcacagcaatatgatggatttcgactattacaaagacacgccaaccgagaagtttggtctggtgcgaaccgccacgctgatccacgccgcacgccaggaggtgaaaaacagcctgctggtcgataacggcgacatcattcagggcagcccgctgggtgactacatggcggccaaaggattacatgagggcgagatccatccggtctacaaggcgctcaacacgctggattacagcgtcggtaacctcggcaatcatgaattcaattatggcctgccctacctgaaaaaagcgctggcgggcgcacgctttccctatgtgaacgccaacgtgattgatgtgaagagcggcaaaccgctgtttaccccatacctcatcaaatccaccacggtggttgatcgcgagggcaaaacgcagaccctgaagataggttatatcggctttgtgccgccgcagatcatggtgtgggataaagccaacctgcagggcaaggtacgcgtcgatgacatcaccgaaacggctcgccgctacgtgcctgagatgcgcgcgcagggcgccgatctgattatcgctattccccactccggcctgagcagcgagccgtatcacacgatggcggagaactcggtttactatctcagccaggtggaaggcattaacgccatcctgtttggtcatgcgcatgcggtcttccccggcaaggagtttgctgacatcaagggtgcagatatcgccaacggcaccctgaaacggtattccggcggtgatgccaggcatgtggggcgatcaccttggcgtggttgacctggtgctgaacaatgagggcggacgctggcaggtgagcagcggcaaagcacaggcgcggccaatttacgataccgcagcgaagaaatcgctggcggcagaggatccggcgctggtgaaggtactggctgacgatcaccgcgccacgcgagagtttgtggcgaagcccatcggcaagtccgccgatgtgatgtacagctacctgtcgctggtacaggacgatccgacggtacagatcgtcaataatgcccagcgcgcctacgtggagcatttcattcagggcgatccggatctgggccgcctgccggtgctctctgctgctgcgccgtttaaagcgggcggacgtaaaaacgatccggccagctatgtcgaagtggagaaaggcgcgctgaccttccgtaacgcggccgatctctatctttatcccaataccctggtggtcatgaaagtcaccggtgcgcaggtaaaagagtggctggagtgctcagcgggccagtttaatcagatcgatccccacagcacgaaaacgcagtcgctgatcaactgggatttccgcacctataactttgatgtgattgacggggttaattatcagattgatgtgacccagcccgcgcgctacgacgcagagtgtcagttgatccatcctgaggcctcacgtatccgtcagcttagctggcagggtaaacccgtcgatccacaggcgaccttcctggtggcgaccaataactatcgcgcttacggcggcaagtttgccggcaccggagataaatacatcgcctttgcctcaccggatgagaaccgttccgtggttgcagcctacatcagcgcggaaaccaaagcgcacggtgaagttcagccgaaggcggacaataactggcggctggcaccgattacctcatccaccccgctcgacattcagtttgaaacggcaccgggtgataaagcgaccggatttattaagcagcatgcgcaatatccgcttcagcccaaagggacagatgcgatcggctttgctctgtggcaggtgaatttacagcagaaataaggcggaagaaaacgctgcaaccgggggggttgcagcgtccggaattacagaatttccagcagttcgacttcgaagatcagggtgctgaatggtgggatagaggcacccgcaccgcgctcgccatacgcgaggttctgtgggatcaccagttcccattttgagccaaccggcatcagggtcagcgcttcaatccagcctggaattacgccgcttaccgggaattccgccggttcgccacgggcaacagagctgtcgaatacgctgccgtcgatcagtttaccggtgtagtgaacgcgtacgcgatcctgacgtgatgggattggaccctcgccctgcgtaatcacgctgaactgcaggcctgattcggtgctgctcacgccttcacgctgcgcatgttcctgcaggaacgcctgaccttctgcggccatggcttcggtgcgctcacgacgcacgccttcagcgcgttcatgcacttcacgcagtgcgcgatgaaccacatcaaccggtacggccggcgagttcccttccagcgcgtcgcgcagacccgcgagcagtgcttctggttgcagaccctgcagaccagattccagcaactgctggccaacctgtaaaccaataccgtaacttgcttgtgcttcgacgctgtcgaaagaaggggtagtcatcttcgttcctttcactctcggataaattcgaacgggcagcatagcagcgcaggccgctggcgtaaaatgccctgcgtcgcagatgacttttgccggggaaagagaaacaatagagccgtcaattttatcaatgctggcaggcacttcgcgccggtattgcccatactataactatcgggggggatcaccccctctgtagcacacgaataagagagcaaacatgggccagatagccccacgacgccgcaggatgcgtgcaaaatatcttgtatcccggctgcagacctggctggccgcacgcaggctaaatcagcctgccggagaggaggaaccccgaatggcttcagacacgtcatcccgcctgccgacatggcttcagcgtatctggcattttaccgaccacattcgctggatggacccgctgcctgcgccgcaccgccgtggcattgtggccgcactgctggtgatgctggtggcgtttctctggcccgccagcacgctgcgctatccggttgagcagccggtcgcaccccagacggagaaagaggtgccgatgcaggcggatatttatgagaacaacagtagccgccagccgtcatccccaccgtctcagcagacgccaaaagccgattctcagggtgagtggcgcaatctgaccatcgcttccggtcagacgctggcgcagctgtttcgtgataatagtctgccggtcaatgatgtgtttgcgatggcgcgggtggaaggcagcgatcagccactcagctcactgaaaagtggtcagcaggtgaaaatccgtcaggatgcgcagggggctgtaacaggtctgacggtggagggcgcaaacggtccggtgctgtttacacgtcagccagacggcagctttattcgcgcgcagtaacgcgaacagcggcgattgaaaggcacaaaaacaaaaacgccggcacagggccggcgtttgtgtcgtgctcagttaataaagattaaccagcaactactttcacgttcagtttcgcgaatacttcgctgtgaacctggaagcttacttcatgctcaccggtagtgcgcagaacgccgttcggcagacgaaacttcgctcttagccacttcaacgccagctgcagtcactgcatcagcgatgtcgcgggcaccgattgaaccgaacagtttaccttcatcgcccgctttagacgtgatggttacagtgcccagttcattgattttctcagcgcgtgcagttgctgcagactgaacgtcagccagtttggcttccagttcagcacggcgtgcttcgaagaactcaacgtttttcttggtagcaggaacagctttgccctgtggtaccaggaagttacgagcgtagcccgctttaacgttaacctgatcacccagggtgccaaggtttgctactttatcaagcagaataacttgcattaccttatcctcttaaagtcgttaatggacagttgccgattactgatgacgatcagtgtacggcagcagagacaggtaacgcgcacgcttgatgcagcgagccaactgacgctggtattttgcacgagtaccggtgatacggctcgggacaattttaccgctttcggtaatgtagtttttcaacgttgcgatgtctttgtaatcgatctcaacaacgccttccgcggtgaaacggcagaacttgcgacgacggaaataacgtgccattaggctagtctccagaatctatcaattcaatctgctcggcatggaacaccactttgctctggccatttcgtgcctgatggcaactaatgaaaccgtcgagtgtgagttgcgtgccgaccgttatatgttgagtaatcacctgatgggcgctgccgctgataataaccggcatacgacaccaggcttgccggtgaaacccggcctcctcctgcactgagcggtgctcaagcacgaactgacagtgaggaattcctgacgggctaactcttcgaaccggcgtcttgcacacagtgccagacaggcgaagtcgattaaccgtcacgatggattactcttcagaatccccagcatctgactcatcagcggattcgttagcaaaatcttcgcgacgatcacgacgctcatctttcgctttaaccatcggcgatgcttcagttaccgcgtttttaacgcgcataaccatgctacggataacggcgtcgttgaagcggaagttcgtttccagctcatcgatcgcttcctgcggcgcttcaacgttcatcagaacgtaatgcgctttgtgcagtttattgatcgggtaagccagctgacggcggccccagtcttccagacggtgaatcgtgccttctgcaccagtgatagcaccagtgtaacgctcgatcatgccaggaaacctgttcgctctggtcaggatgaaccataaatacgatttcgtaatgacgcatcgaaattgctccttacggattattcagcctcctgtcggggtcaaccgcggcccatggaagcaaggaacgttataggctgtgtcccacaaaggttcgttatgacgagcgtttgtgggacacagcctgagaatgcggctgaaaaattgacgcgtaatcatactggcggcgacggctaaactcaagcgcacatttcaacaaatgccatccggcgtgccatatacggtagcttttcgtgctaatcatgtgaatacagcgcgttaagcgggaaaggttcaaaaaagctgataaagagcttcaggcggacgatctggcgataatgtgcacagtcgctaaacttaatacagacgctacggtttggcttatcggcgtctaacagagtgtgttccctgaagtgaggagtcgggcatgaaaacgttcgtcatcgccactttactgggtctcttcctgtctccacccgctcttgccagcaatgctgactgtgcgcagcagataagaagtcacagcagcgaagcggcatcgggttatatctacattaatcggctggatgcgccacaaaagaacccggtcaacgcgcctgccagagcagcagaaaaatcgtctgcgcactggtaagtgctggtaaatttacgggcggcagatccactctccgcccgctcatttttatagctgctgtttaaaaaagctgaccagcgccgtcaatgctgatggcgtgatcttatgtccaatctgtttttcagacagcgaagtcagatgcttcgccagcccgttgtcacgcagcgccctctccagccgtacgctctccgcccagggcaccacctcatccgcctcaccatgccacaacagcagcggacggtttgccagggcctccagccggttgcagggatcgtagtccgccagcggtgccatgcgggcagcaaactgcgcttgctgctcaggcgtgtcggctaccagcggcggaaacagcgactgactgagctgcataaaatagcccgatcccatcaggcaggcgacgctctgaatctgcggataacgcgccatcgcgcccagcgccgtcatgccgcccatcgacgcgcccgccaccgcaaggcgctcgccggcgatcagatcgtcagcgcgcagcgccgattccagctgcggcagctcatcaatgttctgtttcagaatctcccagaagcgaccaaggcgtgcatcggcatcaccgtgatagcgcgcgccgtgcagtttctgcatccggcatcaccgcccggaaccccgcctgtgccagcgcgacagcgaagtaggcgtagacctcttttgaagaggtaaagccgtgataaaacagcacggtgggcagtggctgatgccgttgtccggcaggcgtggcgtgcaggcattcgataccggccagcgtttctgtggtgagttcaatcatggtctctcctgagaaggggcaaggcgtgccgattgagtgtacgtctgcgggttaatttacgaaatcccctgctgcgtttagtcgccagatttcggcctaaacttttcccgcgctttgccgttgatgttgtgtccccctaacttgatcaaaggtaatttatgaagcgtctctctctcagcggcctgagtcttggagttaagctgtctgtactgacgtctctcagcgtagcgttattgttgctggttctgacgctaacccagagccacaccgcttcgcggcagctggaaaatctcgccatcgatgacatgcaaaaccaggtgcagggcatcagtgaaatggccaccatgttcaacgccactctcaccgaagaggtggctcactacaccggtctgtttaccagtttcctgcctaagcgttttagcctggatgaaggctcacgggtgcaggtcggtgccttttcgacgccggtgctgcgcgccgggttaaaaacgctgaacctcgaccagaccgcggtagacgatttcaccgaacgcaccgccgccgtggcgaccatttttgtgcgcgacggcgatgattttatccgtatttccacctcgctgaaaaagcaggatggcagtcgcgcaatcggtacgcagcttgaccgcaacggcgccgcctggaaaagcgtcagtcagggcgacgtctatcaggggctggcgacgctgttcggccatcgctacatcacacaatatcagccggtaaaagatgagagtggcaaggttgtcgccatcctgtttgtcggcgttggcattgataagcagtatgcgctgatgcgtgaaaaaatcctggcacgcaagctgggtgatagtggtcatttctttgtgctcaacggcacccccggtaagacgcagggagagtatctgttcgatcagcacaacgaaggaaaacgacccgcctgggatgacgcgacactccagccgctgctgactcagccgctgggcatgatgcaggcagagatcaacggcgagcaccagattctggcctggcagcagctgccgggctggaactgggtgatcgccggcgaagttaaccgtgaaagcctgctcgccccgattacgcatagccgcaacctgttcctgataaccggactgattctggtggtggtctttgcgctggggtttgtctggtacagccgtcgggcgattacccgtccgctgcagcaggtgatccatctggcggagcagtatgccgccgggaatctgcaggtccatatggatacccagcgtcgcgatgaagtgggccagttgatcgttgcgatcaacggcattggcgatggtctggagaaaatcgtcagccaggtgcgcggcgcggcgcaggagatcagcgacggcacggacaccatcgcggccagcagtcataacatcagcgagcagatcgggcgtcaggccagcagcgtggagcagacctctgccagcatggagcagtttggcgcgacggttgaacacaccgcagacagcctgcgtcaggcgatgtcactggtggccgaagccagcgatatcgtcagtcacggcagccagacggtggtgcgctcggtcaacaccatgtcggcgattaaggtttcatcacaaagcattgcggatatcacccacgtgattgagtcgatcgccttccagaccaatatcctggcgctgaatgccgccgttgaagcggcacgtgccggggaacagggccgtggctttgccgtggtggccgcagaagtgcgtgcgctggcacagcgttctgcgcaggccgctaaagagattgatggactgattgcgacctccatcagcaacgtggcggaaggccatcaattatctgagcagacgcgcgatgcgatgagcgacattgtgacccacatcgagcaggtgcaggcgctgatgggcgagatcaacgtggcggcgcagcagcaggcggcaggaatcggccaggttaatctggcgatgaaccagatcagccaggcgactcaccagaacagcgaactggtgacacaggcggaaaacagcgcgcagaaacctgagtgataaagggcatcacctgacccaactggtcagcgtattcagccttaaatcctgacgccattcagggcgatggcatacacttaatgcttcgtcctgaaagagggttttgctatgcgtttcgcttatttactgatgataagcctgctgctggcaggctgttccgcgcttgagaccacgccaaaagcaccgcccgcgccgacgcaacaggcgcaggagatttcacgggcgcagagtggcggtttgccaaagctgggcaatattaccgttaacgtgcgcggctcaccggatgatgccgggcgggccgtcgccgcccgggctaaccaggccggtgcggcttactatcagatcgtggcgctgagtgaaacagtgatgcccggtctctggtacgccagcgcgattctttacggcgcatcacctgccacaggcgcgggccagtaaacggtctgtgattgctgtctcaagcgggcgggagccacgccgatcgagccactgctggcaccatgcatccgccagcggcggttcgccatatttcagtagctgagcgccggtcgcaagcagcagcagtgtgcgggtcacctcgcgcgcctgctcttcggggactttgctcattcgcagccgtaactgacgccagcgcgcatcgaaatgacgattactccctttcaccgcttcaaattcctggcccagcatctccgaaacctctgcctgacgggtgagcacgcgcagtacgtcaagacacatcacgttgcccgacccttcccagatgctgttgaccggtatgtcacgatagaggcgcggcagctcgctcgcttcgcagtagccgatgccccccagcacttccatcgactccgcgacgaacggggctcccgctttgcagatctgatattttgcagccggagtgaataagcgggcaaacgtgacctcatgcggttttgccggttgtgaccaggcgcgcgccagccgcatcagcagtgcggtttgcccctccagctgcagcgcctgctgtgccagaacctgacgcatcagcggctgatccaccaggtttttccccatcacctggcgctgatgtgcatgccagagtgccaccgagaatgcacgccgcatctgaccatgactgccgagtgcgcagtcgaagcgcgtcataccgcccattttaaggatcagccgcacgccttcgccctcttctcccagcagccagccggtcgcatcgcgaaactccacctcacaactagcatttgagcgattacccagcttatctttaagctgctcaagctggatggcgttgcgtgacccgtcaggcaacaggcgcggcaggaagaaacagcttaatccggcgggcgtctgcgccagcaccagatgcgcatcgctctgcggcaccgagaagaaccatttgtggccggtcagccggtaggcttcacccgggccgcgcgcgcccagcggctcggcccgggtggtgctggtgagcagatcgctgccgccctgtttttccgtcatgcccataccgatcagcagaccccgtttctggtcgccgggctgcgcatgggtatcgtaacgatcgctgagcagcggatcgagccagccttcgaacgcggcaggcagataagtctgcagcagtggaatggccgcgtgcgtcatggtcacggggcaaagcgtgcccgcttcaacctgcgcatgcagaataaagcgcgcagcgcgcgccacgctggcctgttcacgtactgtgggatgccagctgagattatgcaggcggctggcgcagacaccctgcatcagcaggtgccaggcggggtgaaaacggacttcatccatccgtacgccacgggcgtcgtagcgcagcagttcaggtggctccgcgttggcgagccggcccagttccagcgactcggcgctgcccagctgtcggcctaccgaagccagccactcccgatcccatccggcgccttcgcgtgacagtgcctcgccgagcggcgtatcagacaggaacaggttgctgttgctcagaggatggggctgattaaaaacggtgtgtgttgtccaggtcataaccactcctcgcggatgtcactcagtaagtatacccgtcgtctttcaagctgcatttttgttggctgcgttcactcacccgaatcacttactcatgtaagctcatcgggattcgttctcttgccgcctcaatgcaacccgaaatcctttgggtatatacgaatgacgcgcagttatgcctggtacagaaactaatttgtggcgaggatcacatcggggatcaggcgttgcgctgacgcaccgcttcaaacaggcagacacccgtagcaaccgagacattcagcgaagagacgctgcccgccatcggaatgctgatcagctcatcgcaatgctcacgggtcagacgacgcatgccttccccttccgcgcccatcaccagcgccatcggaccggtcattttgctctggaagacggtatggtcagcttcacctgcggtaccgacaacccagatgttgtactcctgcagcagacgcagggtacgtgccaggttggtgacgcggatcaacggcacattttctgccgcgccgctggccacttttttggccgttgcattcaggggagcagagcgatctttcggcacgataatcgcgtgaacaccggccgcatcggcactgcgcaggcaggcacccagattgtgcggatcggtgaccccgtccagcaccagcaggaagggtttctccaggctctgcagcagatccggcaggtcgccttcctgatactgacgacccggttttacccgcgccacaataccctgatgcacaccgccttcaacctggctgtcgagccacttgcgctcggccagctgaatcacgaccccctgagcttccagcgcggcgaccacgggttgcaggcgacgatcgtcgcggcctttgaggataaagacttcctggaatcgttgtggatcacgttccagcagcgcctgcacggcatggataccaaaaataatttcgctcatcgatctgctcagtgtttggaaatgaatgaatgaccgccctttctcagtgagaaagggcgggtgcgcgcatcagtcaggctgcgccttttttctggcgcgcttcgcccgggtggcggcggcgattttacgggttttttccgagacgtttttacttttattctcggtatttgcagcggcgggcttgcccttgtcgccccggaaagcggcgtccggctcgaagttggacttcttgctcgcatcacgacggcgtttcgctggcgctttgtcgtcacgcttcgcccggtcgcgtgcggttttgccttcaccacgtacctgacgctggctggagatcagggcaaagtcgattttacgctcatccatatggacggcttcaacacgcacttcaaccgtgtcacccagacgataggtgcgaccgcccgattcaccgatcagacgctgacctaccgggtcaaaacggtagtaatcgttgtcgagcgtcgaaacgtggaccagaccatcaatgaacagatcgcttaagcgtacaaagaagccaaatccggtcacgctggagatgacgccgttgaagacgttgccaacctggtcctgcatgaagtcacacttgagccagtccgcgacatcacgggtcgcttcatcggcgcggcgttcggtcagggaacagtgcaggcccagttgcagcatctgcggcatctcgtagtgatagccgccggttgctgtcgtcatatctttggctacgctgcgatctctcggcatcaggtatttaatggcgcgctgtaccaggcctttaccttcatcctgctcttttgccagcagatatttgatggcgcgatgcagcgtcagatccggataacgacggattggcgaggtaaagtgcgcatacgacgagagtgccagaccaaagtgaccgcggttttccggatcgtaaacggcctgcttcatcgaaacgcagcagcatggtttgcagcatttccgcatcaggacgatcggcaacctgcttcagcagcgccgcatagtcgattggctgcggtttattgccgccaggcagactcagtcccagctcgttgagcacggtacggaagctcttgatgctttcgtcggtcgggcgatcgtgatcgcggaacagcgccggttcctgatttttctcaacgaagcgtgccgaggcgatgttcgccaggatcatgcactcttcgatcaacttatgggcgtcattacgtgacacgcgctcaacacgctcaatacggcgctcggcgttgaagataaacttcgcctcttccgtttcaaacgagataccgccgcgctcttcacgagcggcttccagcgcatgatagaggttgttcagctcttccaggtctttaaccagtggcgcatactgctggcgcagctctttgtcgccctgcagaatgttccagactttgttgtaggtcagacgcgcatgggagttcatcaccgcttcgtagtgcttgaagccggtcagtttacctttggtcgagatggtcatctcgcacaccatacagaggcgatcgacctgcgggttaagcgaacataagccattcgacagcacttccggcagcatcggcacaacctgcgacgggaagtagaccgaggttccgcgctgatgcgcttcgtcatccagtggggtgcccggacggacgtaatagctgacatccgcgatagctacccacagacgccatccgccaccgcgcttcttctcacagtaaacagcatcatcaaagtcacgggcatcttcaccatcgatggtgaccagcggcagcttacgcagatcgacgcggccttttttggcctcttccgggacttcttctttcagtttgctgacctgagcttccacttccggcggccaggtgtgcgggatttcatgcgtacgcagcgccatatccacggccaggctggtacccatatcatcgcccagaatctcggcgattttaccgatcgctttgctgcgacggttcggacgctggaccagctcaaccaccaccacggaacccatgcgggcattcatcgtctcttcaggggggatgaggatgtcaaaactcaggcgactgtcgtccggtaccacgaagccggcaccggcatcggtaaagtaacggccaacgatctgattgttgcggggttcctgcacccggaccacgcgcgcttcgcggcggcctttgcgatcggcacccagcggctgcgccaggatcacgtcaccgtgcatacagaatttcatctgttctgcggaaaggtagaggtcatctttctgaccttctgcccgcaggaagccgtagccatcacggtggccaatgactttaccgcgcaggagatcaagacgttctggcagggcataacactgacggcgggtgaacaccagctgaccatcacgctccatggcgcgaaggcggcgacgcagcgcctcaaggtgttcttcttcctgcagattcatctcttcagccagctcttcgcggctggccggtttttcacgtttttctaacagagccagaataaattcacggctcggaatagggttttcgtatttttcagcttctctatcctgaaaaggatcttttgacatagcggttcctccgatgtcatttaatatttatttccaccggcgatctggacaagatgatctcataaagtggtgtatttccttcgaccagatctgccaacgtatagctatccagctcctgcaaaaatcgctgcaccgcatcatgtaacgcctgcttcagacgacaggctggcgtgatggaacaggacgcacaatccactaattgtagtggttccatcttacgtaccacatcgccaatgacaatctgacgagctggcatacccagacgaatgcccccgtttttaccacgcgttgcggcgacatagcccgcccggctcagctgattgataattttgaccatatgattacgggacaaaccataagtgttcgtcacttccgtaatattggtctgctgaccttccggcaacgatgccagataaatcagtgcccgtaagccataatcagtaaaactcgtgagctgcacagtaacctcagtgaaccttcaggcgcggcatgaccttattcgccctgtgattgatgccaggattaaatcggatcgccattcgattagctacgatgataaaccagagtctgtctggccgtgcgcttttttaagccagcagaaggtttgacaagcgaagggaggttaagtggcatcaaagaatggaaaaacaagggccggacagcgtccggcctgaatgattacgcgtcgaaacgggtcgcgcagaatcattgtttcactacgatcagggccggttgagatgatatcaatcggcacacccgttacctcttccacacgcttgatgtagtcacgcgcggcctgaggcaaaccttccagcgtcttgacgccaaacgttgtctcgctccagcctggcagggtttcgtagatcggctcaatgccttcccagttctctgccgccagtggcgtggtggtcacttcgcggccatcaggcatacgataagccacacagatcttcacctctttcaggccatccagcacgtccagcttggtcatgcagaaacctgacagggagttgatctggaccgcgcggcgaaccgctaccgcatccagccagccggtacgacgacgacgaccggtggtcgcaccaaactcattaccctgcgcacagaggaattcgccggtttcatcgaacagctcggtcgggaacgggcctgcgccaacgcgggttgagtaagctttcacaatacccagcacgtagtcgacatagcgcgggccaatgcctgaaccggtcgctacgccacctgcggtggtgttggatgaggtcacgtacggataggtaccgtgatcgatatccagcagcgtaccctgcgcaccttcaaacataatcagatcgccacgcttacgcgcgacgtccagcagttcagagacgtcaacgaccatgccagtgatgatgtcagcgacttccatcacatcactcagcactttatcgaagtcaactgccggctctttgtagtactccaccagctggaagttgtagaaatcgaccacttctttcagcttggcagcaaaggtttctttgttaaacaggtcgctgacgcgcagggcacggcgagcgactttatcttcgtaagccggtccgatgccacgccccgtggtaccaatcgctttggcgccacgagcacgttcacgcgccatatccatcgcaacatgatattgcaggatcagcggacaggcttcagaaatcagcagacgttcacgtaccggaatcccgcgcgcttccaggcctttcatctctttcattaaggcttcaggagagagcactacgccgttaccaatgatgctggtgacgttatcgcgcagaatgccagaagggatcaggtggaggacggttttttcaccgttgatgacaagcgtgtggcccgcattgtggccgccttgataacgcacaacgtaattcgcgcgctcagtcagaaggtctacaatcttacctttaccttcgtcaccccattgggtgcccagtacgacgacgttcttacccatttctcaaaatcaccgattgcttaaaaaaggattctaccatctgatcccgtggttttcagcacttttagcatacgattgcgcgcttttttgcctgagttttgatcactacaacatgttggggataatagcgttgaaaggcacaatttagccggtctgaacgtcagcctcagaggttgccgtgcaggctgagcatgcagtaaatcaccatgccagcaacgaccagtcctccaccaaagcggtgtagcagacgatcgggcaaccgcgtcatcgtcaggatcatgcgtcgccaggcgcgcggcataaacatcggtcccaacccttccagcactaacaccagcgccagcgccatccagatgcttgttttcattctgatacccaaaaaaaagggccgacaacattgtcggcccacaggttatatcagttcttagcgtgtcgcgttagagggcgccttcatatatcggaagaagtcgctatccgggcttaacaccatcacatcctgatcgctattgaagctgttttcataggcacgcaggctacgaataaaggcatagaagtcaggatctttgctgaacgaatcggcaaacaaccgcgccgtttccgcatcaccgtcaccgcgtgtaatcagcgcttcacgctgggcttcagccagagtacgggtgacctggtaatcggcctgggcgcgcagtttttccgcctcttcctgaccctgtgaacgctggctacgcgctaccgcttcacgctcagcacgcatacggttgaagatcgcatcagacacttcagtcggcaggttgatctgcttgatgcgaacatccaccacctgaatacctaacgccgccatactgttcgggtttggtgctggctcgctgctgttggtttcacgctcgacacgggccgctgcactggcaatcgcatcatcagccgcaggggttgcgatttcatcatcgttgcctgcagagccggtattcagcgcgtcacgcacatcggtagtcagacgaccacgagagtccgttacgatatctttcacatccagacgacccatctcagaacgcaagcggtcactgaacttacgtttcagcagcacttccgcctgagagacatcaccgccaccggtggccaggtagtagcgactgaagtcgctgatacgccacttgatgtaggagtccacgatcagatctttcttctctttggtgacgaagcgatcggcctggttatccatggtctggatacgcgcatccagcgttttaaccgtttccaggaatggaatcttgaaatgcagacccggctcaaacacctgcggcttgttttcgccgtcgcgcaggactttaccgaagcgcagaacaatgcctcgctgcccttcctgcaccacaaacagggacgcatagagcgccaccagcacgacaatgattaaaaatactattggcttacgcatcgattactctctcccttcgcgctggctgtcgctgcgctgagcatttgcccgacgctgatccatgatgttgtccggactgtatgacgacgtgtcattgcggctggcactgctatcggagcgcgcaggcagcgaagaaccattcgcgcctttctgaccattctggcccgatgaagtctgtccgccacgcatcagttgatccagcggcagcaccatcaggttattactccgatcgttaaccagtactttgcgggtatggctcagcacacgttccatggtctcgatatagagacgctctttggtgatttccggtgcagctttatactcaggcaggatcttggcgaaacgcgccacctcaccctgcgcttccagaacggtacgctctttgtaagcgcgtgcctcttccagaatacgttgcgcctggccgttagcacgaggctgaacttcgttggcgtaagcttcggcttcgcgaacgtactgctcgcggttttcgcgtgcggcaatcgcgtcatcaaatgcagacttcacctcttccggcggacgtgcagcctggaagttgacgtccagcaccgcgatccccatgttataagggcgaatcgtctcgtcgatttcacgctgggtatcgctacgcaccacggtacgaccttcggtcaggatgcggtccatggtagagcgaccaatcacgccgcgcagtgcgctgtcagtagcctgacgcaggctgtcgtccgcgctggtcacagcataaagataacgttccggatcggtcacgcggtactgcacgttcatctccacgcgtaccacgttctcatccgaagtcagcatgacgccagaagcagccagttcgcgcaccgattcaacgttaaccgcacgcacctgatcaacgaatgtcggcttccagttcaggccgggttcgaccagatgactgaatttaccgaagcgcgtcaccacgccacgttccgcttctttgatggtgtagaaaccgcttgcagcccagatgactacagcagcaacagccacgataccaacaattttgccaccgctgccggagccgcgctgaccgttgtcgttctgtttgccaccgcccagtccaccaagcttcttgctcagcttacggaagatatcatccagatcaggaggcccggattcccgtcctcccttattccccccagagttgccgccttgattattgctgcttccccacgggtcgcggtcctgtccgttatttccgggctgattccacgccatgtttctactccatttattgtaattacgatttttacccttcagctttcggattgcagcggtgttggctgccttcgctcaccccggtcacttacctgcgtaagctcccggggattcactcagttgccgccttgcttaaatccaaaatactcgggtaacgccagcgtattcgggtctgcaaagaaagtgcgacaatcttcaatttttaaggtaaatgcgtttgggcaatatcaaacaatgtaactggtcagcgacggttcctgcttacataaacgcatccactcaataatgggcatacgaatctgcaatcctacactgccgtcttcttcattccactctttctcaatcgcctgcagctgatagaaacggctgcgaagtcgccccgcttccggtggcagacgtaatgcgtgctgggctatttcacccgccagacgctcagacagcgcctgccatagcaacggaatgcctgcgcctgtctgggcggaaagccagacgcggattggcaggttctcttcgttacgatcaatacgcggttcgaatccgtcgagcatatcgattttattcatcaccagtaacgtcgggatttcgtccgcttcaatctcttccagtacggcatcgacagcagcgatattttccgtgacgcgaaggtcagccccatcaatcacgtgcattaacagcgtcgcctgacgtgtctcctgcagcgtggctttaaaagcggcaaccaggtcgtgaggaagatggcgaataaagcctaccgtatccgccagtaccacgtccccgacatcagcaacattcagacgacgcagtgtggggtcgagcgtcgcaaacagctggtctgcggcaaagacgttggcggaggtcatggcgttaaagagggtcgacttgccggcgttggtgtaacccaccagcgaaaccgttggcacatccgctttggcgcgtgactgacgtccctgctcacgctgtttttcaactcgctcaagacgagacaaaatctgactgatacggccgcgcaacagccggcggtccgtttctaactgcgtttcacccgggccacgtaaaccaatcccgcctttctggcgttcaaggtgggtccagccgcgcaccagacgtgtcgcaagatggcgcagctgtgccagctcaacctgcaatttaccttcgtgggtacgtgcgcgttgggcaaagatatccagaattaaaccggtgcgatcaatgacccggcattcgcacaggcgctcgaggtttctttcctgagcgggcgtaagggcatgatcgaataatacgaccgatgctcctgttgtttttaccgcatcggcaatttcaacggcctttccttcaccgacaaaatacttggggtgtggcgctttgcggctgccagtaaccacttgcagcgcctcaacgccagcagaagagaccagggtttcaaactcctgcaaatcttctacttctttgtcttgggagaaccagatgtgtaccagtacggcctgctcaccggcttcataacggtcaaacaagctataacctcgctaaataaaagaccaggacggaaaaccgctgttctccgttcctggctgtacggtgacgcgttattctgcgttatcaccgtcttgttgtggctgtggctgcgcagttgtgttgctgccgccatgatggtaattgttgctgccgccaccggtattattgctatggtgagaaaccgggcgtgaaggaacaacggtagaaatggcgtgcttatacaccatctgactcaccgtgtttttcaacaaaatgacgaactgatcaaatgactcaatctgaccctgcaacttaataccgttaaccagataaatcgaaaccggaacacgttcacgacgcagtgcgttcaaaaacgggtcttgtaatgattgccccttagccattctatcttttccttatatgcttgttgtttgttgcaagtagaacctatggttctgaaaaaaactgcgtaaaaatttgcgcacgataacccatcaattgtacacaatcacccatgcttcgcactaagaacctgtaacactgtatcacgcgccagccggggctcgtcactgtcaagccagtgaacattttcccaaccgcgtaaccaggtcatctgtcgcttagcaagctgccgggttgcgcaaattccccgataaaccatctcgctgtaatcgatttcgcccgataaataagaccacatctgacgatagccaacacaacgaatggaaggcatgtccgtatgcaaatcacctcgtgcaaaaagggcccgagactccgcttcaaatcctgacgccaacatctgctcaaaacgcaacgcgatgcgctggtgcagcaattcacggctcgcgggggcgatggcaaactgttgcacgtcgtagggtaacgcttcaccggatgtttttgtcagttccgttaaagttttacccgaaataaaaaaaacttccagtgctcgcgaaagtctctgcggatcattcggatgaatacgactgccggcaaccgggtcgatttcacacagctggcggtgtaaagcttcccagcctttttcacgcgccgtttgctctatccgctgacgaaacgtcgggatcggccgagggcaacggcgacaatccttcaagtaacgccttgaagtagagcatggttccaccaacaagcaacggtattcgtccggcttcaacgatatccgccatttctgctaaagcatcccgccggaactccgctgccgaataggcttcagcgggatcgcgaatgtcgagcagacgatggggtgccactgctaactcctcagccgacggtttcgccgtaccaatatccatctgacgatagattaaggcagagtctacgctgattagttccactggtaaccgcttacgcaattcaattgctaaagcggtcttgccagaagccgtgggtcccatcaaaaaaatagcctttggccggccagcctggtttaattcactcatgcttcaacgcgttgatcgcgctctcaatctctatgggctgtaataagcctgaaggcggcgatttcagtagctgtgggcaaagccgttcaagctctgccagcaggttgatcgcctgtgagtgattccagtcggaggactctgtatcctgacgccgcgccagccactgggccagttgcgtcgcagagatctcctgctgccgggcgagatagcctaacagctcaggaatcaagatttgtaaattttgtgttcgtaacggtaaaggcaccgcgcgtaaggtcacgtggtcaccttcgggctgaagatcaatacccatctgattgagcaggctgctcttttcttttgcggcctgccgttcatcgagggcgattttgagccgcaccggaatcagcagaggttgcggtttaagtccctcttcacccggttcaagctgcgcctgtttcagccagcgcgccgcgaccggcagcgctatcagcattaacttctgatcctgctccagcagcgcatagtggttttgcaacacggtcagtacccggccaaagctctgggcatgcgcggccagcggcgagggtttttcggctggacgcggtgccggttcacgggtttttggcggcggcgtggcgctgacaggcgttttcagcaactgctgataaaccgcgccttcacgctgacgatacacgttctctttgttttgccaggccggcgccgctgcgggcggtgtttgccgcgtggaggctgaagattgattctcgctggcgggcgctgaaggctgcgcaaaatgattaccccccgccgcctgacggttttccggctgccagcgcggtgcggcttcttctgcctgcagcgcaggcaaaatgggtgacgctatcgcctgtaacgcgctgaccacgccctgataaataaaatcatgcaccaggcgtgactgatgaaaacgcacttcatgcttggccgggtgaacgttgacatccacctgatgcggatcgatctccagatagagcacgtaagcgggctgctggtcatcctggagctgggtctggaaagcctggcgaatagcgtgattaatcagcttgtcgcgcatcatccggccattgacgtagcaatattgtaactcggtgacctggcgcgaaccggcgggatcggcgacccagccgcgcagcgagagatcatcatgctgccagtcaattcgcagcgcatgctgaataaacgtggtgccgcagatagctgccagtcgccgtttcgcgctggctctcctcgctgaccgcccgatactgacgcatcattttgccgttgtggctcagtgaaagcgcgacatcaaaacgcgccagtgcaatacgacggatcacttcgtcgatatgaccgaactcggttttctctgtgcgcataaatttgcggcgcgccggggtgttataaaacagatccagcacttcgagcgtggtcccacacggatgcgcagccggtttaaccgttaccgtcatatcacgcccttccgcataggcctgccaggcttcggtttgatcggcggtacgtgaggttaaggtcaggcgggagacagaactgatactggcgagcgcttcaccgcgaaaacccaggctcatgatcgcttccaggtcatccagtgaggcgattttactggtggcgtgtcgggccagcgccatcgacagctcgcttttcacgatgccgcagccgttgtcacgaatgcggataagctttgcgccccccttttcaatatcaacgtcaatgcgcgttgcaccagcatccaggctgttctccaccagctcttttacaaccgatgcaggacgttcaaccacttcacccgccgcaatctggtttgccagttggggcggtaaaatttgtatcggcatggttttccttttagctggtcgcccggcgcagcggccgggcaaacaatcaggatgcagggattttcaggttctgccccaacatgacgttggtcgatttcagattattggtctgcattatcgctttcgggctgacgccataatgtgcggcaatgccggtcagtgaatcccccacaaccactttatgacgcacaatgccgcgtggcgtggcgcgcgtggtgcggctggcggccgcactggccggcactttcaaccgctgtccgacccataccacatcccgcttcagggtgttcatctcacgcagggtcgccatgctgacgccatacttcgcggcaatcccggagagtgtctcaccgcgcgttaccgtatggcgctgagttacgccggtatattgcgtcaccccggtcgccgggttgctggcgacgttaaccgctggcgacgagcccagcggccggttttcctcctttgggatggattgcagcgggtgcgccaggaaataagtgcgcagacctttatagatcgactgcgcaatcttatcctggtgtgcgctactgccaagcagtcgctcctccgaggaattactgataaagccggtttccaccagcaaagaaggaatatcgggtgaacgcagcacgccaagactggcatgctcaggcagacgtttatgcagcgacgtcacgctgcgcatctgctgcaacactttctgggcgatgtcataaccgacacgctgcgagtgaccgaattgcaggtcaagtaccgcctggctgaggtaggggtcggcctgactgttagccagcaggtcacctgcgccgcccagcagctcagactgtttctctttctgctccagccagttagccatctcgttattggcccggcggtttgataatacccagaccgatgcaccggtcgccgcatggctcggcgcagcgtcagcatgaattgaaaccagcacgttggcgttggctttacgcgccacgtcggagcggcccataaccgagataaaatagtcgccatcacgcgtcaggacgcctttaaacatcggatcgttattcagcaacacccgcagtttacgtgcaatcgcgattgtgacgttcttctctttcagtccgcgctgcccgatagcgccgggatcctgaccgccatgtccggcatcaatcgccacaatcacggtatcgtttctggctgacggcccggccaggactcacggtgctggctgtgctggtcacggacgtcaccggattcgaattaaaggggttagccgctgcggcactctgggtgggcacgcgtgtcggggccgttaccggcgcaggcacactgcgcgtaacagcaggtggcttaccggtaatggtgaagacgacgctgtagctgttgccattgcgctgggtgaccgcccgggttttacccgcctgcgtcagctcaaacaccagccgcacgctctgtttatctttcggggtgctggtgcgaattcgctttacgatgttttcgccgctgaaatttaacggcagcccctgaaccacgccgctctggcgcacatcaagcaccacacggtcaggattgcgcagcgggaagaagccatagacaggttgtccggcaaagttcagggtgatggttgcctggctgtcgccattagcgactttgatatccgacagggtggcggcaaacaggggtgtacagaccagcagcaacagtgtcaccagcgctattttcatccgtgacatcatgcctgatccctgccctgaccaaattgttcaagccattgctggcccgacgaggattgtgccgtcagttccgcttcacgcgcctcacccacgtaacgcagcgttagcgtgagatcgggcggcggcagaaaaccggcgccctgctgcggccattcaaccaggcagatagcatcgccgctgaaatagtcgcggatgcccatgaattcaagctcttcaggatcggcaagacgatagaggtcgaagtgataaagtgtgcggtcgtccagcgtgtaaggctcaaccagagtgtaagtagggcttttgacgttgccctgatggcccagcgcctgcagaaagccgcggctgaaggtggttttacccgcccccagatcgccatagagataaatcactgccgcgctgccacaggcgcgcgccagctgagcgcccaaactgagcgtagccgcctcatcgggcaaagagataacacaggtcttcatgcttctttattcatctcaggattaacaaactgccacagcagatccagtaaatcagttgccagcataccgcgcgtaccacgttccgcagcgaccgcatcggccgcggcaccgtgtgcaacgcagccggcgcaggccgcatcaaacagcgtcagtttctggcccaccagcgaggcgatgattccactcaggagatcgcccataccgccggaggccataccggcattgcccacgtcagcaaaggccatttcaccctgctcgctggcaatcagcgtaccggcacctttcagtaccactacgccgccataacgctgcgccaatgtctgcgctgcatgtaagcggtcactctcaatttcactggtctcggtattcagcaaacgcgccgcttcaccaggatgcggcgtaataatgcgattctgacgtttctccgcactgattgccagcaggttaagtgcatccgcgtcccaaagcatcggcttttcactgctcgctacccgcttcagcgcccgctttccccagtcgcgctgacccagaccgggccctatcgcaatgacatcggcccactccagcgcctccgtcaggcgctcatcggtcagttcatcgaccataatttcgggccgggcggtcaggatcggaataatattatctttgtgagtaagtactcgcaccaacccactaccgctgcgcaacgccgcttcggccgtcatccgtaccgcgccagcggtaccggcatcgccccccactaccagcagccggccatgactgcccttgtgcgaggttggtttgcgcggcttgagccagcgggttaatgcgctggcatcataacgcgcgatgggagccccttcgcccgccagaaaagcggccaggccgagatcggcatagtaaagctctccaatgtaatctcgcgctttgccagtgatctggcccggtttaagagcaaccacactcagcgtatggctggcattaattacctcaccgggcgcggtgccattgcgggctgataagccggaaggcatatcaatggcaagtttcggcgccgcatgagcgtttcgcctgctggatcagcgtggcatagggttcttcgggcgcacgatgactgccggttcccagcagcgcatccacaatcacatcgatctgctctggccagaccgcatcggccgcatgaatttcaccgcccgcatccagccacgcgtcccgtgcacgctgtgcctcttccggcaacgctttttcactttcgcacgccagcagcgtaacggttttgcccgccgcctgtcccagtcgcgccagcacataaccatcgccaccgttattgccgtgaccacacagaatcagccagtggctggcctctggccagtgcgcagtcagatgctcgtaagcggcctgtccggcacgcagcatcagctcatacagcgtaatgccgagcgcatcggccccctgttgctcaagctgggccacagcctgcgcaggccagacagaatatggtaaactgcggctgtttttcttcgaatcctggttactcatgtcataccctctcgatcttcatcaattcgcacaacagattaaacagtggggattggatctcggctttcagcaggtcggcatcaccgataccgatctcagtgcggaagagccgcgcctgcaggcgtggctggataagcagtatcatggcgagatggagtggatggcgcgacacggcatgatgcgggcgcgtcctcatgaactgctgcccggcacgctgcgcgttatcagcgttcgcatgaactaccttccggccaaagccgcctttgccagcacgttgaaaaatccccagctgggctatgtcagccgttatgcattaggtcgtgattaccacaaagtattgcgcaatcgactgaaaaagctcggagaaatgatccagcagcattgtggcgagcttaattttcgcccgtttgtggattcggccccgctgcttgagcggccgctggcagccaaagcgggactcggctggaccggcaaacattcgctgatactgaatcgggaagcaggctcatggtttttcctcggcgaaactgctgatcgatattccgctgccgatagatacaccgcagcaggagcagtgtggccgctgtgtcgcctgcatgaccatctgccctaccagcgcgatcgttgagccctacgtcgtggatgccaggcgctgtatttcctatctcaccattgagctggaaggcgcgatcccggaagagtttcgcccgctgatgggcaaccggatatatggctgtgatgactgccagctgatctgtccgtggaatcgctatggacaactcagtgacgaaagcgatttttcaccgcgagcggcgctacacgcccctgagctgatcgatctgtttcaatgggatgaagcgaagtttttacgcatcactgaaggctcagcgattcgccgcattggtcatttacgctggctgcgtaatattgcagtggcgctgggtaacgcgccctggtcgcccgaaatcgttcaggtactggaacaacgactcggtgaaagtgacctgctggatgaacatattctgtgggcaatcacgcagcagcagcagaaacgcgagcaactcgtggttgaagtgcaacctgcccagcagaagcgcctggttcgtgcagtagagaagggtttaccgcgtgatgcgtgattgaacagcttgatcgcgaattatcgttttccacatgctgtgaataaaaataaaaagctgttgtcattcaactgcaacaacgctgattttgctgttaaataacaaattgaaatattttcataatgataaatatcaacaacttatataaaagttgtgtttatttaataatgaggctatcgcttcggttaacctgcaaagttgtggataactctgttcaaaagccatttacagatcgccgtaacaggcgcagatgatggggtgcagtgctgtggataaccttcatgaaacaatcaaaatcacgcgacgtaaaacagtcggctaacggactgaaatgagggtgatgttaaatctggagcgggaaacgagactcgaactcgcgaccccgaccttggcaaggtcgtgctctaccaactgagctattcccgcatagaagggcactactaaaaaaactggagcgggaaacgagactcgaactcgcgaccccgaccttggcaaggtcgtgctctaccaactgagctattcccgcaaagagggtactgcttacattttaaaactggagcgggaaacgagactcgaactcgcgaccccgaccttggcaaggtcgtgctctaccaactgagctattcccgcgccttgtaccgttaataaattcttcaccggtacggggtgcgcattatacgagaaatcgttgctgctgcaagcgtctgaaagcaaaaattttcgctttcagcgcgtttgctgattaaatcagcaacctggtgatttcatgcgcacccgtcgccgattaaagctgcaaaaagtgttcgcggtagtacgccagctccgccacggactcacggatatcatccagagcctggtgcgtccccccttttttgaagccaggaaggatatcgggtttccagcgacgagccagctctttcagggtactgacatccagataacgatagtggaagtacgcttccagctcaggcatatacttaaacaggaaacgacgatcctgcccgatgctgttgccgcagataggcgaggtgttcgccggaacccactgtttcaggaaactcaatggtcgccagctctgcggcacgatcgtcaatctgactctccttcacccgcgcaaccagaccgctgttggtatgagtgcggacattccactcatccatcagcgccagttgcgcatcagactgatgaacggccatgaccggcccttccgccagaatgttcaggttggcgtcagtcaccagggtcgcaatttcaataatgcgatcgtgcgtcggatcaagtccggtcatctcaagatcaatccagatcagattctgttcatttccagtagccatgctgtttcctgcggttgctgtagtcgtcatttacgatgaataaggtgtatcatagacgttttgcccagccgggcgaaatctggctaacgctgtgagggtgagtgagtaaaaataaactgtcgaagggccaacaacgccgcgtaagcgctaaccacgatcgccgtctcaaccaacgcagagagcgtccggaagcggatgacaacctgtttggtgaagctgcagatggggtcgttgtcagccgttttggcatgcacgctgatgttgaggatagcgcaggcgtcgcccaccgctgcaatatccgccgtaccattcgttcgctggtcaccggcgaccgggtgctgtggcgtccggcaaccagcggcaacaaaggtattgttgaagcggtgcatgagcgcaccagcgtattaacccgccccgatttttacgacggcgtgaagccgatggcggcgaatatcgaccagatcatcgtcgtctccgcaatcctgcctgaactgtcgttaaacatcatcgaccgctatctggttgccagcgaaacgctggatattgaaccgttgctggtactgaacaaaaccgatctgctggatgacaaggcgcgcgcctttgtcgataagcagatggatatctatcgcaatattggctatcgcgtggtgatggtctccagccgggcgaaaaacggcatggacgacctgaaagcggcgctgaccgaccgcatcagtatctttgccggtcagtctggcgtcggcaaatcgagtctgctgaatgccctgctcggcttcgacaaagaagagcaggtcgctattctgactaacgaggtttcggatggctcaggcttaggccagcacaccaccaccgcatcgcgcctttatcacttcccggacggcggcgatgtgatcgattcacctggcgtgcgtgagttcggtttatggcatcttgagccggaacaaattacccgcggatttgtcgaattccgcacattccttggcgattgcaaattccgcgattgtaaacacggcagcgatcccggctgtgccattcgcgaagcggtcgaacagggcaaaatcaacaggtcccgttttgataactaccaccgtatcctggagagcatggcgcaggtaaaaacgcgtaaaaatttccctgatggtgaaagttaatcggtataaccgcgtctgaacgggtaagccagggcattttgcgaggtacattccagtcgcgcgtccagaccgtgcagcgtgccggaattcgggtatagtcgccatctgaacggggcgctgctacaatccgcccccttttttacaacgtcataaaatagccaggaggctaaggtgtttgatcgtttaaaactcggcttgaatcatattctcccgaagaaatggctgactgaacttgccggttggggcgccagtcgccgcggtggttggttgaccaaactggtcattgacatctttgtctggttttacaaagtcgacatggcggaagcgcgaaagcccgataccgccagctatcgcacctttaatgactttttcgttcgtccgctgaaagacgatgcgcgtccggtggatgccgatgccaatctcatcgccctgcccgcggatggcgctatcagccagctcggccacattgatggcgatcagattttccaggctaaaggtcatcactacaccattgacgccctgctggcgggtgatgagcggatggcggcacaatttgttgatggcgagttcgtcaccacctatctggcgccccgtgattatcaccgcgtccatatgccgtgcaacggcatcctgcgtgagatgatttatgtacctggcgacctctactcggtcaacccgctgaccgcgcgtaatattcccaacctgttcgcccgtaacgagcgcgtcatctgctacttcgaaaccgatatcgggccgatggtgcagatcctggtgggtgccaccattgtcggcagcatcgaaaccgtctgggctggcaccatcacgccaccgcgtgaaggcgtgatcaagcgctggcactatccggcagcggatgatgaaagcgccgtggtgctgctgaaaggccaggaaatgggccgcttcaagcttggctctaccgtcatcaatctgttcgcacctggccgcgtcaaactggctgaaagcctggaagcagaaagcaaaacccgtctgggtcaaccgctggcgattgcgctgccggtcgcgacagacatttccgacgtcatcgtcgattaaattgagtgtcctctgtgcgttcgattctcctcctgctgctgagcctgtggctcagcagcccggccttcgcggccagccttcctgatgccagccagctcaaacagcagctggaagagataaaatcggccaaaagttcaccctctcaggctgaacagatccagacgattgaagccgccttaaactttctctctgaacgcgatgaatcgctggagcgcgcggcgcaatatcagcaggttattgatgattttccgcgtctggcgcgcgaactgcgtcagcagatcgccgcgctgagtgacagcgggaaaaccgtgcgcaacaacatgagcagcgccgagctggatcaggagatcctgcaggtcagcagccagctgctggaagaggggcgtcaggcacggcaggagcaggatcgggcgcgggaaatcagtgattcgctgtcgcaactgccgcagcagcagacggaagcacgccgggcgatgacggagagtgaacgccgtttgcagagcgtcagcagcagttcgccacaggggcagctgcaactggcggctcgccaggcggaaagcgccgcgaataaagcgctggtcgatgaacttgagctggcacagctctctgccaacaaccgtcaggaaactggcgcggatgcgggctgaagcccaccagcgcaaagcaactcagctcgataactatcttcaggcgctgcgcaaccagctcaacgatcagcggcaacgtgaagccgaagtcgcgctggcccgcaccgagcaactggcagaaaacagtggcgatcttccgccagagatcagcgatcagtttcgggttaaccgcgaactctcggttgccctgaatcagcaggcgcagcgcatggatctggtggcgtcgcagcagcgactggccactaaccagattattcaggtccgtcaggcgctctctaccctgcgtgaacagtcgcagtggctgggtgcctctaatctgctgggcgaagcgctacgggcgcaggtcgcgcgtctgccggagatgcccaagtcgcagcagattgataatgagatggcacagcttcgcgtgcagcgtctcaattatgaagatctgctggagcgccaggaggcgctgcgcaagggacggcaggccgatggtcagcccttcaccgcagaccagaagcgtattcttgatgcgcagctacgcactcagagggaactgctcaattcgctgatctccggctgtgacacgctgattctggagatcactaagctcaaggttggcaacacgcagttgcaggatgcgctgacggaagtcaaagaggcgacgcatcgctatctgttctggaccgccgacgttaacccgattggtttgagttatccgctggatctggccaaagatctttcccgtctgctgtcgctggatacgctgggtcagctcggcaaagcgatggcgatgatgtttaccagccgcaactcggtgctgccgattattggtgcgttgctgctggtcggcttcagcatcagttcgcgccgccacttcaatgctttccttgaccgttccgccagcaaagtcggcaaggtcacgcaggatcgtttccgcctgactatccgtactctgttctggtctatcctggtggcgctgccgctgccggtgttatggggtgcgttgggttatggcctgcagaaacgcctggccctaccctatcgccgtagcgattggtgatggcattaccgccacgctgccgctgctgtgggcgtttatgatcagcgctgcctttgcccgtcctaacggcctgttcattgtgcatttccgctggccgcaaaaccgggtggcgcgcgccatgcgctactactcgctgagcatcggattaattgtgccgctgattatgttgctgatcgcctttggtaatctggaagatcggcagttctcctcgtcgctgggtcgtctctgtttcatcctgatctgcggggcaatcagcattgtcaccgtcagcctgaagcgttccgggattccgctctatctcgataaagagggaaatggcgagaacatggtgaaccggatgctgtggaacctgatgatcgccatgccgctgatggctgccctcgcctccgctgtgggttatctggctaccgcgcaggcgctgctggcgcgactggaaacctctgtcgccatctggttcctgctgctggttatctatcacattatccggcgctggatgctgattcagcgtcgccgtcttggctttgatcgcgcccgtcagcgtcgtgccgatatgctggctaaccgtgcgcgcagtgaagaagagaaggagcaaggctctctgaacactgatgcgattgaaattgaagagccggtaattgacctggatgcgatcagtgcgcagtcgctgcggctggttcgctctatcctgatgcttatcgccctggtctccgtgattgtgctgtggtcagaaatccattcggcctttggcttcctggagaatattcagctgtgggacgtcagtacctcagtgcagggcgtagagtcgattcagcccatcaccctggggtcagtgctgatcgccattctggtgtttattatcaccacccagctggtgcgcaatatgcccgcgctgcttgagctggcgctgttgcagcatcttaatctgacgccaggtacgggttacgccatcaccacactgaccaaatatctgctgctgttgattggcgcgctgattggtttctcaatgattggtattgagtggtcgaagctgcagtggctggttgccgcgctgggtgtgggactggggtttggtttgcaggagatttttgccaactttatctcaggtctgattatcctgttcgaaaagccgattcgtatcggcgataccgtgactatccgcgacctgaccggcagtatcacgcgaattaatacccgcgcgaccaccattaccgactgggaccgcaaagagatcatcgtgccgaacaaggcctttatcaccgagcagtttattaactggtcgctgtccgattccgtgacgcgcgtggtgctcaccattccggctccggcgaaagtcagcagtgaacaggtgaccaccattctgatccaggcggctgagcgctgcagctatgtcctggacacgccgcaaccggaagccttcctggtcgatctgcagcaggggattcagttatttgaacttcgtgtgcatgctgctgagatgggacaccgtatgccgctgcgtcacgaactgcatcagttgattctgagcggatttgatcagcacggtattgagatgccgttcccgccgttccagatgcgtatggaaaccctgggtaagaagctgcctgccagcaacggcacacccgctgcccgcgcctataagtctggcggactgtaatgcaaaacgcccggctgagccgggcgttattgcaagtctgagccgtcagttactgtttaacgaactcttcgccctgggcgatatctttcttcagcgtatccagcatgcctgacagcgcctgctgttcgtaagcgctgagggtaccaatcggcctgcgttcagccacaccgtttttacccagcagcagcggctgggagaagaagcgcgcatgttcaccctcgccttctacgtaagcacactccaccacattagcttcacccttcagcgcgcgtaccagtgacaaaccgaaacgtgcggctgcctggcccatcgacagcgtggccgagccgccacccgctttggcttccaccacttcggtgccggcgttctggatgcgtttggtcagatcggccacttcctgatcgctgaagctgacgcctttaacctgcgacagcagcggcagaatggttacgccagagtggccaccaatgaccgggacttccacctggtcaggctgcttgcctttcaatgcagccacaaaagtattggcgcgaatgatatccagcgtggtcacgccgaacagccgatttttgtcgtaaacaccgtgctttttcagcacttctgccgcaatggccacggtggtattgaccggattggtgatgacaccaatcaacgctttaggtgccgttgtggcaacctgttcgatcagattacggacgatacctgcgttaacgttaaacaggtcggcgcgatccataccgggcttacgtgcaacaccagcggaaatcagtaccacatcggcaccctgtaaggcaggcgtggcgtcttctccactgaatccctgaatagccactgcggtaggaatatggctgagatcaacggcaacacccggcgtaaccggcgcgatgtcatacagcgagagttctgaacctgcgggaagctgggttttgagcagaagtgcgagcgcctggcctatgccgccagcggcaccgagaacggcaactttcattcttaactccttattaaggtggggcagagatgggccgaaattctatctgtgtcagaccttaatcaactgctcaggcgatgataaatatccgttgttaattctacgtgttttcacacttaatctccggattcaaaagttacttatcattgtacctgaatgaccgacaactttgccgtcgtcagacagagaacggctacgtgcgttttctgttactacaccaccaataatataacaactttgcaaccttcgccttccggggctgtgacgcgtgttttggtctgagcggatttatttgctattatcgccgcccgctagccgcccggacgctgctcatcaatcgaacgattgcataaaaatgcatataaatgcataatcaccactctgccgcgggcggatgcgcggttattctctctatttattggtaacctatgcgaaacccatcgaaacaagacgatctggttaaggctttcaaagccttattaaaagaagaaaaattcagttcccagggcgaaattgttcaggcgcttcaggacgagggctttgaaaatatcaatcagtccaaagtctcgcgaatgctgaccaagtttggcgcagtgcgcacccggaatgccaggatggagatggtctattgcctgcccgctgagctgggtgtgccgaccaccaccagcccgttaaaaaacctggtactggatatcgactacaacgatgccctggtagtgattcataccagtcccggcgcagcacagctgattgcacgtatgctggattcactgggtaagtcgcacgggattctgggtaccatcgcgggtgatgacacaatctttattacccgcgcgcgtgacttcaccgttaagcagctgcacggtgccatcctcaccctgtttgaacaggaaactctgatcgcggactgacgaccggctatcatgtgccagatcgtcagttcgttctctctgctcacccctttccacaatagtcacccgctctggataagtattaagcctgcttttacacgcccggctgttggtcagatcgataactctgcttcaccttctgcgctattttacactgctttacatcactgaaccggcaccattgcccggatccagatcaaactccagcccgatacacctccgactttcgcactaaaagttaaagtgatctatctcactgtttttgcgattaaaagtggcttaaaggttactttttatcctttttttataacgttaagttattaaaagtagccataaggataaagaatcacaaaaaaacattattagcggagtattaatttctgacgttattagttctatacttcttttcgtgatgcaaatcacactaaataaaaagataaaaatagacgacgaggaaaaatctatgaacgtaaaaactaccattgctaccctgagcattctctccgccctctcatttggtgctgttgcagcagaatctattgatgcgtcacaggcacagaatctgcaggctgtcggcaccatcagtgtcagcggcgtggcgggttcgccgatggatatcaaacagaaactcagcgacaaagccgatcagcagggcgcaaaagcctatcgcgtgattgaggcatacaacaacggcaactatcacgctaccgccgcactgtataactaaggcgtaaccgataatgccatctgctctctgtctgacgcgcccttttgcgctccggagagctgaagcagaaatttcaggagagttgaccatgaaaatgaaattagctatcgctgcactgagtctggcatccctgttctcagtaggtgccaacgccgccagcctggtgtccaatgaacaggcacagggtctgcagccaatgaatcagaccatcagcattggtggacgaaatggcgaccagacacatatccgtcaggtgctgtcagagaaagcggatgcccagggcgcaagccactatcgcatcatcgaaaacaaccaggataacacctggcatgtcaccgctgagctttataaataattaaccgtgatgacgcctgaagggcgtcagaagatatcgacgacccgcctttacgagtaaccgcaggttgttgaatgtattgaggagataatcatgaatatcaaaacaaccatcgctacagtcagtctgctttccgttatggcgttcggcgcatcagccgcacagctggtcaccggcgatcagacgcagaacctgcagcctgcgggcaccgtgaccatcagtggaaccgcgggatcgccaatggattaccgcgctgagctttctcagaaagcggatgaacagggtgccagcgcctataaagttattgaggcgcgcaccggtgataactatcacatcaccgcacagctttataagtaattcctcgtcagatgtatgacgaaccctttggccccgctcgccggggcctttttttatctgacgttttatctgacgttaaaatgaagctgaccttccagctcctcttctgcttcatcaaataacagaatcagcgcgccataacgccgtcgctgtcccctgcccagattaacaaattcaatctccagcggcagcggtaacagatcgcccgtcaccacatcccataatccatccagatcgcagatgcggcgctcctccagcgcaaatcgctcgctgaactgccggaagaaatgggcctgatcgacaatttcattaaaatcaaaacgctcgattttcatgctgacggctcccatgctccgtctgcgggcgacctgcgccgcccgttactgtccgctagctcaaaccgcccaggtgcagcgctttgacctccagatactcttccatgccgagtaccgaaccttcgcggcccagccccgactctttcacaccaccaaacggcgccagctcggttgatacggcacattcattaatgccgatcatgccgctttccagcgcggctgaaacacggaatacccgctgcagattctgcgtgtaaaagtatgcggcaaggccgaacggcgtatcgttagcgcgacggatgacctcatcttcatcatcaaagcggaaacaggcagccaccggaccaaaggtctcctcctgcgcgagctgcatcccttcgtgcgcctcagtaatcacagtgggctgccagaagttgccacccagcgcatgtcgctcgccacccgccagtaatttgccaccttttgctaccgcatcattgacgtgctgctcaaccttttccaccgccgatgcctcaatcaatggcccgacaatcacgccctcttccatgccgttgcccaccttcagcttgttcacttcggcagccagctgctgagtaaaacgatcatagatagcattgtgaatgtagaagcggtttacgctgacgcacacctggcccgcattacggaatttgttggcaatggcgccctgcacggcggcatcaatatcggcatcgtcaaacacgatatagggagcattaccccccagctccatcgacacttttttcatggtttcggcagcattacgcatcagcagcttgcccacctgggtggagccggtgaacgagattttacgcaccgctttgctggccatgatggcatcgctgatggcatgggtatcaccggctaccgcattcagtacaccatcaggcacgcctgcctccttcgccagcgccagcagggcaaaggcggagagtggcgtgttattggcaggtttaataatgccggtgcagccggcagccagagctggccccagtttgcgggtcagcatcgccatcgggaaattccacggcgtaatggcggccacaacgccaatcggttcgcgggttgccagaatacgggagccgggtttagctggcggaataatctcaccattggtccgtttcgcctgctcggcgaaccactgaataaaactggcggcgtattctacttccccttccgcctctttcaggggcttgccctgttcggtcgtcatcagctgtcccagccagcgcttgttctcaatgatcagctggtaccagcgagtgagaatttcagcgcgcgcttttgcagtctgcgcccgccaggcgggaaatgcgcgctccgctgcggcgatagcctgttccgtttcagctttacccgctttcgccacctgtgcaatcacctcaccggtcgccggattggtcacgtcaaaggtagaagccgcctgatgccactgaccgtccgctaaataaccggtccggaacagttcgctctcttgcagtgatttcattgattcgctcctgtcagttttgctcttccgtctggagagtatagttggcaaaagcgacagattttgtgatgggtggggattgcgcaggccgctgcaggtcacagcggccagattcagatttggatgagcgtgttctggtacttatccagcatcatagccagtcgttttaccggttccgttacgctggcgggagcctcgtaatgggccagtttttcctgatagacatccagctctttcagcagacgttcaaagtagtaacgccgcttgtcatcgctgctggcggagatcacccggtcagcggtgtaacgcaactgccggtgataagcagagagatcggcattcaccggcacttctgcgtcgcgtaaccgctgatgaccgatgatcagcgtcagggcgatgcgatatttgttgatatcgcccggaaacaggttgagcagcagaaacagttgctgatagagcgctggcagatggttttcacgccggcgcgcctgattggtcgtcatggcagagacagccgcatacataaagcggttcagcagcttgcggccggtgcgcgcttttgatttatcacgaatcagcaggatcaccatcatcgccacgaagcagccgatgacctggcccagaacgttatcgagaaagacgttaatgtggaattccatcggattatccagcaccagaacgttaagggtgccaatcaatgcccccagcgtgccgagctgacgccgctgaatgaagataccaccgataaacccgagcaggccgattgcgatgcagagcagcagtgcgctctgctgcgtcgccgggagaacatacataaagtagagcgcgcccagcggaaccgcgaccgtcatgccgtagagaaagtcctttgccatcatcagcgggttgggcatacgcatcgccagtgcggtgatgacagccagcatgaccatgcagccactgccagaggtccagccggtatagagccagaacagcgaacccagtgcggtcgccacaaaggtacggataccgttgatcatcgcatgatgcgtttcagcggaaacgcgcctggatcaccacttcgcgctgcagaatctcctcttccagcgaggtgatccggctattacttttgatccctttcagtagcagcagatattcggtagcagtgcctacccagctggccagcgtgaccggcgttgatttgccgctggcaccaatcacccgccgcatcactttcatccgcttatgcacctcttcaacggtcgaggctggtttttcaaccatcagacgatactggggcggaatgtaatcaggacgggaattctggatcagaaaggtttcggctgcctgtgtaatcagcgtcagtgacagcgtattgagcatctgcaaacggcgattgctgttcttccagcgtgaggattccatcatcagctggctgcgcatgctgttcagcgccgtggtgcgccgtaccagcgcgctccaggctttatcgacctcttctttatcaccgtgagcgacgcagagttgcagcaggttatagtgtgccaccagcagcgaatcgacctcagcgtcgatcacttttttaatcgaacggggtgagaaaatcatgtcggccagaatggcgcacaggatgccgagtacgatttcactgcagcgctctaccgcatattgtggcaccagcgtcagaccgccgctggcgttagccgtcaccacaataatcagcgcggtgtagcccgccagtccgagcgcgtaagagttttctaccttgatcagcgaagagagccagacgcagagtcctgcccagatgcagcacagcagcagcatcacgaccggtgcacgcacggtggcaatcatgatggtcagcgcggcgatacagccaataaatgtcccgataatacgcaaaacgccgcgatagcgcagcgccccggaataggggtcccccccggccgcaaacgcggtaccgccagccacgataccggcggtcatcaccgcccagcgcggcgtttcaaggttaaagtgaaaacccaccatcagcgctaacaccagcgcaaaggtgagctttaccgggaaaccgcaggaactcgatcatatcgccctcttaaccaaactcacgcaggcgattaaacagtcggaccatcggtgaaacctgttcaggctgacgatcggcctgaccggtgatcaccactgtcgctgtcgtgcccgccgggaagcgattgccgggctgctgatcaagccggatgcgaaccggcacacgctgcgccagacggacccactccagattggaatctactgtggccatgcctttgctgtcgaccgagctgctgctgttggtgacgccagccgccacactgtctacggtgccacgcaacacgatgttgctgccaagtggggtcacttctgcgcggaagcccttctccacgccgtgcagtttggtctcttccaggtaagccagtacatagaaggagtgctgctgaaccagcgccacggcaaccgaaccacgggtaataaactcaccctggtagacattcaggttggtgacccagccatcggatggcgctttgaccgtggtgcgctcaaggtcaatcttcgccagatcgcgtgtcgccaccgatttcgccagctgatgttcgctggtttgcagatcgttattggattgctcgatagcctcgcgcgacatggcggaggtgcccagctggttacggcgcccggcttcgcgacgtttctcactgaccagtgcctggtaatattcaacatccgcctgcgcctgatcgagcgctttttgatagcgcggccggtcaaccacaaacagcgtatcgcccttcttcaccagctggttgtcgtgtaccggaacctcggtaatcaggccggtgacgtcaggggagatcgccaccacgtcagcggcgaaacgcgcatcacgggtccagggcgattcggtatagaagacccaggcacggaaaataatgaccactgcgatgatgaccagcaggatagtaatcgcgtagcgcgcgatttttcttatgagtgctttcacttaaacctcagactaataaacgggagacaaggtaaaacacacagcagtaaagcgctgtattaaaaagtgccggatgccagacaagatcgtagataccgctcggcgtaagcacgcgtttcactaaccagaacagcatcagtgaaataataagttcgatgaaaatgggcggaaaagagagcccaaacatgacaaataccggaagcacactcatcacaaatccttagttcgaccttgccgggatactcatgcctcttcagatgtcgcaggaaaaccctctggaagcgttatccgaaccgcagctggcttaataatagcgtatcatcgaagggtatcaggcaatgaagaatcaccgggaaataccccggcgcgcttataataacgcgcctgactataagttttctacagaatgtgatctaaatcacttttaagccagagtaaataatggaacgacttaaaggcatgtctgtcttcgctaaagtggtcgaactaggttcgtttaccgctgcggcgcgtcagcttcatctgagcgtctcatcaatcagccagatcgtcgcgaaactggaagatgcattgcaggtgaaactgctgaatcgcagtacccgcagtatcgggctgaccgaagcgggcaaaatctattatcagggctgtcgccgtatgctggccgaagcgacgcaagtgcatgaacagctttacgcttttaacaatacgcccattggcgtactgcgaattggcagctcctctaccatggcgcagaacgtgttagccggcatgaccagcgatatgctgcgggaatatccggggctgagtgtgaatctggtcaccggcgtttcccgccccggacctgatcgcggatggtctggatctggtgattcgcgtgggagcgttaaaagattccagcttgttttcgcgtcgcctgggtgcgatgccgatggtggtgtgcgccgcaaaaagctatctggcgcagcatggtacgccggagaagccgggtgatatcgataatttttcctggctggaatatagcgtacggcccgacaacaatttcgaactgattgcgccggaaggattagtgacacgcctggcaccgcagggacgttttgtgaccaatgattccctgacgctgattcgctggctgaagtcgggcaatggcatcgcctatgtgccgatgatgtgggtgattgatgagatcaccgcaggcgagatcgatattctgtttccgcagtatcagtccgatccgcgcccggtctacgcgctctataccgagaaggataagttaccgcttaaggtgcaggtctgtatcgattatctgaccggctattttgaacaggtggctgaacagtatcagcagcatcgtaaaagttaacaataaattgttgacaacatctgtcccaaccagctgtaagacccagccagcgaaggaaacacggtcagataggaaagacgcaaaatccgtcatccctgacacgctcggcccgcgcgatccgtggcgcgggacgctttcctcctctgcccgtgttccctgcgctttcagctattgcattgctgccaggttcatccggctatggatttgtcagcattctgacaacccgccgggcggcgggttgttagggtcacatcaggcggtgccgccgatggtcagtttatccagcttcagggtgggctgaccgacaccgaccggcaggctctgcccctctttaccacaaacgccgacgcctttatccagcgccaggtcattacccaccatcgagatctgctgcatcgcttcgatgccggaaccaatcagcgttgcgcctttaaccggtttggtgattttgccgttctcaatcagataagcctctgaggttgagaagacaaatttgccggaggtgatatccacctgaccgccaccaaagttcggcgcatagaggccatactcaacgctttcaataatatcctgcggcgatgacttgccagccagcatataggtgttggtcatgcgcggcatcggcagatgcgcgtaggactcacgacgtccgttaccggtagggctaacccccatcagtcgcgcattcagcttgtcctgcatgtagcctttcagtacaccattctcaatcagcatgttgtactgaccgggaacgccctcatcatctactgccagtgaaccgcgcagcccttcaagggtgccgtcatccaccacggtacagaggtcagacgcaacctgctgaccaattttaccgctgaacaccgaggtgccacggcgattgaagtcgccttccagaccgtgaccgaccgcttcatgcagcagcacgcccggccagcccgcacccagtaccaccggcaacgcaccagcgggtgcggccacggcggagagattcaccagcgccatacgcaccgcttcacgcgcccaggcgtcagcgcggacttcgccatcttcatctgcgaggaaaaacgcataaccggtacgcgcaccgccgccgctggcgccgcgttcacgtttgccctgatcttccacctggacactaatagagaggcgaaccagcggacggacatctgccgccagcgtgccgtcagtcgcggctaccaatacctgctcgtaaacgccggtcaggctggcattgacttcctgcacgcgcggatcagccgcacgagccactttatcaacgcgatgcagcagggcaattttgtcttcacgtgtcaggctgctcagcggatcgatagcctgatagagcgaacggttcatcacggcagaaagcgtgtgtgccttgccatttccctgttcgcgtacgatgctgcgtgcggcttcagaggagagacgcagtgcattcagcgtgatctggtctgcataggcgaagccggttttctccccgctgaccgcacgcacgcccacaccctgatcgatatggtaggagccatctttaatgattttgtcttccagcacccaggattcgtgaaagctggactgaaaatagagatcggcataatccagacgacgttctgaaagctgccctaacagggaaaataggtcctgctgattaatgccgttagcagtcagtaactgctcacttaccaggttcagagtcatcgtttctcactcattatgtgctcagataatcatagcctgcggtaattccggtacggcgtcaaattcacttgttgtcagtttcacgcggtttacgcagcacttcattgatttccggtttatctagcgggccactgatgtgataacgcagcagcgatatcttgttccacaggggtcccagaaactttactggcggcaaacaccgccgcgccaattaccggattgatggcaaaagctgtcgccacaccgaccgaggcggatatttccggcgcaaccaccgcttccatgtcgatctgacgcttcaccaggtcgagattaccctgcatcgcaatgtccgcttccaggccatccaccagcagattatcggtgcgcatcatgccgttttcgatccaggcggtgccgttaatcgagtcgaagtagaaagaattggtgaaggtgtcgctgaagtcgaagcgcagcttgcgcagtagcgcatcaaagctcaccagccgcagaattttcccggcggcaccggtattcacatcggcgatctggcctttgccaaagtgggtcttcagggtgccgctcagcgtctctgccgagggctgccagggggcagagcgccagtgcaggtcatacgcaatatcaaatggcgcatcgcgcagcggcgtgttgaccccaaaccagttggtcgcgttattaatattcgggcctttcagcgtgcccttcagcgaagtgcgctggtcgtccgggcggttaacccattccccgttgattttcagttgtgaactgccagtatccacttttccgttagtaagcgctaacgtatctccgcggggttgcagcatcgcggagacctgaccatatttctgacccagcacccagcactctttacagcgcaactgtaaagcgggccactggctgaagttaatattcgtggctttttgaggtggcgctttgccgcctttgccttcaccgttatcccactgcggattgtagtaaaggtaatccaggttcacctgccacggtgctttcggtgccattgccagcgcaccatgcagctctttagccctgacgccgacctgacccttgccgcccgcactctgagccagtgtcgcttcaacctcatgccattgctgcccggccagggtgacggccgggctgcgaagcgtgatattgccgggcagcgtgacgccacctgttttgaggccgccgcctgactcgctgcccccggatgctccccctgcggccatcatcgccacccaggcctcgccatccagcgcgggcaggttcagtaccatgccgggatgatcgggcagagcaggtgttttctgcgcatcattcagccagatgccacgatcgacgcgcagcgtcggctccagcaaccagcggctgttaaagcgatggtttgcatcgacgctgccactgagatcgaaatggtgcaggtcgccactggccttgattgcgactggcatcgcctcaccggctttcttatcgagcggtgcaggtaagtgactacttacttcttttgcattaccgttcagcgtcacgtcataacgcgccccgccatgatggggcagcgtaatattgacgtcgccctgccacggcagatttccgcccaactgcttgctgacggctgcaggaagctggctgattttagcaggctgccagtcgccctgaagtttgacgttcacgccaaaatcgtccggattctctttggtgctgaaacgcacgcccatcggctgaccaaaccagttcgcacgcagatcctcactggccagattgccgttgtcgtaacggaagcgcccggagagattgttaatggtggtttttaacggtttgataaacagcgaattattgttcaggtccacattgccacgggcgtgaacctgctcaccatccagcgggatatccagattcaggtggccgccgacgcggcctttgatttccagctgctccagcgcggcacccagtgaaggtttcagcggagtctgcccgaaatagtccgcgatttgctggccttcaccactgatatcaccctcaatgatcagtttttctttcaggtagtcggggatgaccgcagtgacgttgcgcgcgtccacctcgcccagtttcgccaccggcgctttcatccagagaccgtcattcaggaagttaaggtcgatatcgagattgcttaacgctggccatttgggctgaaacgcataggttgcctggcgaagcggcacccagacctggaacatgccatcattatgcttgaacgggaacagcgccggattaccggcaaacagcagtgtggcgttgtccaccttgccacccttcactgccccactcagatagtgcgtcaggctgttacccaacagcggcaccgggaagtagcgccaggcatcgcccgcatcggtaagccggataccggccagaatatccagacgaggctcaccgccgctattctgctggtagctgaagtcgccgcgcgcccagagcgagcgcgcctccaggtcaagattttcgcccgccagcgtgaggccatgatcatcattcagccagcgcagcgcaccggtcacccgcttaatctctaacggagcctggaacatgtcgccatagggaacggtcgccgcccccatatccacactgacctgaccattgctcaggctgccgcgcgcttcaccgcttaaatggctgatgcccggcaacagtttccagtgctgccagctgaaatcacgccacttcacctgtacgcgggttttttcaggctgctgtaacggaatatccagcgccaggccatcgatggtgccctgtggctgcagcgtctgccagttttcaaacagtgccggagagagcggcgcaaacagcggaacgatcggcgcaatatgactcagcaccagctgtgtggcgcgaaacgcgcacttccggctgaccatccggtcccagcatctgcttatcttcaggacgccataacagagagaagtgaccggcgggccaggcgtggccatcggtgctgagccgggtttgtggcacattgaccacccagccattctggaaacgtgacagatgcgcggtcagcccatcgacctcaatgcggtgtcgtccggtctcgccctgccagctggctccgcccttgcgcagcagcagatcaccggcgtagatgtcgccatcgcgcaggttaacccaggccgccaggctaaatcgggcgctatccagccgggtattgtcacgcacccaacgacccagccacgggcgcatgtcgacgtcgtcggcctgcatccagatacggccatcattgagtaaaccgttgctgtcgttaagatcaagccgcacctggaccacgccgtgctggccggtgaagctcgacaggctgacttcgccttcggcccggtggcggttatcttcattgacccaggtgagtcgcgggatcgccagctcagcatgctgaccggaaggggtgcggaaacggatggtgctgtcacgcaggtcaaagtggtcaaactgacgcaggaagagttcgtttatctgcgccggacggaagctgtttttctctttgtcgttatccagcagcgggcgattagtatcgaggtgcaactgccagaaggtcagatctcgaaactgccaccgccagtgcagcagggactgccagacgtcgagagccagattgatgcgtttgatagtgagtttgccgttctcatgcagatcgacgctaagatcgcgaacctgcagggttgggccaaaattctcccatttaccctgtaactggctggcgttgaccggcacgccgctgctgtcggagatgtattgcagaaggttgctgcgatagctgtcgagatgcggcatcaccagacgcaatccgctgaccagcagcgcgacaatcacgatgattgccgcgaccagcagtaacaaaatcctcggcaactgcctcactcacgcctctccttgtgttccgtaaacgacggatagttggttctcatacccgaccgtctcccgataaaagcgttaaaacgcgcattttatctcaaacaagggcgatttttcagcccgatatccgaagaaaccggtgaccgggctggcgttacatcatcaccacgtcgaactgctcctgagtgtagagcgcttcaacatgaactttaacctgcttgccgacaaagatttcgacttcagccagtgcatgagactcgtcggtttttaacgcctcacccaccgtcggtgaaacatagaccagaaagcgatcagaatcataagcgtgatgaacccggacaatctcacgcatgatttcatagcagaccgtttcaacggttttcagcgtgccgcgccctttgcagaccgggcagtcctggcacaaaacgtgctcaatactttcgcgggtacgcttacgcgtcatctccaccagacccagcgccgagaaaccattaataccggttttaacccgatctttactgagcgcgctttccagcgaatgcaatacccggcgacgatggtcttcgttgctcatatcgatgaagtcgataatgatgatgccaccaagattacgcagtcgcagctgacgtgcgatcgcctgagtggcttcaacattggtattaaagatcgtctcatcaaggttacgatggccgacaaacgcaccggtgttgatatcgatggtggtcatcgcttcggtctgatcgataatcagatatccgcctgactttagttcaactttgcgatccagcgagcgctgaatctcattttcgacgtcaaacaggtcgaaaataggctgtttaccgttgtagagctccagcttaccggccatttccgggatatattcaccggtaaattccaccagcatatcgcaggtcaggcgggagtcgacccggatgcgatccagcgccgcgcccgcaaaatcacgcagaatacgctgggccagagccagctcaccgtagagcaggcagcgggtctgattgcgctttttacgctcgctgactttggtccagagtcgtttgagaaaagccgcgtcctgcgccagctcctcttccccgatgccttctgcggcggtacggataataaagccgcccagatcgtcgcagtagtcagccacgaccgctttaagccgatcgcgctctttctcgctctcaatacgctgagagacacccacatgcgatgcgcctggcataaagaccaggtaacgcgaaggcagagtgatgtcagtggtcagccgggcacctttggtgccaagcggatctttgacgacctgaaccaccagatcctgtccctgccgcaccagctcggcgatatcccgcacgataaagtttttcttttcgtcgcccgccacacattcagtatgcggcatgatatctgaggcgtgcagaaaggccgctttctccagaccgatatcaacaaaggcggcctgcatgccgggcagaaacacggcttacacggcctttataaatattgccaacgatgccgcgccgcgcctcacgctcaatgtgaatttcctgcagtatgccgccgtcaatataggcaacacgtgtttcagaaggcgtgacgtttaccagtaattcagccgtcatgttgaccccttacggcacgcagtgactcgaaatggctgatcaactcccctgtctcaaccaagggtaatccgaccactgcatggtagcttccattaattttgcggacaaagtttcctcccctgccctgaataccgtatgcacccgctttatccattggctcgccggtcgcgatatagtcgtcgatgtcggtggcggttaaggtgcggaatgtcacatcagtggttacgacgcaatccagcgcctgctgactgtcggccagcgctaccgccgtcatcacctgatgcgtatgaccagagagtttgcacagcatcgcgcgggcatcagcggcatcgcgcggcttttccagcacttcgccattcagcaccacaatcgtatccgcgcccagcaccggcagatcctgcgcggccagtttgacacccgcctgcgctttatcattggccagacggcggacatagatttccgccgcttcgttcggctgacgctgctcttcaacgtcagtcacgatgcgctcgaatgtcagcccaagttgagttaacagctcacgacgacgcggtgaaccggaagcaagatagagggttaccataaatttccttattgaacagcgaactgacgacgaatttttctcattaataagaatagccagggccagagaataccgtcgacgacactgctccagaaaatttcaggtcggaatgaaacgttgattaccaggaattcagcccagaagacaatcacatccatcgccagcgacagcaccataaccattaacgcttgctgccacaacgctaagttgcggaataactggaacttaaaggcaatcaggtaggcgatgatactgagcgccagcgcacgcacgccgagtgtggaacccgcaatcagatccatgatggcacccagcacaaatccgctgccgacattgacccgatgcggcagtgcgagcacccaatagataaggatcaacagtagccatgagggccggaacatataaatttcatccggccagggcatgatctgcaggacaagcgcaaccaggaaggagagccagatgacccaacgtccctggctgcgatatcgactcaaggctgccccccgcgtgaacgcgaggagttgctttgtccactgctgctggtagctgacggtgcaggcggtcccatctgtacggcaggcgcaggcgggcccatttctcccgcaggcggtaagacctgcggcatcatctgcatcagacgctcgttcgcaacgcgatgaacttcatcctgcggcagcggcatatcaccattgcgatcggcgccccacagcagcagcaggtaacgcagacgctgcagacccgcggtcggatgcgcctgaatcaccgtataggcgcgttgggtatccacttttaccgaggaaaccacacccaccggatagccttcagggaatcggccaccgatacctgaagtcaccagtacatcgccgacccgaatgtccgtattacccggcagatgctcaagctgaagatcttcagtacagccgttacctgcggcaatgacacggatgtcattacgcagcacctgaatcggcagggcatgtgacgcatcgcagatcagcagaaacacggctggtgagttgtccgacagcgatgacctgaccgactacccctttatcactgatgaccggctggccttcatagacgccgttgacgctgcctttgtcgattaccacctggtcggtgtaaggatcggtgccggtggagatgacctgtgtcaccatcttttgctcatcctgacgcagcggtgaacccagcagttcacgcaggcgtgcgttttcctgcttatattgccccagcattagcaggttactgtttttcaggaagagctcacgacgtaacgctttgttttcctgctcgagttgctgacgcgacgccagcgactctgacacgccatccagcaactgacgtggcccattggccaggaagtaaaacggactgaccgacgtatccagatagttgcgtatttgggtgaaagaacccacacggctgtcggcaatgataatggcaatcgccacgataaccgccaggaatagacgcaactgcagggaaggtcccctgctaaaaatcggcttcatataatctgcgtgatcctcgacaacaggagaggaagcgacggcgtaacaccgtgcttccctgggctgaacgcactgcaccggcacagattgcgccggttcacatgccactccctcgcatgatcattgcgttcttagccggttgaggcaattattcttcgctgaacaaatcgccgccatgcatgtcgatcatttccagcgctttgccgccaccgcgagccacacaggtcagtggatcctcagcaaccacaaccggaatgcccgtctcttccatcagcagacgatccaggttgcgcagtaacgcaccaccgccggtcagcaccatgccgcgctccgaaatatctgaagccagctcaggcggacactgctcaagggcaaccatcaccgcgctaacgatgccggttaacggctcctgcagcgcttccagaatttcattagagttcagtgtaaagccgcgcggtacaccttctgccaggttacgaccacgcacttcgatctcacggacttcatcacccggataggctgaaccgatctcatgcttaatacgttctgcggtcgcttcgccgatcagtgaaccgtagttacgacgcacataattaataatagcttcatcgaaacgatcgccaccaatacgcactgacgaggagtagaccacaccgtttcagcgagatcaccgccacttctgtggtaccgccaccaatatccaccaccattgagccagtcgcttctgaaacgggcagacccgcaccaattgctgcagccatcggctcttcaatcagaaacacttcacgcgcgcctgcgccctgagcggattcacgaatcgcgcggcgttcaacctgtgttgccccgacgggtacgcagaccagcacacgcgggctgggacgcataaaactgttgctgtgaacctgcttgatgaagtgttgcagcatcttttcggtcacgaagaagtcagcgataacgccatctttcatcggacgaatcgctgcgatattgcctggcgtacggccaagcatctgtttggcctcatgacccacggccgcaacacttttcggtgaaccggcacgatcctgtcgaatagcgacgacggagggctcgttcagtacgatgccctgtcctttcacgtaaatcagggtattcgcggtacccaggtcaatggacaagtcgttggaaaacatgccacgaaattttttaaacatactaaggggtaatcctgcaagctgggggcggaaaataaaatccgcttactttaccaaccacacgaagctgccacaaggcgcaaaaacgttctgcttcggtgaaaaaagacgcctgattgcgtttaagtcatctgaactggcgatccacaacagcagaatggcgaccagacgccatcagcactgcatttcacgctatttcccctcgccctgtccgacataaaatctaacatttccggcagtaagttcagaggttcagacgcgaataaacattaaaaaaaaccgtaaatttccgtcagtacgaccgcaattcattaaatacggtaacgttgtgaatacttcttcacgttactgttaaccggaagcgagggagcaaaaaagtcgccctgcccacctgctacgcccaacgcgactaaagtttgccactccgctttagtgcggacaccggtagcaaacacctgaatgcccgtacatttacagacttccagcagactctgcacaaacagctgattttcagtccgtcgctcaatattgcgtaccagaccggcatcaagcttgatcagttccagcggcagctgtcgtatgtaggcgctgcttaccacggttaaacccgcctgatttaccgcaacccgacagccaaaagccttaagtgcgcggaaaactggcgttaaacggttgatgtgttgacaaacatctgcctcggcaagttcaaataaaaatcgttttctttgcgctttcgggcactgcagcagcatgttctgcagccagaggacaaaagagcgctgcagaagcgaggtaatcgtcaccgggatcaccagcgtctcttctggccagagttcagagagtgccgcaatgcgagtcattaactggcgatcccagccatcagccatgccgagctgctgtaccaggggcatatattctgcggccagcacttctttatcgccgtcgaagatgcgggtcagcatcacccggtgctgtaccttaccctcaatattgacggtgggtttatgatagagccgcgggccgccacggctaagcgtgttctccagcagggtttcgccagcgcacactaccccgcccggcgtcctgcggatttccggcaccattggtccagttgttgccgcccagcagtgccgcacgtcgggtagccatttcggcattttccatcacctgcggcacagtctgcccgctgtgccaggcgctgataccgatatggatgagatcatcacgattaaccagccgcatcggcggcagggaatcaacggcattgatcagctgatccgcaatactgtttgcctctttgagactgcgatgcggcagtagcacggcaaaatcactgcggaaatagcgtgccagcagggcgccaggatagcgcagcacaaaggtggaaagcatgttgacgaaattgaagaggtactcctcaaccagccccggctccagcgaatccttcagcgtgtccagatcgggcaggcgcaccatcatcaccacaccatgggtgccgacagcttcctgatcctccagcagggtggcaagctggttatcaaagaacagccggttgttgagaccggtgcgtccatcctgcgcagcaaaggtgcggatcagcgtgtcgatacgcagacgctgttcgcccgcctcctgcagatccgccagcaacacatccagtgcgcggctcgctctcggtggccactcatccgcaccgcgtttcggcattacaccgcgctcaccgctgataatcgcctctgcccgcacttcaagatgctccataccgcgccactgacgactgagccagcgatgcatcagcagcagcaccagactcatcaccagcatgacggtaaacaggatgcccagcgtagaggtgccggtaatggagcgcagccaggttttggcaggatcaagggtgacgacccgcagctctaaccccgtctggtgcattaaaggcacatcgacctggataaaacgattaggctcgtcttccagcatctggttttcgtgtcgggagagggtaaggaaagtctgcctgccgttgtgaagagaaatctgctcggcattcattatcggcatcatacgcgtgagccagacatgcagctctgccggcgtctgggtgaacatcgcctgatccacttcggtcgccagtatctgcgcccgatgttcaacccgctgatgactgaaccagaaaacactgaatgcacagcctgccagcatcaacgacatggccagcaggcttaaaaaggtaataaacgcagataattttgtggttaatcgcatccctgtgcctgtattactgcggtgataaccggatcacccaaccttgtaccgtcagcctgacgaaaacgcgagcaaaaatagcataatttgccgttgccgacagcgccgggacgtatgaagccgaagtatatcgtcgggatatcatcgctgacgttgatcctggcacttttcggtgcattctcatcgtaccggccagccaggaaatttcacattttcagtgcgaaactggctgatatcagtaatagtcatcatgctggttaatgacatcctgtctggagaaggcaccatgaaacgcacaccccgtctgaccgaagccgacgtaacgccggaaagcatttttaacatgaagcgccgccaggtgctgaaaacgctgggactgagcgcagcggcgatgggtatgccgggcgtggcgcaagccgatattctcagctggttcaaaggcaacgatcgcccacccgcgccagcaggccggccgctggactttaccaaaccagcgcaatatcaggccgatctgaccttaacgcctgcggataaagtttccggctataacaacttctatgagttcgggctggataaggccgatccggccgccaatgccggtacgctgaaaacagaaccctggaaactgaccattgatggcgaagtggctaaacccgtgaccctggatatggatgacatctttaaacggtttgccatggagcagcgaatctatcgcatgcgctgcgtggaggcctggtcgatggtggtgccctggataggctttgagctgaataagcttatctctctggcggaaaacccaccagcaaagcgcgttttgtcgccttccagacgctgtacgatcctgagcaaatgccaggtcagaaagatcgctttattggcggcggactcaattatccctatgtcgaaggtttacgtctggatgaagccatgcatccgctgacgattctgaccaccggcgtctatggcaaagcgctgccgccgcagaatggcgcgccgattcgcctgacggtgccgtggaaatatggttttaagggcattaagtcgattgtcaaaatcaccctgaccgcaaatcagccaccaacgacctggaaccagatcgccgcagatgaatatggtttttatgccaatgtgaatccgcatgttaatcatccacgctggtcgcaggccactgagcgatttattggcccgggcggcagtctgaaggtcgaacgtcagccaacgctgctgtttaacggctatgccgaacaggttgcgtcgctctatcgtggcctggatttacgggagaattactaggtggtacgcctgtcgataaaacagatcacctggcttaaggtgattctgcatctggcggccctgttgccgctggtttatctggttcttgccgcgatgcagggcggcctgagtgcggatccggcaaaagatattcagcattttaccggccgcatggcgctgaaactgctgctgggtacgctgctggtctcaccgctggcacgttatggcaggcaaccgctgttaatccgcacccggcgtctgcttggcgtctggacgtttgtctgggcttctctccatctgctgagttattacctgctggagctgggcgctgacaatctgcgtctgctgggcagcgagctgatttcccgtccctatctgacactggggattatcagctggctgatattactggccctggcgctgacgtcgtttcagcgcgctcagcgcaagctcggtaagcgctggcaaaccctgcacaacgcggtctatctggtggccattctggtgccgattcactatatctggtcagtgaaaaccgtgtcaccccagccacttatctacgcactacttgctgcaatactgttagcctggcgttacaaaaaatttctcaaatggtggcctcgctagcgcttcacccgttgttttcctctgcacttttctgataaaagatgtggcccgcaggccacatccgatcatcttcgcagataagaccagtattttgctgcgaaatgacacgaaacggatataatgcccggctttattgctcgtcgggtcttctttttcattctcaaaggtgacaaatgaagattcgcaaggtattttacgcgatgcctcaatgattgcgggagatggcagcacgatggcgcataaattacatattctgcttttaaacgggcccaacctgaacctgttgggaacgcgtgaacctgagaagtatggtcataccacgctgcgtcagatcgttgacgatttgacacgtcaggcagaccagttgaatgtggaattgagccacctgcaaaccaatgctgaatttcagctgattgatcgcattcatgaggccaaaggcaatgtggattacatcattattaatcctgccgcgtttacccataccagtgtcgcactacgtgatgccctgctggcggtagaaataccgtttatcgaggttcatctctccaacgtgcatgcccgcgagcccttccgccatcactcctatctttctgatgtctctgctggcgtgatctgtgggcttggcgctgacggctacacatgggctttacaaacggcagtaaaacgcctgtctcaaactaattaatcaaactgagtacggaaccccactcatggatattcgtaaaattaaaaaactgatcgaactggttgaagagtctggcatttcagagctggaaatttctgaaggtgaagagtccgttcgcatcagccgtgcacctgcaaacgtgggttacccgatgatgcagcagacttacgctgcgccggttcaacagcctgctctggcaacagctgttgctcctgttgcagcggttgccgaagcggcaccggctgaaatcagcggtcacatcgtgcgttcaccaatggtagggaccttctaccgtacgccgagcccggatgcgaaagcctttgtggaagtcggccagaaagtgaatgccggcgataccttgtgcatcgtcgaagccatgaaaatgatgaaccagatcgaagctgacaaatcaggtgtagtgaaagctatcctggttgaaagcggtcagccggtcgaatttgacgagccactggttatcatcgagtaacggggcagatcatgctggataaaattgttattgctaaccgtggtgagattgcgctgcgcattctgcgtgcctgtaaagaactgggcatcaagactgttgcggtacactcaagcgcggatcgtgacctgaagcacgtgctgctggcagacgaaaccgtctgcatcggcccggcgcagtcagttaaaagttacctcaacatcccggcgctgatctctgctgcagagatcaccggcgcggtggcgattcaccctggctacggcttcctctctgagaatgccgattttgctgagcaggttgagcgctccggctttatctttatcggtccgaaagcagacaccattcgcctgatgggcgacaaagtctctgcgattaatgcgatgaagaaagcaggcgtcccaaccgtacccggttctgacggttcgctgaccgatgatatggaaaaaaaccgtgcctttgcgaagcgcatcggttatccggtcatcatcaaagcctctggcggcggcggcggtcgtggtatgcgcgttgtgcgcagcgacaaagatctggaacaatccatcaacatgacgaaagcggaagccaaagcggctttcagcaacgacatggtttacatggagaagtatctggagaatccgcgccacatcgagattcaggtttctggctgacggccagggcaacgcgatctatctgggcgaacgtgactgctctatgcagcgtcgtcaccagaaagtggttgaagaagcgccaggcccaggtattactgaagaacagcgcagctttatcggcaatcgttgtgccaaagcctgtattgagattggctatcgtggcgcaggtaccttcgagtttctttacgaaaacggtgagttctacttcattgagatgaacacccgtattcaggtggaacatccggtgaccgagatgatcaccggtgtggatctgatcaaagagcagctgcgcattgctgcgggtcagccactgtcgatcaaacaggacgaagtggttattcgcggacatgcggtcgagtgccgtattaacgctgaagatccggtcaccttcctgccaagtccgggtaaaatcacccgcttccatgcgccaggcggttttggcgtgcgctgggagtcgcatatttactcaggctacaccgtaccgccgtattacgactccatgatcggtaagctgatcacctatggcgaaacgcgcgacgtggctatcgcccgcatgaagaatgcgctggcggaactgatcatcgacggtatcaaaaccaacgttgaactgcagatgaaaatcatgtccgacgaaaacttccagcacggtggaaccaatatccactatctggagaaaaaactcggcttgcacgagaagtaaacgcaacgctgagtcagtcagaggccggttaatccggcctttttcttttgccgctggcgttaaggttgaatcatggatgctcgttttatacaggcacataaagaggcgcgctggtcgctctacctcaccctgctctggctcgctgcctgggggctttctgcctggctgggtggcagtgaaattggtatcaccggcctgccgcgctggtttgaactctcctgcctgtttgctcccctgttgttcatattcctgtgctggatgatggtgcggttaattttccgcgacatgccgctggaggacacaaatgaacagtgaaattatcctgccgttactgatttatctggtgctgattgccgcgctgtcggtgtttgccgtgcgcaaaaggcgcgagggtagcttcctcactgaatatttccttggcagccgctccatgggcggatttgtgctggcgatgacgctcaccaccacctatatcagcgccagctcgtttattggtggtcccggtgccgcctacaaatatgggctgggatgggtattgctggcgatggtgcaggtgcccgccgtctggctctcgcttggtgtgctggggaaaaagtttgccatcctggcgcgtaagcataatgcggtgacgctgaatgacatgctctacgcccgctatcagagcccgctgctgatctggctggcaagtctgagcctgctggttgcctttatcggtgccatgacggtgcagtttattggcggcgcgcggctgctcgaaaccgccgcaggcatcccgtatgacacgggtctgctgatttttggcggcactattgcgctctacaccgcttttggcgggttccgtgccagcgttctcaatgacgccatgcagggcatcgtgatgctgattggcacatttctgctgctgttcgcggtgattcatcaggctggcggcctgagcacggccgtgcagaaactgcatgacattgatcctgctttgctgtcgccgcagggaccgggtgagattataacgccgaccttcctcagttcatttgtcgtgctggtctgctttggggtgattggcttgccgcatactgcggtgcgctgcatctcttataaagacagcaaggcagtccatcgggccattattctgggtaccattgtagtggtgatcctgatgctgggaatgcatctggccggtgcgctgggccgggcgatactgccgaatctgaccgtgccggatagtgttatacccaccctgatgatcactgtgctgccaccgttagctgccggactgtttctggcagcccccatggccgccattatgtcgaccattaatgcccagctgttacaggcttcggctacgctgatcaaagatctctatctgcgtgttgccccacagcagatggaaaatgagacgcggctgcggctgttatctggcaccattacgttcgcactgggtctcctgctgctgattgcggcctggaatccacccgatatgattatctggctcaacctgctggcctttggcggccttgaggcggttttcctctggccgctggtactgggtctctactgggaaacgcgctaatgccgcaggcgccatcaccggcatggtggtgggtggaggctgctacgcttttctggcgagcctgaacctgcagattctgggttttcatcccattgtgccctcactgcttttaagcctgctggcatttttagtgggcaacctgtttggacgcgcgccgcaaacggtcgacgcgccgcaacattgacggaaagagagacgttatgccgtggattcaaatcaaaattaatagctcaggtgaacacgcggaaacgctgagcgatgcgctgatggacatcggtgcggtttcagtgacctttcaggataccaacgacacgccggtgtatgagccgctgccaggtgaaactcgcctgtggggcgataccgatgttatcggcctgttcgatgcagaaactgatatggccgcgattaccgccgaactggcgcagcatccgttgctgggcgccggttttcgtcaccggatcgagcagatcgaagataaagactgggagcgcgaatggatggaaaacttccatccgatgcgcttcggtgagcggctctggatctgtccgagctggcgtgatgtgccggatcccgatgccgtcaacgtgatgctcgatcccggcctggcgtttgggaccggcacgcatccgaccacctcactctgccttacctggcttgacgggctggatctggtgggcaaaacggtgatcgatttcggctgtggttcggggatcctggcgatcgccgcactgaagctgggcgcggctcaggcgatcgggattgatatcgatccgcaggctattcaggccagccgggataatgctgagcgcaacggcgtctctgatcgcctgtcgctctatctgccccaccagcaacccgaaaatctgcaggctgatgtggtggtggccaatatcctggccggcccgctacgtgaactggccccgctgatcagcgtactgccgaagtctggcggtcatctgggcctctcgggcgtgttagagagccaggcagagagcgtctgcgaagcgtatgttagcgagttcacgctcgacccggttgcggttaaagaggagtggtgccggattaccgggattaaatcctgaatatggcgcctgtctgccgcctctgatatcgctctgcccggaacaaagtgccttaacagaacattcagccagcccgtagcgtaagttgcgggctttcccgatttgaaatggatgcttgtatcgttaatcacggcatgtgacgttttttatctggcgaattgacgtacttttctggaaaaacttttgctcacaatttcagcataagttgttaaatcattgatatttaagcttaataaatatgcacatcgatcatgacccggatttcattgatctttcttgctgattgttcaaagtttggcctttcatcttcctgcaaaaatgcgtaatatacgccgccttgcagacacagtatggccattctgacttcatgcgtattggaaacctccagctgagaaatcgactgattgcagcaccgatggccggtattaccgacaggccgttcagggcgctgtgtcacgaaatgggtgcaggcatggcagtttctgagatgttgtcttcaaacccggaagtctgggctagcgacaaatctcgattacgtatggttcacagcgatgagccaggcattcgcgccgtgcaaattgccggttgcgatcccagtgaaatggcgcaagctgcacgcattaatgttgaggctggtgcacaggtcatcgacattaatatgggatgccctgccaagaaggttaaccgcaaaatggcgggttcagccttgctgcaatatcccaccgtggtggagtcaattctctccgcagtggttaatgcagtgaatgtgccggttacgctgaaaattcgtactggctgggatcctgaaaacaggaactgtgtcgcgattgcccaattggctgaacgctgcggtatacaggctctgacgatacatggtcgcactcgtgcctgcctgttcaacggagaagctgaatatgacagcattcggacagttaagcagagtgtctccattccgattatcgcgaatggagacataactgacccgcataaagccagagcggtgctcgactatacaggggccgatgctctgatgataggacgtgctgctcagggaagaccgtggatcttccgggaaatccagcattatctggacactggggagttgcttgccccgctgccgatggcagaggtcaagcgcttgcttgtttcgcatatacgtgagctgcacgacttttacggttcaggcaagggataccgtatagcgcgaaagcacgtctcctggtacctgcaggagcacgccccgaatgaccagtttcggcgcacattcaacgccattgaggatgccagcgaacagctggaggcgttggaggcatacttcgaaaatcttgcgtaacgaaataaagagctgaaagaactatgttcgaacaacgcgtaaattctgacgtactgaccgtttcaaccgttaactcacaggatcaggtaactcaaaaacctttgcgtgattcggttaaacaggcactgaagaactattttgctcaactgaatggtcaggatgtgagcgacctgtatgagctggttttggctgaagtcgagcagcctctgttggacatggtgatgcagtatacccgtggcaatcagacccgtgctgccctgatgatgggtatcaaccgcggtacgctgcgtaagaaattgaaaaaatacggcatgaactgatttttagttctgtctgtaaatcacgccagccttcgggctggcgtttttatttgtgcgtcgacgcacaaagccacggtaatgatagtgaaacagtttccggtaatatggtaactgtagttgcaatcgctggcgtgatatttcaccctctcgctttcgcccgctgtgatttgacttagtgcctgcctgaccctcacctcgcttcacatccccgccactgctgggtatgtgactttctgcgcattaaaaagcaacgcaatctcttcatacatttctgcctgagtgaatgctcacactgctcccacatagtgaaactatttgcactaaatgtgatcgggtcgactcgcattgcttccttttggtgcgccatattagcggaactttctaagtgcttccgattattaaccgttctttcatacgaattcaggaacctgcaaacctggcatcagctttgcagagtcgtggatggctgaccgccacagacaggaaaaacgcacactaaagtgcgcaaacataacaacatgatcccgccacacaggatgctttatgaaaaagatgatgctctctacgctgatcgctgctgcctcgctggttgccgttgctcagcaagcacacgcaggcaccacactggatgcgataaagaaaaaaggttttgttcaatgtggtatcagtgacggcttgccgggcttctcctatgcagatgctggcggcaagtttaccggtatcgatgtggatgtgtgtcgtgcgacggctgccgctgtgtttggtgatgcgaccaaagtgaaatataccccgctgaccgcgaaagagcgttttaccgctctgcagtccggcgaggtggatgtgctttcacgtaataccacctggacctcatcgcgcgatggcggcatgggcttcctgtttgcgggcgtgaactattacgacggtatcggcttcctgactcaccagaaggccggcctgaaaagtgcgaaagagctggatggtgccactgtctgtattcaggcgggaaccgacaccgagctgaacgtagcggacttctttaaagccaacaaaatgcaatatacgcctgtgacctttgaccgctctgatgaatcggctaaagcgctggatagcggacgttgcgatacgctggcatctgaccagtctcagctttacgcattacgcattaagctgggcaaaccggacgaatttattgttctgcccgaagtgatctccaaagagccgctggggccgttggtgcgtcgtggtgatgatgactggttcaccatcgtgaagtggtcgctctacgccatgctgaatgcggaggagatgggcatctcctcgaagaaacgttgatcagatgacggccaagccaaccacaccagacatggcacacttcctgggcgccgaaggtgattttggtaaggatctgaagctggataacaagtgggcctacaacatcgtcaagcaggtgggtaactatcaggaaagctttgaccgtaacgtcggtaaagacagcgcactgaagattgcacgtggtcagaatgcgttgtggaaccagggcggtattcagtacgcaccaccggtacgttaacagacctcactaatcgggcaccctattctgtggtgccctaccccagctttcgttactgaggtttcaacatgtcacaacgcccaaccgtgaaaagggatttttcatttggtaatcccacggttcgcgcctggatttatcagctcatcgccgtcgtcgcggtgcttggtgtggtgggttatctggtgcataacaccattattaaccttgctaatcgcggtattacatcggggtttggatttcttgagcgcactgccggtttcggcatcgttcagcatctgattgagtacactgagggagatacctacgcgcgcgtatttctggtcggattaaccaacacgctgctggtctctgcactctgtattgttttcgcttcgattctcggattcgcggtcggtcttgcccgcctttctgacaactggctgctgcggaaactctcgaatatctatatcgaaaccttccgtaatatcccacccctgctgcaaatcttcttctggtactttgcagtcttacgcaatctaccgggcccacgtcaggcgctgaatgcttttgacctggcatatgtcagtaatcgcggactctacgttccatggccgacctatgcagcaggcagctggccgtttgttattgcactgcttctggccgcggctgtgagctatggcctgtaccgctttaaccgtaaacatcagctgaaaaccggtcagttacgtcgcacatggcccgctgccgttgcgatgctgattctctttcctttgcttgcacacattgggtttggcccagccacgcactgggatgtgccacaactgcgcggtttcaatttccgtggcggctcggtgatgataccggagctggcagccctgacgctggcactgtcgatttatacgtcgtcgtttattgctgaagtgatccgctccgggatccagtcggtcccctatggtcagcatgaagcagcgcggtcgctggggctgcctaatccggttacgctgcgccaggtgattattccgcaggccatgcgcgtcattattccgccactgaccagccagtatctgaacatcgtgaagaactcctcactcgccgccgctatcggttatcccgatatggtgtcgctgttcgccggatcggtactgaatcagaccggtcaggccattgagacgattgctatcacgatgggcgtttacctgattatcagcctgctgatatcaatgcttatgaacttctacaaccgcaaaattgcgctggttgagcgttaagagaacgggataactatgtctgtgactacgcatgaaacgccccccgtcccgacgactctggtcagtcgcgcctggttttgggctcgtaaaaacctgttttccagctggtttaatacgctactgacgcttttttgcatctgggttatctggcacgtcattccgcccgcgctgaactggctggtctttcaggcaaactggatcggcaccacgcgcgccgattgcaccaaagagggtgcctgttgggtctttatccatgctcgtttcggccagttcatgtatgggctttacccgcatgagttgcgctggcgtattaacctggcgctggtgatcggcctgctgtcgattgtgccgatgttcctgaagagcctgccgtatcgtggacgctacattgctgcctgggctgtcatctatccggtgattgtctggtttctgctgtatggcggctatctggggctggaacgtgtcgaaacacgtcaatggggcggattaacgctgacgctgattattgcgtcagtgggtattgccggtgcgctgccgctgggtattttgctggcgctgggccgtcgctcacgcatgccggtcgtgcgcacgctgtcgattatctttattgagttctggcgcggcgtgccgctgattaccgtgctatttatgtcatccgtgatgctgccgctgtttatgtctgaaggcactaacatcgacaagctggtgcgcgcgctggtcggcgtcattctgttccagtccgcctatgtggcagaggtggttcgcggtggcctgcaggcactgccgaaaggtcagtacgaagcagccgaatctctggcgcttggctactggaagacgcagatgctggttattctgccccaggcgctgaagctcactattcccggcctggtcaataccatcatcgcactgtttaaagataccagcctggtcatcatcattggtctattcgatctgttcagcagcgtccagcaggcaacggtcgatccgacctggctggggatgtcgaccgaaggttatgtctttgctgcactggtctattggatcttctgttttagcatgtcgcgctacagccagtatctggaaaagcgctttcacaccgggcgtacatcgcactgaggttttacatgactgactctatgacacactcttccgacgcgttgatgatctcgcttgagaaacgtgaataaatggtacgggcaattccatgtactgaaagacatcaacctgcaggttaaaccccgtgaacgcatcgtactgtgcggaccttccggctccggcaaatcgacgacgatccgctgtatcaaccatctggaagagcatcagcagggccgcattgttgttgacggtatccatcttaatgatgacgttcgtaacattgagcgcgtgcgcaccgaagtcggtatggtcttccagcacttcaatctctttccgcatctgaccgtactgcaaaactgcacgctggcaccttcctgggtaagaaagattccaaagaaggaagctgatgagctggccatgcactatctgcaacgcgtgcgtattgccgagcatgcacataagtttccgggccagctctctggcggacagcagcagcgtgtcgccatcgcccgctcactctgtatgaagcccaaaattatgctgtttgatgagcccacgtcagcgctggatcctgagatggttaaagaggtgctggatacgatgattggtctggcggaggatgggatgactatgctgtgcgtcacccatgagatgggctttgcccgaacggtggctgaccgggtgatctttatggatcggggagagatcgtcgaagtcgcgccaccgcaggagttttttgcgaatccaaaatcggagcgtacccgggcgtttctatcgcaggttattcactgatcagacgttcagttatctcactacccggcctggtgccgggtttttttatggcctgaacagccgctttaatatgcttactgacctgttgctgttatgaatagacagacagatacgctgtgaagagggagttttatcgcggtttgccacaacgaaaaaagcccttcgcatacgcaaagggctctctcttatttaatgcctggcagttccctactctcgcatggggagaccccacactaccatcggcgctacggcgtttcacttctgagttcggcatggggtcaggtgggaccaccgcgctacagccgccaggcaaattcttttatttaccgaactcgtgtcttaactggtgctgatacccagagtcgaactggggacctcacccttaccaagggtgcgctctaccaactgagccatatcagcacactaaatttgatgcctggcagttccctactctcgcatggggagaccccacactaccatcggcgctacggcgtttcacttctgagtttcggcatggggtcaggtgggaccaccgcgctaaagccgccaggcaaatcttggtgcacgaaacgaatcttttacgccatgaccgcgttgccatcgctcagccacaccggtcacatacttcagtatgctcccgctgacgtcctcgctctgcgccttgtcacgccgcaaaatctttcgtttccgctaatttttatccggtacaggctgaaaattgtgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccgggtaacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttacggataaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaataagggaccggatttacctggaccctccgcctacacgcttaaaccgggacaaccgtcgcccggccgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcttgtgtgcttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgccaaatcattccttattacggaggaatgacgcgctgcgtcgtttcaattttcagcttgttccggattgttaaagagcaaatatctcaaacgcggcccggctgcttacgcaaccaaatcggttttgagatactgtatggagacacctttcacctgtcaccaagcaggtggcgtcccctaggggattcgaacccctgttgccgccgtgaaagggcggagtcctaaccgctagacgaaggggacacaaaagtgtcacgacttcgcagccgtcctgctcattactttttatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccaaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccccgtcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaaggagcaagctcctctgtgctaccgtccgacttgcatgtgttaggcctgccgccagcgttcaatctgagccatgatcaaactcttcaatttaagtttgatttgcttaaacaagttaagcggtgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctttctcagaagtttttctccggcggtgcagtctcctgtgcctctcaacccgcttcccgttgccggtgttccgtgtcgatggaggcgcattatagggatcccgtttaagagcacaaccctttttttggatcttttatctgaacggttataaatgatccagattgatgagatcgccagcgatccaggccagaattggcttgtcagctgcctgaaatcgcatcaggctgcattgaaaacagaacaaaggagaacatgatggcttccgccctacgtccatataaagaccttttcccgcaaaccggccagcgcgttatggtcgatccaagcagtgttgtggtcggtgatgtcataatggaggacgacgtgagcatctggccgctggttgcgattaggggggatgtgaatcaggtccgcattggtgcccgtactaatgtacaggacggcagcgtttctgcacgttacgcataaatcagcgtctaacccgcaaggcttccctcttattattggcgaggatgtcacggtcgggcataaagcgatgttacacggctgtaccattggcgatcgcgtgctggtcggaatgggatcgattctgcttgatggcgtaatagtagaagaagaagtgatgattggtgccggaagtctggtgccgccaggtaaaagactggagagcggctatctctatctgggtagtccggtcaggcagatcaggccgctgaatgacaatgagaaggaaggtttacgctattccgctaataattatgtcgcctggaaagatgattacctggcgggagataaccagatccagccctgagcatcaatattatcctgacggatagccgcttcggcctcatcttccagatcccagcgatggtgctgaaacagcgccatcgtctccccttcaccaaaacgtgaagtcagcgacttcccgctgattgcacaggtcagccgcatgccgttgaccagcaccgggaaacagaccgcgttcagttcagcattataggtttcatcatcaggaaactgtatcgcctgattcatggctgcatggcctgtttaagctgggtaatcaccggtgcgatttccggcatcacaccgtgccacagatagaaggcatgagcagcctgccccaccagcatgcccaaaccatctgccagatgagccgtgccctgcgcctgacaccagcgcaggaaaggcgtcagcccgctttgataaaacatgtcataacagcgcacatcagcatgaatgactgctgcaggtaaaggaggggtttcgccattcacgccgcttgaggtcgcattaatgatcagatcaaagtgctgatctgcaagctgctcaaaaccacatgcgcggatagtgccgctccctgcaaacaggctagccagctcttccgcccgcgcggcggtacggttaacaacagtgagtgtcacgcctgctgagagaagcggcagaatgaccccacgtgcagcaccgcccgcccccaccagcaataccttgtcaccagagttgatcatcttcagccgttcaagatcgcttaacagcccgataccatccgtgttgtcacccaggatctgcccatcgctgagttttttcaccgtgtttaccgcgccggacagggctgcacgttcgctgagctgatcggcaaattcccatgcctgctgtttaaaaggtaacgtcacgttggcaccacgacctccctgttcgaaaaaggcagagagcgcctgaggaaaaccatcaatcggggcacaaatccgaccatagcgatgttcaacgcccgtctgttcagcaaaagcctgatggatcagcggagatttactgtggttgatcggattaccgaaaacggcgaattgatccatgaattagccctgacgtataagttcgccgctgatgacatcgcggatttcagagggattgagccgcccacctgtttttcccgacagaaccgggaactgctcaccaaactgctgcttcacttcttcagccgttcggcagggaggcaggcctgacagatttgcactggttgagaccagcggtttaccaaatgcgcggcaaagggcctgcacatcaggatggtcactgacgcgaatggccagtgaatcaaactgtccggtaagccagcgaggcgtttgtggcggaaacgggtgcgacaaaggtcaccgggccgggccagcatgcaaacatccgctcacgctgtatcacagacagttcccgagcggagatgtaaggttccagctgggtgtaatcagccgcaatcaggataagccccttttctaccggacgctgtttcagcgccagtaaagccatgacggcagattcactgtcagggtcacagcccagaccaaatacggcttcagtaggataggcgatgaccgcctgtcgattcagctgctctaagcaggtttcaagtgaatcggcgaggtgttgattttccatggtctatgaattctcttcagcaatggctttgccacaacttttactggcgcaaaagcgtttgatcccttgggccgtctttttttcaactaatagcggatactggcaataaggacagattccggcaacgggtgtcagattcacaacaaactggcaggctggatagcggtcgcaggagtgaaacgttttgccgtaacgggagcgccgctgaactaaccggccttcatggcactgtggacaggccagcgaggtttcatccggtttgtcgatggtttcggtgtatccgcattccggatagaggctacagccaatgaacatgccaaatcgcccctgccgcaacactttatccgcaccgcattcgggacaggcgtggccttccagcactttgaccacatgaccatcggcctgaccctttaagggtcgaatgtagtcgcatgccgggtagttcgcgcagcccagaaaaggaccgtgtttaccggagcggataaccagttctgccccgcaagcggggcagggatcctgtttacgcacggtgaagagtgcagctttactcatagcgatcaatgcatgaaaggaaatttaatgcagcataccttcattggcgtcgaatagcagttcttccatctgctgataggcattttcacatccgggaatgttgaacaacaccatcagtaccacccatttgagatcctccaggtcaaactcagaggtatccagcgccataatgcgttcgatgaccatttcacgcgtttccaggttcagcacctgaatctgctccaggaacagcaggaaaccacggctgtcagcatctaaacgtttgctctcttcatcggtataaatacgcatggagagcggatcatttgtcagtaaaattggcgcaaccagtccttcctgatagtcagccaatctttctaaccagttcagcgcactgtaaatatcttcacgatggaacccggcatccgtcaggtcgtctgtcaatctgtcctgatcaacacccatttctgcttcgttgtggatatatgtctcaaacaaatacatcagtacgtcgaacatggcatgccctcctcaatcggacatagccgccgggtacagctgcgatccatcctgctaactccagttccagcaactgagctgagataactggcacagattggccggcacgttcagcgacaacgtcaacaggtgtaacatcatcacctacgttagccaacacatcagcaaatggcaatggagcatcgtcactcacctcagaataaatttcaccggccggtgtcatcggcagccagttaagtgcacttgccagatcttccacgatgttatggggatgggccaccagcagcgccccctgctgaatcagccagtttacgccttcgcttaacgggttaccgagcgcgccaggtaaggcatagacattacgattttgctccagcccataccgcgccgttaccagggaaccactcttcagcgaggcttctaccaccagcaccccatggctcaggccgctgataatacgattacggcgcggaaaattaagcggatgcggcagggtcgtcagcggaaactcagaaaccaccgccccaccctgttcaacgatctctgcggcaagatgggcatgattgctgggatagagccgctgcaatccactacctaacacggccaccgttttaccgcccacgttgagtgctgcctgatgcgcaacaccatcaataccccttgccagtccgctggtaatggtcagaccgctgaggcttaagtgctgggtaaaccagtcgcaccagtagcggccatagtgtgaacagtttcggctgcccaccaccgctaactgtggtgtgctgataagcgcaggatcgccatcaatatagagcagcggcggaaagcggttggtttctttaagacgggcaggataggccgcgtccagagcagtcaccagatgatgagccggactctgatccagccaggaatagacttctgtgagattattttcattaaaatcatcatattgctggcactggctctcatctaagccaagccggataagctgctccctgtctgcctgtccggcacctatttgctgcgccacatcaacccagcgttttcctgtcattccagtgacggcggccagccgtacagactgcgctattttgtccatcttcagctccctgatcgcccttgcttcctgccgcagaatgctgtcaatcaggcctcgaaaagtctacaatataaggtagtaatcttttcttaaccgaatacagatctggatatttatgtcagttttgcaggtattacatttccctgacgagcgtcttcgcaaagttgctgcgcccgttaaagaagttaacgcagacattcagcgtatcgttgatgatatgttcgagacgatgtatgccgaagaaggtatcggtcttgcggctacgcaggtcgatattcatcagcgcattatcgtgattgacgtctctgaaagtcgtgaagagcgtttagtgctgattaaccctgagctgctggaaaaaagtggtgaaaccggcattgaagagggttgcctctctattccggaacagcgcgcatttgttccgcgtgccgagcgggtaaaggtccgtgcactggatcgcgagggtaaaagtttcgaactggaagccagcgagttactggccatctgtatccagcatgagatcgatcatctggaaggcaaactgtttatcgattatctgtcgcctttaaagcggcaacggatcaaaaataaattagagaaactggcgcgtcagaaacgcgcaggcttcctgagatcttaataagggataaacgtgtctgccccgctaaaaatcatctttgctggcacacctgactttgcagcgcgtcatcttgacgcgctgcttgcttctgaacatcaggttatcgccgtattcacccaacccgaccgtcctgctggtcgcggtaacaaattaacgccaggcccggtcaaaacgctggcgatggcacatgacattccggtttatcagcctaagtcactgcgacctgaagaaaatcagcaactggttgctgacctcaaggccgatgtgatggtggttgtagcctacggattaattctgcccaaggccgtgcttgatatgccacgtctgggatgcatcaatgtccatggctcactgctgccacgctggcgcggagctgcgcctattcaacgtgcgctctgggctggcgacagcgaaaccggcgtgaccatcatgcagatggacgtgggactggataccggcgatatgctgcataagctggcctgtccgattactgcccaggataccagtgccacgctgtatgacaagctggcacagcttggcccacaggggctgctggatacgctgacattactgaccactcagcaggcttcacctgaaaaacaggatgaaacgctggccaactatgctgagaaactcagtaaagaggaggcacgtcttgactggacactctctgcagaacagcttgagcgttgtattcgcgcttttaacccgtggccgatgagctttttcaccattgaagatcagccggttaaagtctggcaggcaagcgttctgccccacagcgatcgtgcgcctggtgaaattatccatgctgacaagcatggcatccaggtggcgacggctcagggcgtactgaacctgctccagttgcagcccgccggtaaaaaaccgatgtcggctcaggatcttctcaactcgcgccgggaatggtttgaacctggaacccttctggactgactctcaggcccggtccctcaccgggccttttgtttgatgacaaaaccctatgactaaatctatcaacctgcgtagcctctcggctcaacttattgagcgtgtggtcgacaagggcgaatccctgaatacggcactgccagccgcccagaaaaagctctctgacaaagatagcgcgttagtgcaggagatctgttttggcgtattgcgcacattaccgcagctggaagcgctcattggcaaactgatggagcgtccacttaccggcaaacagcgggttctgcactatctgatcatggtcgggctttatcagctggaatatacccgagtgcccgcccatgccgcactggcagaaaccgtcgcgggcgccgaagtactgaagcgcaccagtatgaaaggcttattaaatggcgtattacgccagtttcagcggcagcgggaagagctgctcgccactgttcaggatggcccgcagcgctatctgcatccgggatggctgctaaagcgtttgcagcatgcctggccggaacaatggcaacagattgtcgaagcaaataatctgcgtccgccgatgtggctgcgggttaatcgccagcaccacgatcgtgacacgtggctggcaatgctggccgaaagcggcaggaatgcacagcctgctgtcgatgtgccggatgcgctgcggcttgacgcccctgccccggtcagccagctaccaggctttgatcagggttgggttaccgtgcaggatttatctgctcagcgctgtgccttgctgcttgagccccaaaacggcgaacagattctggatttatgcgctgcgcccggcggtaaaacgacccatatccttgaaatcgcgcctcaggccgaagttatggccgtcgacgtggatgcgcagcgtcttaaacgcgtaaatgagaatctgcaacgactgggtatgaaagcagacgtgaaacagggtgatggacgaaacgccgcaacagtggtgcggcgatcgtcagtttgaccgtattctgctggatgcaccctgctctgctaccggtgtgatccgacgccatcccgatattaagtggctgcgtcgcgatcgggatatcgccgagctggcaaaacttcagggtgaaattcttgatgctatctggccgcacctgaaacctggcggtacactgatttatgccacctgttccatcctgcctgaagagaatcatcagcagatagatgctttcctgcagcgccagcatgatgcgcaggcagagcccctcagagatgcgcccgcgaacggcttacaggtattcccggaagccgagggcggagatggtttcttctacgctaagctgataaaaaaatcgggtacaaactgaaatgagtattgataagcgatgaaaataatcattctgggcgcaggacaggttggcggaaccctggcagaaaatctggtgggtgaaaacaacgatatcacggtggttgataccgactcttcacgcctgcgtcacctgcaggataagttcgatcttcgcgtcgtgcagggtcatggttctcatccacgcattttacgtgaggcgggtgcagaagatgccgacatgctggttgccgtaaccaactccgatgaaaccaacatgattgcctgtcagattgcttattcgcttttcaatacgccgaatcgcatcgcccgtattcgcgcagccgactatctgcgtgatgcggacaagttatttattcctgaagcggtgcctatcgatcacctgatctcgcctgaacagctggtgatcgacaatatctatcgtttaatccagtaccctggcgcattgcaggtcgtcaactttgctgaaggcaaagtcagcctcgccgtggtgaaagcttattatggcgggccactggtaggaaatccgctgtcgatcatgcgtgagcatatgccacacattgatacccgcgtagccgctatatttcgtcaggatcgccccattcgcccgcagggttcaaccatcgtagaagcgggtgatgaagtctttttcattgcagccagtcagaacattcgtgcggtaatgagtgaaatgcagcggctggagaaaccttataaacggattatgctggtaggtggtggtaatatcggtttcggcctggcacaaaaacttgagaaaaattacagcgtgaagctgattgaacgtaaccctcagcgcgcagcagaaactggcagagcatcttcacgacacagtcgtcttttatggcgatgcgtcagatcaggaacttctcgctgaagaacatgttgatcaggttgatctctttatcgccgtcaccaacgatgatgaagccaatattatgtcagccatgctggcaaaaaagatgggggcgaagaaggttatggtgctgattcagcgccgcgcctacgtcgatctggtacaaggcagcgttatcgatatcgctatttcacctcagcaggccacgatctctgccctgcttggtcatgtgcgcaaagcggatatcgtgggcgtttcatcgctacgacgcggtattgcagaagcgatcgaagcgatagcgcacggagacgaatcaacttcacgcgtggtcggccgctccattgatgatatcaaactaccgccaggcaccattattggcgcagtggttcgtggagacgatgtgatgattgccaatgataacctgcgaattgaacaaggtgatcatgtcatcatgttcctgaccgacaagaagtttgtatcagatgtggaacgtctcttccagccgagtccatttttcctgtaaatgccgcgtttacaggcgaacagaacacaaggaacgcaaaactgccgcttaattcgctgtgttgatggcaaaaccagtagggtttgttagactttatggcattggcttgggcaaggagataagtatgagtttaatcaaagagtttcgcgatttcgcaatgcgcggcaatgtgatggatttagccgttggtgtcatcatcggtgctgcattcggtaaaattgtttcatcgttagtcgccaacatcattatgccgcctttaggcttactgattggtggtgtcgattttaaatcattcgcctgggtacttaagcctgcagttggtgatgctccagccgttgttatgcagtacggtatcttccttcagaccatcttcgatttcgtcatcatcgctttcgcaatctttatggcgatcaagttaatgaatcgtctgtacaagaaaaaagaagtagagaagccagtggctaaaccgtcaaacgaagaagttctgctgactgaaatccgcgatctgctgaaacagcagaatacccgggtctagttaataagccgccgcacaggcggtttttttaaccgtaaaagcagaagggcagtgataagacgctttcttatcactgccctcccatccagtccccttgccatgtttctctttccgcttaaaactacctttacccttttgcttctgctcgatgcgttgccgaaatagcgggtcgtgtaacagagcctgaatcgcgttatcgcggatttgccctttggtgtgctgatatttactcatgacgcctcctgttgagatggtctgatactctattcctttgcagcaaaataacaatatgcttatttgctcgaagcctctccccgctccagcgcctcaagaattgagcacgaaatgctactgtgactgtcaccacaacaggcatcggaaaggtgtcgcagagaaacgctgcatcgtttctaattctgcgatcatctgagcaacttcgctcagccgtttttcaacgatcgcttttgattcctgacaggtgtggtgcgcaggatcaacccggatcgaaagtagctctctgatcgcttccagactgaaacccagtttacgaccataacgaataaatttcagacgctgaagatcgccctcgctgtaaaggcgaaaaccaccttccgtccgaccatcatgatccatcatctgctgcttttcataaaaacggatagtgtctggcgtcacctccgcaagcttagctaactgaccgatgcgaaacatttactcctcctcgcggaaacgatgctgaatagcagtggaataactgccatggagaaagtcggtactgatacccgcctggcgtaatcttagctccagcacctgaagccgatggcaatgatcctgataattttgatccgcaggatcgaggttacgaagaagatcgttaacttccatggcttcacgtctgagctcaagctccggcggcagaaagcccgcatttttcagtaaacggtagcccgctcttaactcaggcggaacatgactgtcatcatccagctgcagcggcttaccagagccgggaagattactcagctcgcctttttccagcgccgctttgatgtactgttcagcaagttcatcaaccagccacatagttagctcctttgaacatgaaaagagtaagttctaaggtagtaaatttcaggcaataaaaaacccgccgaagcgggttttttacgttgctacagattactctgcggctgcttctgcttgagcttctggacgatcaaccaactcgatgtaagccatcggagcgttgtcaccagcacggaagccacacttcagaatacgagtgtaaccaccggcacggctcgcgaaacgcgggcccagctcattaaacagttttgccacgatctcgttatcacgagtacgggcgaatgccagacgacgattagctacgctgtcggtcttggcaagagtaatcagcggctcaactacgcgacgcagtttctttggctttcggcagagtcgttttgatgatctcatgacgaaccagagaaccggccatgttgcggaacatagcctgacgatggctgctgttgcggttcagttgacgaccactcttacgatggcgcatgaccttatccttctcagtgaaaccttaacctgtgatctgattattcatcagcaatgcttgctggcggccagttctcgaggcgcatgcccagagaaagaccacgcgaagccagcacatctttaatctcggtaagagattttttaccaaggttaggcgttttaagcagctcaacctcggtacgctgtaccagatcaccgatgtagtggatagcttctgccttaaggcagttagcagagcggacagtcaattccagatcgtcaacagggcgcagcaggatcggatcgaattctggtttctcttctttaacttccggctgacgtacatcacgtaagtcaacgaaagcttcaagttgttctgccagaatggttgccgcacgacgaatcgcctcttcaggatcgattgtgccgttggtttccatttcgatgaccagcttgtccaggtcggtgcgctgctctacacgcgctgcttcaacattgtaggcgatacggtctacagggctgtagcaagcgtcaactaacaggcggccgattgggcgctcatcttcttccgaatgaattcgggcagaagccggcacatagccacgaccacgctgaactttgatacgcatgctgatagcagcgtttctcatcggtcagatggcaaatgacatgctgaggcttgacgatttcgacatcaccatcatgggtaatgtcggctgcagtcacagggccaatgccagatttattcaaggtcagaataacttcatctttcccctgaactcttaccgccagccctttcaggttgagcaggatttccaggatatcttcctgtactccctctttggtgctgtactcatgaagtacaccatcaatttcaacctcggtcaccgcgcaacccggcatggatgaaagcagaatacggcgcagtgcgttaccaagagtatggccaaagccacgctctaaaggctcaagggtcaccttggcgtgcgtcgaactcacttgctcgatatctaccaggcgcggttttagaaactctgtcacagaaaccctgcattgtgtcctctctttggtactaagccttacttggagtaaagctcgacgatcaggtgttcgttaatgtccgcagacagatcagtacgttcaggaatacgcttgaacacaccttccatcttagtcgcatcaacttccagccaggttggcttttcacgctgctcagccagctccagagcggccttcacgcgagattgctttttggctttctcacggatgctaacgacatcattcggagatacctgataagaagcgatgttaacaacgcggccatttaccagaacagacttatggctaaccagctgacgtgcttctgcacgagtggcaccaaagcccatacgataaactacgttgtccagacgaccttccagcagagccaacaggttttcaccggtgttgcctttcagacgagctgcttctttataatagttacggaactgacgctccagcacgccgtagatacgacgaactttttgcttttcacgtaactgaccgccgtaatcagacagacgcggtttacgcgcaccatgctgaccaggggcttgttcaatcttacacttggaatcaatcgcgcgaaacgccagacttaaggaataagtcagtgccctcacgacggctcagcttgagcttaggacccaaatatcttgccattttctttctccaactatcctaaaaaaacgggcgttatacgcgacgttttttcggcggacgacaaccgttatgagggatcggagtcacatcagtaatattagtgatgcggaaaccagcggcgttcaaagcacgaatcgtagattcgcgacctggacccggaccctttaccataacttccaggttcttaattccgtaatcttttaccgcttctgcacagcgctctgcagcgacctgagcagcaaacggagtggatttacgtgaaccgcggaaaccggaaccaccggcggttgcccaacccagtgcgttaccctgacgatcagtaatggtaacgatggtgttgttaaaagaagcatggacatgagccacgccatctgagacttgttttcttacacgcttacgtgcacgaactggtgcctttgccattatttactcaccccgattatttcttgatcggtttacgcggacccttacgggtacgtgcgttggtcttagtacgctgaccgcgaaccggaagaccacgacgatggcgcaaaccacggtagcaaccaaggtccataagacgcttgatgctcagggtgatttcacggcgcagatcaccttctacaacgaatttcgcaactgcatcacgcagctgatcaatttgttcttcagacagctcactgatcttaacattttcagcaatacccgttgaagcgcagatggctttagaacgagttttaccgataccgaagatcgaagttaatgcgataacggtatgtttttgatcaggaatgttaatgcctgctatacgggccactatgcactcctataattaaacaagcacgtcccatgctgaaaagcccgttttcaggatactcaaatggaaacgcactgacatacaaaagattggctggctaatctagccagctcaacccgactttgcaagaaaaatatgtgacaaaatcagccttggcgctgtttatgctttggctcggcgctgcagatcacacggacgacaccgtcgcgacgaatgattttgcagttacgacataatctcttgacggaagcacgaactttcatttttactctccgtaacttctcaaccaactgaattaacggccgtagcctttcaggttagctttcttcagtgccgactcgtactgacttgacatcatcagagtttgcacttgagccataaagtccatgatgacgacaactacgataagcagtgaagtaccgccaaagtagaagggaaccttcatcgcatcacgcatgaaactccgggataaggcagataaacgtaatgtagagagcgccgattaaggtcaatcgcgtcattactttatcaatatacttcgccgtttgctctcccggacgaattcccggtacgaatgcaccagacttcttcaggttatctgctgtttcacgtgggttgaaaaccaacgccgtatagaagaaacagaagaagatgattgcagtcgcatagagtagcacataaagcggctgtcctggctgcaaatacagcgaaattgttgtcagccagttccaaccggtaccgcccccaaaccacgatgcaatcgttgccgggaacagaataatgctggaagcaaaaatggctggaatgacgcctgccatgttcactttcaacggtaaatgtgtgctctgtgcagcgtaaacgcgacgaccttgctgacgttttgcgtagttcaccacaatgcggcgttgaccacgttcaacaaagataacaaagaaggtcactgcgaatacgagtactgcaaccaacagcaacagaaggaagtgcaggtcgccttgccgcgcttgctcgatggtatggccaatggccggcgggagacccgcaacgatacctgcgaagataatgatcgaaataccgttaccgataccacgttcagtaatctgttcgcccagccacatcaggaacatcgttcctgagaccagactcacaacagcggtaaagtagaaagcaaagcctggattcattaccaggccttgcatccctggcatattcggcagaccggtagcaataccgatcgactgaaatatggccaataccaacgtaccgtatcgggtgtactggctaatcttacgacggccagcctccccttctttcttaatttccgctaacgctggatgaaccaccgttaataactggatgataatcgatgccgaaatatacggcatgatgcccagtgcgaaaatagaagcacggctcagagcaccaccagagaacatgttaaacatttcaatgatggtgccacgctgttgctcaagcagtttggcaagtacagtggcatcaataccagggattggaataaaagagccaatacggaagacaatgagtgcgccgattacaaacagcagtctgcgtttcagctcaccaaagccacccttggcactttgaaaatctaatcccggttgtttagccatctgctacttattcctcgattttaccgccagcagcttcgattgcagcacgtgcacctttggtgacacgcagaccgcgaaccgttaccggtgtagaaacttcaccagacagaattactttaacgaattcaatctgaacaccgacaatgttggctgctttcagcgcgttcaggtcgacgataccgccttcaactttcgccagatcagacagacgaatctctgtggtgatcattgctttgcgagaggtgaaaccgaacttcggcagacgacggtacagaggcatctgaccaccttcgaaaccgcgacgtacgccaccgccagaacgtgagttctgacctttgtgaccacgaccaccggtttttccgaggccagaaccgataccacgacccagacgcttggtagcgtgcttagacccttcggccggagacagagtatttaaacgcatctcttactcctccactttaaccatataggaaaccgcgttaaccataccgcgtactgcaggcgtgtcttcacgctcaacggtgtggccaatacgacgcagacccaggccaaccagagtggctttatgcttaggcaagcggccgattgaactacgggtttgagtgattttaatagtcttagccatcgtgattaccccagaatttcttcaacggatttaccacgcttagcagcgaccatttccggagatttcatattgcccaggccgtcgatagttgcacgaaccacgttaatcgggttagtagaaccataggcttttgccagtacgttatgaactccagcgacttccagaacggcgcgcattgcaccaccggcaataataccggtaccttctgaagccggctgcatgaacacgcgggaacccgtgtgtgcacctttaactgggtgctgcagggtgccgttggtcagcgcgacgttaaccatgttgcgacgggctttctccatcgctttctggatcgctgctggaacttcacgcgctttaccgtaaccaaaacctacgcgaccattaccatcgcctaccacagtcagtgctgtgaaggagaagatacgaccacctttaacagttttagaaacacggtttaccgcgatcagtttttcctgcagttcgccagcttgtttctcgatgtgtgccatcttagacctctaccttagaactgaaggccagcttcacgggcagcatctgccagtgcctggacgcgaccatgatattggaaaccggaacggtcgaaagaaacaccagtgatgcctttttcgattgcgcgttctgcgatagctttacctactgcagctgcggcttctttattaccggtatacttcagttgttcagtgatagctttttctacagtagaagcagcgaccagaacttcggaaccgttcggggcgattacctgtgcgtaaatatgacgcggggtacgatgtaccaccaggcgagtagcacccagctctttgagcttgcgacgtgcacgggtcgcacgacggatacgagcagatttcttatccatagtgttaccttacttcttcttagcctctttggtacgcacgacttcgtcggcgtaacggacacccttgcctttataaggctcaggacgacggtaggcgcgcaagtccgctgcaacctgaccaatcagctgtttatcagcgcctttcagcacgatctcagtctgagttggacattctgcagtgatacccgcgggcagctggtgatcgactggatgagaaaagcccagagacaggttaaccacgtcgcctttaacggctgcacgataacctacaccaaccagctgcagcttcttagtgaagccttcggtaacaccgattaccattgcgttcagcagcgcgcgagaagtacccgcctgcgcccagccgtcaacgaaaccttcgcgcggagcgaaagtcagagcgttgtcagcatgcttaacttcaacagcatcattgatagtacgagtcagctcgccgtttttacctttaatcgaaattacctgaccgttgagttttacctctacgccggcaggaacaacgacaggtgctttagcaacacgagacatatgtatcctccgattacgctacgtagcagataatttcgccaccaagacctgcctggcgcgctgcacgatcagtcatgacacctttagatgtagaaactacagcgatgcccataccagccattacctttggcagctcatcttttttcttatagatgcgcagaccaggacggcttactcgctgaatgctttctacaacagctttgccctggaaatacttgagagtaagttccagttccagcttgatgtcgccttcgattttgaaatcttcaatatatccttcttccttcagaacgttggcaattgccaatttcagcttggaggaaggcatggtgaccgcaactttgtttgcggcctgaccgttacggatacgggtcagcatatccgcgatcggatcttgcatgctcatctgtgttactcccgtgattcaattggtgacaattaccagctagcctttttcaggcccgggatttcaccgcgcatggcggcttcgcggaccttgatacggctcaacccaaacttccgcaggaaaccgtgcggacgacctgtttgacggcagcggttacgctgacgcgaagggctggaatcacgcggcagactctgcagcttcagaacagcatcccaacgatcttcgtcggaagcgttcacatcagagatgatcgctttcagttcagcgcgtttagcgaagaatttgtctgctaattttgcacgcttaacttcgcgtgctttcatagattgcttagccattaagtaaccctaccttacttacggaacgggaagtcaaaggcagccagcagagcacggccttcatcatcagatttcgcagtagtggtaatggtgatatccaaaccacgaacgcgatcgactttgtcgtagtcgatttctgggaagatgatctgctcacgtacacccatgctgtagttgccacgaccatcgaatgacttagcggacaagccacggaagtcacggatacgtggaacagcaatggtgaccagacgctcaaagaactcccacatgcgctcgccacgcagagttactttacagccgatcggatagccctgacggattttgaagcctgcaactgatttgcgtgctttggtgaccagcggtttttgaccggagattgctgccaggtcagctgctgcgttatccagcagtttcttgtcagcgatcgcttcaccaacacccatgttcagggtgatcttctcgacccgagggacttgcatgacagaattgtagccaaactctgtcatgagtttctggactacttcgtctttgtagtaatcatgcagtttcgccatcgtactactccaaattacttgatagtttcgctgttagacttgaagaaacggacttttttgccgtcttcgaatctaaagcctacacggtcagccttaccagttgccgcgttgaacagtgcaacgttagaaacctgaatagcagcttctttttcaacgatgccacctggttggttcagagccggaaccggcttctgatgtttcttcaccaggttgataccttcaacgatgaccttaccagaagacaggacattcttaactttaccgcgcttacctttatctttaccggttaacacgataacttcgtcgttacgacggattttagctgccattgttcgctccttagagtacttctggtgccagagagataattttcatgaacttttcagtacgaagttcacgagttaccggcccaaaaatacgcgtaccgataggctgctcactgttattgttcagaataacgcatgcattaccatcgaagcgaatgacagaaaccgtccgggcgacgaacacccttcctggtgcgcaccactaccgccttcaggacatcaccttttttgactttaccacgcggaattgcttccttgatggtaactttgatgatgtcaccgacgcctgcgtagcgacggtgcgagccacccagaaccttgatacacattacgcgacgtgcaccggagttgtcggcgacgttcagcatagtctgttcttggatcattttagtgctccgctaatgtcaactactacttcgggacctaaacctcaggtcgttagaaagccccataattgagggcgcggcattgtaacaccggttctcacagatgggtagaaaaaataaacggctctcaatcgagccgctgatttcccctgatgacagggagggcgtattctagggaatagtgcgaacagtagcaaatgtaatctgccttatttttcgtcgcctcccaaataaagtgcccttctgactcaaccagccagtttcctggccagttggttatgctgacgcaacacggctggcagttcaattccggccacttgtccgtcccgtacccggacttttccgttaatgatgctataggcaacctgtcccggattacagaacaccagggcggctacaggatcgtgccctgccccggcaagtccaattcgattcaggtcaaaaatggccagatcggccatcatgcccggcgcaatggtgcccacatcatcgcggtttagcacctttgctccacccagcgtcgccagttccagtgcctgacgtgccgtcatcgcatccgggccgaagccaacgcgttgcagcagcatcgcctgacgaacttcggccatcatgtctgagctgtcattggaggctgagccatccacacccatacccacgtgtacgccggcatcacacatatggcgtatcggcgcaataccggaaccgagacgcatgttcgagcagggacagtgcgcgacgccggtaccggtacgtgcaaagagttctatgccatgctgatccagtttgacgcagtgtgcatgccagacatccggtcctacccagccgaggtcttcaacatactgtgctggcgtcatattgaatttttcacggctataacgaatatcgctgtcgtttctccgccagatgggtatgcatagagacattgaagctgcgtgccatcgctgcggattgcttcatcagctcacggctgactgaaaacggcgaacatggcgcaaccacgatgcgtaacatcgaaccgtggctgtcatcatggtagcgctcaatcacacgctgcgtatctttaagaatggcggcttcatcctctaccagcgcatcgggtggtaagccacccagggacttaccgacgctcatgctgccccggctcgcatggaaacgcatgcccattaaggctgcagcctcaatactgtcgtcaagcttacagccattcgggtagacgtagagatggtcactggtagtggtgcagccggagagcattaactcggccatggagatctgtgttgagatatgaatcatctcaggcgtcagattctgccacagtggatagaggtgggtcagccagttaaagagctcgccgttttgcactgcaggaatagcgcgggtcaggctctgatacatgtggtgatgcgtattgatcaggccagggatgacaatatgtcctcgcagatcgatgatctcatccgcgctatcaggtaacgagcgtgcttccccgactgcaaggatcttatttccttttatcagaatagaggcgttacctatttccctacggtcagcatccatgcagaccacacattcagcattcttcagtaacagagttcgttccatgctattgcctgtgggtagtggttgtgtgttacccgataatagcggcaagcttttggcagagctaatcgcaggtaacgcagctaacagtggcaattttaacagtgaccggcgtaagcggtcatgactctccattttcacggcacatttccttgtacagttatgataaccccggcgtttatagcctggcgttttcaggccacctcgcctgaagagaggcagcttaatccctgcaagcccctgaatttgtgagcaccatcaaatccgtattgccacgggcacaaatggatcaagcccgaatcgcaggcaaaaaaaaaccccctgccgaagcagagggtttcctcagaaaaaacgattcttattacagaacagctttctcgattacgcgaaccagggtccaggatttagtcttggacagtggacggcattcgcggatttctaccacgtcaccaattccacattcattgttctcgtcatggatgtgcagcttggtcgtacgtttaatgaatttgccgtagatcgggtgtttcacgaaacgttcgatagcaacaactgcagatttctgcattttgtcacttactacacgaccctgcagagtacggattttatcggtcattacgaacccgccttctcagtcagtaaagtcttaacgcgtgcaacatcacggcgaacctgtttcagcagatgagtctgctgcagttggccagatgctgcctgcatgcgcaggttaaattgctcacgcagcagattaagcagctcagtgttcagctcttcaacgcttttttcacgcagctcagttgctttcattacatcaccgtcttagttacaaaggtggttttgataggcagttttgctgctgccagcttgaatgcttcacgggccagctcttctggtacgccgtccatttcatacaggactttaccaggctggatcagggcaacccaatactctacgttacccttacctttacccatacgcacttccagcggcttctcggtgatcggtttatccgggaatactcggatccagatcttaccttgacgcttaactgcacgggtcatagcacgacgtgctgcttcgatctgacgagcagtcagacgaccacggccaacagctttcagaccgaaagtaccgaagctgacatccgtacccgcagccagaccgcggttacggcctttgtgcactttacggaatttcgtacgctttggttgtaacatcagcgactctccttacttacggcctttacgctgctgctttttaggttgagcagccggttccggttgttcaacagcagccataccacccaggatctcacctttgaagatccataccttaacgccgattacaccataagtggtgtgcgcttcagaggtgttgtagtcaatgtcagcacgcagtgtgtgcaatggcacgcgaccttcacgataccattcggtacgtgcgatctcggcgccacccagacggccgctaacttcgactttaatacccttcgcgccaagacgcatggcgttctgaactgcacgcttcatagcacgacggaacatcacacgacgctccagctgtgaagtgatgctgtcagctaccagtttcgcgtccagttccggcttgcggacttcggcgatattaatctgtgcaggaaacgccagcgatattcgcgacgaccgtgcgcagtttttctacatcttcgcctttcttaccgataacgatgcccggacgagcggtgtgaatagtcacacggatgctcttcgctggacgctcgataacgatacgagagacagatgctttagccagttctttagtcaaaaactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtaatgtggctggtgcgcttcaggatgcgatctgcacgacctttggcacgcggcataatgcgtttcatggtcggaccttcatcaacgaaaattttcgtgattttcagatcgtcgatatcagcgccatcgttgtgttcggcgttagcaatggcagattccagaacttttttgaccagtacagccgctttcttattggtgtaggtcaaaatgtccagtgcctgcgacactttcttaccgcgaatcaggtcagcaacaaggcgaaccttctgagcagaagaacgagcgtggcgatgttgagctaaagtttccatctcttcctcctacttatttcttcttggcttttttatcagccgcgtgaccgcgataagtacgtgtcggcgcgaattcacccagtttgtgaccaaccatttcgtcggaaacaaagacaggaacgtgctgacgaccattatggacagcgatggtcaaaccgatcatgttaggaaagatcgttgaacgacgggaccaagtgcgcaaaggcttcttgtcaccgctttccaccgctttctctaccttcttcagcaagtgcaggtcaataaaaggacctttcttgagagaacgtggcatggcttatcctctaatattatttgctacggcgacgtacgataaacttatcggtacgcttgttgctacgggtcttcttacctttggtctgaacgccccacggagttaccgggtgcttaccaaagttacgaccttcaccaccaccgtgcgggtgatcaactgggttcatcgcggtaccacgaaacggtaggacgaacaccacgccaacgggctgcaccagctttacccagaacgcgcagcatatgctcagcgttgccgacttcgcccagtgttgcgcggcagtcagactcgactttacgcatttcacctgaacgcagacgcagggtaacgtaagaaccttcacgcgcaacgatctgcacgtaagcaccggctgagcgagcaatctgaccgcctttgcctggtttcatttctacgttatgcacggttgaacccaccgggatgttacgcatcggcagagtgttacctgctttaatcgcagcatcaacgccagattggatctggtcgccggctttcaggcctttaggggccaggatgtaacggcgctcgccgtctttgtacagaaccagtgcgatgttcgcagagcggttcggatcgtattcaagacgttcaacaactgccgggataccgtctttgttgcgtttgaagtcaacaatacgataagcctgcttgtgaccaccaccgatatgacgggtagtgatacgaccattgttgttacggccaccggatttgctgtttttttctaccagcggggcaaatggtttgcccttgtgcagctccgcgtttaccactttaactacatggcgacgacccggagatgtcggtttacatttaacaactgccattgtctttctcctccgacttactcagcgccgccagcgaagtccagattctggccttctttcagggtgacgtaagcttttttccagtcgctacgacgaccgatacgctgtccttgacgcttaactttgcccttaactaccagggtgtttacgtctttaacttctacttcgaacagtttctcaacagcagcaacgatctctgctttggtcgcgtcattagcaactttgagaacgatggtattggttttttccatcgcgctagatgctttttcagatacgtgcggcgcgcgcagtactttcagcagacgttcttcacggatcatgccagcatctcctcaacttgcttaactgcatcagcagtcataacgactttgtcgaaggcgatcaggctaactgggtcgataccggatgcatcacgtacgtcaaccttgtacaggttgcgcgcagccaggaacagattctcatccagttcaccggtgatgatcagcacgtcttccagagccatgtctttcagtttctgtaccagcagcttggttttcggtgcttctacagcaaatgattcgacaacgatcagacgatcttgacgtaccagttcggacaggatgcttttcagcgcgccgcggtacatctttttgttaactttttgactgtggtcctgcggcttcgcagcaaaggtcacaccacctgaacgccagattgggctctttacagaacctgcacgcgcacggccggtgcctttttgacgccatggctttttgcctgaaccggttacttcggcgcgagttttctgcgcgcgagtaccctggcgggcgccagatgcgtaagcaacaacaacctggtgaaccagcgcttcgttgaaatcacgaccgaaggtagtttcggaaacagtcagcgcgctctgcgcgtctttcaatactaattccattgctatccccttacgccttcacagctggtttaacgatcaggtcgctaccggtagcaccgggaactgcacctttaaccagcagcaggttgcgctcagcgtcaacacgtactacgtccagactctgaacggttacgcgctcattacccagctgacctgccattttcttgcctttaaacactttgcccggagtctggttctgaccgatagaacccggaacgcggtgagacaaggagttaccgtgagtagcgtcctgggtacggaagttccagcgcttaacggtaccggcgaaacctttacctttagaggtaccggttacgtcaactttcttaacttcagcgaaaatctcaacgctgatgctctgacctacagagtattcttcaccttcagcggtgcggaattcccacaggccacggccagcttcaacgccagctttagcaaaatgaccagcttcaggtttggtcacacggtttgcttttttagcaccggtggtaacctgaattgcctggtaaccatcgttttccaggcctttgacctgagtaacgcggttcgcttcaacttcgattacggtgacggggatagaaacgccatcttcagtgaagatgcgggtcatgcccacttttttaccgactaaaccaatcattgtttcaacctctcaatcgctcgatgacctgattaacccaggctgatctgcacgtcaacaccggcagccagatccagacgcatcagagcatcaacggttttttcagttggctcaacgatgtctaccagacgcttgtgagtgcggatttcgtactgatcacgcgcatctttgttaacgtgcggagagatcagaacagtaaaacgctctttgcgggttggcagcgggattggaccacgaacctgcgcaccagtgcgcttggcggtctcaacgatttccgcggttgattgatcgatcagacgatgatcaaacgctttaagacggatacggattctttggttctgcatgagaccagagctccaaactttttatagacgaaaaaaattactactcgagcccattacgattgatgggagagtgtaatcgttcagcatataactccacaattgggagtattgtcaggcggcctaaatttcagccgtctgcgattctgctcgaatcgcgcctgcaatatctgcaggcccgcgcattatacgtaaatctgttcaggaagcaacccgtgttgaggttttacccattaaattgtggccggttcgtgaagcgtgcgtcgcattgcactgccgtatcgctgataaatcagttattcagttgtgactctgtttccgcccttcttcattcataggtgacacagaacccgttgcccacgagagtgcatctaacctttcgtccggagcataatcatgtcgcccactctgataactcacattgctgcactcgcaggcggaggtgcattgggaagctttctttctctgaccagccagcgcttcacccccgccctctcacccgctcaatggtttgccctactctgctttccgggttcgcactgtaatcattgccagcagcgcctgctgtggcgagatgcactgccgttaataagctggcctggcttaaaagggcggtgtcgcttctgtcatcgcgcgttcggcgcagaaaacgttgtcattgaatggctgtttgcccttctgtgcctgctggtgctgcagagttttgaccactctgcggaggctatttttattattacggcctcaggcctcttgctgctcgtggctgccatcgatcgtcgccacttctgtatacctgacccgctcaattatctgctgctctggtctggattattccatgccacgctgtccggaaccgaaacaacggcgatatggggtgctgtggcgggctactgtgcgttgtggctgctcgcctggagctatcggcagatgcgagggtacgagggattaggttatggcgatatcaagctcttcgcagcgttaggtgcctgctgtggctggcaggcattaccctggattgcgttgggtgccaccgttatggcgctgacgtcgatcgtgatgctgcaactgcggggttttattcagggggacagcccgctgccgtttggccctttcctggccattgcgggctgggtagcgatagtactgcagacccgattcactcttgtttgatttgagcctgcagatagtttctggatgcccatcttctggattaactcaagttccgtctcaatccagtcgatgtgatgttcctcatcagccaggatttcaatcatcatgtcacggctgacatagtcatgcactttgtcagcataggagatagcttcacgaaggtctttcgcgccctccagctccagattcaggtctgaactcagcatctcttcaacatcttcaccgatacggagccgtcccagatcctgaagatttgggatcccttcaaggaaaagaatacgctcaatatatttatcggcatgtttcatctcatcgattgattcatggtattccacatcattgaggcgcgtcagaccccagtttttgaacatgcgcgcatgaagaaagtactgattgatagcaaccagttcatttccaagcagtttgttgagatgactgataactttgatatcgcccttcattgttaaccctccgcgtctggtttattagagcgtagatgcggttaaaaagaagtcaaaaaaactcgacagatattgtgggtattcacgcaccgatcgtcggtcaggctatctctttgtagagtggtgcatgctgcatctcttcatccataatttcacgcgcagcacgaatacatttgccgcattgcttgccgaccggcacaagctggcgcagttgctgaatagatttgggctgatagcgacgcacgacttcacgaagggttttatcactgatggcattacacaggcagacgtacattgattcatcactcgggtacattttctgtacacagtgtaaatgcgaatcgtttttatttcaaacccaccttttgcagggttatggcgttttcagagcaaaaaaaaagagcaccgaagtgctctttttactgtgttgcagtggccatttacacagccacagcagatatcacaattaagcgataactttagcaacaacacccgcgccaacggtacggccgccttcgcggattgcgaagcgcagaccttcgtccattgcgattgggtggatcagggtaacaaccattttgatgttgtcgcctggcattaccatttcaacgccttctggcagctctactgagccggttacgtcagttgtacggaagtagaactgtggacgatagcctttgaagaacggagtatggcgaccaccttcgtctttagacagaacgtaaacttctgactcgaactgggtgtgcggcttgattgagcctggcttagccagaacctggccacgctggatgtcttcacgcttgataccgcgcagcagaacaccacagttttcgcctgcctgaccctggtccagcagcttacggaacatctcaacaccggtacaggttgatttcacagtatctttgataccaacgatttcaacttcgtcgccgactttaacgatgccgcgctcaacacgaccggtaacaacggtaccacggccagagattgagaatacgtcttcgattggcagcaggaaacggcatgtcgatcgcacgctgtggctctgggatgtagttgtccagatgctcagccagttcgatgattttcgcttcccactctgggttgccttccagcgctttcagagcagaaccacgaacgattggagtgtcgtcgcctgggaagtcatatgctgacagcaggtcacgaacttccatctctaccagttccagcagctcttcatcatcaaccatgtcacacttgttcaggaacacgatgatgtaaggaacgccaacctgacgacccagcaggatgtgctcacgggtctgtggcattgggccatcagtcgcagcaacaaccaggatcgcgccgtccatctgcgcagcaccggtgatcatgtttttcacatagtcggcgtggcctgggcagtcaacgtgcgcatagtggcgagtcggggtttcatactcaacgtgtgaagtgttgatggtgataccacgtgctttctcttctggtgcgttatcgatctgatcgaatgcacgagcctggccgccgtaagttttagacagtacggtggtgatagctgcagtcagggtggttttaccgtggtcgacgtgaccgatggtgcccacgtttacgtgcagtttgttacgctgaaattgctctttcgccatggcgataattccttacgttgtgccttcaccatctgggtgaaggcatcagttcaaatttaaaccgtagcttatttgctacgagcttcaataacggcctgcgctacgttgtttggcgcatcgtcatacttcaggaaactccatggagtaagaagcacgacctttggtcagagaacgcagctgagttgcgtatccgaacatctcagacaacggaacttcagcgtgaatctgaacgccagtagcgttagattcctgccctttgagcataccacgacgacggctaaggtcaccgatgacatcacccgtgttctcttctggcgtttcaacttcaaccttcatgataggctcaagcagaacaggtgtcgcttgtttaaagccttgtttgaaggcaagagacgcggccagtttaaacgccagttctgaggagtcgacatcgtggtaagaaccgaagtgcagacgcacgcccagatccacaaccgggtaaccagccagagggcctgatttcagctgctcctggatacctttgtcaaccgcagggatgtattcaccaggaatcacaccacctttgatgtcgttgacaaattcgtagcctttcgggttcgaacctggctccagtgggtacatgtcgataacaacatggccatactgaccacgaccaccagactgcttggcgtgtttaccttcaacatcggtaactttgttgcgaatcgcttcacggtaagcaacctgtggtttacccacgtttgcttcaacgttgaactcacgcttcatacggtcaacgatgatgtcgaggtgcaattcacccataccggcgatgatggtctggttagattcttcatcagtccatacgcggaatgatgggtcttcttttgccagacggcccagagccagacccattttttcctggtcagctttggtttttggctcaacggcgatagagattaccggctccgggaactccatgcgctcaaggatgatgacgttatctgggtcacacagggtgtcaccagtggtcacatctttcaggccaatcgcagctgcgatatcacccgcacgaacttctttaatctcttcacgcttgttagcgtgcatctgaacgatacggcccagacgctcacggtttgacttaaccgggttgaacacggtgtcacccgtgttaacaacaccagagtaaacgcggaagaaggttaagttacccacgaacgggtcggtagcgattttgaacgccagtgcagcaaacggctcgttgtcatcagagtgacgaacagccggcgtgtctttaccgtcgtccagcataccgttgatcgcggtaacgtcagtcggtgctggcagatattcaacaactgcatccagcatcgcctgaacacctttgttcttaaatgcagaaccacaggttaccaggataatttcgttgttcagaacacgcttacgcagagatgttttgatctcttcttcagtcagttcttcaccaccgaagaatttctccatcagctcatcagagccttcagcagcggcttcaaccagcttcgcatgccattcttcagccagttcctgcatatcagctgggatatcttcgtagacgaaggttacaccctggtctgcgtcgttccagttgattgctttcattttcaccaggtcaacaacaccggtgaatttctcttctgcgccgatagccagctgcagaggaactggagttgcgcccagacgaacttccatctgtttaacaactttcaggaagttagcacccatgcggtccattttgttaacgaacgcaatgcgtggaactttatatttgttagcctgacgccatacggtctcagactgtggctgaacgccaccaactgcacagtaaaccattaccgcgccatcaagcacacgcatagaacgttcaacttcgatggtgaagtcaacgtgtcctggggtgtcgataatgtttacgtggtgtggttcaaactgcttggccataccagaccagtaacaggtggtcgcagcggaggtgatggtaataccacgttcctgtttcctgctccatccagtccatggttgctgcgccgtcatgtacttcaccgattttgtggtttacgccggtgtagaacagaacgcgttcggtagtggtagtcttaccggcgtcgatgtgcgcactgataccgatattacggtagcgggcaatgggtgttttacgagccatttgattcctctgattctcggacgttcaaggtaagtcgaccccagcgggttggctgattgagcgcccgctggtttaacaactacgtggtgattaccaacggtagtgtgcgaacgccttgttggcttctgccatgcggtgaacgtcttcacgtttcttaactgctgtacctttgttctctgcagcatcagaaagttcgttcgccaggcgaagagccattgatttatcaccgcgtttacgagcagcatctacgatccagcgcattgccagagcattacgacgaaccggacggacttctactggtacctgataagtagaaccaccaacgcgacgtgacttaacttcgacagtcggacgcacgttttccagggctacttcaaaagattccagcgcgtttttacctgaacgctgagccagggtctcaagcgcggtataaacgattgattctgcagtagattttttaccatctaccatcaggatatttacaaatttggccagcagctctgatccgaacttaggatctggcagaattttacgctgaccaatgacgcgacgacgtggcatggaaatactccgttgttaattcaggattgtccaaaactctatgagtttattatgacatttaatttaaaacgtttggccttacttaacggagaaccattaagcctttggcttcttcacgccgtacttggagcgagcctgcttacggtctttaacacctgagcagtcaagcgcgccacgaacggtgtggtaacgcacacctggcaggtcttttacacgaccgccacggatcaggatcacggagtgttcctgcaggttatgaccttcaccaccaatgtaggaggtaacttcaaaaccgttggtcaaacgcacacggcagactttacgcagtgcggagtttggtttcttaggagtggtggtgtacacacgagtacaaacgccacgtttttgcgggcaagcttccagcgccggcacgttgctctttgcaactttgcggacgcgtggtttgcgaaccagctggttaactgttgccattaaatagctcctggatttgcttttgcttcgtaaacacgtaataaatcgcctcgtagaattacgaggaggcagaattttagggctgagtcaaaggggtgtcaagaaataaccaggttttagccgattaccagaccatttgttgctgatgcctgatcgttagcgtgacaaacccagtatagtctactgactgcacacgggtcgaaatttgtccagcgagaccgcgagcctggacatcttcgtccagcacccagagcgtcgcttcgctctctgacagtcgcatcaatgcgtggctgccagctaaagcggccagcacgccatcctgcaacagcagcaggtcatcacccgcacccgccattaaaagcaggctctcaaggtcacagtgtgccggtgagtgcagtaacgtatgcagcattaacgtctcttaaaaagtaagaatgcgatcgtagctggccagcgtctgtcgcagtgccggcgcgtccagtagcgtaacatccagcaaccggtcagcgtcaacctctaatccacgcgctatcagcgatgtccggcagagatagcagtgttcaatctcatatagtgccagcacgccaaaggtcgcggcatagtgacggctcttaatcgtctcaggttgctggtgcagattaagctgcagcacgccatcaccgataaaaaacaggccgatatcctcactgagcgcgcccgtggccagcgcggcatccagcccctcacgtcctgcgctgctgccgtgcggcgcccgggtaaagacaaacgcgacccgattcatcagaaactgcaccatgcgttcacagctcagcgccgcttccgccagcgcgcccagcccgctcagggtaaagcccggctgcaggttactgcccgccagctggagtcgtgccgcttcctgctggtcgctgacgccacgacgcagcgcggccgccacacaaatattcagtgccacaccctgctcctgatgcaatgtctgccatgcgcgcaccagatcaaactcatcactggcgggcgacgtcagttggttagcgttcagcaccccttcgcgatagaagaaaacactgtcaagctgatggcctgccgtcagcagtgcgcaggcaaacagccaggcactggtcgcctgttgcgtaccgtaagccgggccggtgaccagcagggtgtaacgcattaccgctcctgcccctggaagtcgccatttttaaactgacggatatagagatagacggtgtgtttggaaatattcagccgatcggccacctggttgatggcatccttgatgtcgaagatccccttctcatacaggttcagcacaatctgacgattcttggcgttgttcgatacattacggtcagcactcacctcttcaatggtgaactccagcgtctgcatcaccagatcgtctaccgaaactggcgaagttgacgttggagtcaacctgctgcatctcgggcggcataaaggtcgacatgatctgtgagaacggcacatcaaggttcatgttgatgcagagcaagccaatgacccgctgctgacggttacgaatcgcaatcgtgaccgatttcatcagcacgccgcttttggcacgtgtgaagtaggcacgggagacattactgtccgcaccatgcatatcatgcagcatacgcagggctaaatcggtaataggcgaaccgactttacgtccagtgtgttcaccattagcgatacgcactgccgaacacttaagatcttcaagcgaatgcaggacaatttcacaatgcgaaccgatcaacatcgccaggccatccacgacagcctcgtacgatttcagaatatcgtaatcactttgttcgaacgggcgctgctccagaagatcgaagtcgctcagttcacccggattgaatggattagacattgaagagtatcaccctgaatggctggagcctgtcacagcggcttatgggcagactcaatattgggataattaggcaggcattagtctggcaaatgtcgtcggcttatgccagaggtttgtcgtgaagccgaaatgaaaccgccgcccggaggcggcggtcagcagattactgcgctttttctgcagcagcaggcgcaggagcctgtgctttttcatctgcctttggcgctggtttgatatcaagcagctcgacatcaaacaccagggtggagttagccgggatgcccggaacgccatttttgccgtaagccagatttggtgggatcaccagcttgatcttgccgcctttcttcacgtgcttcagaccttcagtccagcccggaatgacaccatccagacggaatgaaagtggctcgccacgggtataagagttgtcgaattcagtaccgtcaatcagcgtccctttgtagtttaccactacagtgtcgctgtctttaggtgcgtcgccggtaccctctttctcaactttatacagcaggccgctttcggttttcttcacgccgctctctttagcaaatttggttgcgtaagcttcgcccttttcagagttctctttcgcatctttttccattttcgctgaggctgcgcctttcacgcggccttcaaaggattgcagcgtctgctcaatctcttcatcagagagtttgctcttgccaccaaatgcatcctgaacaccagcgatcagctgctgcttatccagtttgatgcccagtttttcctgctccttcagggagttgtccatgtagcgacccagcgaagcacccagcgcgtaggcagactgctggtcttcatctttgaaggcagcatttttcggtgcctgaggcgcagactgtggcgcggcggctggtgcagcctgtggcgccgcagcggtatctgccgccattgccagcggagcattcagcgcaacagccatggtggtagctaacaatgtgactttaaacagtgatttcatccattctccaaaaccgaagcgtctaacctcgggaaacattgcggacttcagggtccacactataactttacgtggcagtgtcgaacactcccacaatgtaattacccggttaacttccgacctttataacatcgggaagtttcatcagagatgatgccgcgctgccttttttcaagcgcaacgcctccgggcgtgaaaaaaacaggtgattcctggcattcagatcgtagaatcacgccccgagtcgcaccttaacagaggaacaggtcatgcaacaatctgagtgggaacagcgtctggagacgctggagagcaaactggcctttcaggagatgactatcgatcagctgaacagcgcggtcgttcagcacgagctggagatgaataagatgcgtgagcagatgcgcattttaaccgacaagctcaaagcgaatgcgccatcgatcgtcgcctcacaatctgaagagacgccaccaccgcactactgatcgcgggctatctggccccggcttacccgggcagaaccagaatacgcgccaaaagaaaggccacccgagggtggccttgaaaggtctgttgagacttagtggctgcagccgcagccgccagtgccacaaccgcctttaccctgatcatggtcgtggtcgtgatcatggccgtgatcgtggtcatgatgatggccatctgcaccgtgaacgtggccatgagccagttcttccggcgtggcttcgcggatagcaaccacttcaacgttgaagttcaggttctgacccgccagcatgtggttaccatcaaccacgacgtgatcatcttccacttcggtgatttctaccggtaccgggccctgatcggtttctgccaggaagcgcatgccaacctgcagttcgtcaacgcccatgaagacgtctttaggaacgcgctgcaccaggttatcgtcatactgaccgtaggcatcgtttgccgggatatgcacgtcaaacttgtcgccggcaatgtggttttccagcgcattttccagaccagaaatcagggaaccatgaccgtgcaggtagtctaacggtgcactcaccggtgactcgtcaactaacacgccgtcttctgtacgtacctgataggccaggcttaccaccaggtcttttgctactttcatgatatctcctaaccgttgagagctgagatcccgtctcattggtctattctttcgtgcaataacaccaaccagaaaggttcggggctgagtacaagagggttttcactttctcttgcgactacagcgttaatggcgacaattgtaacggaattcaatcccgctgtaagtccaggcgtaaaaaaagctgcgccattccgctactcaggatgaaaaataccgataacctgctcattagtgcgaacctgatcgcgcgcctgcttatcggcctcacgcatctggtgaccacacttcacgcactccaccacatcgacattattttcacgccacattgccagcgtgtccttctcctggcagtgcgggcatgtcgcaccagcaataaaacgtttacgcattagcttctgcctgtttaaagaggttattcatcatcgtcccagccgtcgatctgccgcttttcgcgctgcatttcgcgctggaagatatcttccagttcacgccgcgcttcacggacgcgcgaagcctgcgcgctttcagagagattgggcatcagctcgcgcagcatccgcatatcaagatggcggaaatactgctgggcgcggtgcgcctgatgcggatgcatccccagcgtcatcagcgttttacgtcccagctccagcgcactggagaaggtctcacgcgagaactgcgtgacgcccgcctgaagcagttcatgcgcttctacacggccccgggcgcgcgcctgaatctgcaactgcggaaaatgctgctggcacagatgtacaatcgtcatcacatcttcgggctcgttacaggtgatcacaatcgcctgagcgctggccgcaccggcggcccgcagcaactccagttcggtggcgtcgccgtaatagaccttatagccatatttccgcatcagactgactgcactgatatcgcgctcaagcacggtgatgcgtttgttattcgccatcagcaaacgccccacgacctgcccgaagcgaccaaagcccaccacaatcacctgcggctgatcgtcttcgacaaagtgtttctctgcctcgtcatccggctcattgaagcggcgtgccagcagacgatcgattcccttcatcaacagcggcgtggtcatcatcgacagggttaccgtcaccagcagcatcggcagttgatcgccagagaacagctttgccgaggaggccgcggaaaagagcacaaaggcgaactcgcccccctgactcagtacgccagcgaaactgctgccgctcagagctgcgcaagccataaatgcgcgccagcagatagagcaccagcgttttcaccgccaccagcgtcacgacacccagcaggatggtcacaatatgggtatagagcacaccgaggttgagcgccatgccaaccgaaataaagaacaggcccagcagtaaacctttaaacgggtcgatggcgacttccagctcatgccggtactcgctctccgccagcaggatcccggcaataaaggtccccagcgccatcgacagacccagcgcatccataaacagcgcggagcccagcaccagcagcagcgaagcggcggtaaagacttcgcgcacgcccgacgcagcgatgtaacggaagataggccgcagcagatagcgtccgcctaccagcatgccggcaaacgccagtactttcatgccgaccttcatccagtcgatatgaccgctgtcggttccggccagcagcgggatcagcgccagggctgggatcaccgcgatatcctgaaacagcaacaccgaaaagcccagttgccccgcttcgctgcggttcatgcctttatccatcatcagctgcagggccatagcggtcgaggacatcgccagaccaatcccgccaatgatcgcagcctgccagctaaagttggtcagccacaataagccgcccagaatcgccgctgagaagatcacctgcgccgcgccgacgccaaaaatggagcggcgcagcgcccacagctttgccggattcagctccagcccgataataaacatcaggaacaccacgccgagctcagagaagtgcagaatctcgtcgacgtcgctgataaagcctaatccccacgggccgatagcgatacccgccaccagatagcccagaactgcaccaataccgaggcgagccgccaccggtacaatcaataccgccgcgaccagataaatcaccccggcggtcagcagcgtttgcccttccatctatacccctccattcggcagcggtgccgccagccagtcgccataggcgcgggcgtaatttttcattaattcaggactctgacgacgcgcccagtagacgatcatcggcggcatccagtgcatacggcacatctgcgcggtcagctcaaaaggacgcataatgtcattgagcgaatagcggttcagaccctgatgtctgaaggcactttccggttctccggtggtgacgacgctgcgccagtactttccttccagcgcattgccatccacgccattggcgaaaccgcgcgacagaactctgtccagccactctttcagcagcgccggacagctataggtatagagcggatgctgaaaaatgatgacatcatgttcacgcagcagctgttgttcatggtgaatatcgataaaaaaatccggataggtcgcgtacagatcgtgcacggtaacgtgttccagtgcctgagccggctgcagcagaatccgattggcgatcgaatcctgtgattccggatgagcataaagcagcaaaaccctgggtggctgcgacatcctttccctccaaagcgtcgtcattggtgcggttttccgctaccatgcacgacgcagcaaaatctcattatgttgccagtaaattaacatattctgacgatacggcgcttacatgattgtcttctcagccttacaaattcgccgcggcatccgcgtcctgctcgacaatgccaccgccaccattaatcccggccagaaggtcgggctggtgggtaaaaacggctgtggaaaatccacgctgctgtcgctgttaaaaggtgaaatcaccagcgatgccggtaccgtcactttccccactcactgggcgctggcctgggtgaatcaggaaacccctgcgctggataaagccgcgctggagtacgtgattgatggcgatcgccagtttcgccagcttgaagcagaaactggcggacgccaatctgcgtgacgatggcaatgccatcgcgctgctgcatggcaagctggacgcggtgcaggcgtggagcatccatgcgcgcgcctcaagcctgctgcatggtctgggcttcagtcaggaacagctgcaacgcccggtcagcgacttctcgggtggctggcgcatgcgcctcaacctggcacaggcgctgatttgccgttccgatctgctgctgctggatgaaccgaccaaccacctcgatctcgatgcggtgatctggctggagcgctggctgaagagttatgaaggcacgctgattctgatttcgcacgatcgtgacttcctcgatcccgtcatcgacaaaattattcatatcgaacaggagtcgatgttcgaatataccggcaactacagctcctttgagcggcagcgcgtcgccaaactggcacagcagcagtcactgtatgagagccagcaggagaaagtggcgcacctgcacagctacattgatcgcttccgtgcccaggccaccaaggcgaagcaggcgcagagccgcatcaagatgctggagcgcatggagatgattgcgcccgcccatgtcgataacccattcagcttcactttccgcaagccggagaacctgcctaatccactgatgaagatggagaaggtcaccgcgggttatggcgatcgtattattctcgacgccatcaagctcaacctggtccccggctcgcgcatcggcctgctgggacgtaacggtgccggtaaatcaaccctgattaagctgctggcgggtgagctggaggcgatggacggcaagatgggtctggcgaaagggatcaagctcggttacttcgcccagcatcagctggagtacctgcgggccgatgagtcaccgttgcagcatctgtcgcgtattgcgcctgaggtgctggaacagcagctgcgcgactatctgggcggcttcgatttccgcggcgataaagtcactgaaatcactgagcgcttctccggcggagagaaagcgcgactggtgctggcgctgattgtctggcagcgccctaacctgctgctgctggatgaacccaccaaccacctcgatctcgatatgcgccaggcgctgaccgaagcgttgatcgacttcgaaggtgcgctggtcgtggtatcgcacgaccgacatctgctgcgcgcgaccaccgacgatctctatctggtgcatgatggcaaagtggatgtgtttgaaggcgatctcgaagattatcagaagtggctgagcgatctgcagaagcagcaggcgcaacaggatgccgcgccgaagcaggataacggcaacagtgcccaggcgcgtaaagaccagaagcgtcgtgatgctgaactgcgcacccagacgcagccgctgcgcaaagagatagagaagctggaaaagcagatgagcaaatggcagagccagctggccgaagccgaagctcagctctcagacagcgctatctatgaacagagccgtaaagcggacctgaccaccgcgctgcagcgtcaggcggagagcaaatctgcgctggaagaggtggagatggcgtggctggaagcgcaggaacagctcgaacagattatggcatcataaaaaaatctccccgcgagcggggagattctcttttaacggggtttatcgcccagcaccgttgcccgctgcataatgcgccgggcaggatagtaatcagcattggcataatgctgcgtgacccgattatcccagatagccagatcgtctggctgccagcgccagcgcacctgaaactccggtttggtggcgtgcgcaaacagaaagcccagcaccgcatcactctctttctcgcttaaatcgacgatccgcgtggtaaagccctcattcacaaacagcgcttttttgccgctgaccggatgggtgcggatgaccggatgctgcactggcggatgtttttctaccgcctgctgccagcgctgatgctcgtcctcggttttgcggtacttatactcctggaatgactttttgaaatcatgctcggcatggagacctgccagcagctgcttaaagggttcagagagcgcttcgtaagccgcaatgccgctggtccagagcgtgtcaccccccgactccggtaacaccttcgaggccagcaaggcgatcgctggcggcgtatcaataaaggtgacatcggtatgccagttgtcattatctggcggattatcctgatgggtatccagcacgataatctcctcgacgccttccgcatgcggatagaccggatggatgtgcagatcgccaaagcggattgccagcgcgcggtgctgttccggcgttattttctggtcacgcagaaacagcacctgatgacgaagcaggccatgataaagctgctcaaactgagcatcactcaatgggcgagacacatccaggtttgagacctgcgcgccaatgtacgggccaagcggggtaaaactgagacgtttcgttcatgattgttctccactccagggcgtcagacggcgctgcaacgcgcggagcccgagttctaagctaaaagcaataaaggcgattaccgcgatacccgccagcaccacatcggtggcgaggaattctcctgctgactgcaccataaaacccagaccccgcgtggcggcaatcagctcagcggccaccagcgttgaccagccaacccccagaccgatgcgcagaccggtgaggatctccggcaacgcgcctggcagaatcacccagcgcagcagttgccagcgattagcccccagcgagcgagccgcacgaagtcggacctgctgcgtgttacgcacaccggccagggtggagagcgtcaccggcgcgaaaatcgccagatagatcagcaggattttcgaggtctcaccaatgccgaaccagatcaccatcaatggcagataggcgagtggcggaatcgggcgatagagttcaatcagaggatcgagcaacccgcgagcgaccgggctgaggcccatcaggatccctaccggaataccgatggcggcagcggcagtcagcgcgatcagcattcgtgtcaggctggcggccagatgctgccacagcgtggcatccataaagccctgcgcgctggcaatcagcagcagcttgcttaacacctgctgcggcgacggcaggaacagcggggcaatcaggcccagcgcggtcacgccccaccagagcagcaacagcagagagagactcagcatgctcagcgtaaaggcggttgaaaacggccagcgcaaacgacggcgcaccggcagagacttgtcattgatgagtgcactcatgcaaacgcctcccgctgatcaaagacccggctcagcacatactcgcgctgggcgataaaatgcggatcggatttgatgctgcggcacgactcccctgcggcaaagcgctgaccaaagccaggacgcagccgctctacgatgcggcccggtcctggcgacagcagaatcagttcgctggccaggaaaatcgcctcttctatgtcgtgcgtaatcaacagaatctgtttaccgctgtcgcgccacagcgtcagcagcagggtttgcatctgctctcgggtaaaggcatccagtgcgccgaaaggctcatccagcaacagcagttgtggatcggtagccagcgcgcgcgcaatgcccacccgctgacgctgaccgccggacaactgccagatggcgcgcttttccgcgccctccagccccacctgcctgattaaccggcgggcaatcgtgtcgcgatccgggcgtgacatccccgccagctgcagaccaaaggcgacgttatccagtacgttgcgccacggcagtaatccttcatgctgaaacaccacgccgcgctccgcaccaggcccggtcaccggctggttatccagcgtgatgctgcccgactccaccggcaggaaaccggcaaccagattgagcagtgtggttttgccgcagccggaggggccgagcaccaccagcagttcatggctatccagctgcagattgatatcctgcaacaccggctgtccggcataacgggcattaaggtgagcgatgcgcagcatagtgcctccttaaggtttaactaatggctcgacgaaacgggaggtcacatagctgctgtagtcgttatccgcctgcggcacccggccctgtgctttcagaaactgcgcggtatcgacgatcgctttattgaccggtttgcccagttgctcaacctgctgctgcgccgtgaggtaggtattgcccttcaccagaccgggcacctgtgcttccggcacaccgctgaggcgagagagtttgctgaggttatcggactgcttcagccagctgtcggggctgttcaggtaggcctgctgcgcgtcaagcgcgctgcgggcaaaagcagtcacgatctccggatgctgctgagcaaaatctttgcgtaccacccagacatccagcgtcggcgatccccagcttcccacttccgcagagtcggttaacaccttgccctctttttccagctcattaaccgccggtgcccagacgtaagcgccatcaatgtcgccacgctgccaggctgcaataatcgctggcggctgcagattgaccagctgtacctgtgacggtttgatgccccagtgtttcagcgcagccagcaggctgtagtgggtggtagagatgaacggcaccgcgatgcgtttgccaattaaatctttgggcgtagtgatgttcttcttcaccaccagcgcttcagagttgcccagctgagaggcgagtaaaaaggcttcaatcggcagcttctgcgccgccgcgaccgctaacgggctggaaccgatattgccaatctggacgtcaccggacgccatcgcacgtaataccccggcgccgctgtcaaacttgcgccagtcaacgctggccccgctctctttcgcaaagctgttgtcagcctgcgccactttcgccggctcagccgaggtctggtaagccacggtgacattgaccgcatcagcccgaaacgccagcagcgccagcgctgcggctaaaaaagttaaacgtgttgctgccatgatcactaccccaccgtttttatagtggaggcagtgtctctgcgcgctatagtttcataaaggaattaaaaattatccctaatagaaataagttcttagatcactatctgcaaaacaaagttaaaaatcgcaaatgctgaaaatagctaaagtaagcaaaaatgtcaggcgctcacattgtccctgtgctattcatatgcgttcccaattattgcctgttaaggtttctgaatccgatgtcgatcgagaaagtcgctcagctggctggcgtctccaaagccacggtatcgcgggttctcaacgcgcatcccggcgtgaagcccgatacgcgtgagaaagttctggcggcaatctctgcctgcgactatcagcccaacttactggcgcgtcagctgcgtacgtcgcaaagcaacatgctgctggtgctgatctcggatatcaccaatcccttctgttcacgcgtggttcagggcatcgaggccgaagcggaaactgcacggctatcacatcctgctctgtaactccgcctcgcagctccagcgtgaagccgcttatctctccctgctgaccggaaaagtggtggatggcgtgattacgatggatgcggcctccggtttacaggatttgcaggcgctcattgccggggcgccctgggtgcagtgctgcgaatttgatccggatatccccgcctcctcggtcagcattgatcaccttgaagccgcgcgcgacaccgtccattaccttgccggtaaagggcgtaaacgcatcgggctgatcaatggcgacatgcgttacctttactcgcatcatcgtgaaaagggctaccggcaggcgattgaggagctggggtatgtctggtccggcgtctcctacacttacgaaatctcctgtgaggcgggcagtcaggggctaagggagttgatggcgctgccggaaccgccggatgcggtgttcgcggtttcagatgtgctggcggtaggcgtggtgcatgcggcgctggaagcgggtctgcgcgtgccggaagatctggcggtggtcgggtttgatggcgtgtcgtttacccgcagcctgaatccgccgctgacgaccatcgagcagccgatgaaccagctgggcgcgcgtagcgtgcaattgctgctgcagaagatccgcaatcctaatgcgccagtcatccgcgaggtgctgccctggacgcgcgttgaacgcgcatccagctaatttagtgccagattaacagcacgcaggcggcggtcagcagccccatggcgaggttaaaaattttccaggcgcgacggctgcgcagaatgcggccgatcatcgcaccaaatcccatccagataacacccgataccagattaaccagaaacatgccgatgcttatcgccatcactgaatggcgatatgcgtcaccggccaggctgaaactggcgaccgcgcccagcgccatcagccaggccttgggattgatcaactgcaacaatccgccctgccagaagggcatcggcgcatccggcgcctgatcggtttccagcttctcataactggcggtagcgattttccacgccagccagagcagatagaggctaccggcgattttcagcaccaggtgcagcgaaggatagagcaggatcagcccgccgacgccaaaggccaccatcagcagcataacctgcattccgatcatgatgccaatcatcagcggaatggtgcgcataaagccaaaattagcgcccgaggcggtgagtaacatattattaggcccgggcgtaatggccgcgacccaaagaaatcccaacattgataagaaaagactcagttccatggcaatcgggtactccttaccctgcaagaaaaaacttatcgaagctaacagtgtgatatggaacagacaagcttttaccacatgaaatttaccggaccggaaaacgagcacttcacgcctcctgagagtctgcgtaacgcgcacctgcagaccctgctgccgcgcctgctacgtcgtcgtatcacgggcgatccccactggcaacgtctcgacctgccggatggcgacttcgtcgatctcgcctggagtgaagatccgcagttcgcgcagcataaaccgcgcgtggtgctgtttcatgggctggagggcagttttcatagcccctatattcatggactgatggcgatctgccatgcgcgcggctggctggcggtggtgatgcattttcgcggctgcagcggcgaaccgaatcggctcaaccgcatctatcactccggcgaaaccgaagatgcccgtttttttctgcactggctacgcacccgctggggccgtgtacccaccgcggcggtgggtttctcgctgggcggtaacatgctgggctgcctgctgggccagcagggcgcagccgctgaggtagacgcgggcgtcattgtctccgctccgctgctgctggagccctgtagcgtaaaactggaacgcggcttctcacgcgtctatcaatactatttgctggcgcagctcaagaaaaatgcccgccgcaaactgcacgcctggccggatacgctgccggtcaatctggcgcagctgaaagcgctacggcgactgcgcgactttgatgatgccattaccgcccgcgcccacggttttctggatgcggccgattactatcatcgtgccagcgccatgccctggctgaagcacgcagagaaaccgctgctgatcattcacgccaaagatgatccttttatgagtgatgaggtgatcccgcacagcagccaattatctgccactattacttatcaactgacaccacacggcggccatgtaggttttgttggtgggacattacgccagcctgaaatgtggctggaacagcgtatcccccagtggatcgccccttttctggataactgatctcgtgattattccctggcaacaggtctcacctgagacccttgaaaatctgattgaaacctttgtgctgcgcgaaggcacggactatggcgagcaggaaacgcagcctgatcgacaaggtggccgatgtgcgacgtcagctggaaacgggtgaagtggtactggtgtggtcagaactgcacgaatcggtcaatatcatgccgcgcaaagaatttcgtggctgatgcacccaacggcatttcgtgttaacaatgcctattgcccgacctcacagggagcttttctatgtctgcacgtcatcccattatcgcggtgactggttccagcggcgcagggaccaccaccaccagcgtggcgtttcgcaaaatctttcagcagctcgatcttcatgcggcggagctggaaggtgacagttttcaccgctttacccgccctgaaatggatatggcgattcgtaaggcgcgcgatttaggacgtcatgtcagctacttcggcccggaagccaatgactttggcctgctggagcagagctttaaagagtatggtcagagcggacagggccagtcgcgtaaatatctgcacacctacgatgaagcggtgccgtggaatcaggtgcccggcacctttacgccgtggcaaccgctgccgcagaacaccgatattctcttctacgaagggctgcacggcggcgtggtaacggcgcagcacaacgtagcagaacaggttgatctgctggttggcgtggtgccgattgtgaacctggagtggattcagaagctggtgcgcgacaccggcgagcgcggccattcacgtgaagcggtcatggattcggtggtgcgctcgatggaagattacatcaacttcatcacaccacagttctcacgcactcacctcaactttcagcgcgtcccgaccgtcgatacctcaaacccgttcgctgcccgcgctattccgtcactggatgagagctttgtggtgatccacttccaggcgctggaagatatcgacctcccctacctgctggcgatgctgcagggctcgtttatctcgcacatcaatacgctggtggtgcctggcggcaaaatgggtctggcgatggagttgatcatgggtccgctggtgaagcggctgatggaaggtaagcgaatagagtaagaggccaaaagggcctttccagactaatgccaatgccaatgccaatgccaatgccaatgcaggatgaatctgacagcagcgaaaaagcttaacacgcagggaaccgggtcagaagaggaaagcgtcccgcgccagggacggcgcgggccgagcggccagggattggcttaagcgactttccgatctgacccggttcccagcgcaggcacagtctgacagcggaccgacacaaaccgctctgaccctgttcaatacgcaggcacagtatcaaagcggattcccggcccaggcacagtcctaaagcaacctgcatcagatactggaagtgaagttagcaggtctgcaataacccctgcggctactaaagttcgatcacttcatagctatgggtaatgttgacgcctttacccagcatgatggccacagagcaatatttttcagcagaaagatccacggcgcgtgataccgctttatcctggagggctttaccactcacgataaaatgcaggttgatgtgcgtaaagattcgcggcgcctcttcacgacgttctgaggtcagttttacttcacaatcagccacatcgtttcggcctttttgcagaattgataccacgtcaatcgcgctgcatccgcccgccgccatcagcaccatctccattgggctgggcgctttatcacccgaatttccatccatcagtatctgatggccggatgaggattctccgaggaatgtcagcccttctacccatttcactcttgcctgcatgatttttgctccggaatacgctgttttgtcgccagagtacgctttcgcctggtaaacagcaatccagagaaatccgcccgtagctgaagcgagacaacagaagacagtcggcaaaagctgtgctacaaacagtgctgaaaatatttttcgtcacccgatgacgaagccgggaaggatgatgcgcactgcgcctgatgcggcccgaataatttcctgaaatggaaacgcttgaagctttcaccgcctgacagggaaaactgccccctgtattttgggcacgattacaacagaggataatagcgaatggttctcggcaaaccgcaaacagaccctacactcgaatggttcctgtcccattgccatattcacaagtatccatccaaaagtacgctgattcaccaaggtgaaaaagcagaaacgctttactacatcgtgaaaggttccgttgcggttctgattaaagatgaagaaggcaaagagatgattctttcctacctgaatcagggcgattttattggtgaaacttggcctgttcgaagaaggccaggagcgcagcgcctgggtacgtgcgaaaagcgcgtgcgaagtggcggagatttcttacaagaaattccgtcagctgatccaggttaaccctgacatcctgatgcgactctcatcgcagatggcgcgtcgcctgcaggtgacgtctgaaaaagtgggtaacctcgctttcctcgacgtaaccggacgcattgcacagaccctgctcaacctggcgaagcagccagatgccatgacgcatcccgacggcatgcaaattaaaatcactcgtcaggaaattggccagattgttggttgttcacgtgaaaccgtgggccgtattttgaagatgctggaagatcagaacctgatctccgcacacggcaaaaccatcgtcgtttacggcacccgctaattcctgtcacccacggcgtgatggcaacatcacgccgttattgtttgtgttgggccgatgtggcgtcgaattatttaccatcctgaagtcaattacgccttgcggcaaacgctggtactctgtctgccggtggcgctgggctggctggctggcgacctgcaaaaaggtctgctgttctcattagtgcccgcctgctgcaacatcgccggtctggataccccgcataaacgcttcttcaaacgcctgattgttggcggcagcctgtttgccctcggcagctttctgatgcagtggctcaccctgcatgctattccgctgccgctgatcctgtttgctatgcccttattgctcggcgttaccggggagatcagcccgctgcatggccgtctgctgcccggcaccctgattgccgccatctttaccctgagcctgattggccgcatgccaatctatgttcccccgctgctctatatcggcggcacgctatggtacgggctctttaactggttctggttctggctgtggaaagagcagccaatgcgcgaaagcctgagcctgatctaccgcgagctggctaactactgcgacgcaaaatataccctgctgacgcagctgaccgatccggaaaaggcgctgccgccgctgctggctcgtcagcagaaagtggtcgatctgattaacacctgttatcagcagatgcatatgctgtcggcaagccgcgatcacagccataaacggctgacgcgcgcctttcaggtggcgctggatctgcaggaacatatctcggtcagcctgcatcggccggaagaggtgcagaagctggtcgaacagagccacgccgaagcggtgatccgctggaatgccaaaaccatctcggcccggttgcgggtgctggcggataacattctctatcaccagctacccgatcgctttgcgatggataaacagctcggcgcgctggagaaaatcgcccatcagcatcccgacaatccggtgggtaacttctgcctttaccacttcaaccgtattgcgcgggttctgcgcacccagaaacccctttatcagcgcgatctgatggctgaccgccagcgccgtctgccgctgttaccggcgctgcgcagttatctctcgttccgctcatcggccctgcgcactgccggccgctttgcggtgatgctgatgctgggcagcgcactggcgctgttcttcaacatccccaaaccctactggatcctgatgaccatcatgttcgtcagccagaacggctacagcgctacccgtgtccgcattcagcaccgggcgctgggcacttttgccggtctggtgatcgcggctgccacgctgcgcatggcggtgccagagtcgctggtactgctgatcatgctggcgattacctttatcagctatcgctttacccgccagttctatggctggtcgatgattggctttacggtcacggcggtttactcgctgcaattgctgtcgctgaatggcgcgcagtttctgctgccgcgtctcatggatacgctgatgggttgtctgatcgcctttggcgggatgctgtggctgtggccgcagtggcagagcggcttgctgcggcagaacgcccatgacgcactggaaacctatcaggatgcgctacggctgttgctgggtgacgaacagtcaccagagaaactggcttatcagcgcgtgaaggtcaatcaggcacacaatgcgctgtttaactcactgaatcaggcgatgcaggaacccgcgttcaactcccgctatctgagtgatatgcggctttgggtcacgcacagtcagtttatcgtcgagcatatcaacgctatgacgattctggcgcgggagcacaccatgctcactgcctcgctggctgagcgttacctgcaatcctgtgaaatcgcgctgcagcggtgtcagcagcggctggaatatgatggtgaaagctcacaggttaacctgctggatgagctggagaacatcagtgagggaccgatcacggtggtggagcagcatgtgcggcgcattctcgatcatctgagcgtgatgtacaccatttcatcgctggcgtggaaccagcggccgcaacatggccgctggctgatcagacgcttacgtaaaaactaagctagccgttgagcacgttgccgacggccgtggcgaagcggctcatgccctcttcgatgtcggcaggctcaatgatcagtgacggggcaaaacgcatcacgtcggtgccggcaaccagcaccatcacgccttctgcggccgcggcattcaggatgtcgcgtgctttaccggcatgctgcggtttcagcgccgcgccaatcagcagacccttgccacgaatatcgctgaagagatcatacttcgcatcgatggcctgcagcgccgtgacaaagtgctgacgacgtgtctcaacgcctgccagcacctccggcgtattgataatatctagcgcggtttcggcgatggcgcaggcgagtggattgccgccataggtggtgccatgcacgcccggcgccatggtcgaggcgatctcgttagtggtcagcatggcgctgaccgggaaaccgccgcccagcgctttggctgaggtcagaatatcgggctggatgccataatgctcataggcgaacagcttgccgctgcgccccatgccgctctgcacttcatccagcaccagcagcgcctgatgctgatcgcaaagctcacgcagtccctgcataaattcctgcgttgcgggcacgacgccgccctcaccctgaatcggttcaaccacaatggcgcaggtgtgatcgtcaatcaccgctttcactgcgttcagatcattgaacggcacatggacgatatccgccggtttaggcccgaacccatcagaatattttggctgtccgccgaccgtgacggtaaacaacgtccggccatgaaaggcgttatgaaaggcgataatcttacttttgaacgggctgtgacgtttgcaggcgtagtagcgcgccagcttaaaggcggcctcgttggcttcggccccggagttagcgaagaagacccgctcggcaaaggtcgcctgaattaacttactggcaagacgcagcgccggtttcgttggtgaagacgttgctggtgtgccacagcgtctcgccctgacttttcagcgtctccaccagcgcaggatggcagtgtccaagtgcggtgacggcgataccacctgagaaatcgatatactctttgccctgctgatcccatacacgactgcccttgccttttaccggcacgaactgcgcaggtgcataaacaggcaaaataacgttatcgaacgtctcccgcgtgaccgcaattttttccgctgccattgatgaccccatttagatgattgatgtgcaactttgaaataataatcacaaaatatgcataaaaaatcactcaaaggcaacttattgctcaaggaaattgcgcagcagctgatgtccctgctcgctgagaatgctttcgggatggaactgcacgccttccagcgccagggttttatggcggaatcccataatttcgtcaggctcgccgtcacgcaccgtccaggcagtcacctcgaaggcatctggcagggagtcgcgctgtacaatcagcgaatggtagcgggtcacggtcagtggattattcagagtgcggaacacgccctgtccggtgtgctgaatcgcagaggttttgccgtgcatcacctgacgcgcacgcacgacctgcgcgccatacgcctgcgcaattgcctgatggcccagacagacgcccagcaccggcagctgaccggcgaaatgccggatcgccgccagcgaaatgcctgactccgacggcgtgcagggaccaggggagatcaccagatgagtcagcggtaacgccgccatctgctccagcgtgatggcatcattgcgcaccacccgaacctgcgcgcccagctcgcagaaatattgataaagattccaggtaaaggagtcgtaattgtcgataagcagcagcatggccagtccagaataattacccgcgccgctattctacgcggttaagccgcctcgctcaccactttcgcaaatacctgctccagcaaagtcaggtctccggccacaccagcctgattcgccgctttccagctttcagcgtcagtctcttcccaggagagcagataaccggcatgcagcgccagctgttcaaagaaaatccgctgcgcccgaccgttgccgtggcggaaaggatgcaacatgttgatttcgcagtagtagtgggcaacacgctcaataaacgcgtcacgcggcaggtcaacgagtcccttctcctcctccagcgcggccatcagggcgttaccttccttttcgatatattcgaaatgacagaacggcgtctcatcgcgccagatatcgatagtgcgcagttcaccagcccagctgtagacgtcctgaaacagcgtacggtggatctggcacaggtaaggcagtccaggattacgggggcccagctccagcgtggcggcacgcgccgcactaaaactcagctccgccttacgcagctgcgcggcatcgtgaatatctggcaggtttttcagcacattgtcatgctgccacaggtagggatcctggctgacggcggtattagagtccatattgcctcctcagtgacgccagacgtgcggccacatcatcgctgtttacgctggtttcatttggcgagaagccttccagccgacagctggcctgatagctggcgctacgccgctgtcgccacagggtgaccttctgtttttcggtgagtttgttcgccatgccgcctcctgctcaggtttttgccctaagtataagagcaaattctggctttgccggatgcggcaggcggtcgccatccgcagatggcgacgaaacggacttaaggcaggactttggcggagaggataactaccggtttggatggaacattctggtaaggacccacatctttggtcggtacctgagaaattttttcaaccacatcctgacctttcacaatcttaccaaatacggcatagccaaaatcgcgctgtccgtgatcgaggaatgcattatccgcgacgttgaggaagaactggctggtcgcactgtctttatcggcggttcgcgccatggaaatcgtgccacgcaggttacgcaggccgttatccgcttcattcttgatcggcgcgttggtctgcttctgctgcatgtccgtagtgaagcccccaccctgcaccataaagcccgggatcacgcggtgaaaaatggtgttgttgtaaaaaccgttgttgacgtaatcaacgaagtttttcacagaaaccggcgctttctggttattcagttcgagttcgatattgccggcggaggtggtgagcagaacgtgggtgtcaccttttgcagccagcgcctgggcggaaacggaagagagcgctaacagggtgatggccgctgttaaagtacgtttaaacatgaaagattccttacctgggagagcgggcacaaaaacgtgattgattgtaaagagactctattccaggagccagcgttttacctatatttacgctgtggcagcaaatggggggagcaaacgttaaaccccgacaattacgtgattaaaatcacacaacacatgaaatatggatctctggtttcactggttgtttattaagatcacggttccgtttacactttctgacactttttggcacccggttctcaacaggttcagaacatgacaaaccgtaatcgtattggcctcacctggataagcttcttctcctacgcgcttaccggcgcgctggtgattgttaccggcatggtaatgggcgatatcgcaaaagatttccagatcccgatctccagcatgagtaataccttcaccttcctcaacagcggcatcctggcggcggttttcctgaacgcctggctgatggtgattgtgccactgaagcgtcagctgattttcggcttcgtcctgatggtactggcgataatcgggttgatgaccagccgcgatctgaccgtcttctcgctctgtatgtttgtgctgggcgtggtcagcggcattactatgtcgatcggcaccttcctgatcacccatatgtatgaaggccgccagcgcggttcgcgcctgctgtttaccgactccttcttcagcatggcgggcacgctgtttccggtgctggcggggattctgctggcgcgtcagctgccgtggtactgggtctacgtctgcatcggctttatctacgtcgcgatcttcatcatgacgctgtttgtcgagtttcccggtgctgcgtaagcccgaaaacagcccgacagttgagaaagaaaaatggggtgtgggcgtgctgctgctggcagtggcggcgctctgctacattctgggccagcttggctttatctcctgggtgccggaatatgccaccaaagtcatgggcatgaatattaatgatgccggacaactggtgggcagcttctggaccgcttatatggtggggatgtgggccttcagcttcctgctgcgcttcttcgatctgcaacgcatcctgatggtgctggcgggactggctaccgtgctgatgtactggttcgtcagcagccaggatgccagtatgctgaagtggatcattatggtgttgggcttcagctcgagcgcgatttacaccactatcatcacgctcggctcgctgcagaccaaagtggcgtcaccgaaactggtgaactttattctgacctgcggcaccgtcggcaccatgctgaccttcgtggtgaccgcgccgattgttgagaagagcggcgtgcacacggcgctggtcaccgccaacggcctctacgcggtggtgtttgtgatgtgtgtcctgctggggctggtcactaaacatcgctcgcacggtcacgttacgcattaatcattcagggcggcgattgatcgccgccctgatgtttaacgccggaagtctatccgctcccgctcccgccagtaaatctcgctttctgcaggctttgtctctgccaccacgatgccgcgacgcagtgagtagcgcaccggaacctgtcttcttactgcatcaaaaccactctctgccggcagaataatcaggctggcatcgttgccggtctgaatgccatagcctgacagctgcagcgtcttcgcgctgttatgcgtaatcagatccagacccgcatcaatctgctcatagcccatcaactgacagacgtgtaagcccatatgcagcacctgcagcatgctggcggtgcccagcggataccagggatcgaacacatcgtcgtggccgaaacagacgttaatctccgcctccagcatctctttcacccgcgtaatgccgcgccgcttaggataggtatcaaagcggccctgcaggtgaatattgaccagcggattcgcgacaaaattaatgcccgacagcttaagcagtcgaaaaagtcgtgaggtatacgcgccattgtaagagtgcatcgcggtggtatgactggccgtcacgcgcgcgccgttgccatcgcgatgcgccagcgccgccacggtttccacaaagcgcgactgttcatcatcgatctcatcgcagtgaacatcgatcagccgatcgtagcggttagccagcgcaaaggttttatgcagcgactcaacgccatattcacgggtgaattcgtaatgcgggatcgcgccgaccacatccgcgcccagccgcaatgcctcctccagcaacgcttcaccgttgggataagagagaataccctcttggggaaaagcaacaatctggatagtgatccatggcgccatctccgcctttagctccagcatcgctttaagcgccgtcagtgacgggtcagaaacgtcaacatgggtacggacaaactgaatgccgttggcaatctgccacttcagcgtctgcatcgcccgccgcttaacatcttcatggctgagcatggctttgcgttcagcccagcgctcaatgccttcaaacagcgtcccggactggttccacgcgggtttcgccagcggtctgggtggtatccagatgaatatgcggctcaataaaaggcgcgcaggctaagccaccctcgccgtccagcgattcatccgccggtgaagcgtgctgcggctgggctgagatccgggcaattttgccatcggcgatggcgatctgccataaaccatcccgccagggtaaacgcacgttattgatccacttaggtgacatcattgccgactccttttccggttttgtgttttaaaactaacacgattcaggtgacccgccgcaagcccgaataatcagcgggttatccgcaccagaaaaaattatttcaaatcaaccatatacctcttaataggtatatggcgtcgtggttgatgtatatcaataagtgccagaaacggcgcgctattgtagccgcagatatcgcaaatttgaggcaaaaatgagcaagcacaatgtcgtcgttatcggtaacggcatggtcggccaccgcttcatagaagaattactagagaaagcggaacctgaccagttttcgctgaccgtcttttgtgaagaaccccgcgtcgcctatgatcgtgtccacctgtccgcctacttttcccatcacaccgctgaagaattgtcgctggttcgtgaaggctattacgacaaacatcaggtcaatctgctgctgggtgaacgcgccatcaccattaatcgtgatgagaagctcatccactccagtaccggtcgcgcagtgcattacgatacgctgatttttgccaccggctcttatccgtggatcccgccaatcaacggtgccgaaggcagcgactgctttgtctatcgcaccatcgaagatctcaacgccatcgaagcctgttcgcgccgcagcaaacgcggcgcggtgatcggcggcggcctgctggggctggaagcggcgggcgcactgaaaaatctgggcattgaaacccacgtcattgaatttgcgccggtgctgatggcggagcagttagatcagcaaggcggtgagcagctacgtcgcaagattgagcagatgggtgtacgggtccacaccggtaaaaacacccaacagattgtgcatcacgaacacggcggcaaaacgctgcagtttgctgatggcagcgcgctggaggtcgatttcatcgtcttctccaccggcattcgcccgcaggacaaactggcgaaacagtgtggattagccctggggccgcgtggcggcatcgccattgatgaccagtgccggaccagcgatcccaccatctacgctatcggtgagtgcgctgcctggcagaatcgtgtctatggcctggtggcgccgggttacaaaatggcccaggtcgccagcgaccatctgctgggccgcgacaatgcgtttaccggcgcggacatgagcgccaaactgaagctgctgggtgttgatgttggcggcattggcgatgcgcgcggcaccacgccaggcgctcgcagcgtggtctggctggatgagagcaaatcgatctacaagcgcctgattatcagcgaagatcagaaaaccctgctgggtgccgtcctggtgggcgacaccagcgactatggcaacctgctgcagctggtgctgaatgctattccgctgcctgctaatccggaagcactgattctgccaaccggcagcggggataaaccggccatcggcgtcgattctctgcctgataccgcacaaatctgctcctgctttgacgtcagtaaaggcgacatcattaaggcggttcagggtggctgtcataccgtggcagcactgaaaagcagcacccgtgccggcaccggttgcggcggctgtatcccactgatcacccaggtttctcaacagtgaactcagccgtcagggcattgaggtcaataaccatctttgcgcccacttcgcctggtcacgtcaggagctttatcacctgattcaggtagaggagattaaaacctttgacgaactgctggcccgctatggtcagggttacggctgtgaagtgtgcaagccggtggttggctcactgctcgcctcctgctggaatgagtatgtgctcaagccccagcacgcgccgttacaggacagcaacgacctctaccttggcaacatccagaaagatggcacctactcggtgatcccgcgctcgcccggcggtgaaatcacgcctcagggactgaaagtgattggcgagatcgccgagcgctatcagctctacaccaaaattaccggctctcagcgcatcggtctgtttggcgcgcagaaagacgatctgcccgccatctggtcacagctgatcgacgccggatttgaaaccggccaggcctacgccaaggcgctgcggatggcgaaaacctgcgttggcagcgcctggtgccgttatggcgtgggtgacagcctcggcttcggcgtgatgctggagaaccgctacaaaggcatccgtacgccgcacaagatgaagtttggcgtctctggctgcacccgtgaatgtgcagaagcacagggcaaagatgtcggcattatcgcgaccgaaaaagggtggaacctctacgtctgcggcaacggcggcatgaaaccgcgccatggcgatctgctggcggccgatctcgatcagcagacgctggttacctatctcgaccgtttcatgatgttctatatccgcaccgccgacaaactgcagcgcacctcgctgtggctggagagtctggaaggcggcatcgactatctgcgtaaggtgatcgtggatgacaaacttggcctcaacggccagatggagcagcagctggccgcactgcgcgccagcgtcagctgtgaatggaaagcgacgctggaagataaggatcacctgacgcgctttgcccactttatcaactcgccgcagcgcgatcctggcgtgcagcgggtcgcggagcgcgaccagcaccgcccggcacgcgccgatgaacgcattgccgtgaccctgattgaggagaccgaatcatgagccagtggaatccggtgtgcccgctgacgcagatcctgcccgccacgggcgtctgcgcgctggtcaaaggccaacagattgctatcttccgtccccgcaacgatgagcagctctatgccatcagcaatatcgatccctttgccgatgccagcgtgctgtcacgcggcattattgctgaacatcaggatgcgctctgggttgccagcccgctgaaaaagcagcgtttccgtcttagcgatggctactgcatggaggatgaaacgcgctccgtggcggcctggccggtgcgggtcaatgccggacaggttgaagtctgcctgtaactcccgtcaacagcccgcctccgcgggcttttttaaggacgtctgatggactacttccccttattctgccgcctgcagggccgacgctgtctgctggtcggcgcaggtgacgtggctgagcggaaagcccgcctgctgctggaggccggcgccgaaactgctggtcggtgcccttgatttctcccccgccttccggcaatgggcgcagcaggaaaccatcacgctgctgccaggggcgtttgatccgcactggctcaccggctgctggctggtggtcgccgcaaccagcgacgatgcagtcaatcagcaggtggctgaagccgccgaaaaacagcagatcttctgcaatctggtggatgcgccgcagcaggccagcgccattatgccgtcgatcatcgatcgttccccgctgatggtcgccgtctcttccggtggacgcgcgccggtactggcgcgcctgttgcgggagaagctggaggcgatgctgccgcaacaccttggccagctggctcagctggcaggcactctgcgcgcgcgggttaaacagcaattcagctctgtcagtgcccgccgccacttctgggaacgcttctttaacagcgagcggctggcccagacgctggccaacggcgacagtgaacgcgcggagcagattaccgaccagctctttaacgctgaccttcaccaacagggtgaagtggcactggttggtgccggtccgggtgatgccggattactgaccctgaaaggcttacagctgatccagcaggcagacgtcatcgtttatgaccggctggtctctgatgagatcctgaatctggtgcgccgcgatgccgagcgcatttttgtcgggaaacgcgccggacatcactgcgtgccgcaggatgagatcaaccagctgctctgcgaacaggcgcagcggggaaaacgtgtagtgcggctgaaaggcggcgatccctttatctttggtcgcggcggtgaagagctggaagcgctggcgcagcggcagattccgttcagcgtggtgccggggatcaccgccgcatcgggctgtgcggcctacagcggtattcccctgacccaccgcgatcatgcgcagagcgtcagactggttaccggacatctgcagaaagagggctcgctcgcctggcagacgctggcggcggaacagcagacgctggtcttttatatggggctcacgcaggccggagagattcagcagcagttgataaagcacggtatgcgcagcgatatgccggtagcgctggtggaaaacggcaccactacgcgtcaacgcgtggtcaccgggacactgagcgagctggaagcgttagccggtcaggtgaccagtcccagcctgatgataatcggcagcgtggtaagtctgcgcgacagtctgcgctggttctgagtccggcaaataaaaacggcgggcacaatgcccgccgtcctggttgtctgctcagccattacggcatcgcgacaaagcctaccgcctgatacaccttcttcagcgtttcctgcgcctgtgcgcgtgctttggccgcgccatcacgcatcacctgctccagcagtgcttcatcgttgcggaagctgtgataacgctcctgcagctcagagagcatacccgacacagcatcggctactgcgcctttcaggtggccatacatcttgccttcgaactcctgctccagctcggcgatggttttaccggtcacgcccgacagtatatccagcaggttagagacgcccgctttctctttgatatcgtagcgcaccactggcggctcttcagaatcggtgacggcgcgtttaatcttcttcacgaccgctttcggatcttccagcaggccgatcacgttattgcggttatcgtcagacttggacatcttcttcgtcggtttccagcagcgacatcacgcgcgcgccagacttcggaatcaacggctctggtactttgaagatatcgccgtagatcgcattgaagcgatgcgcgatatcgcggctcagctccagatgctgcttctgatcttcacccaccggcacctggttggtctgatagagcagaatgtcagccgccatcagcaccggatagtcgaacagaccggcgttaatgttctcttcgtaacgcgctgatttatccttgaactgcgtcatgcggctcagttcaccgaagtaggcgtagcagttcaggatccagctcagctgcgtgtgctctggcacatgcgactgaacgaagatggtgcttttttgcgggtcgataccacaggccagatagagcgccagcgtgtccagcgtcgctttacgcagtgcaacaggatcctgacgcacggtgatcgcgtgcagatcaacgatgcaataaatgcagtggaaatcatcctgcatctgcacccactgacgcagcgctcccatatagttgccaatggtcagttcgccggacggctgtgcgccgctgaaaacgatgggtttcatacttatgtcctgatatttacagccccagagcgggcaaaagttcgtcgaaagagtcgagggttaaatcgggctggctggcggcaatcggctcgccatagttatagccaaaggtcatgccgatattgggtacgcccgccgcctgtgccgcctggatatcattgcgtgagtcgccgacaaacagcaactcattcggcaacacaccaaaggtgcccagcaccataaaaattgccgcaggatgcggttttttaaccggcacatcgtcgccaccgataatcagcgaaaacgcattagcaatgccaagcgactccagcagcggtgccacaaacggcgtcggcttgttggtgactatcgccatcggcagcccggcagcctttaatgcggccagcgtctgctttacctgtggaaacagcgtactgcccgcatccacggtatcggcataatgccggtcaaacagtgcccgcgcatcacgctgctcttctggctgcggctcacggcccagcgcgaaggtcagcgcgcgggccatcatgatatccgcgccgttgccaatccaggttgagacacgctcaaggcccgcctgcggcagacggaggtcattcagcgtgcggtcaatcgcatcggccaggccgggtgcgctatccaccagtgtcccatcaagatcaaacgccagcgcacgaatatcagtgaaatgagccattggccttctccagttcgttgcgcatatcgtcgatcacttttttatagtcagggtgaccgaagatcgcggaaccggcgacaaacatgtcggcaccggcggcagcgatctggccaatgttgtcgatcttcacgccgccatccacttcaaggcgaatgctgtaaccgctctgatcgatacgcctgcgcgcttcacgcagtttatccagtgtgccaggaataaatgactgaccgccaaagccagggttcactgacatcagcagaatgatatccagcttatccatgacgtaatcgaggtagctcagcggggtcgccgggttaaacaccagacccgctttgcagccatgctctttgatgatttgcagggtgcggtcaacgtgttcgctggcttcgggatgaaaggtgatgtaggtggcacccgctttggcgaaatcagggattagcgcatctaccggcttcaccatcagatgcacatcgatgggggcagtgatgccatagtcgcgcagtgctttcagcaccatcggacccatggtcagattaggcacgtagtggttgtccatcacgtcgaagtgaaccacgtcacctccggccgccagcgctttggctgtgtcttcgcccaggcgagcaaagtccgccgaaaggattgaaggggccagcaaatattgtttcatccgattctcccactgttgtgcgccagcacgcaggctggcgtaatgcgttggtcgcggacgaaacagactagctataaagtgccagcagttcgtcgaccttggtgcgacccgttatgcttcggctgatagaacgccgggctttgaccacatgtaactctgcatcctgataccataaacgcgtcagtgcagtgtcgtggttagaaatcagtaccggtatccggttctccgacgaagccagctttgccgctaacgccgccaggtttctcctgctcacgcaggctgaagctgttggtgtgataagccgtgaaattggccgttgccgacagcggcgcataaggcggatcgcaatagactaccgagcctttaccggcattggtcagggtaacatcgtacgattcacagacaaacgtcgctttttgcgcacgctcggcaaaccataacagttctgcttcaggaaagtagggtttgcgatagcggccaaacggcacgttgaactcgccacgcaggttatagcgacagaggccgttgtaacagtgacggttcagatagaggaacaacagcgcgcgcaggtaggcgtcggtgctggtgttaaattcggtgcgacgctggtaataacagatttcgttgttactttccggcgtaaacagcagctgcgcgtcacggatgaaatccgccgtgcgcgttttaacaatgttatagagattaatcaggtcactgttgatatcagccagatggtagcgatcaaattcagtgttcagaaacaccgaacccgcgccaacaaagggttctaccagacagtcgccttgcggcagatggcgatggatctcttctactaagggaaattttccccctgcccatttcaggaaagcgcgattttttttcatgctgtcgtggttattacatcttattgtgaggctgtggctggaccgacagcagatctgcgcttaaaacggggccagaaactggccccacatccgctattggctggcttctttcttcacctggcttactggtttaacccacgggttcttcgcacgcacttcggcaggcagtgaggctaccgcgcgtttggcatcagccggtgtggcataggaaccactcaccagcacgtaccacgactgaccgttacgggtggttttgtagacgtgatacccactcagattctgctgcttagcccaggcattcaggctttccgccttcgatgcaccgctcagctgcagggtatagctgccgcctggcaatgatttgctggctgaactgctgcctgccgccgcagcagaaggggctggcgtacgtgctggcgtggtatgtgttttgctgtcacgggttgcaggcttcgaagcagttttatgcgatgaatcgtgcgccggacgggcagaagcgtttgatttgtttggcgtctgacggcctgcaggggccgtaaccggattcgcagccgttccggcattaccgctgaccgtggcaggcgctgttggcagtgaactgccaccctgcgtgcccatcgcggcactgtcgacctgctgctgctgattactcagcgcgctgttcagatcgcccggcagcgtgacacgctgctgatttgctggcgtctcaacaggggcggcctgcgtaggcgttgaagccacaggcggcattgagacgtcgcgctgcgggtcagacacagcattaccgctggtcgccgcgttattttcgctggtagctggcgtggtctgcccgccggttggcgtcgtctgtccacccgacatggaagaggagccggccaggtcgatattcttttcgctgccggaaccgccaccagcggcaggcgtattgcccgcagtcgcaggttttttctcatccgggccattcagcgccgaaccaatacccagtaccagtaacagcagaaccaggatcccgacacccatcatgatgcgctggcgcgaaaccggtattttggctgcgggagacgacttacgagggcgcgagggacggcgatcgctggcgtcaggttttaactcatcttccggtttaaactcatccattttgcctcctccgtaaagcggcattccgcactgcgcaccctgcgcgccgcgtcaccactcaactgcttaatctcaggattgctgacaatcattaattgcagccagcaccatatcatgtgccacgccaccacgcacttcagagcggccaatcgacagcgggagtaccagccgcaattcgcccgccagaactttcttatcgcgcatcatgtgcggcagatacatctccgcactcatcgcctcaggcccatgtaccggcaaaccggcacgcaggaacagggcaataatgcgatccgtctcctgcgcctggaactgccccaggcgttcagccgtgcgtgccgccatcaccatgcccgctgcaatcgcttcaccgtgcagccagttgccatagcccatgtgtgcttcaatcgcatgaccaaaagtatggcccagattcagcaacgcccgctgaccgttttcacgttcatcggcggccacgacttcggctttcagttcacagcagcgacgaatgcagtacgccagcgcctgttcatccagcgccagcagggcatcaagattctgctccagccactggaaaaacgcaccgtcgaggatgatgccgtacttaatcacttccgccagacccgacgccagttcgcgcgcgggcagcgtctgcagacaggcagtatcaatcaccaccgacgcgggttgataaaacgcgccgatcatgtttttgcccagcggatggttaacggccgttttgccgccaaccgaagagtcgacctgcgacagtaaggtggtcggtacctgaataaagcgtacgccacgctgataactggccgcagcaaaaccggtaagatcgccaatgacgccgccgcctaaggcgataagcgtcgtatcacgaccgtgcggcttttgcaggagcgcggtaaaaacctgatccatcacggccagcgtcttatattgctcgccgtcgggtaagatcacctgatccacttttacacctgccgcggtcagcagcgccgtcagctggtcaagataaagcggagccagcgtctggtttgtcaccaccatggcgttttcgcccgcggttagcggccaaaaagaagccggatcgttaaacagtccggcagcgatagtgatggggtaactgcgttcccccagtgagacggtgatcttctccatgatgcccgatacctgttaaggagccttcgaacgttggatcaacttttttccaacatgtggataatctgattcgccaccactttcgcactctgatcatctgtgcgaatggttacatcggcgatctcttcgtagagcgggttacgttcgccagccagcgcttcgagcacttcacgcggcggtgaatccacctgcagcaacggacgttttttgtcacgttgggtgcgcgccagttgcttctcgatggtggtttcaagataaaccacaacaccgcgggcggagagacgattacgcgtttcccgggatttgacggaaccaccgcctgtcgccaggacgatgccttgcttctcggtcagttcgttaatgattttttcttcgcgatcgcgaaagccagcttcgccttcgacatcaaaaacccagcccacatccgctccggtgcgtcgctcaatttcctgatcggaatcgaagaactccatgttgagttgctgagccaactgacggccaatagtgcttttgccggcacccatcggcccaaccagaaagatattgcgtttctctgccattttgtcggtattactaagaattcgttaatgataccccgcgttcagcatttgctggcgggacaggaaactgagacctcatgagcgttagcaagagtcagatgaaaaattatctcaacactcaaggctgtttggcaaccgattatattgccttcagcacatccatttctgaattggcctgtgttcgcgaaactgtaacgcgccagcgctgcgtctttacaacgctgcgtacagaggagttttctgatctgtttgccgggatttacccagcatagacggttacaccgtattgaaaatcgctaaaccttgtaagctaattcctctcctgcgtcaacgcagatggccttaagggacgcattttccgttttatccagccgtaagcgctgcttccctgaccaatcgcggcgtaatgaagatcaccagctctctttttttgcgctgatcagattgctggcgaaacaacccgccaatcagcggcacatttcccagtagcggcacctgattctgtccgcgggtgcgctgctgctgaaagataccgcctaacgccagtgtttgcccgtcactgaccgtgacctgagtctcaatttcctgtttatcgatggataatatgtcgctatcgccggttctgatgctgcgacccggcatattctgactgatatggatcttcagctggatgcggccattgccggaaatcgtcggtgtcacctccatacccagtaccgcttctttaaactcaatactggtggccccgctgtttcctgccgacacttcataaggaatttctgtgccctgcttaatcgaagcggtctgctgatgtgaggtaaagaggcgcggactggcgataatttcaatctggttctcctgctccagcgcacttaactccagatccagaagctgccctccaatgcgcgccagcgccatacccacgctgatgccgggtgaactcaccgctagcggaacatccagccgcggatgatgcaggatatcagtaacggcggcgtcccccgcctgcaatccccacttcacgcccagctcctgcagatgctcctcgctgatagtgacgatgtgggctgacagttcaatctgttccagtggcagatccagcgcccgtatccagcgctccgtctcttttaaagccgccgcactatcgcgcagtaacaatgcgttggtgcgtttgtcgaccgtcacgctaccgcgcggcgtcatcagcgactgacgctcactcagcaggctggcatacacctcgctggcgctggcataacgcaatatcacagcgcgctgttgcaaaggaacctgctgcaactgcgactgctgctcagcctcacgtgcctgctgctgagcctgctgccagctttccggatagaccagcaggacattattctgttcaaccagcgtcagctttgccatgcgcgccaccaggttgagcgcctgatgccagggcaggttatccagccgcagcgataacgaaccttcaacctctggcgcaatcatcagattgatctgctgatagtcagccagcgcctgcaaaatacgctctaccggggcgttatcaaaagtcaggctgagaggctcctcatcagcggcgtaaaccggcagcaggcagcttagtagtagcagcagagtggttatccttatcatgcgaacgtccttttaaataaaatgcggcctgttgtgcgttgcagctattcggcaccgctaaggtgaggctgcggcgggtcatacccgccagttgccagggtgcgaatggaaatggcttgccggtgcgggccgtaatactctctccctgcggggtcagcagccaggcatggaaatgcgcctcccggccaatgatcccctgcagacgccagccggtgagcggttccactgtcgcctcacagacggaaccggctacaggccggaacggatcgcgcgccagcacgccgccacagcacaacagtaaaatcagcagactatggcgcatcgtcaggttccagccagagttgagccaccaggtactgcggctgcgccagcagctggaaatgcaccggaaacggtgcggaggcctgggccagctcggcaaaaagcgactggaacgccggccactgcagatgcagcgtcagcatgcgtgagggggcgtccggctgccactcttccagctggctacggcgtgccgccaggatctcttccactgcacggcccgatgcagatgctgatctcgcgatctgtatcgactgcagctgcgcctgcaactgtgcattatcggggttctgacgccactggtgctggcgcagctgcagagtgcgggtcaactgcaacagcgtctgctgttcagcaatgagcgcctgctgctgtggccgtaaccacaggatccaggagagcagcagcagaccggataagagtgcggcgagcaagccatagcgcgcaatagcggccatctgccaccagcgctcccaccattcactcactgttcacctcctgcatctctgcccgcagtgaaaaccgataatggccatcagcctgacgcttaaccccgccctgcttcaccagaccaaacagggccacagtggttaattgctggcggaactgtcggactgccgccatatcctgtgcctgcccctccagtgtcagacggtcgtcgcgcttctccagccgggtcagccaggcggtgtcgggaagtaacgcgggtaaatcgagccagaactgctgccaggcggccagttgtgcagcctgctggcgatgcttcgcctgctgtttttgcacgaccgcgagctgctccagtaactgcttctgttgcgctaactgctgccccaggctttccagcgcctgctgctgcgtcctgctcgcctgcgccacctgctgacgcgtctgctggatccgccaggtttgctgcatcaccaccagtaacagggcgccagtcgccagtgacagcacgaccaggctttgtcgccgctgctgttgccgacggcgctgccgccagggcagcagattaaccgcgaccatcactcatctccgtcgcgcagcgccagcccggccgccagcgcaaaagcgcccggattctccggcaaaggtggctgcttataacgaaacagatcaaaaggggaaaacgcgctaacgtctgcgggcaacggcgtctgctctgcggtacaccaggcgacagaaacgcgccccgggaaaggcctgccgttgcagtgcctccagcgtggcggcttcgcctgtgtcagcagcggtgtgcgcatcgctccagagccagcggttatcctgctgcagaaccagtaccgcatcgtcctgcagcgctgcctgccgggctaaccgcttcagcgcctcggtggtcagttcgaacacctgcggttttaaacctgcctgcaacaggggtgccgcccactggtcgataatctccagccgcgctgccgtgacgcagagctgaccgctctgcgcatccggccggtaatcaagcgccagcgcagcgggctccagcggaaagagacggcgcgcggccgcctgcacgtagtgccccagcgcgggctcattcagcgactgcgcaggaagggggagctggcgctgcagcaccagctgggcaggcaatccgacccgcagcgaataacggcgtggcaaccgctgacgccaggtcgttaaggccgccagtaattcaggcgaagattgcagcacgccgtttcttaacgtatcttgcggcagccgctgctgccaccagtggcgtagctgccagccatcacgacgaggctggagggccagggcgcaaatctgcctattctgaatatccagcccaatttgccaggtatgaaaagccatacgcgcgatctccttatcgtccgggaaaatggacatatcaaagcgtctggcttgcctttatactaccgcgcggttgtttataaactgctcaaacgacaacagatgggaaattccaggtgaagttcgtaaagtatttattgatccttgcagtgtgttgcatcctgttgggagctggctcgatttatggtttatacaaatacatagagccacagctgcccgacgtaaacacgctgaaagatgtgcgtctgcaaacccctatgcaggtttacagcgccgatggcgatctgatcgcccagtatggcgaaatgcgccgtattccgttgactctgcagcaagtgccacctgtgatggtgaaagcgtttattgcgaccgaagatagccgtttttatgagcaccatggtgttgatccggtgggtattttccgtgcggccagcgttgcgctggtctccggtcacgcctcgcagggtgccagtactatcactcagcaactggcccgtaacttcttcctgagcccggaacgcaccctgatgcgtaaaataaaggaagcgttcctggcgatccgcattgagcagttgctgaacaaagatgaaatccttgagctctacctgaataagatctacctcggctaccgtgcttatggcgttggcgcagcctcacaggtctattttggtaagccggttgaccagctgtcgctgagtgagatggcgatgattgccggtctgccgaaagccccttccacctttaacccgctttactcgccgagtcgtgccctgtcgcgccgcaacgtggtgctggcgcgtatgctggatcagcattacatcacgcagcagcagtatgatgaggcgcgtaatacgccgctggtcgcgaagtatcacggtccggaaatcgctttctctgccccctatctcagcgagatggtgcgtcaggagatggtgaaacgctacggtgagaatgcctacaccgacggttacaaggtctacaccaccgtgacccgtcgcctgcaggaagccgcgcagacctccgtttcgcaataacgtcatggcctacgatatgcgtcatggctatcgcggcccgaccagtgtgctgtggaaagtgggtgaaccggcctgggatcagaccaggattgagaaagcgctgaagacgctgccggtctatggtccgctcaatccggcagtcgtaacggaagcgcgcagcgatgaagcgaccgtgatgctgaaagatggcagcaatgtgtcgctggcattagccggagtgcgctgggcgcgtccttataagtctgacaccgtgcagggcccgacgccgaaaagcgtgacgcaggtattgcaggcaggccagcagatctgggtgcgcaaggtgggtgatgagtggtggctgggccaggtgccggatgtgaactcggcgctggtctcgctggatccgaatgatggtgcggtgcgcgcgctggtaggcggctttgcctttaaccagagcatgtttaaccgtgcgacccaggcgctgcgtcaggtcggctctaacatcaagcctttcctctataccgccgcaatggatcgcgggctgacgctcgcctcaatccttaacgatgtgccgatttcacgctgggatgcgggtgcgggtgctgactggcgtcccaagaactcaccgccaacttacgatggtccgattcgtctgcgtcagggtttaggccagtcgaaaaacgtggtgatggtgcgtgcgatgcgtgcgatgggcgtggattacgccgctgagtatctgcagcgctttggtttcccggctcagaacattgttcacaccgaatcgctggcattaggtgcggcctcatttaccccgttacaggtggtgcgcggctactccgtgatggcgaatggcggcttcctggtcgatccttacttcatcacccggattgagaacgaacagggcggcctcgtatttgaagagaaaccgaagatcgcctgcccgcagtgcaatctgccggtgatctacggcgagaccaaaaaagcgctggccctgaatgaagagagcgtcgagaacgttgcagcctcaaataacaatcagaatcaggccgttcctcagcctgaactggagcaggttcccgctcaggcacaacagggtgagcagcaatatgcgccgcacgtgatcaacaccccgctcaccttcctgatcaagagcgcgctaaacagtaacatctttggcgaaccgggctggatgggaacaggctggcgtgccggacgtgacctcaagcgtaatgatatcggcggtaaaaccggtaccactaacagctcgaaagatgcctggttctcgggttacggccctggcgtggtcacctcagtctggatcggctttgatgatgcgcgccgcaatctgggccgcagcacgctctccggcgccattcccgatcagatttcgggctatgaaggcggtgccaagagcgcgcaaccggcatgggatgagtacatgaagagtgcgctggatggtgtaccggtgcagccgttaacaccgccggatggtgtggtcaccgtcactattgatcgcagtaccggcaagctggcaaatggggggggtaacacccgtcaggagtacttcatcaatggcacccagccaaccgaatattcggttcatgatgtgggtaccaccattatggataacggtgagagtcacgagctgttctgatgtgacccacgaaaccgcactgtaaaaaaggccgacgtcagtcggcctttttttattcagtcacagatgatattcagtaactcagccgcccctgcttcaccagccattcgcgcgccataaacagcgcactgacattacgtgcctcgcggaaatcgggttcatccagcagcgacatcatatcgctcagcggccagcggtggacaatcagcggctccggctcatcgccttccagcttttcagcgtaaagaccttccgccaccacgatgttcattttgctggaaaagtaagagggtgccatggtgagtttgcccagcgttgtcagctgatcggcaccaaaaccgacctcttctttcagttcgcgaactgccgcttcattcacggtttcacctgaatcgatcagccccttggggaaaccaagctcataggtttccagtccgacggcatactcctgaatcaggatcagatggtcatcaataatcggcacaatcatcaccgcttcacgctctgagggcttcatccgctcataaacgcgatgcgcaccattgctgaaagtcagatcgaccgattcaatggtgaataaccgtgaacgtgccacggcggtgatattgaggatgtcaggtttttttggaattttcatatcagcctcaaattattttgcgccggctatctggagcgaattagcatacctaaccacaggcaattgtgcgacagtcagacaatcacgttatcgttacacagattacatcgattgaataacagcctttggttatcagttaagactaaatttgcattagtcaatatgctgcgataagtttcagataataccgatatttaatccagtctgagccggttaccattcggacaaggcagggtttaacaaatgctaatcagatatacgctggcactatttcatcgggtgtctgactcctcagggttatataatcttccggaatgcctcttttatagtgagcataaccgaaagcgaaagtttaaagtgaaggcagcattttggctgaattgagcagagcatgagcacaatcttgatgatcctggccatagtgctgacctgttcaatcctggcaggcattgggttctggtacgctatgcggcatcgtccgccgttggcgaaacctctgccatttatcagtccgccctgccgtaaactctctgctcaggagcgtgaggcggttgataagtatgtcgccgcgctggaaaagcagccccgtaccacggtgacgaccgataagcgcagcgcgtccgaacgactgacgctgacggcacaaagcaacaatgtctaccccgttacccgtgcgattacccgctacggactctctacggacgatccccataaatggcgctactaccttgatgaagttgaagttcatctgccgccgctgtgggaacagtacatcgccgacgaaaactacgttgagttaatccgcacccaatctattccgctggtgatctcgctgaacggccactcgctggtggattacgccgtggatcagcaatcgctgccgacgctgatgcgtccggtgtcgaccaacgcctctatccgcaaagcggaaacggaaaacgtcgaactgctgcaggtgcgcaaagagacgccggaagagtatcgtctgtcgcggccagatggcacgcgtgaagcggtgatcatctctcttgccttcttactcttcttcttcagcctgttagtccccgcaacgctgatgatctggctggtgctgacgggtgcagtcatgattgccgccagcctgtggctgctctaccgcattccgggtgagcgcggcctgcgtgacatacactgcctgcgcggcgcgccaaagcgctggggcctgttcagcgaatcgaaccaggagcagagcaatatcacgctggggattattgacctcgcctatccaccacactggcagccttatgtcgcgcacgatctcggacaggtgacggatgtggagatctaccttaaccgtcaggtggtgcgtcaggggcgcttcctgtcgctgcaggatgaagtcaaaaacttccctattcagcgctggcggaaaaacgtggtgctggcctgtggttcactgatggtgctgaccatgctggtcacctggatcccgctcggcatgccgatcaaactcagtctggcctgggccaggggcactgacagcctggaggtcagcagcgtcgataaactcagcagcgtgcccctgaatattggcgacaacctcaaagtgagcggtaccggcatgtgttcggtgccggacaactatcagagcaaccgaagttacgccttcatgccgttcgactgctcggcggtctactggaataacgccacgccgttgccgcagccacaatcggacattattgataaagcagctgctctgctggagaccaccacaaagcagctgcatccggaaaccaataccgatcctaaactgaatccgcagctggcctccgcgattcagaagtccggcatgatcctgctggatgacttctccgatctggtgatgaaaacgcaggatctctgtaatcagccacaggattgtatgcgcctgaaaaatgcgctggtgaacctgggcaatgccaaagactgggaagcgctgatgcgtcgcgcagattccggccagctaaacggcatgaatgtgctgctgcggccggtcagtgccgaagccctggaaaacctggtcaataccgccacctcgaccttctttttccgcgaaacccgtcgtgcagcggaaaatcttaacagcccgccgccagggggttttctgatcgtcagcgacgagggtcgccagctggtgaatcagcctcagccaaccgtgtcgctgtttgatctcgatccgccctctcagtggcgcgaactgcaacgtatctccgccatgctgctgcatacgcctttcagcgccagcggcatcatcaccagcatttcaacggatgccaacggcacgcgtcatatcgtgctgcacaatgaaccggatgccatggcgcagtggcgctatctcggcaccgtattgctgctgctggtgctgttaacctgcggtgtgatcaatgggttactggcgctgcgccgtatgcaccttaatcgccagcgcatgatcgatatccagcactactacgacaagtgcttcaatcataacctcggcactttgcagagcgtgcgcccgatattctgagccctgcccttctgtgctaccctgtcgcccggtttttttacagggtgaaacatccgcatgctcaactggtctgagattgataccgtgctgctcgacatggatggcacgctgctggatttggcgtttgatcgccacttctggctggagcatgtgcctgaacaactcagtcagcaacgcggcattacccgggcggaagccgaagcaatcatcgcagaaaagtatcaggccgttgcccatacgctaaactggtattgtctggattactgggcagaagcgctggcgctggacatccgtgccatgacctgggcgatgcgcagccgcattgcgctgcgtgacgatacgctgccttttttgcaggctctgcgccgtgccggcaagtccactatcctgctgaccaacgcgcatccttacaatctggacgtcaaactagcgcagacaggtttagcgccgcaccttgatttattactttccacccatacctttgggtatccgaaagaagaccaacgtttatggcaagcggtacaacagcacaccggcttttctgcgccgcgcacgctgtttatcgatgatagcgaagtgattctggatgctgcggcgtcatggggcatcggcgagtgcttaggcgtaaagaaccccgattcgggtcgtcctgagcaaatctttcagcgtcatcgcgccaccggcgactaccggacgctgatctgagtcaggagcagcaatgaagaaagagaaaagcagcgaagaggtacgcctcgacaaatggctgtgggccgcgcgcttttacaaaactcgggcgattgcgcgggagatgattgaaggcggcaaagtgcattacaacggccagcgcagcaaacccggcaaggtggtagagctgaatgcggaactgacactgcgtcagggcaacgatgaacgcaccgtagtggtggcggacatcagcgctcagcgccgtccggccagcgaggcccagcagctctatcgcgaaaccgatgccagcattgaaaaacgcgaaaaaatggcgcaggcgcgcaaaatgaatgcgctgactatgccccatcccgatcggcgacctgacaaaaaagagcgtcgcgatttgatgaagtttaaattatcgggcgatgaataacgccgtcttagctgacgcgccatcgccccgtaccagtgagagaaaaaatatgtcagcccaggatcaactgcaccgttatctgtttgaaaatgccgccgtgcgcggcgagctggtgaacgtctctgacacctggcgtgaaaccgtaaagaaccatgactatccggcaccggttaaaacgctgctgggtgagatgctggtcgccaccagcctgctgactgccacgctgaagtttgatggcgaaatcaccgtgcaattgcagggtgacggtccgctgtcgctggcggtgatcaacggtaacaacaaccaggaaactgcgcggcgtagcgcgtatcaaaggcgacatcccggacgacagtaccctgaaaagcatggtgggcaatggctatctggtgatcaccatttcccctgaaaagggcgaacgttatcagggagtggtgggactggaaggtgaaactctggcggagtgcctggaagattacttcatgcgctcagagcagttgccaacgcggctgtttatccgcaccagcgacaaaggcgccgcgggtattctgctgcaggtgatgccggcgcaggatacggagaaagaggttttcgaccatctggcaacgctgaccgaaaccattaaaacggaagagctgatcgatctgcctgcgaatgaagcgctgtggcgtctctaccatcaggaagaggtcaccctctacgatccgcagccagtgatctacaaatgcacctgctcgcgtgagcgctgtggcgaagtactgaccacgctgccgcaggaagaggtagatgagatcatcgcggaagatggcaaaatcgacatgcactgcgactattgcggctcaaactatgtgtttgacgccgtcgatatcgccggtattcgcagccactcccttgagaataataaccagcttcactgatttatcgggcggcttctgccgccccttccccgccgcccatgcctatccccataatttttcagacaaattatctttttttactttcataacatcttttaaacgttcgaaacatagccttaacgcgccctgagtcgcatttttagatcactgctctttttcccttaacgcagaagagtaaactgcgcgcgatcgtgcaaacgcccggaagtcagaggcagatgccctgaattgcccggtgatctttgcaggctgtcgtgacgaagcgcagtcgactgtcagtgatttgccgcacccgatacaacagccggtggcacgatcccaacctatctctgctttgcagaacagacaccgatttaaggagcagtaaaatgcgcgttaacggcctgacctcgcaagaccttgccgctttgggcatcgtggataccacggaagtggtttacaaccctgattacgacacgctttttcaggaagagacgcgcccggacctcgaaggttttgctcgtggcaccctgacgcagagcggcgcgattgcagtagacaccgggattttcaccgggcgatcgccaaaggataagtacattgtgcgtgacgacaccacgcgcgataccctgtggtggaacgaccagggcaccggcaaaaacgacaatcagcccctgtcgcaggagacctggaacgcgctgaaaagctgcgtcacccgccagctttccggcaagcgcctgtttgtggtggatgcgttctgtggtgccaatgccgattcccgtctgagcgtacgttttgtcaccgaagtggcctggcaggcacacttcgtgaagaacatgttcatccagcctgacgacgctgaactggccgaattcactcccgactttgtggtgatgaacggcgccaaatgcaccaatccagactggcaggcgcagggtcttcactctgaaaactttgtcgcctttaatctgactgaacgcatgcagctgattggcggaacctggtacggcggcgagatgaagaaaggtctgttcgccatcatgaactacctgctgccgctgaaaggcatcgcctcaatgcactgctcagcaaatgtgggtaaagcgggcgatgtggcggtcttctttggcctctcgggcaccggcaaaaccacactttctaccgatcctgaccgccagctgatcggtgacgatgagcacggctgggacgatgatggcgtgtttaacttcgagggcggctgctacgccaaaaccattaacctctctgagcaggctgagccggagatctaccgcgccattcgccgcaatgcgctgctggaaaatgtggtggttcgcgaagatggcagcgtcgattacgacgacggcagcaaaaccgaaaacacccgcgtctcctatccgatcaatcacatcgacaatatcgtgcagccggtctcaaaagcgggccacgcgaagaaagtgattttcctgaccgccgatgcgtttggcgtgctgccaccggtttcacgtttgacgccggagcagacgcagtatcatttcctgtcaggtttcactgccaaactggcggggaccgagcgtggcgtcactgagccgacccccaccttctccgcctgtttcggcgcggcgtttcctgatgctgcatccgacgcagtatgcggaagtgctggtgaaacggatggaggcgtcaggtgcgcaggcttatctggtcaataccggctggaacggcagcggcaaacgcatctcactgaagaatacccgcgccattatcaatgccattctggcgggtgagctggatgatgcgccgatggaaacgctgccgatctttaatctgcagatgccggttacgctgggcgaactggatagtgatacgctcgatccgcgtcgtagctgggagagtgaggagaagtggaccgccgccgccgaaggtctggcgcagcgctttattgataacttcgacaagtacacggataacgccgcaggtgctgcgctggtgaaagctggcccgcaacgctaaaagaagcggcgcggcaatgaaactgccgcgccgtttttatcatcccgacacgctgttgctgccgttgttgtggctcagcgccatgctttccactaacggcaaccaggcacgaatgcgtaaaccgccgcgttcgctctcgccaatctccagcgagccctgatgggcatcgatgatacgctgcacgatcgccaggcccagaccggttccgctggtgctgcgggcgctgtcgccgcgcacaaagggctggaacagatgcgccagctgatccggcttaatgccaggtccatcatcttccacctggaaccaggcacgatgcagttcccgtccgctgctgaccctgatccagccattaccgtatcgcgcggcattgaccaccaggttagccagtgcccgtttaatcgacagcgggttgatatccagcattaactcttccggcatcaccgcattttcgatctcacgttcatagccgctttcagcggccaccacttcgcccagcacactgttaaggtcggcgcgctcagtctgcatctcctgaccggtacgcaggtagtcgatgaactgttcgataatggcgttgcactcttcgatatctttattaatcgattcggccaggtagccatcctgctcgctcatcatctcggtggcgagacgaatacgggtcagaggcgttcgcaaatcgtggctgacgcccgccattaacagcgtgcggtcatccgccagctgcttcaccccggccgccatctggttaaaggcgcgggtcaccgatcgcacttctgacgcgccatactcgcgcagcggcggcggaataatcccgcgcccgacctgcagagcggcgtgctccagatccaccagcgggcggttctggatgcggataaacagccaggcaccgccaatcgccagcagcataatcgccagggtgtagcggaacagcggcgagaagtcgccctgatgaatctcagtcagcggcacccgcacccagatatcgggcgacagccaggttttcagccagacgacgggcgagtttttgttaacctcaacccgcacatcggtgggaccgccaagctgctggcccatctgctcgctcaggaattcatagtgctgcgcccatcgcaatccgctctcctctgctgctgcattggtgtagagcgagatccccagtttcgcggtagatttcccggcgaaacgccggtggcacttccagctgcgtgccatcttccagctgcaaccggtcggtcatcagcatacgaacttcgtaagcgagcaccttattgaactgttgcaggctgggaagaatggcgaagttcagcaccaccagataggtcgttaccaggctgacaaacagcagggtaacgatcagcagcagggtgcgggcaaacgaactgcgaggcgagaagcgcagtcgcttcatgctttactgccgtccggcacaaagacgtagcccagaccccagacggtctggatataacgcggatgcgcaggatcctcttccaccatgcgacgcaggcgggagatctggacgtcaatcgaacgttccatggcgctgtattcacggccacgcgccaggttcatcagcttatcgcgagacagcggctcacgtggatggctgaccagtgctttcagcaccgcaaactcaccgctggtcagcggcatcggctcatcttcacggaacatctcgcgggtgccgaggttaagtttgaacttaccaaaggcgatgatcgcctcttcctgcgaaggtgcgcctggcagttcattggcctgacggcgcagcaccgcacggatgcgcgccagcagctcacgcgggttaaagggtttaggaatatagtcgtcagcgccgatctccagccccacgatacgatccacctcttcgcccttggcggtcaccataataatcggcatcgggttgctctgactgcgcagacgacggcagatggaaagaccatcttcgcccggcaacatcaggtcgagcaccatcagatgaaaggattcacgggttaacagacgatccatctgctcggcattagcgacactgcgcacctgaaagccctgctcggtgagatagcgttcaagcagtgcacgcagacgcatatcatcatcgacgaccagaattttgtagttctcttgcattttcaactcccaaaggcgctattgcctgagccaacattgttaaaaaaagatgccttatagtgacagtcattaatggtttatattctagccaaaattgttacaaagcatattaaacaggagcttatatttgatttaaggcgatttcgggtcagttttaacgcgtctggcgctgcccggcccctgttacggcaaatctgaaaaaacggctctgtttctctgaatcgctggcgtcagaagcgggccagtttttattcgatgaacgaattcagcaagttagcagacaatttgacttaatgatcagccatcattgtggataagctccagataatctacctcaacagcagtcaggcagcataatattccagcaaacctgcgtaacgccccactctcctctcggattagtttcagcggtgccaccagcaagaccagttgaaattaaagtccgttaaatcaatcagtaaagccaacttttcgccatctccgttttcaaccagactgctcaggcaacattcgatgtctcaacggggattacacacaatgaaaaaaacaattttactgctgagcgcgctggcattaagcagcgtcactccagcttatgctgccacagccaccggtgaagcagctggcgcagcggcaaccaccacagcacaaggtaactctaacgccatcggtgttggcgcagtcgcagccctgctgggcgttgcgctggccaccatgggcggcggcggcggtgacggtcacagcaccggtacatcgaccaccacggcgactcacgccggtaaataagtatcacgacttcttttacagcttcagattactggcttcagattgttgttcagcaccaaccctttcgccgccggggaagtcaacgtgggtttttagcctttaaaaaccctttccccgcccttttttgccgcgccccctttgtcttacactgttcctctttggatctctctggccggtatagcatgaaaacccgactcattacccgcgaaggcttcgataagctgaaagcagaactcgactatctctggcgtgaagagcgaccggaagtgacaaaaaaagtcacctgggctgccagtcttggcgatcgcagtgaaaatgccgattatcagtacaacaaaaaacggctgcgtgaaatcgaccgtcgcgttcgctatctgaccaaaagtcttgaacagctgcgtatcgttgactattcaccccagcaggatggcaaagtcttctttggcgcctgggtggaaattgaaaacgatgagggcgacctcaaacgcttccgcattgtgggctacgatgagatttttggccgcaaagattacatctccatcgactcgcccatggcgcgggcgctgctgaaaaaagaggtcggcgatgccgccaccgtcgagacgccagtggggccggcgctgtggtatatcaacgcgattgactacccgcaataacccttcagattatcgctgaaagccgcccgcgtctctggcaattttaaccatcaatccgtataactgtcggctatttctcaacccggaaagcaagacaatcctgatgatgaaagttctgagccagataattgccagtgagctcaaggcgcgtccagagcaagttgacgccgccgtttcgcctgctggatgaagggaataccgtgccgtttatcgcacgctatcgtaaagaggtcaccggcgggctggatgatacccagttgcgccagctggaaacccgcctcagctatctgcgtgaacttgaagagcgacgccagtcgattctgaagtcgattgacgatcaggggaaactcactgacgacctcgcccgcgcgatcaacaccaccctcagcaaaaccgagcttgaagatctctacctgccctacaaacagaaacgccggacgcgtggacagatcgctatcgaagcgggtctggagccgctggcggagacgctgtggcaggagccgtctcacattcctgagcagcttgccgaacagtatgtcgatgccgacaaaggcgtcgccgacgtccgtgccgcgctggatggtgcccgctacattctgatggagcgtttcgctgaagatgccgcgctgctggcgaaggtgcgtaattacctgtggaaaaatgcccatctggtgtcacgcgtggtggaaggcaaagaggaagcgggcgcgaagttccgcgactactttgatcaccatgaagcgctgagcggcgtgccgtcgcaccgtgcgctggcgatgctgcgtggccgcaacgaaggcgtgctgcaactgtcgctgaatgccgatccacagtttgatgaagcaccgcgtgaaagccatggcgaaacgctgattgctgagcacctgaacctgcgcctgaataacgctcctgccgacaactggcgtaaagcggtggtgagctggacgtggcgcatcaaggtgatgctgcatctggaaacggagctgatggggacggtgcgcgaacgcgcagaagatgaagcgattaacgtctttgcccgcaacctgcacgatctgctgatggccgctcccgccggtatgcgcgccaccatggggctggatccgggcctgcgcaccggcgtcaaagtggcggtggtcgatgccaccggcaaggtcgtcgcgaccgataccgtctatccgcataccggccagaccgcgaaagccgcggccgccgtagcggcactctgcattaagcatcaggttgagctggtggcgattggcaacggcaccgcttcacgtgaaactgagcgcttcttcctggatctgcagcagcagttcccgcaggtcacggcgcaaaaagtgattgtcagtgaagctggcgcatctgtctattcggcctctgaactggcggcgctggagttcccggatctcgatgtttcgctgcgcggcgcggtgtcgattgcccgacgtttgcaggatccgctggctgagctggtgaaaatcgatccgaaatcgatcggtgtgggtcagtatcagcatgacgtcagtcagagccagctggcgaagaaactcgacgcggtagtagaagattgcgtgaacgccgtcggcgttgacctcaacaccgcctcggtgccgctgctgacccgcgtggcgggcctgacgcgcatgatggcgcagaatattgtcggctggcgtgatgagcatggccgcttccagaaccgtcagcagttgctgaaagtgagccgccttgggccaaaagcctttgagcagtgtgcgggcttcctgcgcatcaaccatggcgataacccgctggatgcctcaactgtgcatccggaagcctacccggtggtggagcgcatcctggccgccaccgagcaggcactgagcgatctgatgggcaacgcaggcagcctgcgtaatctcagcgcccgcgatttcattgatgaacgttttggtctgccgaccgtcaccgacatcatgaaagagcttgagaagccgggccgcgatccgcgtcctgagtttaaaaccgcacagttcgctgaaggcgtagagacgctgaacgatctgacgccgggcatgatcctcgaaggtgccgtcactaacgtgaccaacttcggtgcatttgtggatatcggcgtgcatcaggatggcctggtgcatatctcttcgctctccgatcgcttcgtggaagatccgcatcaggtggtgaaagcgggcgatatcgtcaaagtgaaagtgatggaggtcgatctccagcgcaagcgtattgctctgaccatgcgtcttgatgagcagccaggcgaaggcaatgcccgtggtggcgcgaagaaacgctgctccgcgcgaggagaaacgtcagaacaacgcgaaaggtcgtccgcgtccggtcagctcgtcagcaggtaacagtgcgatgggtgatgcgctggctgcggctttcggtaaaaaacgctaagcttttcagggggccactgcctggccccctcttcacacccttctccccggttgaaaatccccgccatcgcgctacgctaaaaagacgcctgtcataaaaacaacacctgctgtggcacccaattcacgatggaaacgatcaccgatctgattgataagatttatgctggcacatttccggaggcgacctttgcgcgcctgctggctgacatcgccaccgcccgcgaggccattaagctgccgcgcaaggcacactgggatgagcaggatgtggtgctgatcacctatgccgatcagtttcgcgaagccgataaacccacgctcagcaccttttcccggttctatcagcagcacctgcaatccacgtttccgctggttcacctgctgccctttttcccctggtcgtccgatgacggcttttcggtgattgattaccatcaggtcgatccgctgtgcggcgactggcaggacattgcgcggctgcatcaggaaacccggctgatgttcgattttgtctgcaaccatatgtcggcacacagcgcctggttcagccacttcctggcgcaggatcccggctgggacgatttctttatcagtatgccgcccgccaccgatctcagcgccgtgacgcgtccgcgcacctcgccgctgctgacgccgtttaaaatggcggatggcgaaacccgctttatctggaccaccttcagcgctgatcagatcgacctcaactttgccaatcctgaggtgctgctgcgcatggtcaatgtgctgctcgactacctgaaacgcggcgctgactatgtgcgtcttgatgcggtcggctatatgtggaaaacgcccggcacgcgctgtattcatctggaaaagacccatcagctggtgaagctgtttcgcgctattgccgaccaggttgcgccaggcacggtgattatcaccgagaccaacgtgccgcatcaggacaacatcagctatctgggcaacgggcacgatgaggcgcagatggtctatcagttttcgctgccgccgctggtgctgcatgcgattcacaccggctcggcgcgcgcactgcggcagtgggcgagcgctctggatctcagcagcaacgacaccacctttttcaactttctggcgtcacacgacggcatcggccttaatccggcgcgcggcattttgtctgaagtggagattgtggcgctggtgcgcgatctggcgctggaaggcgcgctggtctcctataaaaacaaccctgacggcaccaccagcccctatgaaatcaacgtcacctatctggatgcgctcaaccgtgaagatgacgatgacgccacgcggctgaaacgttttttgctggcccatgcgattctgctggtctttcccggcgtgcctgccatctatatccagagcattctgggtggtcgtaaccattacgatggcgtgcgcgccgccggacacaaccgggcgattaatcggcagaagtatgatttacagcagatagaagcggatctggcgggcggtaactggctgcgccagcaggtctatacgcggctcggccagctgattcagctgcgtcgtcgccagcctgcgtttcacccggataatccgatgacgctttatgagagcgaaaacgccgtgctggtgctcagacgtcatcagccagaaagcggtgacgggctgctgtgcgtgtttaatctcagtggacggtcagtggagacgcaattaccggtggcgcatacgttgcaggatgtggtgagcggagagaaaattgatggcacccagccggttaagctggatgcctggcagttcatgtggctacgttaattacttgtagacttcagccgttgcgctgaatttaccgtgttcgcggcctgcgatcacgcggtagtatttaccgcccttttcgtcagcgagcttcgacaacactttcttagcatccattggcgaggtggtttccgccgtggtgttaacgttgccgatcttttgcaggttcattgttttaacttcttcctgggtgacttctttcgctgccatcgcagaaaatgaaatcgcgcccatcatcattgaagccacaacccatttaaaaaccttcattatgtttaccctcattcatgatccattgtgagatgtaagcagccgctaaacgcgtaaggcagtatggaacggcatagtcatttccatgactaatcacataaaattgcaacggcctcgctcacagagagaagtattgctgctgtctgcgattttgccagttcaaagcgtcattatcacggcagattactgataaaattaacaatatgctggcaaaagctctcaggatgggaaataaaaggcgcatgtgcggctttttcgataaccactgagggcgatgctggcaacatttcatcaatctccgccacaatccggcgcggcaccagtccgtctaacgcgccatagagccgcaggaaacggcagcgtaatctgcggtaacgcgtcgcgcagatcgacctggcgcagaatctccagtccgccatccagcaccgccacctccggcatcggctgcgacagcaccacctctttcagctgccgcgcatcggcgcgagccgtttcggtacccagcgtctgcagcgccagaaagcgctccaccgtgcgctggaaatcgttgctgagcatctgctgaaagttctgcagcgtctccggtttaatgccgggccagctctctgtggcggtgaaacagggcgacgaggcaacggtgatcaatgcagccagtttttctggcgcactcagcgccagctgcgtcgccaccagtccgcccagcgaccagcccaccacaatcgactgcggtggcagcgcaggcagcaattgcgctgccatctgctccagcgtcagcgcaccgaaatgctggctgcggccatagccgggcagatcgaccagatgcaggcgatagtgcgcgctgagtcgcggaatgatgctttgccagacttcggcattcagtccccatccgtgcagcagcacaagatcgcgttttccttctccgcaggtgtgccagtagagcgacgtcatcagttactatcccgaaaatgataaggaggtcgctatgctagcaatgcccgccctgtgttggctatgccggatgccgttgcggatagcccggcacggcatctgcagcttatgtctgcgcggattaccgccgttaccgctgctctgtccacgctgcggattgccggcaggttcagcaaaggtcgcctgcggccgctgccagcttaaaccgcccgcctggcaggcgctggtctgcgtcaatgactattgtccgccgttcagccagtgggttaaccagcttaaattttctcacataaccgcactcagggtgatgctggcgcggctgcttttgctaagctggcttaatgtttaccggcgtggcagtgtgccgcgtcccgatctgctgctgccggttccgctgcatcggcgacgacgctggcagcgtggctttaatcagacggtactgctggccgcaccgctggcgcactggctgggatgtgaatggcgcgaaggtctttcccgcaagcgcgggggcgcattacagcatcagctcagcgcccgccagcgccgcaccaacttacggggtgctttctgccttgaaatggtggtgcagggacgccatatcgctctgctggatgacgtcattaccaccggcagtacggtagatgaaatcagccgcctgttaatggcccagggtgccgccagcgtgcaggtctggtgcctgtgccgtaccttgtagagcgtctttgatgggcgtattataaccaactaaattagtcaactattgagcaatcgacatgatccgaattactgactctgcccaggaacatttttctaaactgctatccaaacaagaagatggcacccagattcgcgtattcgtgattaacccgggtacgccaacagccgagtgtggcgtctcttactgtccgcccgatgccgttgaagctactgacaccgaactgaagttcgaaaagctctctgcttacgttgatgaactgagcaagccgtatctggaagatgctgaaattgacttcgttaccgacaatcttggttcacagctgacgctgaaagcgccgaatgccaaaatgcgtaaagtctctgatgatgcgccaatggttgagcgcgttgagtatctgcttcaggcgcagatcaacccacagctggccggccatggcggtcgcgtgtcgctgatggagatcaccgatgagggctacgccattctgcagtttggcggcggctgtaacggctgttcgatgatcgacgtgaccctgaaagatggtatcgagaaagagctgctggccgccttcccggaactcaaaggcgtgcgggatattactgagcatcagcgcggtgaacactcgttctactgatgattaagcgcggcagcctggctgccgcgcttctgttattgccctttctgtcctgactgacgctgctggctgaccaccttcagcagtgcattcacttccttgtccgcaaagatctcctccagcgttttgctcagcttgcgtcgccagttagggtactgctccaccgtgcccgggacgttgaccggcgtggtcatgccaagccagtcctcaggctgcaggccaagcagcgcactgtcggtatccgccaggaagcgatgtattgcccgattcagcacaggcgtcatggtgagcttctctgccttcttctggctgcgtgccggtaaggcgcccgcctgatgcagcgcatccagcagcgcctgcttctgcgcggcgcgctgctgatgtaacgctttcaccgcatcgcccggatagaggccaatcttctcacccagcgccaggtcgccctgctcccagaagccggtcagcgtaggcagatcatgcgtgctggcgctggcgatcgactggcgcggatagtcctgcggcgcgcgatagcgctcatccttctcctgctcaaaccagagcaccttccatgaaaagacgccacttttacgcagcaggctgacaatctcctggggcacagtgccaaggtcttcaccaatcaccatgcagcgcagccggtggctctccagcgccaggatacccagcagatcgttgaccggataggccacataggcgcctttatccgccgtctccccggcaggcacccaccacagacgcagcagtgacatcacgtgatcgatgcgcaacgcgccgcagtcgcgcatattggcgcgcagcatgtcgataaatggctggtagccgcgcgccttcattacatgcggatccatcggcggtaagccccagttttgtcccagcggaccgaggcggtcaggcggcgcacccaccgaggccttgaggcggtaaagctccgggtcgtgccaggtttccgcgctgccttccgccacgcccactgccaggtcacgatagagtccgacgctcatgcccagcgcctgactgtgcgtccagcagccagagaactgctgctgcgctagccattgcagccactgccagaaagcgatctcctcatcatgctgtgcacaccactgctgcacctccggcaactggctgttgcgccacgcttccggccacgcaggccagccgccctgctgcgccttgtctgcccgccgctccagctgtatgccgtcgtaagcggcctgataacgcaggctgtcgccgccttcacgcacaaaggccgcccaggattgatgctcttcgctctggctgtctcgcgtctgaaagtgtgcccaggcgagccgcagcgcagcgagcttaagcgccattacggcctcgtaatcaaccagctccgcctcacgcgctttggtcagcgccttccgggttctggcgcttttccaccacttctgtgccgccgcgctttgctgaaaatcggctacctgactgacgtcgatatagattacgttcagccagcggcgcgacgacgggctatacggactggcgaaaccggcgctggcgggatagagcgcatgcagcggattcagcccgacgaaatcgccaccgcgttcagccagctgcaccagcagctgatcgagatcgccgaagtcgccgatgccccagtttctgttcagagcgcacggtgtagagctgcaccagcgcaccccagcgtttttcccccgcctccagcggcggaggcagatagcagcggcgcggcgcgacgataatccgcgtctgccagctttttttgcccttactgagtgtgagctggtggtacccctgcgccagcgggccaggcagtgtaaaaggctcactggcggttaactcgccgctgtgctgtttgccgttttcagtctgcaactgccagcggtaaacgccgctgccctgtggcgtcagctgtcgcttgccactgccgctgaacaccgcgaccggcggcagcggcgatttttttgcgtcctgcggatcgtccatcaccgccagcagcgcctgcagggtctcatcgctgatcgcctctttctcgccattgacgttgatgtagtccagtgaaattcccgcggcacgggcggcctgaccgagtgaatgttgcttcattgctgctccttagcgcggtgcctgccagatacgttgctgatagtcacgaattgaccggtccgaactgaacatgccggttcgtgccgtattgaggatggcggcgcgggtccagccttccgggtcgcgccacagggcttccacccgttgctgcgcctcgatgtaggcctggaaatcggccagcaccagccagggatcgccatgtttcgtcaggctctccagcatcaggtcaaacgcatgtttatccccgttgctgaatttgcccttctccagcgatttcagtagatcgtccagcggcttgttctgcttacgcacctttttcgggttatagcctttcgccttgagcgctttgacctcatccacggtgtgaccgaagataaagatattctcctcacccacctgttcggcaatctcgacattggcgccatccagcgtgccaatcgtcagcgcaccgttcagtgccagcttcatgttgccggtgccggaagcttcatatccggcggtggagatctgctctgagagatcggccgccgggatcatcagttcggccacggtgatgcggtagtccgggatgaacaccactttgagtcggtcaccgacccgtggatcgttgttcaccacctccgccaccttgttaatggcgtaaatgatatttttggcgaggtaataacccggcgcggctttggcaccgaacaggaacacccgtggcgtaaaggtgacatcctccgggttatgacagagcttctgatagcagtagaggatatgcagcaggctaaggtgctggcgcttgtactcatgcagccgtttgatctgcacatcgaacagcgcggccgggttcacgataatccccgtgtggcgggcgatatactccgtaagctgcgctttgttctgctgtttgatgctgcgatagcgctgacgaaacgcctgatcgtcggcatacgcctccagaccgcttaacgcctcaaggttattggcccactcggttttcagcgtctcatcaatcagcccggccagcgccggattacactgcttcagccagcggcgcggcgtgatgccgttggtaacgttgtggaatttctgcggccagagctggtgatattccgggaaaagatcgctgaccaccaggcttgagtgcagcgccgccacgccgttgaccgcaaagccgctgacgacgcagagattcgccatccgcacctgaccgtcagcgaccaccgccagcttgtgccacatcgctttgtcatccggccagcgctgcttcacctgctttttcagccgctggttgatctctttgatgatcagcatatggcgcggcagcagactgcgcatcagcttctcatcccagcgctccagcgcctccggcatcagcgtgtggttggtgtaggcaaacaaccggctggtgatctgccacgcctcatcccagctcagctgatgctcatccagcaacacgcgcagcatctccgggatggcgatggtgggatgtgtatcgttgagctgaatcacttcgaagtcaggcaggctgtgaatgctgcgtcccgccagatggtgacgacgcaggatatccgccaccgcacaggcgcactggaaatattgctgcatcaggcgcagccgcttgccggcctgatggttgtcattgggatagagcactttggtcagttttgccgcctcgatgcccggctgctccgcctgcagaaaattgccgtcattaaacgccgtgagatcaaaaggatgcgcactcactgcctgccacagacgcagcggcagcgtcacgccgttgcggtagccggtcaccggcaaatcccaggcctcaccgcgcagcgtaaaatcaggcagccagcgtacactgccgttttcctgcttttctacccggccccccatcgcgacttccacatccagcgccgcgttgtggcggaaccagggatagcgctcacgttgccagtcatcgggcgcttcaatctgctgaccatcatcgaaagactggcggaacaggccgtactggtagttcagtccgtggccggtggcggactgccccaccgttgccatcgaatccatgtagcaggcggccagtcgtcccagcccgccgttgcccagcgccggatcgacctcctgctccagcagttccgttaaatcgaactcgtgctcagccagcgccgctttgacgtcgttataccagccgagattgagcaggttgttgccggtcagacggccaatcagaaactccatcgagaggtaattaacgtgacgctgctgcacagccggacgcggtgccggttgtgcgtccagtagctccgccagcgccgcgctgaccgcctgccacgcctggtgcggggtcatctgctgggcggaaacggagacttaactgttgccactggcgggtaaaggcggcattaaaacgggctttattaaatttttgctgcggcatatcactcccttctgttacgcaatgaggtgaagcaaaaatagaaagcgcacgggctggcaaccgggtgccagcaaccgttaagtaaagacgggagtgaggaaaaaagcgacagcaatcaaagaaaaacgccagccgggaggctggcgtggcaggaatcagcagagttcgaggtgaacctcatgctgctcaatcaccttcattacgctggcaggcggcgttttgtccgtgtagaggtagtcaagcagactcatgttgccgaggttgaccatcgcattacggccaaacttcgagtgatccaccaccagcatcacgcagcgtgaattttcaatgatggcgcgcttggtgcggacttcgtgatagtcaaactccagcagcgaaccatccatatcgatgccgctgatccccagaatgccatagtcgagccggaactgagaaatgaagtcgagcgtcgcttcacccattaccgcgccatcgcgggtccgcacttcaccgcccgcgataatgacccggaaatcgggtttatccatcagcagcatggcgacgttaaggttattggtgaccacgcgcaaatcgctgtggttgagcagcgcatgcgccaccgcttccggcgtggtgccgatatcgataaacagcgtagcaccatccgggatctggctggccacgcgctgggcaatccgcgctttttccgctgaccacatcattttacggtcgtgccaggcagtattctcagagctggagggaagcgccgcgccgccgtggtgacgctgaattttgttctgatcggccagatcgttgagatcgcgacgaatggtttgcgggctgacctcaaaatgatccaccagctcctcagtactgacatatccctgacgacggactaaatcgataatcgcgtcatgacgttgcgtctgcttcacgttcctctcctgttaacccgcataatcctgtctaacgacgcgtgactttacgcgtatccaccagcgccatcgccagtccgaccaccagaccggcgacgtgcgccgcgttggcaatagccagaccaaagacgccaaaccagccaatcaccagccagaccagcgcaaaaccgatcaatccccgttcaagatagacgccgctgtcgggatcgcgctccccgcgcagccagcagtaacccatcagggcatagaccacgcccgacaggccaccaaaccagatgccgctgaacttcgcctgcagccagccgctgagcagagccgaaatcagcaggatgacaaagagtttgccgctgccaagtcgcttctcaaccgcgccgcccagataccaccaccacatcagattaaacagaatgtgcagcagtgaaaagtgcagcagcgcatggctgaaccagcgccagacctgaagatgctgatcggcatccggccaggagagccaggccatcacggtgcgatcgcccatgacctgcatcagaataaatatcgcgatacagagcaccatcagcgtcatggtcagcggaccggcacgctcacggatattcgcccagatattgctgcgctcatagcgcaggccactgtcggtttttccgctgtgccagctggcggcctgataacgcggatggttagggtcgtgcaaaaactgctgaagttcgttttcgaccagtgaaatcttgctctcatcatccagcatgatgacgtagtgattttcatgctcaatacgcagcgtgatgccccgcgtcgccatgtagtcaacaaaggcctgcgccatgcggggctgattaaattgagtaatgcgcatcagtaactctccatgtgacgagcggcaatctattcgctgccgagggcaacctgctgaggaaaggcagcacgccaggcatcaaagccgccatcaatgctgtacgccgcgctgaagccctgtcccagcagatattgtgccgcgcttttgctgctgttgccgtgatagcacatcaccagcaccggcaggctgtgatcggcgccgctgacaaaatcgctgaggttgctgttggtcagatgcaacgcaccggccgcatgacccagggcataactttgcggatcgcggatatctaccagcagcgcaccctgcgccagacgcgcctgcgcctgctgcacatcaatacattcgaacgtttccatgggatctctcataacagcgtcacaatagcgcgtagtgtaacccgagaatccacgccgataacctgacaatcgttacggctatcggtttttttggtgggcagaatgttagctatatcacgcaaaaatgtttttacctggttaaaagctggcgtcaatgttggtttgcgattatgattatgctcgaaaacgaacattagtgaactattccgaacatcggaggagatgacgtggaaaccaaagacctgatcgtgatcggcggcggcatcaacggtgccggcattgcagcagatgctgcaggacgcggactgtcggtgttaatgctggaggcgcgggatctggcttgcgcgacctcctctgccagttcaaaactgattcacggcggcttgcgctaccttgaacattacgaattccgtctggtcagtgaagcactggccgagcgtgaagtgctgctgaaaatggctccgcatctggcgttcccgatgcgcttccgtctgccgcatcgtccgcatctgcgtccggcgtggatgatccgtaccggcctgtttatgtatgaccatcttggcaagcgtaccagtctgccaggcagtaaaagtttgcgatttggcgcggattcggccctgaagccggaaattacgcgcggattcgaatattctgactgctgggtcgatgatgcccgcatggtggtactgaacgcacaggaagtcgtgaagcgtggcggcgaagtccgtacccgcacccgcgtgacccgtgcctggcgtgaaggcggcctgtggaaggtcgaagcggaagatgtcgacagcggtaaaacctttacctggcaggcgaaaggcctggtcaatgctgccggcccgtgggtcaaacagctgttcgacgacagcctgaagctgaaatcgccttacggtattcgcctgatcaagggcagccacatcgtggtgccacgcgtccataccgaaaagcaggcttacattctgcagaacgaagataaccgcatcgtgtttgtcatcccgtggatggatgagttttctctatcatcggtaccaccgacgtcgagtacaaaggcgatccgaaaaacgtcaatattgatgacagcgagaccgactatctgctgaaagtgttcaacggacactttaaaaagcagctgaccgctgacgatatcgtctggtcctattccggtgtccgtccgctgtgtgatgacgaatccgattcgccacaggcgatcacccgtgattacaccctggatgtgcgcgacgataatggtcaggctccgctgctgtcggtatttggcggcaagctgaccacctaccgtaagctggcagaacatgcgctggagaaactggcgaagtactacccgaacgcgggcccggcatggacgaagaactgcgtgttgccaggcggaaatatctccggcacccgtgaagattatgcggccagcctgcgtcgtcgctatccgtttatcagtgaaaatatggcgcgccacttctcgcgcacctacggcagcagcactgaaaccctgctggctggcgcgaaaagcctggacgatctgggcgagaacttcggtcacgagttttacgaagcagaattacgctacctggtgcagcatgagtgggttcgtgagctggatgatgctatctggcgtcgtaccaaacagggcatgtggctgaccaaagagcagcaggcgcgagtcaccgagtggctggcagcgaaagctaaacccgccctgtcgctggcatcataaacggacagtaactaactaaagaatcagaaagcaggcttcggcctgctttttttatgtctgcgatagcgggtcggtgaatccgggtgctgatccaacaggttgcgcttttcagcgtgtagcagagtttatttttgtacgacgaactttttattaaaaatgccaggctcaaaccattttttatacagaaatccgtttatgcgatcacatttttggtcagcgcctaaactcaactctttctgcttcgcatatcaaaacgttcacatcctattgttactgtaaatataacgttcaggctttttgcttaattgaacgacgtcatcagaaagcacaaactttcctcagtaaaaacgaaacaaccgttattttaatcaggaggttgaaatgaacacaggccaaacgcctgcccgggaatggaacacgcgccgcagtgaaaaagcgcgtcgtctggcatccttccctgttgatggcaaagtcattcctactgaaagagctgtagaagcatttgaaaaactgattgcaccgggcgaccgggtggtactggaagggaataaccagaagcaggccgattttttatcacgtaccctggctgaggttaatccggcgatagtacacgacctgcatatgattatgccgagcgtgggtcgcagtgagcatctggatattttcgaaaaaggcattgcgcgtaaactcgacttctctttttccggtccgcaaagtctgcgtatttctcagttgttagaagatggtcagctggaaataggcgcaatccacacctatatcgaactctattcccgcctttatgtcgatctgagtccaaacgtcgcgctgattgccggttataaagctgaccgcaaaggcaacctttacaccgggccgagtactgaagatacgcctgccctggtggaagccgccgcgttccgtgacggtatcgtgattgcccaggtaaatgagctggtcgatgacgagaccgacctgccccgcgtcgatattcctggctcctggatcgattacatcgtcgtagccgataaacctttctttatcgaaccgctgtttacccgcgatccgcgcctgattaagcaggaacatatcctgatggcgatgatggcgattaaaggcatttacgccgaacatcaggtgcagtcacttaaccacggtatcggttttaacaccgccgcgatcgaactgctgctgcctacctacggcgaacaactcggcctgaaaggcaaaatctgtaagcactggacccttaacccgcatccgacgctgatcccggcgattgagagcggctgggttgaaagcgtgcattgcttcggtggcgaaactgggcatggaagagtacattcgcgcccgtcccgatatcttcttcaccggcagcgacggctctatgcgctctaaccgcgccttctgtcagctggcaggtcagtatgcggtggatatgtttatcggtgccaccctgcaggtcgatggcctggcaaactcctcaaccgtgacccgcggtcgcctttccgggttcggcggtgcgcctaacatgggccacgatccgcacggccgacgccatgccacgcctgcatggctcaatatgatcaccgaaccggatccgatgcagcgcggtaaaaaactggtggttcagatggtggaaaccttccaggccggtgccaaaccgacctttgttgaaacgctagatgccgttgaagtggcgaaatcgaccggtatgccgctggcaccggtgatgatttatggcgatgacgtcacccatgtgctgaccgaagagggtattgcctatctttatcgcgcggaaagccttgaagagcgccgtgcgatggtcgctgcggtagccggtatcaccgatatcggccttggcgtcgatgcggcgcgcgtggcggccctgcgtaaaagcggcaaagtggtctatccggaagatatgggcattcgtcgttcagatgcgacccgctcactgctcgccgccagcagcgtctctgacctggtggaatggtcgggtggtctttataacccaccggcaaaattccggagctggtaatgaaacttctgtcgcagactcaaaccgaggcgcaggccagccagctggcgacgattgcgcgcgattgtctgaccgatgaagcgcggctaagccccaagccgggtctggtagacagtcgggggaacggcgcgcatcaggatctgacgctggcgctgatggagcgttccgctcacagccttgtgccgacctttctggcgctggcccgtcacagctggctgcgccctgctgatattgccctgcgtgaaacggtgggtcggctgggccgtgacggtgaacagcagatgatggcggcaaccggcggcgtcaacacccatcggggtgcgatctgggcgctgggactgctggtcagtgctgcagccatgcacggtggcgcggccagtgccgaccagctgacccgcaccgcagccgcgctggccagcctgcccgaccgcgccgcgccaaaactgttcagcaaagggttaaaagcgacgcatcgctatcaggtgcccggcgcacgcgaagaggcgcagcaggcgtttcctcacgtgatgaagctggcgctgccgcagctgctgacaagtcgtgcaacgggtgccagtgaaagtgaagcccgtcttgatgcgctgatggcgatcatgacctcgctcagcgatacctgcgtgctgtcacgggccggtatgaccggactgaaagcgatgcagcaaggagcacgcgccgtgctgctgtctggcggctgtcgcacagcaggcggccagaaggcgctggcgcagctcgatcagcgcatgctgtcgctcaacgcttcgcctggcggggccgccgatttgctggccgcgacgctgttcattgatcgggtctgttcacctgaacattcttatttctagaggccattatggaacacatcacattatctttacctgctaaccgctcactcagcggtaaagctctggcaggggtcgttggttccggtgatatggaagtgctgtacaccgcaactgaaggacaaacgcttagcattgatatcaccacctcactggataacagcgacgcccgctggaaggcgctgtttgaccgcctgaatttaaccaacggtctgcctgccggaaagctgattattcacgatttcggcgcgacacccggcgtggcgcgtatccgtattgaacaggtttttgaggaggtgagccatgcgtaacgatgccagttttattgaattacgcgcccgtgagcgcgcccgtgcactgctggacgacggcagctatcgcgaactgctggatcctttcgaaggcatcatgtcgccgtggctggccccgcagggtgtggtgccgcagtcagatgacggcatggtggtggcacgcggcacgctgaacggtcagcctgcggtcgttatcgccattgaaggcaccttccagggtggcagcatgggcgaagtctccggtgccaaaatggcggcggcgctggaactggcagccgaagacaaccgcaatggaatacccactcaggcggtgctctgcctggaaaccggcggcgtgcgtttacaggaagcaaatctggggctggcggcgattgccgatattcatgccgcaattgtcgacctgcgtcgctataccccggttatcggcattattgccggtaccgtcggctgctttggcgggatgtccatcgccgctgcgctgtgcagctacctgattgtgacgcgtgaagcgcgcctggggctgaacggtccgcaggtgattgagcaggaagcgggcattgaagagtatgactcgcgcgatcgcccatttatctggagcatgaccggcggtgaaatccgctacgccagcggcctggtcgatgcgctggtcggtgatggcgtcaatgcggttaaaagtgcgatgaatgactgcatcgccaaaggcgttccggcgcagcaccgcagcgataaatatgccgatttcctgccacgtctgacgcagttcgacacccgtcagcaggcggacacggcgcagattaaacagcttttcgcccgggaggataaataatgacccagacaaacagccgcggtgcaacctggctggaaaaacttgcacctgatgcgcagcgcctcagcggcctgtgcgcctctgtccaggtggcggacggccagctcaatggcgaaagcgtgcgctttatcgccgtggtgcccgatgcacaaaaccactatccgcgtgccgcgcagggcgaagtcggcctgctggaaggctggacgctggcgaaagtggtgaatgaaacgctggaagaggacaagaacagcgacgtgaaacgcccgattgtggcggtgatcgacgtaccgagtcaggcctatggccgtcgcgaagaggcgttcggtattcatcaggcgctggcgggggctgcgggcgcttatgccaaagcacgccttgcgggtcatccggtgattgggctgattgttggcaaagcgatgtctggtgccttcctggcgcacggttatcaggccaaccgcctgattgcgctcaacgatcagggtgtgctggtgcacgcgatgggtaaagagtccgccgcgcgtatcacgctgcgttcggtggaggcgctggagaaactggcggcgaccattccgccgatggcctatgacgtgaataacttcgccacgctgggtctgctctccgatctgctgaacgtggccaatcccgatgcgccttctgacgccgatgtggcgatggtcgagatcgcgttgcagaaagccattagcgatgcgcgtcaggatccgagcctgaaaaaccggctgggcgcatccaatcgccacagctcctccctggttcgcgagcggatgcgcgcaacctggtaattaaataaaaaaataaacctgccgaaaccggtctgacggggcgcattgctaagtgcgccccggggcagtggccgtgttcagaattataaacatcgctgttaacagaaaattctttcttaaatacaggtgatttatgatttatataattgttcatgcccttgctccgatttttgtcatcatgctgctgggtttctgggccggtaaggccggaatggtcaacaacaaagacgtctctctgctgaatattttcgtcatggattttgcactgcccgccgcgctgttcagtgccacggtacaaacgccctggccgggcatcgtggcgcaatggccgctgattgtggttattaccggcgcaatgtggattacctatggagctgtctatttcgcggctacaaaagttttcaaaaagtcaccgcaggatgcggctgtgctgacgctgacggtggcgctgccaaattacgccgcgctgggcctgcccattctggccagcgtgctgggtgaaaatggtgccacttcgctctcggtagcggtctccatcgcctgtggttcagtgctgcttacaccgctttgcctgctgattctggaacgtgaaaaagcgtttgccgacggcaccgaacacggttcaaccctgaccatgctgccgattctgatgtggcgttcagtgaaaaaaccgatcgtactgggaccgttgattggcgtggtgttatcagcgctgggcgttaaaatgcctgatctggtgctggccgccatcaaaccgctgggtctggctgccaccgccgctgcactcttcctgaccggtgtcatcctgtcggcacgcaaactgaaactcaacgcggtggtgggcgtcggcacggtaactaaactgctgattcagccctttatcgcctggggtctggtgctggcattgggtctcagcggtccggtggcaattaccgccattctgatgattgcgctctccgccggtttcttcggagtggtgtttggcaaccgctttggcgtgcagtcgccggatgcagaggctgtgctgctgctcagctctattctctgtattttgtcattaccgctgttcattacgctgacatcaggaatgtaatatgagctctgtaccgcgcccccacgatcttctctggctgcgagacggcaacgccttagccgccatcagtgagagctgggtcagtcagttctggcatcccggccttccggtcgtggtgcggcgcgacagaagccaaaccgggctgataccggtgggtgtgcgcggcgagcgccgcgaacagcgcgccgccggatgggtcaatgcagcggatatcgttcgcgttgtcacaccggagatgctggcagcgcgtgcgcagttgcttgcctcgccgttcaccggttatgcgccggtcggcgcggcgattgccctcagtgagcacgactggccgtggcgctggggcattaccggcagtaccggttacgcactggcaactcagcaacccacgctgcatgccgccagcgatcttgatttagttattcgcgcgccagagccgctggcgcgcgatgcgctgcaacgctggcaggcgcaaaccgacacgctggcctgtcgggtcgatacgcagatagaaacgccgtccggcgcgtttgccctcagcgagtggctgcgtgaaggccgcgcactggttaaaaccgttaccgggccgatactgaccgcttcaccctggagcagggagctacaatgaaaatactctttacctttcccggccagggcactcagcgtgccgggatgttacagcaccttcccgacggcgacgccctgttaaacagcgtgcgtgcagtgctgggcgacgagactgaccagctcgacagtgccgatgcactgcgccacacgcgcgccgtgcagctcagtctgctgatttgcggtgtcgcctgggcgcgcgagctgatccgccgtggagtgaaacccgatatcgtcagcggtctgtcgattggtgcgtttcctgctgcggtgatttccggcgcgctggatttcagtgatgctctgcggctggtggcgctgcgcggcgatctgatggagcaggcttatccggagggatatggcctgaccgccatcaccggcctgacgctgagtcgtctggaaaaactgctgcccggcagcaacacctatatcgccaacctgaatgcggaaacgcagattgtgattgctggccgcgacgaggatatggcggtagtcgcgcagaaagcgctggatgccggtgccagcaaagcgattaaactcgcggtgagcgtgccgtcgcattgcgcgctgctggataagcccgctgcagaaactggcgcgcgcgttcgggtccgtcagcctttcccgtccccattgcgcttacctcagcggttcaaccggacgcgtgatttgggagccggagaagattgccgacgatcttgcctttaatatggcgcgtacggtgcagtggaatgatgcgatggtttcagccaatcagcgcgatgcccgactggcgattgagatgccgcctggcaatgtgctgaccggcctgacgcttcaggcaggctggcagggcgacgcgatttgtctggagcgcaacagcgttgaggttgcactccatctggttaaacggctaagtcagtaaggctgcgggcgtacatccgcccttctgccgccagtgccagcaggtcattatcccgttcgcggcgatgtgagtagacaatcgagatctgctgacgcatctggtaaggctcagcgagcgtcagcagctgaatgttgttttcatacaccttcttcatccgtcccgggatcagtgccaggccgacgcccgcctgcaccaggcttatcatcgagaagatgtcattcacctgggtgaccatgcgcggttcaaatccggctatctggaacgcctcctgcgaaccggcataggttgcaaacccttcagccagggagacaaaatcacggtcggcataatcacgcagatccaccggaccagctccgtcccgcgtctcaccggccggtgtggccagaaagatcctgtcttcaaacagcggaatcacatcaaaatgcgcgtcgctgagttcgccgtcatcggtggcgatcagaatcgcatccagcgcgtcatcttccagcatattcagcagcatttgattggaacccatggtcagatcgagctccagcgtgggccgacgcagcttcatgcccatgatcagccggggaatggtctccagcgtcagggagtagagcgtgccaagtcgcagacgccctccgccgatgcctgcgactttgcgcgcctcttcaatgcctttgcccatcagggtggtcacatcgcgacagtagtccagcagcgtccaggcggcaggtagcggcaccaggttgcggcccttgtggataaacagcgggcagtcgatgccctcttccagcgtatgcagtgcgcgatgcacgctgacgctgctcagctccagcgcttccgccgtacgggcgatattgcccttgctcataaacatcatgaagacgctgagtttacggaaggtaatttcctggttgatgttgtcactcattgctgctgttgcctgtagggtcattttgctttcccgcatagtagcgattctcagccagggtgtaatgatctggctcgcacaagaggcacttacggaggcagaggcgataagaggctgaaccttctgaaagaggagcgggatagacggtgaacaaagagtgcaaaggagagtgcggccgatccctcggccgcaaagaaagtcagaaaccttactgcacgcgccttacaaccttactggcgagatattccagatctcatcagcgtactcctgaatcgtacggtccgacgagaagtagcccattccggcgatgtttttagccgcgcggcgttgccactcatccggtttacggtagagcgcatccactttatcctgggtatccacatagctgcgataatccgccagcaactggtagtgatcgccgaagttgaccagtgaatcgaacagattgcggtagcggcccggatcctgcggactgaacagaccggaagcaatctgagtcagcacctgatgcagctcttcatccttttcataatagtcacgcgggttatagccccctttacgcagggcttcgacctgcggcgtggtattaccgaaaatgaagatgttctcttcaccgacgtgatccagcatttcaacgttggccccatccagcgtaccgatggtcagcgcgccattcagcgcaaacttcatattactggtgccggacgcctctgtccctgcggtagagatctgctcagagagatcggccgccggaataatgatctgcgccaggctcacgctgtagttcgggatgaagaccaccttcagtttgttcttcacctgcggatcgttgttgatcacattggcgacatcgttgatcagatgaatgatgtgcttggcaacgtaataggccgacgccgctttaccggcaaaaatattgacgcgtggcacccaatccgcctgcggatcggccttgatacggttgtatcgggtgatcacatgcagcacgttgagcaactggcgtttgtactcgtgaatgcgcttgatctgcacatcaaacagcgcgttcgggtcgagcaccacgtccagattcttcgccacccagtcggccagccgacgcttgttctgatacttggcgaccgccactttttcaataaacgccggatagtcgatctgcgccttcaactcgcccagctggctgagatcggtgcgccagttgcggccaatctcctcatccagcacctctgacagcgccgggtttcgccagcgccagccagcggcgcggagtgacgccattggttttgttacagaagcgaccagggaacaggcgggagaaatcggcaaacagcgactgtaccatcaggttggagtgcagctccgaaacaccgtttactttgtggctgaccaccaccgccagccagcccatgcgtatccggcggccatcgttttcgtcgatgatcgaaatgcgcgacagcagatccaggtcatcgggatagtgatcctgaatggtcttaaggaagaagtcgttaatttcaaaaataatgctgaggtgacgcggcaggatcttgccgatcatatcaaccggccaggtttccagcgcttcggtcatcagcgtatggttggtgtaggagaagacctgacagcagacgtcaaaagcgttgtcccagctgaatttatgatcgtcgatcagcaggcgcatcagttcggggatcgccagcaccggatgggtatcattcaggtgaatagcgattttatccgccaggttatcccaggtctgatgcatccgccagtgacgattcagaatgtcctgcaccgtcgcggagaccaggaaatattcctgacgcaggcgcagttcacggcctgagtaggtcgagtcatccggatagagcacgcgcgacacgttctcggagtggtttttatcttccaccgccgcaaagtagtcgccctggttgaacttgccgaggttgatttcgttgctggcctgcgcgccccacagccgtaaggtgttggtagcgtcggtgtcaaagcccggaatgatctggtcataggccatcgccaggatctcttcggtctccagccagcgcactttcgcgccttcgtgctggacgcggccaccaaagcgcactttgtaacgagtattgaaacgctggaattcccacggattaccatattcaagccagtaatccggcgactctttctgctcaccttccacaatgttctgtttgaacatgccgtagtcataccggatgccatagccacggcccggcatgcccagcgtcgccagcgagtcgaggaaacaggccgccaggcgacccagaccaccgttgcccagccccggatcgttctcctcttccatcagctcggccagatccagacccatctcatccagcgcctggttgagatcgtcataaatccccatcgccagcagcgcattgcccagcgtgcggcccatcaggaactccatcgacaggtaatagacctgccggacatcctgcgacagctgagcacggctggaacgcagccagcgctccaccatccggtcgcgcaccgccagcagtgaggcgttaagccactcatgcttattggcgatagagggatctttgccgatggtaaacatcaatttataggcaatcgaatgctttaaggcatcaaccgtcaacgttggtgaggcgtaagtgaaaggtgcattcatatccagttttcccaatccgttacatcaaacgttggtagagatcacggtaggcttgtgctgccacctgccagctaaagtccatcgccattgcctggcgctgaacatagcgccagagcgaaggacgggaccacaacacaaacgcgcggcggatagcccgaagcagtgaccaggcgttggcatcttcaaaactgaatccactggcgatgccgtcggccagattctccagtgagctgtcattcacggtatcggccagcccgccggtgcggcgtactaacggcaacgtaccatacttgaggccatagagttgtgtcagaccgcagggctcaaagcgactcggcaccacaatcacgtctgcgccgccgacaatgcggtgtgagaacgcttcgtgatagccgatctgcacgccgacgctgcctggatgctctgctgccgccgccaggaagccctgctgcagttcagcatcgccctggcccagcagcaccagttgaccgccctgcgccagcaagccgggcagcgcctccagcaccaggtccagccctttctgtttggtcagacggctgatcacgcagaacaccggcgctttatcatctaccttcagacccatcgccacctgcagctggcgtttgttctccgctttcgcttccagcgtgtcgcggttataacgcgcgctgagcagcagatcgtgcgccggatcccagatagagggatcaacgccgttgagaatgccgctaagacggccttcacgcatccgctgtgccagcagggtttccatgccgtaagcatattcggcagaggtaatttcatgggcgtaagtcgggctgaccgccgtgatatggtcggcgtaaaaaagtcccgctttcaggaaggagatctgaccgaagaactccagcccgtgcatgttaaagaatgaccatggcaggccaatctcttccatgtggtgcgccatgaacagcccctgatacgccaggttgtgcacggtgaagaccgatttagccggacgaccacgcgcttccagataggcgcaggtcaggcctgcgtgccagtcatgggcatgcacaatatcgggacgccacatcgcgtccatgccgcacgccagttcacagccaacccagcccagcagcgcaaagcgcagatagttgtcgacatacgcaaactgcgattcgtcatggtagggactacccggacgatcgtagaggccgggagcatcaattaagtagatgcccacaccgttaaattcaccaaatagcagacgtacatgaccggcaaatgtttctcgctctgtcacgacctggagatcaggtatgcctttgcgcaatgcgggaaaaccgggcagtagtacccgcgtatccgtgccgcccgcaatttgtgcctgaggtaatgccccgactacatcagccagtccgcccgtttttagcagcgggaaaagttccgaacagacatgtaaaacctgcatcctcgacctcattaagttatccgacacgctccgcgtgccgattgcgtaagtttcgcttatcgcttacagccccgctttggccagcctggccagcatggcgcgggttaccagtacgatgccttcatccgaacggtgaaaccggcgactgtcttcatccgggttttcgccaatgaccatgccttccggtaactcgcaggcacgatcaatgacgcagcgacgcagacgacacgatcggcccactaccacatcaggcagcagtacagttgaatctatattgcaaaaagagttaacgcgtacccgcgggaacagcaccgaattgaccaccactgaaccggagatgatgcagccccccgagaccagcgagttcatggtcatcccgtgactgccggaacgatcctgaacaaatttggccggcggcagcggctccatgtgggtacgaatcggccaggtgacgtcatacatatcgagttcaggcatcaccgatgccaggtcgagattggcgcgccagtaggcttccagcgtcccgacgtcgcgccagtaaggcggcgcattgtcatcgttctgtacgcaggagagcgcaaaggagtgcgcatagccttcgccgcttgccacgattttcggcaggatatctttgccgaagtcgtggttagagcctggcgtctgcagatcctcttccagcagttcatagagatagtctgcgttgaaaacgtagatccccatgctggcgagcgcctgagtgtcatcacccggcatggtgggcggtttcgcgggtttctccacgaagtcgatcaccatgttctcttcgtccaccgccatcacgccaaacgccgtggcttcatgcaccggcaccggtaaacaggcgatggtacatttcgcctcgttgaccacgtgatccagcagcatgcgtgaataatccatcttataaatgtggtccccggcaaggatcacgatgtactgcgcctgatagcggcgaattacatcaaggttttgcgtcacggcatcggccgtcccgcgataccactgttcggtcgaaaatcgctgctgcgctggcagcaaatcgacaaactcattcatctcttcattgaagatcgaccagccacgctggatgtgctgagtcagggtatgagactgatactgagtaatcacgccaatccgtcggataccggagttgacgcagttggagagggcaaagtcgataatgcggaacttgccgccgaaatgcaccgccggtttggcacgtttggccgttaagtcgaccaggcgcgtgccgcgtccgccagcgaggatcagagcaaccgtctgtgtagggagctggcgggccagcatcaggtgatctgttctatctaacttaaccatgtctgactccttatgattgcttttggaacacgcacacaccgtgtgcgggaccatgccagacagttagcaggatggggttgtcgtccccggcgaaaggaggaagggcgcgccattctccgtctggtaacacgatgtcattcaccgtatccgtggcgtttattgttattaaccagcggccggacagcaggatctgcaatctgtgcatcccctgtgcccattcatcgtgttgcagtggctggccaccggcattgagccactgcacattgccgtcaccgtcctgccaccagcgatctgcggtcagcgccggaatgcgctggcgcagctcgatcagtgcagcggtgaatccgactaatcccttctcatccgcctgccagtcaagccagctcagggcgttgtcctgacagtaagcgttgttattgccgcgctgggtgtggccgcgctcatcgcctgccagcagcatcggcgtgccctgtgacaacagcagcgtcgtcagcagtgcccgcacgctgcgacggcgacgttcaatcacgtcgaagctgacgttcagcccctctttgccgtggttgtggctgtagttatcgccgtgaccatcacggttatcttccccgttcgcttcgttgtgtttacgttcgaagctcaccacatcccatagcgtaaagccgtcatgggcggtgatcaggttaaccgtggcgtgtggcgaccggtcatcatgctggtagagatcgctggaggcggcaaagcgacggacgaactcgccgttgcttatgtcgccgtgcagccagtaacgacgcgcggtgtcgcgaaactgatcgttccattcggcaaacggcggcggaaaacggccaacctgatagccgtcagggccgatatcccagggttcagcaatcagcttgacctgagagagcagcggacaggcgcgtatcgcctcaaaaaatggcgcatcacgctggtaatccggtgtgcggcccagcactggcgcgaggtcaaagcggaagccgtcgacgtggcagatccgcacccagtagcgcagcgcctctaaagcccacgtcatcacctgcggatgatgaatattcagcgtgttgccgcagccggtccagttctgataatcgccctgctcatcgagccagtagtagctggcgttgtcgatgccgcgcatggagattgtcgggccaatctcatcgagttcagcggtgtggttgaacaccacatccagcagcacttcgatacccgcggcgtgcaggtttttgaccgcctgctgaaactcctgcaacggcgtcacgtccggctgaccggaggcgtaacggggatccaccgcccagagcgcaaacgggttataaccccagtagttgctgaggccgagctgcagcagtcgcggctcgctggcgaaatgggccaccggcagcagctcaagggtggtaatccccagactgcgcaggtaattcaccataacaggatgaccgagcgccgcgtaagtcccgcgcagcgtttccggaatttccggatgctgctgcgtcaggccgcgcacgtgggcttcgtaaatcaccgtgttaccccacggaatacccggtgcgacgtcgtcctgccagtcaaaatcctccgcgactacccgtgacttcggcgcaatcgccgcgttgtcatgcggatcgggctgcgtctcgccgccatgaaacagcgggtcatccgctacatcgccctcaaccgcgcgggcgcaggggtcaaccagcagcttcgccggattaaaacggtgtccctgctgcggcgcccagggaccatgcacccggtagccgtagcgctgtcccggtttcaacgccggaacataaccatgccagatatccccgctgcggccaggcaggtcaagacgctgttctgcgccctgttcatcaaacaggcagagctctacgcgcccggcatgctgtgagaacagggtgaagttaacgcctttgccatcgtaactggcacccagcggttcgggatctccggcagtgatggtcattcagcctcccgcaccagccataccgttgccagcggcggcagattgaggctcagcgactgcggtcgcccgtggctctcctgctcatcggtatgcacacgatggttgcgcacgtcgctgccgtgatactcatgctgatcggtgttcagcacttcacgccagtagccaggctggttaacgccaaagcgatagcccggacgcggcactggcgtaaagttactgacgacgatcacttcattgccttcacggtcacgacggacaaaggcgaagacggagtgttccgcatcgtttaccaccagccactcaaagcctgccggatcgaagtcgagctgatgcagcggcgtgtagtactgataggtgtggttgagatcgcgcaccagacggtgaacgccgtggtgccagttgtcgtccccttccagcagatgccagtcaaggctgacgtcgtggttccactcgcgaccctgggcaaattcattgcccataaacagcagtttcttgccggggaagccccacatccagccgtagtaagcacgcagattggcgaacttctgccatgcatcgcccggcatacgatcgagaatcgagcgcttaccgtgcaccacttcgtcatgcgacagcggcagcacaaagttttcggtgtagttgtacatcatgccgaagctcatcagatcgtgatggtgcttacggtagatgggatcgaccttcatgtagtcgagggtgtcgtgcatccagcccagattccatttgaaccagaaacccagcccgccgtcttcggtgggacgcgtcacgccagggtagtctgtcgactcttcggccatggtcaccgaaccggatgccacggtgccgagcgtacggttggtgtgacgcagaaactcaatcgcttccaggttctcacggccgccgtactgattcggcacccattccccttcgctgcggctgtagtcgcggtagatcatcgacgccaccgcatccacacgcaggccatcaatgccaaagcgctccgtccagtagagcgcgttgcccgacaggtagttgctcacttcccggcgaccaaaattgtaaatcagggtattccagtcctggtgaaagccttcacgcgggtcactgtgctcatagagctcggtgccgtcgtatcttgccagaccgaaatcgtcgctggggaagtggcccggcacccagtcgagcagcacgttgaggcccgcttcatgggcggcgtcaatgaaggcgcggaactcgtcacgggtaccaaaacgtcgggtcggcgcatacatgcccagcggctgatagccccagctgccatcaaacggatgttcgttaatcggcagcagttcgatatgggtaaagcccatctctttgacgtagggcaccagctgttcagccagctctttgtagctcagccagaagttgttgtcggtgtgacgacgccaggagcccagatgcacttcatagatggagatcggcgcgtcaaaggcgttggccgccttgcgctccgctttcatctcaaccggctccggcagaccacagatcatcgacgcagtctggggacgcatctgcgcctcaaacgcgtacgggtccgctttgatgcgcagttcgccattggcgtcgatgatttcatacttgtagagctggccgttgaccgcgcccggtacaaacagctcccagatgcccagttcctgacgcagacgcatcggatgacggcggccatcccagaagttgaaatcgccaaccactgacacgcgacgggcgttgggtgcccagacgcagaagcgggtgccgaagacgccatcgatgacgtcaccgtgcgcgcccagcgtctcataagggcgcaggtgcgtcccttctgccagcagccacagatccatctcctgcagcagcggaccaaagcggtaggcatcgtctaccaggttttgctggccgtgccagttcaccgccagctgatagcggaacgggtttttgcggcgtggaatgacgccactgaagaagccacgtgcatcttcacacaccagctgagccagtttgcgcccggtggaggtttcaatgacccacacttcaagcgcttcggggagcaatgccctgacttcaaggccttgctgagttcggtgcatccctagtaacgaaaaagggtcggcataattacccgcaaacagggcattgatcgcatcgcgatcgggaagctctgacatgactttcttcctgtgataattggcagccgaaatgaacgcgacacagcctgtcgcggttcacctgcgctgctcttcattgagccatacgtacaacgacaaagaagtcaggccattccgtgggaaaagtgtttttgccgtgtaccacaaccatttaatccggaaagcacaagagttacctgtggcacatcatggttaaatcatagcttggtcacggcacttgccatggactaaagcaaaataatctttaccgaccggcaaaaaagggaagttgatcactgagtaagcgaaacggcagattgtttcgtgtacgacaaaaacaaaaaaggccggataaatccggcctttggcgatgttttctgtttagctggttaacaaccgcagcatgcgacgtagcggttcggctgcgccccataacagctggtcgcccactgtgaaggcagagagatattccggccccatattcagtttacgcaaccggccaaccggcgtggtcagcgtaccggtgacagcggcgggcgtcagttcacgcatcgtcagttcgcggtcattcggcaccactttgacccactcattgtgagaggccagcagctgctcaatttcagccagcggcaggtcgcgtttcagcttcagcgtaaaggcctggctgtggcagcgcagtgccccgacacgcacgcacaatccatccaccggaatgacgttacgggtggcgaggatcttgttggtttccgcctggcctttccactcttcgcgactctgaccgttttccagctgtttgtcgatccacgggatcaggctgcccgccagcggcacgccgaagttatcggtcggcagggtgccggaacgggtgaagtcggtcacgctacgctcgatgtcgaggatggcggaggccgggtttctgcagcgcaggcgcaacgtgatcgtgcagcatgcccatctgggtcagcagttcacgcatgtggcgcgcgccgccgccagaggccgcctgataggtggcaaccgaagcccactccaccaggtcctgagcaaacaggccgcccagcgacatcagcatcaggctgacggtacagttaccgccgacaaaggttttgatcccactgtcgataccctggcgaatcaccgcatggttgaccggatcgaggatgatgatggcatcatctttcatgcgcagcgtggaggccgcatcaatccagtatccctgccagccgctggcgcgcagctttggatagacgtcactggtgtagtcgccaccctggcaggtaataatgatatccagcgcccgcagcgcctcaatatcaaacgcatcctgcagtgtgccctgctgtttgcccgcaaatgcgggtgccgcctgaccatgctgcgacgtcgagaagaagaccggattgattgcatcaaaatcgcgctcttcactcatgcgggacatcagcacggagccgaccataccgcgccaaccaacaaaacctacattcttcatgtcgtgtccgtctaaggcagttacacctgcttttcatttcagaggagagagcggcgtgctattttcacgccgctctgcgtaataataagatttacctgtgtcccttcactctacaaaatgcaggccgggtagcaagtgaattaattcgattacgctaactttttcagcagcgtaactaataactccgctttttcgtgaacaacatggcgtaaaaccgatgactgaaatgatttcagcgacaatattattgttgttaattatggatccgctgggcaatctgccgatttttatgtcggttttaaagcatctggagccgaaacggcggcgagtggtgctgatccgtgaaatgttgattgccctgatcatcatgctgctgttcctgtttaccggcgaacgcatcctggcatttttgaatctgcgcactgaaacggtgtcgatttccggcgggatcatcctgtttcttatcgccattaagatgattttcccgtcggcggaaagcagcagttctggtttaccggcgggtgaagagcccttcctggtgccgctggcgattccacttgtagccgggccatcgctgctggcgacgctgatgctgctgtcgcatcaatatccgcatcagatgtcgcacctggtcggcgcgctgctgatcgcctggggcgtgacggtgggtattcttctgatgtcaggtctgttcctgcgtctgctgggtgataaaggggtcaatgcgctggagcggctgatgggattaatactgattatgctggcaactcagatgttcctggacggcattcgggcttatctgaagctgtaggagagtgtctgcgcttcccatgaagccagggaagcgcagaaccgacatgattaagagagtagtgtgaaggcgatcattccgaccaccgcaccaacggtaccgagaatggtttccatcagtgtccaggtcttcagcgtttccgcttcgctggccccggtgaagcgaccaaacagccagaaacccggcatcgttcacatggctgataatgattgagccaccgccgatgcagatcgatagcgccgccagctgagcgccgctgtagtgcaacggttcaatcaccggcatgattaagcctaccgtggtcagacaggcgaccgttgccgatccctgaatcacccgcaccgcacctgacaggataaagcaggccagcgcaattggcagtcctgcgccggtcagcgcattgcccagcaccggacccacgccggagtccaccagcacctgcttaaacacgccgcccgcgccaatcaccagcaggataataccggccggttgcagcgcgctgccgcacacctgcattacccgctctttatccataccctgacggtaagccaggccataaatcgccaccagcagcgccagcaggattgcggtgaaaggatggccgataaattccagccactcatacagggtggtgccttcggtcgtgaagcgtgcgccgatggttttcaggccaaccagcaccagcggaaacagaatcagtgagaggctgaagccaaacgacggcagcttgctctcatcgacatccggttgatgatcttccggcggcgcgctgaacgagacgtggttgccaatgaagttgccaaacagtggcccggcaatcagcatgcccgggatcgccgcacagagacccagcaggatcatccagccaaaatctgcgtgcatctgcgaagccagcagcatcggggccggtccgggcagcagaaacgccgccgctgcggccacaccagcaaacagcgggatcaccagcttcaccagattgccgccggtacgccgtgccaccgcaaaagcgatactgatcaacagcacgactgccacctcaaagaagagcggcagcgcgcagatcagaccggcaatgcccatcgcgtaatgggcacggctctgaccaaaggttttcagcatccggatggcgatctgatcaactgcgccggtttcatgcaggattttgccgaacatcgcgcccagcgcgaccacaatcgcgaggaagccgagcgtgccgcccatccccttctgcatggtttcagcgatttgattcagtggcatgccggagaacagcccggcaccgatggacactaacatcaatgcgacgaaggcgtgcatacgggccttcatcaccaggaaaagcagcagcaggacggagcctgctgcggtcaaaacgagtgttgcggtattcatctctatccctggctgatagcgtcctggatagtcgcaaccgtagccgccaccacatcgtccagtgaatgcgcgatatccaccaccagtacatccggctcatcgctacccggctcttccagcgtcgcaaactgcgtcaccagcatctgcggcttgaagaagtggcctttacgcgctttcaggcgggcttcgatggtgtcgaaatcgcccttcaggtagacgaaacgcaggttgtcatttccctgacgcaggatgtcgcgataacttttcttcagggctgaacagacaatcacggaaattgcctgggtgcgctgcatggcaaacgcggcgtcgttcagtgcctgtaaccacggctggcgatcgttgtcatccagcggatgaccatcggccatcttcaggatgttggcgcgtgggtggagaaaatcaccgtcaagaaaggctgtattcagctggtgagagacctgattggcgacggcagactttccgctgcctgaaacgcccatcaggataaaaacgtgatgcgacggggattgcgttgtcatttttctgctccggcaggtgagaatttgccaatgttaccgataacaatatcgtttctcattctcctggccgcttaacagcctggcaacctttttaccaggaaatgcatgaaagtgtgagctgactcataaaaacgccacaatcagatgctgccaccttcactgatctcaaaaccgacatccagcggctggcaggtgctggtttctccggcaatgcgcgccagcagcagcgccgcggcttcgcgccccatgcggtcgcgtggcgtcagcactgttgccagttgtggcgtgacaacctgactgatgtcatggccgtggaaaccggctatcgccatctgagagggcacctgcaatccctggcgctggcactcaaacatcgcgccgaccgccagatcgtcattggtacagaacaggctatctgtttcagggtaaaggcgctgcgcctcacgcagcagatcacaaccggcgctgaatgaagaggcatcttccatcatcacactgcgtggcgtcagccccgcttcgcgcatcgcgatttcgtaaccgcgctgcttctgcagcgtacgttcatccaggcgtgcgccaaggtagacggtatgacgatgacctttgctgaggattgcctgcgtcatctgccgggccgcttcaacgttatcaaagcctaccgccatatccaggcagggcgtgacgctgtccatcacctcaatcaccgggataccggccacttccagcatgcgcagcgtgcctggtgtatgggtgcgttcggtgaggataaccccatcaatgttccagcccagcagcgagcgcagttgcagctcctctttttgcgggttgtaaccaaagtgggcgaccagcgtctgatagttggcttcgtcggtgacggcttcgatgccgcgcaatacgtcagcaaaaacctggtttgtgagtgacggcagcagtacgccaatggcgcggctggtggcgttagaaagcatatcgggggcgcgattggggatataacccagctcatccagtgccaccgcaatcttatcccgcagggcaacggagacctgctctggattacgcaggtaacggctgacggtcattttagtaatgccgacgcgatcggcaacgtcctgtaataccggtcttttcttcttcatcgtagcgcctgggatcgcccttaaagctaaagtacgatgagtctatcacttttctgtcacaaaattgccaaccgggcgcgacgatgcgcgcccgttatctgcttagaccggtggcagatcaaacagcaggacttctgcagccgagctggcttcaatggtcagcgcgctttcgtcccagatagccagggcgtcgctggtggtgatcgcgttgccgttaacggtaacatcacctttcaccacctgaatccagatacgacgtcccgcatcaatcgcgacattgtcctgttcgccggcagccattacccagcgcgataaggtcatgtcctgaaagactttcagcgatccttcacgggcatccgggcttaacaccagctgacgtccctgcacatccgggaagcggcgctgatcatagcgtggctctataccggtacgctcaggaataatccagatctgataaaggtgcagcggctcgctttcgctggcgttgtactcagagtgacgtacgccggttccggcgctcataatctggaactccccggccgggatctgctctttgttgcccatgctgtcctgatgctcaaccgtaccggagagcacgtaggtcaggatttccatatctttgtgaggatgggtaccaaatccctgaccgccatcaatcacatcttcgttgatgacccgcagcgcggagaaacccataaagttcgcatcgtgatagctggcgaaagagaaagtgtgccagctatccagccagccatggtttgcgtgaccgcgttcttcagctttgcgtacatagatcatgttcaaatctcctcaatgttttttatagtctgtccctgagggggtcagattgatagctgaaaaacttcacgcctctgttcaaaatagttgaatgagcattgagcagtggctgaaaagcactgaagaagggcaggcaaaaaaaaagccagcggataagctggctaaataatactggaagcaatgtgagcaatgtcgtgctttctcaggctgtcgggcgacctcccgagaatgcatgacaataataatcattatcattcgcgtctgtaaagtcattttcactttttttaccctgattaacgcggtgaataccttgatgtttaaagggttttaatgctgtggcgggttttaaatcgcgtcacagcgtattttaactctgatcccctgaatgcaaaaaaggccccttccggggtaatgctgatcagttaagattagatttgtaaaggctgtcacggtcaaacgtggcggctttttttccgggcgggccagccgcagggcgggcctgagcacctctgctgctgccgggccgtcctcgcgccgctcacgcggtaccttcggctttgacgtcgtgccgacgaaccgttcggggatcggccctccctggccggccccgaactgtccacgcttcccggcgtggacttctggcccgccgtcacgcctcagcgctgcggatagccctttcagcagcagaggcgctcaggcctccactctcgtgccctttttaacaatacacactgaagcttcagagcaggccggtgccgggcaggggcaggcaatccgcagcgctgaacagaatgagtctgccaggagagcccgcaggacgcgggcgaaaggcggggcggcacaggatgtgccatccccggcggtccgtcaggcagaggaatgacgtgaaggaaccgcgcagcggcgcgaggaccgccagcccctgcccggcaccagactgcgttatcacctgtcgcttaactgactggcattacccttccggggccctttctgattgctgactctgtctgacacggttcactgttaaaccgtgcctgcgcaaacaacacagtaaaatctcaataacccgcactcaaatcatcaatgctgcgcggatcggaagcgccatagagcatgccatccggcccgatcatgatgctctgcgtactgcccatcgacggcagtaccttcacatgctgacctttggtttccagcagacgcagcgtatcggggctgaagcccttctccacccgcagctgatccggcagccactgatgatggaagcgcggcgcattagtggcttccgccacgttcatcccgaaatcgatgctgttaaccaccatctgcaacaccgtggtgataatgcggctgccgccaggactacccgtcaccagccaggtttttccccctttggcgacgatggtcggcgacatcgatgacaacggacgtttcgccggttgcaccgcattcgcttccccgccgaccagtccgtagacattgggcgtgcctggcttggctgagaagtcatccatctcgttattcatcaggatgccgctgttgcccgccacaattccgctgccgaaataggtgttaagcgtataagtcaccgcgaccgcatttccctgcttatccaccaccgagaaatgggtagtctgattgctttcataaggttcgagcttgcccggtttgatctcgctggagggccgcgccttcgccacatcgatctgctgcgccagggttttggcataggctttactggttagcgcctgccacggcaccttcacgaaatcgggatcgccgagatattccgagcggtccgcgtaggcatatttctccgcttccgccatcacctgcatggcatcagcactgccaaagcccatcttcgccagatcgaaattctccaggatattcagaatctgcacgatgtggatgccaccggatgacggcggcggcattgagaagacttcatagccacggtatgtcccgctaatgggcttacgctcgaccgcacgataggccgccaggtcagctttgttgatcagcccgccatgctgcgccatctctccggcgatctcatccgcaatttcacctttgtaaaaggcatccggtccctgacgggcaatcagttgcaggctgtgagccaggtttttctgcaccagcctatcgcccttctgccacggcgtaccgtccggtttgtagaagatcgctttgctgttgggatgagtgatcagcacttctttgccgtaggtcttcaggtcatctgccagcgcgtcgttgaccggaataccgtcacgcgccagtttgatcgccggtgccagcagcgtgctcagcggcagagtgccatatttctgcgcagccagcgccagtccagctacggtgcccggcgtgcctgaggcgagatgtgatgtcagcgacagcttgctgtcggcgttgccctgcttatccaggaacatgtcacgcgacgcgtgtcccggtgccatttcacggaaatcgatagccgtggcgcggccagaggcagtgcgcagcagcataaaaccaccgccgccgagattgcccgcctgcggatgggtcacggccagcgcaaagcctaccgccaccgcggcatccaccgcattaccgccctgacgcaggatctcgacgccaacctgcgtcgccatcgcatccactgacgctaccatgccgtgctgcgcttttaccgggtgaaaagtgtcactgtccacaccgtaggagaccggaggagcctgcgttggcgcggcgttagcgcctgccactacggtgaaactcatcaccagcgaccagctaagctgacgcactgtttgctgcattttcatcctgccaccatcccatattgttatttacatttttttatcatttctgcaagtgcctacaaatacagcaaaataaccggggttaagtcaaatcaggaatagatcggaaagtaaggtctgtgatatcgggtaaacttatggctacgaccctgatatcggtgtacgccgttgtgcacccaaaaccctgtcgctttaaggaaggaggagtgatgaaaaagtggatgattattctggccgctctgctgcctttcgccagtcaggcgaacacgctgaacagcactaacgatccgaataaacctggctataaccccagccagcagcggatgcagtcgcagatgcagacccagcagcaacagcaacagctgaagctgcgccaggatcagcagcgtcagacgcaggacacgcagcgtaaaatgcaggagcagcggaacagcgcccagcagcgggtgattaccacgcagccgggccagcagaatcagaatcagaatctaaaccagaactaatgaaaatcggggccgatgatgtcgatggcatcagtacagatggcatcgacgccccatttcagcaattcccgcgcccgatccgggctgttcacggtataaaccagaatcttcaggcctgcggctttcagtttcggtgacccgctcagcggtcagcaccttatgattaaggtgaattgagacgcacgccagcgcagctgttttctcctgccactgcgggtcccagctgtgcgacagcaggccacgcggcaactgcggctctgccttcatcgcggcttccagcgcctcaaaagagaacgaagagagcaacggtgcgacctgatcctgccacagtatcgcggcagcctgtgccacggcgcgtccggtttcagcatcgctgccggtggtcggtttgatttcgatgttcgccatcatctgatgctgacggcagcgtgccgccacctgatccagcagcgccagcttttcaccggtaaacgcgttgccaaaccagctgcccgcatcaagctgcgacagcttctcccacggcagctgacccgccacgccccagccgttgctggtgcgatcgagcgtgtcgtcatgcagcaggaagatctgcgcatcggccgataatttggcatcaaattcaatcatctgatgaccatatttcgcgccagtgtcgatcgccgccagcgtattttccggtgccagtttaccgccgccgcgatgggcgacgatgtggggatagggccagtgttgtgtgctcattccagacgctttccatgggttgaatcgaagaagtgtaacgcatctgacggcagatgcagccacagcgtactgcctggctgcgggcgttcactgtgggctaagcgtaccaccagtggcgtgtcaccgatgcggccatgtgccagattatcagcccccagcatctccagcgtatcgacccgcagcggcacgccgccctgctcgcggctactgagccggatgtgctctggccggatgcccagcaccaccggtcggttagcccatttcgcttttgtatcgctgagcggcagggcgtgcgaggcgtcgaggtcaaagcgtgatccatcgctgctgaactgccctttcagcagattcatggcgggcgcgccaataaacgaggcaacaaactggctggcgggacgctcatacacctcgactggtgtgccgagctgctcgaccacccctttgttcatcaccatcacccgctgcgccagcgtcatcgcctccacctgatcgtgggtaacatagaggctggtggtctgtaagcggcgatgcagctgctgcagttccagccgcatctgcacccgcagacgggcatcaaggttggagagcggctcatcaaacagaaaaactgccggttcacgcacgatcgcgcggcccatcgccacgcgctgccgctgtccgccggagagttcgcgaggccgacgcatcagcagatgatccagttccagactgcgcgccgcgtcgagcacccgctggcggacctgctctttgcccatgccacggattttcaggccataggccatgttctcctccaccgacatatggggatagagcgcgtagtttctggaacaccattgcaatcccgcgatcttttggctcttcctgagtaacgcgccggtcgtcgatatagatatcgccggagctgacgcgctccagtccggccaccatgcgcagcagggtcgatttaccgcagccggatggcccgaccatcaccataaattcgccgtcattgatggtgacattcagcggctggatgatctgatttttgccatcgtaggatttggttactgcctgaagggttacgcctgccatcttatttctcactctcaaccagaccgcgcacaaaggcacgctgcatgactaacaccaccaccaatggtgggatcagggttaataacattgccgccatcacttcgttccactgggtcggtgagccgctggtggagatcatgcttttgatccccgccaccgccgtgccgaggctggcgtcattgatgatcagcagcggccagaggtactggttccagccgtagataaaggtgatcacaaacagcgccgccagattggttttcgacagcggcagaacaatgtcgataaagaagcgcatcgcgctggcaccatcgatgcgtgccgcctccaccagctcatccggcagcgacataaagaactggcggaacaggaaagtggcggtcgccgaagccatcagcggcagggttaatccgctgtagctgtcgagcaggttgagatcggcaatcacctgtactgtcgggaagatacgcacctcaaccggcagcatcagggtgatgaagatcagccagaaaaagagcgtgcgcagcggaaaacgaaaccagactagcgcaaacgccgacagcatcgacaccgtgattttgccgaaggtgatgcccagcgccatgatcatgctgttgagcagcatcaggccaaacgccggcccgttgccgttgacgccatgcgtccagatgcgcgagatgttctcccacaggtgcgtgccgggcaccagcgtcatcggcacctgatagaccgcttcgttagccagcgtcgccgccacaaaggcgacatagagcggaaacaggatggtgagcacgcccagcaccagcacgatgtggctgaagagatccagcccgcgtcgattctcaatcattggtattgcaccttacgttcaacaaagcggaactggagcaccgtcagcccgatgaccagcagcatcagcaccaccgactgcgcagcggacgaggagagatccagaccggtaaagccttcgcgatagattttgtagatcagcgtggtggtcgcctgcaccggcccgccgcctgtggcggcatcgatcaccgggaaggtatcgaagaaggcgtagatcagattcaccaccagcaggaagaagctgaccggcgtaatcagcggcagcgagaggttgaagaagcgacgcaccggtccggcaccgtcaatcgcggcggcttccaccagcgatttcgggatcgattgcagcgcagcgaagaagaacaggaagttgtagctcatctgctgccagattgatgcaagcacaatcaggaacatcgcctgaccgctgttttgcgcatagttccagttgtagccgatgtggttcagcagatagctgaacaggcccaggcccggattaaacaggaacatccacagtaccgcggccacgacaggcgcaacggcgtagggcagcagcaacagcgtctgatagagacggcgcagccgcaccacataatccaccagcgccgccagcagcagcgaaaagaccatgccgaacaccgtgaccatgccgctgaattttatggtggtccagaacgaatccagatagtaaggatcggcaaacaggcgtctgaagttttccagcccgacaaagctgctggagatgccaaagggatcgaggctttgcagcgagtaccacagcgcttcaccggcaggccagagaaagaagatggcggtaatcagcagttgcggcagcaccagaagatagggcaacagactggtgcgaaagaccggacgagatgaagacatggtgcacctggcgtcagagagaggggccagcctgagctggcccgcaaggagagattacttcacctgctgctggaagcggcgcagcaactcgttaccgcgtttcactgcgttatccatcgcgtttctgcggcgactgcttgccggtccagacgctttccagctcttcgtcgatcacggtacgaatctgcggcatgttgcccagacgcatgcctttggtaaacggcagtggcggcttgttcatcatctgacgggtggcgatatccgcgcccggattcttatcgtagaagccctgctgtttagtcagctcgtaggcggcggtggtaatcggcagatagccggttttctggtgccattccgcagcgatttccggtttagcgaggaactgcataaactcagccacgcctttgtaggttgtcgcatctttgcctttcatcacccacaggctggcaccaccgatcagggcgttctgcggcgcattcggcacggtctcgtcatacggcatcatgccaacaccgaagttgaatttggcgtaatgacggatatcagccagcgaacccgatgaggcggtggtgataccgcagtcgccgttgtagaacttggcggtggactcatctttgcggccaaagtaggtgaagtcccctttcttgttcatcgcttccagcagctcgatatgacgaaccagtaccggcttgttgaactccagcacggcgtcgagtccgtcaaacccgttgtttttggtcgctaccggcagagcgtgccaggcgctgaagttttcaatctggatccagccctgccagccgctggcgtagccacagctcatgcccgatttgcgcagtgcggcggcatccgtcgccagctcctgccaggtttttggtggctgatccgggttcagacccgcttttttaaaggcgtctttgttgtagtagagcactggcgtcgagctgttgaacggctgagagatcagctgacctttgctgtcgctgtagtagcccgccaccgttggcacgaactgcttttcatcaaaggggataccggcgtctttgaagacctgatgcaccggcacaatcgcctgcgaggccatcatggtcgccgtaccgacttcataaacctgcagcaccgcaggggctttgccgctgcgcactgccgcaatccctgctgccaggctctgctcgtagttacctttgtaggtcggaacaattttgtaatcgggatgcgtctggttaaaacgctgtgccagcgaatccacttctttgcctagctcgccttccatagagtgccagaaagggatctcagtggcggccatggcatggctgctgagcgtcagaccgagcagcacgctcatcaggctacgacgaaaggtaacgacggacatagaattttcctgtgcaggtaaatacgcgtgaaatcacggatttctgtttcgcgaagtaacatgacacggggaaatgaaggattaataacagaaagatgacagccgggtgacagaccggtatgcgcaaaagaggaggctggcagcgcagcggtaacgcgtcactgctgccaggttttggttacataatttgcagagcggttgggcagtaaaaaagcccgcagcggattctacttcaccaaatgcaaaaggcgatggcggcccctctaacaccgacactcaaggccgtctgcgccgcatcacacacccattttgaaagccgtcggcggcgcaggcaggttgcgggcggacagcgcgcagccaccggagcgtacacgtagtacgtgaggatggcgagcactgcccaaccgcaacctgaccagtaagccaggcctgtgtaccaaagcgcgcagtaaccggagcgtatatatatacgtgaggattacgagcactgcccggtgtcgaaatggcaagtaagccaggccgtgccccatcaggcacctaagtaagcactgcggacggcttcgttggaaaggagagctgaacctgtgtcttcgagcaccacatgcccgtttctccagcacatagcccctatccgccagcttcagcgcctgattcgcattctgctccaccaggaaaatcgtcatcccctcgctgcgcagctgctcaatggtgtcgaagatttgctgaataatgatcggtgccagtcccagcgacggctcatccagcaacagcaggcgcggctggctcatcagcgcacgaccaatcgccagcatctgctgttcgccgcccgacatcgtcccggcgcgctggattttacgctcctccagacgcgggaagagttcataaacgcgcttgatccgcgtcagatagtccggacggctggcaaaaaagccccccatcgccaggttctcttctaccgtcatgcgcgaaaagacccgtcggccttccggcacgatggcgatcgcttcacgcataatgcgtgaggtttgccagtcggtaatggttttgccatcaaaggtaatggtgccctgcgtcgcgcgcggctcgccgcatagcgtacccagcagcgtggtttttccggcaccgttagcgccaatcagggtgacgatttcgccctgattgatatagagactgacgttgtgcagcgcctgaattttgccgtagtgggcgctgacgttctcaatggttaacatcgcatttgccatctcaggcctctcctaaataggcacgaatgacatccgggttattacgaatctcttccggcgttccgttagccagcggcgttccctgattgaccacataaatacggtcagaaatccccatcaccagcttcatatcatgttcaatcagcagcaccgacaccttatgttcgccacgcagctccgcaatcagcgcgtccagctcgtgcgtctctttggggttaaggcccgctgccggttcatccagcatcaggatttccgggcgcgtcaccatacagcgcgcaatctccagccgacgctgctgaccataggccagattgcccgcctgacggttagccagatccagcagccccacccgctccagccaggtcgccgcacgatccagcgcctcgctctcactgcggcgaaacgccggggttttcagcagaccggaaaatacgccgcttttcagatgctgatgctgcgccaccagcaggttctcaatgaccgtcatctcacggaacagacgcacgtgctggaacgtccgcacgatgcccatccgcgcaatcttctggcccggcaacccttcaagatgctgctcacgcaatgtgatcgtcccgccggttggcttgtaaaagccggtcaggcagttgaacacggtggttttaccggcaccgttggggccaatcagcgaaacgatctcctgcggacgcagctccagcgccacattgttcacggctaacagaccgccgaagcgcatcatcaggccttcaacggctaataaaggctgaatcatgcctgctctccttgtttaccggttctgagcttcagatgcggacgcttcatcggcaacaggccctgcggacgccagatcatcatcagcaccatcaggccacccagcaccagcatgctgtactcattgagatcgcgcatcagctcgcgtgacaccaccagaaggatggcggccagaatcaccgcaaactgcgaacccatcccgcccagcaccacaatcgccagcacaaaggcggattcgacaaaggtaaaggattccgggctgacaaagccctgacgcgccgcgaacaggctgccggcaaaaccggcaaacgcggcactgatggtaaaggcggtcagcttgatgcgggtcgggctgaggcccagtgaacgacaggcaatctcatcctcgcgcagggcttcccaggctcggcccagcggcatccgcagcagccggttgatcacaaacagcgtcagcaccaccagcagcagcgccaccaggtagaggaagataatgcggtcgctgggatcgtacttcaggccaaagaagttatggaaggtatcccagccaccttcccgcggcgtacggccaaactccagaccaaacagcgtcggtttcggtatctggctgatgccgttcggcccgccggtcagggcggtattgttcagcagcagaatacgcacgatctcaccgaagcccagcgtcactatcgccagatagtcgccgcgcagtcgcagcaccgggaagcccagcagcagaccaaacagcgcggcaactatgccggagagcggcaggcactgccagaagccgagaccgtaatagtggttcagcagcgcaaaggtgtaggcaccgatggcgtaaaagccgccataacccagcaccagcaggccagagaggccgaccaccacgtttaagcccagaccgagcatcacgtagatcagcgtcatggtggcgatatcgacggtgccgcgtgacaccaggaatggccaggcaacggcggcgataatcagcaccgccatcaccagcttctgcttcggcgtcgagccatccagacccggtaacaccagcgccggacccgagattttcttcaggccgctttgccataccggacgcagcagttgaaacagaaacaccaccgcacagcctgtggcgatccagttccagcgcacgctaccggcgttctgcaccaccagattagtgccgtccagattcaggcgcagccccataaagaaggtggcgagcaccagcagcatcaccgaggagatcagggcattgataaaggaagtcttcatactttttcgacctccgggcgacccagaatcccggtcggcatcaccagcagcaccacaatcagcagggcaaacgagaccacatctttatattccgtgctgagataggccgaggtcagcgcctcggcgatgcccagtaccagaccaccaatcatcgcgcccggaatactgccaatcccgcccagcacggcggcggtgaatgccttcatacctgccataaagccgatgaaggggttgattgaaccgtagaaactgtcccagcaatacgcccgccaccgcggccatcgcggcaccgatgacaaaggtcagcgagatcacgcgatccgtattaattcccagcaggctggccattttcaggtcttctgcgcaggcgcggcaggcgcggcccatgcgtgagtagcggataaaggtggtcagcgccagcatcgccaggaacgtcaccacccagatcactatctgcatggtagaaatcgtggcggcaaagccgttgctctcgcctaccgtccactgtccggtaatcagactcggcagcgccaggtcgcgtgaaccctgcgtcaggctgacgtagttttgcaggaatatcgacatcccgatggcggagatcagcgcaatcaggcgcttggacgagcgcacaggccggtaggcgacgcgctcaatgctccagccgtaggcgctggagataattaccgccatcacaaagccggccgcaatcatcagccaggtggtgtcgatgcccatcatcatcagggcggcaatcacgataaaggagacatagctaccgatcatgtagacctcgccgtgggcgaagttgatcatgccgataatgccgtaaaccatggtgtaaccgatggcgatcagcgcgtaggtgctgcccagggtcacaccgttaaacatctgctgaataaaatagagaaactgctcggacataccttgacccttacttaaccgatcatgggcgatcggggtacaaaaaacgcctggcagacccgcaccaggcgttcgtgtcgctggtcaggggaaaccggttaaccggcctcccgctcaccacaaaacagcctggtttacttcactgcggtcgaggtgccatcggcatgccatttaaagacgccgaattcaaagcccttaaggtcacctttctcatcccagttcaggttgcccatgacggttggcaccgcggcaccttccttgaggtttttcacgatagcgtccggctcagcgctcttgctgcgttccatgccggttgccagcgactgcagtgcggcataggtggtccagacgaaacggtccggtcggatccagtttcttcgctttcagcgcttccacgatcgttttgttggtttcaacctgatcgtaacgttttggcagggtcaccagcatgccttcagaagcggcaccggcgatgttcgacagcgaggcgttacccacgccttccggtcccataaactgggttttcaggcccgcagcacgtgcctgacgcacgatctggcccatttccgggtagtaaccgccgaaatagacgaaatcgacgttctctttcttgaagcgcgcgaccagcgtagagaaatctttatcgccagcggtgataccttcaaacatcacgatattggcgccctgctttttcaggctctcctgtacggagcgcgccaggccttcgccatactgctgtttgtcatgcaccacggcgatgcgctgcggtttaagctcgctcatcacatatttcgcggcggtcggaccctgatcggagtcgagaccggtggtgcgcataatcagtttatagccgcgggaagtcaggtcaggggcggtcgccgccggggtaatcatcagcacgccttcatcttcatagatgtcagaagcgggctgggtggatgaagagcagagatggccgatcacgtagcggatgccgtcgttaatcaccttgttcgctaccgcaaccgcctgtttcgggtcacaggcgtcgtcatatttcaccgcaaccagtttgttgccgttaacaccgcctttagcgttgatatcttcaatcgcctgagtcgcaccggcgaactgcatgtcgccgtactgcgccaccgggccagacattgcgccgacaatcgccactttgatatcttcagccagcgccgcatggctcatcgccagtgctacacatcccgccagtaatgcgcgacctttcattttcatcctgactaccccatttgttttgtcgtgtatgttgtgagtgtttgtgctgtcagataaagtcgaaaactgattaagcatgaatgagttagcgtacttttctgacattttttattaataaggctttatttttcaggttattaaacaggaagtttcttctgtaaatcaactgacatattcagaattgactgagtgaaacagcataatacactggaggcaacggccggtttttcaccgctttgccagcgcgttatgctggattgatcgcacgctctccctgtttacaactatcatcctggcatcccgaccatcttttgacctgttttattgatgaaaatgtggtagcactctggttgtacattttcgctgcactttcccctgttacagaggtttttgttatgaagctcactatccagcgtttaaccacgctgaccgcgcaggaccgcatcgatcttggcaaagtctggccggatctggagattgaacaactggagcagcagctggatgagcgccatcgtctctatgctgcccgttttaacgaccggctactggcgggtttgcagctggaaatcgccggaatccacggcaaagttcaccggctgtcggtgcgcgatgtcacgcgccgacgcggggtgggacaatatttactggaagagacgatcaggcagaatgggtcgatagcggactggtggattgccgatgatggcagtgatgatcagcaggtgcgggcagcctttatgcaggcgtgtggcttcagggcgcagagtgacggctggataatggcggtagaatagtcaggcgcagaaaaacaaaaagggcgacataaagtcgccccttaagatgtcgaagtgcgttacgcttcgatcgccatacgcagtttcttcatggcgttcttttccagctgccggacacgtttcggctgacacgccgtactgatcggccagctcctgcagcgtggttttattgtcttcgtccagccagcgggcgcgaatgatgtgctgactacgctcatccagaccttccatcgcatagctcagcttgtcagccgcgtgcgcatcccagttatcctcttcaatgccgtcagcaaagtcagaggttttatcctgaagataaagcacgggtgccatagatcggccttcgctgctctcgtcgtcggcagacatatcaaaggtcatatcctgcgcggccatacgcgattccatttcacgcacatctttgctgcttacgcccagctcacgcgcaaccatctcgacttcgtcctgattgaaccagcccagacgctgcttggttttacgcaggttaaagaacagcttacgctgtgctttggtggtcgcgactttcacgatacgccagttacgcagcacgtattcgtgaatctccgctttaatccagtgcacggcaaacgaaaccagacgcacgcccacttcagggttgaagcgacgtaccgctttcatcaggccgatattgccttcctggaccaggtcagcctgtggcagaccgtagccggagtaattacgagcgatatgaactacaaagcgtaggtgagacaggatcagcgtctttgccgcatccagatcgccctggtaatgcagccgttcagccaacgctttttcctcttctgccgaaagcatcggccaggtattcgcagcccggacgtaagactccaggttgccaagaggagcaatagctaaagtttgcatttctttggtcattcaaaccctcacaaattcagtggaattgccgcacatttccctgcgcagacgatacattacgttaacgtcgcgcgaaatccgaaagcaatctgtgctacttagagtggtaaagttatccacaagttcaattatagcggtgaatattttacacacagatgacaggaagggaagagaggaaatatcctctgcacccaccatcggtagcagaggaccattataacaaaaaaatgttgcaggcgtttactgcggcgtaaatcgacgtaaatgttgtaccgttgccagccacgcagccacccagccgatgattgccgcaatcagtaacagcagcagcgcctcatcccacgagaagccttccagcgagaaggtggtaccaaataccgtcgccacgctggcaacaacggactgcagacgcagcaccagcacttccgacagcagcagcgacagcaccgcaccgctgaagcccagcagcgccccgccatagaggaatggacgcaggataaagccgtcagtggcaccaatcagcttctgcacgttaatggtgtcgcgtcgggcaaagatgctgagccggacgctgttaccgatcaccaggaacactgccacgatcatcagcacgccaatcattgaggcgatctgccccaccagcccggtcagcgccgccagccgcgcaaaccagctatcatccatccgcacttcatccacgccctgcactttagttacccgatcgcgcaggctttgcatggtgtctgagttctggaaattgagcttaggtgtaatgatggccaccgcaggcagcggattctgctccagcatatccattgcgccgccaaagcctgaccagttgcggaactcgttcagcgcctcttcccgcgtcaggtagttgacgttatccacgccttcgacctgcttgagctgcgccaccacgttttctgccgccgtgtcatccagcgttttggagagataaacggttaactgcggcgccggataccactgcgttgccgcctggctgacgtttttccacaccatgtagcagacgctgggcagcgtcagtgaaatggcgatgaccatcaccgtcagcagggttgccagcggctgacgccacatatcagaaagcgtgccgcgcagcgcatagcgccactgctcctgccagccgcctttcagcgctttgctcttcgactgctgcttcgctttcggcgcagccggacgtttaatgcgtttattgaccatcgtggcctccgtgcagacgtccctgattcagcgtcatcatccggtagttgcgtcgggcaatcagaccgctgtcatgcgtcgccatcaggacggtgacgccgacgcggttaaactcttcgaacaggcgcagaatatcttctgacagcgcgtcgtcaaggttaccggtcggttcatcggccagcagcacggctggcttgttcaccaccgcacgggcgatgcccacacgctgctgttcaccgccagaaagctgaatcggataacttttcgctttgtcgagcagacccactttatccagtgccgccgaaacgcgacgacgaatgtcttcgccgctggcaccggagataatcagcgggatcgccacattttcataaaccgaacgatccatcaacaggtggtgatcctggaaaatcatgccgatctgacgacgcaggaaaggcacctcgctgttacgcaggcgggaaatgtcatggccgctgaaccagatttttccggcactcgggcgctcaatgccacaaatcagcttcagcaaggtacttttaccggcaccggagtggccggtcagaaacgccatttcgccaggacgcagacggaaatctaccccctgcagcgcctgacgtccgccgagatatgccttactgacctcttcaaagcgaatcatcctaattagtcctctcgggcaaacagtgcctcaataaaatcttccgccttaaacggccgtaaatcttcaatgccttcaccgacgccgatgtagcgaatcggaataccgaactgatcggccaccgagaagatcacgccgcctttggcggtgccatccagcttggtgagcgcaatcccggtcacgccaacggcttcattaaacagtcgggcctggctgaccgcattctgtccggtgctggcatccagcgtcagcatcacttcgtgtggcgctgaatcatccagttttttcatcacgcgggtgatttttttcagctcttccatcaggtgcgatttgttctgcagacgacccgcggtatcggcaatcagcacgtcaacgccacgcgatttcgcggcctgaatagcatcgaagatcaccgaagcggaatctgcaccggtgtgctgagcaatcaccggaatgttattgcgctggccccacacctgcagctgctcaacagccgcggcgcggaaggtatcaccagccgctaacatcacggatttgccttcagcctgatactggcgcgccagtttaccgatggtggtggttttacctacaccattgacgccaaccatcaggatcacaaacggcgttttgcctgagacgtccagtggcgcgtccactttcgccagaatcgaggccatctccgctttcagcaggccgaagagcgcttccgcgtcacgcagttgcttgcggtttgcctgctgggtcagatgcgtgatgatgcggcgagtggtatccacacccacatccgcaatcagcagttgctcttccagctcgtcaaacagctcatcatcaatctttttgccacggaacaggctgataaaaccggaaccgaggttctgacgggttttcaccaggctgcgcttcaggcgggcaaagaagccctctttgctgggacgctcctgctcctgcacgatgagtggcgcggcggccagcgggagatcgctgacggtatcggataatgtctctgccggttccgcgtcggtgacttcggcttcgcccagtgccagtgcggtcagctcttcctcggtgagcggtgcttccgtttcgctgtccggggtttcaacgatcgcagcttcgtccggcgtcagcgcttcatcgcttaacggcgcttcggcttcgctgtgcggggtttcaacgatcccggcgtcatccagcgccagcgcggtcagctcttcttcgcttaacggcgcgtccgcttcgctgtccggggtttcaacgatcggggcgtcgcccagtgccagggcggtcagctcttcttcgcttaacggcgcatcggcgggttccgcatcaacggctggttttaccacgtcgtcggcgtcaataaccggcgtcgcgtcatgttcaggtgcggtgatttccagtagcgcttcaggatcggcctcaatcggcgcagcttcatccagcaccatgggtgccgactcgtgcggcgctgccgcggtgacttccgcctcacgctgctgcccggccaccgtttcggtgataacgacagtctcttccgcttgcgcttcagcctggcttaatgccggggcgtcctgtttctgcctgctgctctgcgggttctgcgacctcttgtgtctgctcctccgctacaggttgtttctcttcctctttgccaaatcccagccaggaaaaaaagccacgttttttctcttttgccattgtgtgacgacactcctcgatggctttgtcccggtcgcgcgtggtttccaggggtaaatcaatgaaagttggtcagcgccagaccggcgtaaaccgcagaataatgcatgacttcagcaactcagtagtctaacactttccagccagctcaccacagcacccttttttaacgtttcttctcaccgattcgcccgttaaactacgcaacaaattatgacgagttgtgagcaagatgaataaaaacccccgcagtacaggcggtgccgggcagattcgcatcattggcggccagtggcgcggacgcaaactgccggtgccggacagcgccggactgcgcccgaccaccgatcgggtacgtgagacgctgtttaactggctggccccggtgctgccagatgcgcgctgcctcgactgctttgccggtagcggcgcattaggactggaagccctgtcgcgttacgcgggatcggcgacgctgctggagctggaacggccggtggcgcagcagctgacaaaaaatctgcagacgttgcgcgccagtaatggcaccgtgattcagaccaatgcgttaaactggctggcacagccaggtgaaccctttgatgtggtgtttatcgatccgccgtttcgtcagggattgctggaacagacgttacagctgctggagcagaatcactggctggccgatcaggcgctgatttacgtcgaaagtgaagtggaaaatggcgcaccgccggtgccgccagagtgggatctttatcgcgagaaaatagccggacaagtggcttatcgtttgtatcaacgtcaacaggagacgcaggatgttacttaatttggggcgtctgttgatgctatgcgtgtggggatttttactggctaacctggttcatccctacccgaaaccgctgacttattttatcaacgttgcgctgattttcatgatcctgatgcatggcctgcagctggtgttactgcgcaccacgcagaccaaagatgcgccgccgattgaccgcgtcacccaagccaaagtgtttctgttcggggtattcgaactggtcgcctggcagaagaaaaacttcccacgcaagaaataatcccgggcgggcgcgatgcccgccggttactgccggggtgtgaagctgataaagcgcgtgccctgcatcttcagctcgcctctggcgcccttgtccagctgatgatattccgcctctttaagctgcactttgatgtcgctggcaccgttcagcgggtgaaacagcacctcgtagcgcatctcttccccggcgatcacttcccgctgccgtgaacggcgattgggtgcaggaaattcacgtttggttttgacctcaacctgcagagaaacgctcgggtgaagcgtcatttaccgccacttcccggcgttgcttaatgaactgacgggtcgccagcacggcgataatcgccagaacgatgataaagattagcggcggtttgctcatagcgttcttgtgcctgcaggatgattaatcaggcggcaaagcatacaaccagagttgcctgattgtcacatctcagaggcttaacctaaactggaagggatattttgggatctttcaccattttgaacaaaaaagggagaaacaatgctctggtctttcctcgctgtacttttctccggctggctctatgtcgacgccacctatcgcggcccgcaatggcaacgctggttatttaagccggtcacgctgctgctgcttgtcgggctggcctggcaggcaccggtgctgcagactacggactacctgattctggccggtctggtcgcgacgctggtcggtgatgcgttaacgctgctgccgcgtcagcagatgctctatgccatcggggctttcttcctgtcgcacctgctttataccctctgcttcgccgccagcatgaccatgaccttcttctggccgattccgctgacgctgctcatcatcggtgccgccctgattggcatcatctggagccgactggaagatctgcgctggcctgtctgcacctttatcggcatgacgctggtgatgacctggatagcgaccgagcagtacttcttccgcccgaccgattacagcttctcgatcatggttggtgccggtctgctgctgctggcaaacgccgtctggtttatctctcactatcgtcgccgctttaccgccgacagcgcgattgtcgccgcctgctacttcgccggtcactttatgatcgtgcgctcgttgtgggtcgtctgaaaaaatagccttgactctggagttcactccagagtgtaggataaaggatgggctgcgttgctcatcccactattcttacactctggaggtcatatgcatcaacatcacgcctgtggctgcggcaaaccccgtgccagtcacgccgcagcaaaaccgctgtgccaggttcgccaggcccgccccctctccctttctattcatgccgcgacgcctgtacctgccgagacggcaggatgttgctgtgacagtcactgcagccctggcaacgacaccgacaccgctgaggaaagcgaccggcgaggtgccgacagttatccctttagctggcaggtcagcgggatggattgcccgtcgtgtgcccgcaccattgaaaccgctgtccgtcaggtgagtggcgtgaccgatgcccgtgtcttgttcagcagcgagaaactggtggtcaacgctgaccaggacgtacaaaacgccgttgaacaggcggtgaaaaaagccggcttccagctcgcaaccccatcagccacgtcggccacatcccccgctacgccgggctggcagcataaccagatgctgattttgctggcgctgctggtgcttgccagtagcattctcagccagttcgcgcccacctggggcgatcggctgtttgtgctgaccacgctggtcggcctggtcccggtggcgcgcggcgcctggcagcgtctgcgcagcggatcgccttttaccattgagacattaatgacgctggcgtcagctggcgcactgattattggcgcacacgctgaagccgcgatggtgctggtgctgtttcagctgggcgaacagctggaaagctatgccgcttccagggcgcgcagcggcgttaccagcctgatggcgttgcggcctgaatcggcgatccgccttgaacagggcaaacgtactgaggtaccgcttgcagcgctgcaacccggcgatgtgattgaagtcgcggcgggcagccgcttgccggtcgatggcagcttaatcagcccgcttgccagtttcgatgagagcgcgctgaccggtgaatcgctgccggtaacgcgggccagcggcgaaaaaattcttgccggtgccaccagcgttgaccggctggtgatgctggaagtggtgtcgaagccgggtgaaagcgcgatcgaccgtatcctgcagctgattgaagaagcggaaacgcatcgtgcgccggtcgaacgctttatcgaccagttcagccgtatttacacgccgctggtcatgctgctgtcgctgctggtgatggtggtgccgccactgctcggcgcaggcgactggcagccgtggatctacaaagggctgacactgttgttgattggctgcccctgtgcactggtgatctccacgcctgccgccattacctccgggctggctgcggcggcgcgacagggcgcactgatcaaaggcggtgcggcgctggagcggctgagttcggtgcgcagaatggcgtttgataaaaccggtactctgacgctgggcaagccacagctgacgcagatcctgcgctttggcacggccagcgagtcagagatgctggcgctgagcgccgctgcggaacagggtgccacccatccgctggccagcgctatcgtggcggccgcgcaggcgcgtgatctggtgattcctgacgcgcaggatcagctggtgcaggcgggacgcggcatcagcgcgaaagtcgctggccagcagattcagctgctgacgcccggccatgcacccgatctgacgccgcagcaaaatgcgcagatagcgcaacaggaagctgaaggtgaaaccttggtgttgctgatgcgcgatggcgaagcgctgggtgcgctggctctgcgcgatcagctgcgcgacgacgccgttgaggcgttaaaggcgctgaaaaagctgggtattgagagcctgatgctgaccggcgacaatccgcgcgctgcggcgaccattgcccgccagctggatattgattatcgcgccagtctgctgcccgccgataaagtcgcggcgatccgcgaactgagtcagcaacagccgctggcgatggtcggggatggcattaacgacgcgccagcaatgaaagcggcaacgctgggcattgcgatgggcagcggcaccgatgtggcactggaagcggccgatgctgccctgacgcgtaatcagctcagcaatctggctccgatgattgcgctggcacgccggacacggcgtatcatccgccagaatatcggtattgcgctggggctgaaggcgattttcctggttacaaccctgctgggtctgaccggactctggctggcggtgctggcggattcgggtgcgaccgcgctggtcaccgccaacgcgctgcggttactgcgtcgccgcgcctgatcaggcggcttctgatctgaagagtgaggttaacggcggcctgtacggctgtcgtcaacccgccatgcctttgcggatcagaaactgatagggcagcgtgtcggtttgctgcgccagcaagccatgttccataaagcggcagaagccgggaatatcgcgcgtggtggccggatcatcggcgatgatcagcaacgtctcgccatcctgcaggctgcgtacggttttgcgcaccatcatcaccggctccgggcaacgcaggccacgggcatccagctgatggtcggcagaggaaaaagcatcgctcataatcaactcggttcaggtaagggacgctcattctagcgcgtgctggcggtgaagcaaggcgataacgattgcgctaaaattaaccattgcataaaaagcacaacgcggtaagatgccgccgctttttgctcataaaactgccaggcgctgcccgaacggcgtcccgcaatgggttccctcaccccaacattaaaaaggttgaatatgctcgcattttcttcgcgtcagcgcatgcatgcgcttttctggttatcgctgtttcacctgctggtgatcacttcgagtaactatctggttcagctgcccatttcagtgtttggcttccacaccacctggggtgcattcagcttcccgtttatcttcctggcgaccgacctcaccgtgcgtatttttggcgcaccgctggcccgacgcattattctggccgttatgatcccggcactgtttatctcttacagcgtctcagcgttgttctatcagggtgaatggcagggctggcaggcactggaagtgatgaatctgtttgttgcccgtatcgcctgcgccagctttatggcttacgcgctgggtcagatcctcgacgttcacgtgttcaaccgtctgcgtcgcctgccacagtggtggattgcgccgggctgcgccatgttcctggggaatatcagcgatacgctggccttcttctttatcgccttctataaaagccccgatgcgtttatggcgcagcactgggttgagattgctctggtggattatagcttcaaggtgctgatctgcatggtcttcttcctgcccgcctacggcgtgctgctcaacgcggcgctgaaacgtctggctgaacgccagaccgcccgccaggtcaatttcggctaagtgcccatacggtttccactactatccgctaagatcttctgacaatcatcaggttgcgtttgcaacctgattcctgttgtattaatgcctgactggaaacttaaaaagggattctgatgcgcaacctggtgaaatatgtaggaatgggtttactggtactcggcttagcggcctgtgaccagaagaaagatgaagcggcgaatgacaacggcgtcagcgccagtcagtcggcgcaaaccgtcacgctgatggatggcaaactgagcttctcgctgccaccaggcatgtccgataaaagcggtaaactgggttcgcagaccactaacatgcacgtgtatgcggatgaaaccggtgcccgcgccattattgtgattgccggtgacccgaccaatgatggtctggatgtgctgtcgcagcgtatggaacagcagcagcgtaaccgcgatccgcagttgcaggtggtgtcgaacaaatctgtgacgctaaaagatcagcccgcacagcagctggatacggtgatttctgccaataaccagacctcatggtcttcagtggttctggcgaaagtggatggcaaactggtgacgctgcagattacgctgccaggtgataatcagcagcaggcgcagagcgatgctgacaacatcgtgaaaagcattacgctgaagtaaaacaaaaggctggcttccctgcacggggaagccagccttcggtctgaagggctttttataaacctgcattctcgcgaatatatttccgcgctttcaccgcatattcaaacggattggccagtgccggatcctgctccgcttcaaccaccatccagcctttatagccgtaatcatccaggattttgaacaccggtctgtagtcgatcacgccatcgcccggtacggtaaaggtgccctttttcactccttccaggaacgaaagatggttctcacgcacctcggcgaccacctcatcacgcacatccttaagatgaacgtggaagatgcgcggcagatatttctccagtaccgccagcattttctgctgggagccttcggagtagtagacgtggccggtgtcatagagcaaaccgacctgctcgtcggtcatctccataaaccggtcaatctcttcagtggtctgaatgccggtgcccatatggtgatgcagcgtcacgcgcatccccttctccgccgcgatgcgggccagtttcgttgtagccttccgcggttaactgccactcttcatcgctgaaaatggctttctcttcaaacaccgcaagcccggtgccctgaatacttttgctctgctcggaacagccaatcacccgcgcgcccattgcatgcaggaagttcatatgctcgatgaactgttcgatggttttctgtttgtcgccgttggcgaaaaaggtgctgaaccaggcgttacagatctcgatgccgcgaatgtcgagcatcggtttcaggatcgccggatcgcggggatatttgctgcctacttcgctgccggtaaagccagccagcgccatctcactgacggtctgctggaaggtattctcactgccgagatccggcatgtcatcgttggtccagccgatcggggcgatcgccagttttacattctctttgttcattatcttattcccaggcggagagcggccatgccgcatagacagctaaatcagttatagaaagcaggacgcggcggcatctctaccggctcaatcgcaccactgttctgcgctttaatgcaggcatcggcggcgactgaggcggcaaagccatcccaggcagaaggaccggtcaactggcccgctttgatgtcgttgataaacgcctgcagctcaacgtcatacgcttcgataaagcgatctttccagtccaccagaatggtgttcgacaggcgggcctctttgcgcagctgcaccgaagagggctctggcaagcgcgcaatcccctcttcacccaccacttcacactggatgtcatagccgtaagcgcagttaacgaagatctcgacgtcaatgcgaacccctttctgggtttcaaacagcacgatctgcggatctttcagctgactgtgtgacttcgaggtgacgcgcgggaagactacctgcaccgttttatagtcatcgtttgtcagccagcgcagcacatccagctcgtggatcagggtgttggtgatcgccatcggcgtggtgtagttctccggcacggtcgggttgcggtgcgcacagtgcagcatcagcggctcaccgatatcgccatcggtgatcacttttttcagtgcacggtagcccgcatcgtaaggacgcataaagccgacctgcaccaggcgtttacccgcctgaatctctgcatccacgacccggcggcagccctcagcgctcatcgccagcggcttctcacagaacaccggtttaccggcggcaatcgccgctaaggtgaactcttcatgggtcggatcccatgaggtgaccagcaccgcatcaacatccggagactgaatcacgtcgtgtccattttcgaataccttcgcctcaatattcaggcgttgcagtgcggcacgcgcgccttcgacattaatgtcagagacggcaaccacctgtgcaccctgcaacacatggctgcagcgacgaatatgttcctgaccaattgcacctgtaccgatgacgccaagtttcaaagtcataattacacctgtgtagggttcgtacggagaagagcaaaacgggccgtggcacggccctgaaattaatattttcgcgcctgatccagatggctgttgagcttgtccgccaccgcctgagaacgttcggtcttcgaggcctgcgccacgccgacgtgccaccagctgaaatatttgtggatcatggtttttggcagcactttgatgtcgataagggtggaaaccgtctgcgtgcgggcatcttccagcgccgccttgagctgctccagcgtggtcacacgataggttttgcagccataaccggcggcgatagcggcaaaatcgaccgggataaagccgccgtccagcttgccaccttccgcattacggaaccggaactcggtggtaaagctgtccataccgtgttccatctgcaggttattgatgcagccgttggtcatgttatccagcagcactacgttgatcttcgccccttcctgaatcgaggtgaccagctctgagtgcagcatcataaaggagccatcaccgaccagcgcatagacctcgcgctgcggctgcgccagcttcacacccagcgcggcattcacttcataacccatgcaggagtagccatattcaacgtggtaggcgttgtaatctttggtgcgccagacgcgctgcaggtcgcccggcagactgcccgccgctgccactaccactgcgtctttcggcagttgctcatttaaggtgccgagcacgctgctttgcgtcagtagcgactgggtcaggcggttaaactcagcgaaacaccgcttcgcggtcgagatgatccgcaatctccggcacaaagtcgccatcgtgatattccacctggtagacgcgctgcgtctctttcagcagctggctctgcgcctgctcaatctggttgccccagtcgttgctgtagtgctgcgaggccagcccggcggtgagcgcggtcagcccttcgcgtgcatcagccagcagctgcacgccatcgagcttgtagctgtcaaagttgctgacgttgatgttcaggaagctgacatcgggatgctggaaaatccatttcgacgcggtggtgaagtcggtgtagcgggtgccgatgccgatcactaaatcggcctctttcgccagcaggttagccgccagacagccggtttcgcccacgccgccgacattcagcggatggtcagagaccagcgtgcctttgcccgcctgcgtctccgcaaagggaatctgatagcgctcggcaaactggcgcagcgcctcgcccgcttcggagtatttcactccgccgccgcagataatcatcggcttgcgcttacggttaatcagcgtcagggcatctgccagctgcgccgccaccggcaggcggcgatccagacggtgcacccgtttctggaagaagtagtccgggtaatcccaggcttcgccctgcacatcctgcggcagcgacagcgtgaccgcgccggtttctgccggatcggtcagtacgcgcatggcgttgatacaggcggacatcagctgttccgggcggctgacgcgatcccagtatttgctgacggcgcggaaggcatcgttggtgctgatgctgagatcgtagctctgctcaatctgttgcagcaccggatcgggctggcgggtggcgaagacgtcgcctggcagcagcagcagaggaatgcggttggcggtagcggtcgccgcggcggtgatcatattggccgcaccaggccccacagacgaactgcaggcgataatctggcggcgcagcgactggcgcgcaaagccggtggcagcatgagccataccctgctcattacggccctggtagaccaccagatcgccgctatcctgttccagcgcctggcccagccccagcacgttgccatgtccgaaaatggcgaagatgccttttacgaacttcgtctcaacgccatcgacatcaatgaattgattatcaagaaatttaaccagcgcctgtgccgtggtcagtctgatagtgcccatattcttccttacatgctggtggaccccgacttccgcgacagcacgccaggcgttgtcatcggcggaaaaggcgacctgaataactgaaacgtgaggcgattataaacaaatatatttttcataaaacacgattacagaagaaacatttcattttgcgagtgagatcaaatttaatgacggcaacaggtctggcgggcgattacagtggggaaatctggaacgtttaacagagagtggtgcctgatgaaaaaattcatttcaatgcagcagcttgcctgactggcgtgcggattcctgcgatccccttcacaaccctgacataccgcacatcacgctggcagagttcgctcaggcgggcggcaatcaggagttttacctggttcacaaaattgcgatggatatttcatttcgtattgaatatggaatttttattcctcatactcccctcatagccagtcagacacctacagacccggaagcagagcgtaactggtgtcggtcttcacgcccgccagcgctgctaatcacagaaggaaaccacaggtatgagtacacaacagaaaccgcttgatgtgatttgtatcgggcgcatcgccgttgatttttatggccagcaaatcggggcgcgactggaagatgtcacctcctttgctaaatatctgggcggctcgtcgggcaacgtcgcctatggcaccgcgattcaggggctgaaatcggcgatgctggcgcgggtgggagatgagcataatggtcgctttctgcgtgaagagttgcagcgcgtaggctgtaacaccgatgcgctaatcaccgatccgcagcgtctgaccggactggtgatcctcggcatcaaagatgaagagacttttccgctgattttctaccgcgataactgcgccgatatgggcctggttccggacgatatcgatgaagcctttattacctctgcgcgcgccgtcgcggttaccggcacccacttatcccatcctcagacccgcgaagcggtgctgaaagcgctggatattgcccgccgcaacggcctgcgcacggcgctggatatcgattaccgtccggtgttgtggggactgacctctctgggcgacggtgaaacacgtttcattgagtcgtcacaggtcacgcagcagttacaggaagtggtgcactatttcgatttgatcgtcggcaccgaagaggagtttcatattgccggtggcagcaccgacacactgaccgcgctgaaaaacgtgcgtcaggcgagtcaggcgacgctggtctgcaaacgtggaccgctgggttgcgtggtgtttgaaggcgagatcccggatagctgggaacagactgagctgcacacgggcgtacgcgtcgaggttctcaacgtgctgggcgcgggcgatgcctttatgtctggcctgctgcgcggctggctgaatgatgagggctggactcaggcgtgccgttacgccaacgcctgcggagcgctggtggtatcacgccacggttgcgcacccgccatgccaaccaaagcggagctggatgatttcctgagtcgcgacaaagaggtgaagcgtcccgatctcgacaaccgtctgaaccatctgcaccgcgtgactacccgcaagcagcagtggccggagctgaatgtcttcgcctttgaccaccgcaaacaactggcggatatggcgcaggaagcgggcgtggacgagagccgcattccggaactgaaactgctgctgctggaagccgctcagcaggctgccagagaagcaggattagagaataaaagcgggattctggcggatacgacctacggtcagaaggcgctgaacgccatcaccggtaagaactggtggattggccgcccgattgagctgccgagctcgcggccgctgcgcctggaacatggcaacatcggctcgcagctgatcgactggcctgccgaacacgtggtgaaatgtctggtcttctatcatccacatgatagtgctgaactgcgtaaagagcaggatgagctggtgctcgacgtctggaaacggctgtaacaaaagcggtcatgagctgctgctggaagtgattctgcctgacaacaacccggataagaatgaaacgtattactttgatatgttgagccatttctacagtctgggcatccagcctgactggtggaaactgccaccgctgtcggcggaaagctggcaggcgatcagcggtctgattgagcagcaggatccccactgtcgcggcattctgttactcggtctggatgcgcccgaagagaagcttaaagcgggcttcgccgcggcggccaaagcaccctgggtgaaaggttttgcggtaggccgcacgatctttggtcagccttcccgccagtggttacagggggagctggacgatcaggcgttgattgacacggttaaaggcaactatctgcgactgattgagtactggcgcgctgcccgcgcctgatttgctgctctgtcaaaaagccgcttttagaccgtgcagccacagggaacacggtcagatcggaaagacgcaaaagctgccatccatggcatgctcggcccgcaccatccttggtgcgggacgctttcctcttctgaccgtgttccctgctcgtttagctaatgtgttgctgccagacccgatttttcagcaatctgcagccattccaatctgaatggtgaaagactgcatacttccatccctgctggcatttcatcccggctttcatcctgacattgcccgcgaaaagtcacgcatcgggcgctaaagctaatctgtgaaccatttcataaagccatgaaataaaccgcgtcgttgacgcaaagaaatgaaattttccatccatctgatactatagcgctcattatgcagccattattctaattatacgggcagaagtgatgaacaataatcccacccaactttctctcttgcaggacgatattcgtcgccgctacgaaacgctgagcaagcgtcttaaacaggttgcgcgctacatccttgataacagtaacagtattgctttcgataccgtcgcctcgattgctcaacaggccgatgtaccaccgtcgacgctaatccgctttgcgaacgcttttggcttcagcggcttcaacgaaatgaaacaggtttttcgtcagcatctgatggaggagacggtcaactataccgagcgcgctcgcctgtttcgccagacctccacggacgacagcgccagtgcgcctgaaagtccggcggaaatcctcaacgtctttaccatggttaacagccaggcgctgcagcagctggcgatgcaggttaatcctgagcagctgaacaaagcggtgaaactgctgaatgaggctgagaatatctatgttatcggcctgcggcgctctttcagcgtcgcctcctacctggtctacgcgctgcgtcatcttgagcgccgcgctttcctgattgatggcctgggcgggatgtttaccgagcagctcagcctggtcaacccgaaagatgtggtgattgcgatcagctactcgccttatgcacgtgaagcggtcgaggtggttgaaatgggtgccaaacgcggtgcgcatcagattgccattaccgacagtcaggtcagtccgctggccgccttcagcgatgtctgctttgtggtacgtgaagcgcaggtcgatggcttccgtttcgcaggtcgcttcactctgcctggcacagacgctggcggtttcgctggcactgaacaacgcaaagaccagctgagttccacacacaaaaaagggcagcgcgacaggctgccctttttactgatatgaacgcgggttataaaccgtgattgctgtttatttttctgcgatgacttacgctttccgcggatagctgtcgctgttcacccaggcgtgatctttctcccaggtaaatttccacagccgcaccggccccgccatcacgttcagatagtagttattgtatcccgccagcgtcgctaccggatgatagccgcgcggtaccatcaccacgtcgcgattatagggtgccatacagacatccagggaacggtcgtcggtgtagacgcgctgcatggcaaagccaggttccggatcgaaacggtgatagtaggtctcttccaggtaggtttcgttttcactctcctcctggtcgtgcttgtggctgggataagagctggtatcgccctcgttggtatagacttccaccaccagcaggctatcagccggttcattgtcaggcaggatattgtgaaccaggcgctggttgcgcccttttccgcgatgctcaacgccgacatcggctggtgcaatcaggcgcgcaggcagattcccctgaccgggcgcattacagaccgccagctcaagatcgctgtcagcgtaaacctctacttcatcatcatgcggcacataaacagaataaggcggtacgcgctcaaaaggcgacatgcgctgaccgataccgggaaaatcagcatggcgggtttttaccgaggccagcccggccaccagcaccagacacagctctttatcaccactgctaagacgcagggtttcccctttcttcagcaaataggcatcaaatcccacataacgccagccggcacgctcaggcgtcacatgctgaatacgaccctgcgcgtcaggggcttgtgctttcgacagtaaagacatcctgatactcctctctgtcacgattgacgctgcggtgggctcgcgggcgcggtgccagcgaacaaagcgaccggcagattatcctgccggtcgcgcaccgggatcagcgttgaaatgaatcagcctaaggttggcatactgaattcagacacggtctgctgaccggatggccagcgtacggtggccgttttcatgcgggtatagaaacgcacgccatccggcccatgaacattgagcgcgccaaacactgaacgcttccagccgccgaagctgtggaatgccatcggcaccggaaccggcacgttgacaccgaccatacccgcttcaacgttctgcacaaactcacgtgcggtgtgaccgttgctggtgaaaatcgcgctgccgttgccgaattcatggctgttaaccagttgcagcgcactgtcgtagtccggcgcgcgcatgatgctcagcaccggcccaaaaatctcttcacgccagatcaccatctcagaggtgacatgatcaaacagcgtgccgccgacgtagtaaccttcggcgtgacctgcaacctgcacgttacgaccatcgaccaccagcttcgcgccttcctgctcgcctttgtcgatgtagcccagcactttcttctggtgcgccgccgaaacgaccggtcccatctcattttcatcagcgccctgattaatgccagggccgatacgcagcgcgttcaccagcggagtcagacgggcgatcagcttgtcggcagtatcatcgcccacggcgaccacaaccggcagcgccatgcatcgttcaccagcagagccaaacgcaccacccatgatggcgttgacggtggcatccagatcggcatccggcataacgatagcgtggtttttcgccgcgccaaacgcctgtacccgcttgccgtgggcgctggcggttttatagatatgctcagccacgccagaagaaccgacgaagctcaccgcggcaatacgcggatctttatagagctgctcagcatcttcattggaactgtgcacgacgttaaatacgccatcgggcaggcccgcttcggtcagcagttcagccatacgcactgcagcagaaggatccagcgccgggggcttcagcacaaaggtgttaccgcaggccagggctatcgggaacatccacagcggcaccatcgccgggaagttaaacggtgtaatgcccgccacgacgccgaccggttgcatcagcgagtagctgtcaacgccgctgccgacgttcggggaatattcgcctttgagcagatgggggatcccgcaggcaaactcaatcacttcgatgccacgcgtcagttcacccagcgcatcagaccagactttgccgtgctcagagacaatcagcgccgccagctcatcacggtgctgctccatcagggctttaaagttgaacagaacgcgggcgcgacgcagcggcgaggttttcgaccaggcggcaaaagcgtcatgcgcgacaccaatcgcctgggccacttcatcagcggtactttgcgtcagttcacgtaccactttgccggttgccggatcgtaaacaggaatggtttcgttgctggcgctgaaagtggttttaccgccaataaagttacctatgattgtcatgatgttgcctctttagatggttaagttccctgcagacggaccatgcgacctgccacactgcctgaccaggcaaacctgaaagcgtgctatgaagctattacagtggaacaaatttttcaaatggttctttttggaaaatttgattttagcggcacagatcgcatttttcccgccacttagtctctcgcggcatcacgatgacgggaggccactaatagcggccagccttagcgtagcagggtaatagccggggagtggtttgggcgttttactgcgaagttgatccagcctttatgcatcgggctgaaacggaatatgaaattaatgcgaggctgatctaataatttgtgtttcattattcactattaatgaaataaatgttctctttggtcgcatcatcctcctgtcccggagtcagtgcatggccatcgatccaacccgtttctgtatcaaccgcaaaattgcgccccggctctcgctggaggcattttttcagctggttcagcgtctggggctgagcaaggttgaactgcgtaatgacatgccgggcggcagcgtcactgacgatctcagcaccgatcagctgcgcgctctgaccgacaggtatcatattgatatcatcaccattaatgcgctctatccgtttaaccgcattgatgacacgctactggcccgggccgaagcactgttacagacagcacaacagattggtgcaaaggcgctggtcatgtgtccgctgaatgaggggatagccgtgtcgcctcagcaaacccaggcggcgatgcagcagctggccccgcgctttgcccactatggcattcagggtctggtggagccgctgggttttccggtcagctcgctgcgttcggcggtacaaacgcagcaattgatcgccgcggcggacgtgccctttaagttattgctggatacctttcaccatcatctctatgagcaggctgagcaggagttcccagcaggcattgatgttaaccagattggtctggtgcacctttcgggcgtggaagatcgccgtccgaccgccgaactgaccgatgaagaacgcatcatgctaagtgataacgatgtactgaagagcgtggtgcaggtgaagcggctggagatgcttggctataagggcgtttatgcctttgagcctttctccagtcagctcagcaactggacccctgcggaggttgaacgccagatccgcaacagtattgaactgctgcaagcctgaatcctgttctgcgctttgcgcgcaccattaatcggtttatctgtgtctgaaaagacgttctggcccgctgctgggccattttttttatcctgaagaatcgtctgctgccggcaacaccgcctgacgccgctgcatgcgcagcgtgcagaaaaaagcgacgcagaccagcagcgccgtgagcaggtagacgcgtgagacacccgcataagtcatgatgaatccggcaagtggcccggttatccccagcgacagatccataaaggcggtgtaggtcgccagcgcgctgccctgattctgctgcggcaccacttttaccgccaccacgcccagcgccgggaataccagcgagaacccggcaccggtcagaaatgcgcctgcttttgccatccagggatcacccgctgcggccaccagaaacagtccggcggcttcaaccgccaggcagatgctggcgacccgcagaccgccgtggcggttaatcgcattcgggaacagcaggcgcgcgccgacgaaagcgccgctgaacagggagagcgcaaaggcggccccttcccagcctttatcctgatagaacagggtaataaaggtggcgatgacaccgaaacccgccgaacccatcgccagaatcgcaccaaaaccggcgattttccccagcaccgcacgaaacggcaggggtctggcccggctggcttttacggccggacgcggcaccgcgcagacgatgcctaccacgcagatagcaacaatgaccagcgacagccacagcaggccacccgcccggaatatcaccacgccgagcggcgcaccaatcgccatcgcgccataagtgacaatgccgttccaggagataacccggccaatgtgcagcgaacccacccgcgccacaccccacaacgaggtgccggtgccggtaaaactctggcccacgcccagaatcaagcggcccacgcagagcagcgtcaggcttaacagcggtgattcgatgagcgcagccagcaaaatacacaacccgctgatcagacagcccaccagtccggtcaccaccactttctttggcccccagagatcggcgtagcgtccggcgtgtgggcggctcagcagcgtcgccacatattgcaggctgattaccaggcccgcccagaatgcgctgaagcccaactggtcatgcacccatcctggcaataccgccagcggcagaccgatagtgagatagctggcaaagttgtaggccacgatagagaggatcagcagagagatgttcaggtttccggatggggtgttcggttccgcggcaggctgttcaggcatgagtcctcgcgctcgtatttggctgaatgataaggtttatcctttaactatacccgctttcgccactggcgcctcttaatgacacggctatcgggcggctgcccctgcccggacgtgcagcagaaagccgggtaaaaaccggcacaatggggacttgctgctctgccgcgatagctgagtgctgtggcgctgattacatcacccacctgccaccgcgctttaccgtttctctgataaatcagattgttaattttgtttcagctacactttcaacagccaaattacgttatgagagagagaatgagcgagctgcaacgggaaaagatcggacaaaatattctgataaaactggcgatgctggtcattatcctcgccggggttcgggcagcgtccgatattctggttccgctgctgctggcggcgttctttgccattgtgctgaatccactggtgacaatgctgatgcggcgtggcttccgccgtggactggcgattgggctggtgatcacggtgatcttctgcgctctcgtgctgctgggtgccattattgccagctcaatgagcgagttttccgatctctatccgcaactgcgcgccaccatggagcagaaaatgacggtactgcaacatctggcggcgggctttcatcttaatatttcaaccgatgcgctggtacagcgtttcgatcctaataccatgatgaacctggctaccgtggcgctgagcggcttttccggcgcgatgaccaataccgtgctgctggtgctgaccgtggtctttatgctgtttgaggtccatcacctgccctataaaatgcgcaacgcgctggtgaatccgaaaattcgcatcgccggattgcataaagcgctgaaaggcgtcacgcactatctggcgctgaaaaccctggtgagtctgataaccggcatcgcggtctggctgagtctctatctgctggatgtgaagtttgcgctgttatggggtgtcgtggcgtttatcctcaactttattcccaatatcggcccgattatcgccggtatcccgcccttcctgcaggcgttgttactgaacagcctgtttgatgccgcgatggtggcggcgctgtttaccgcgattcatatggtgtttggcaatatgctggagccgcgcctgatgggccgcggtcttggcttatcgacactggtagtgtttctgtcgctggtgttctggggctggctgctcggtccggtcggcatgctgctctcggtgccgctcaccagcattactaaaattctgatggaaaccacgccaggcggcagccgtctggcgattatgctgggcaccggacgacccaagcgggcgcgggcattaaccaagtagccgctgctgcacgtgctggagatggctctccatcgcctgacgggctgctgcttcatcgcccgccacaatcgcattggcgatctgctgatggtcagcgttcatctcctgcgcgaagctgttatcggcataatggcgctccagtcgctgcacatgcgggctgtggcgccggttccataactgctccagcaggtcgcgtaatacatcattgccgctcatctcactgatcagcagatggaagcgcttgtcctgctccagaaaggccgcgtcgttttcattgtactgctgcagttcagcggtcagcgccagcaatgctgcccgctgaacggtagtgccgttacgtgcggcaaatcctgccagcatcccttcaaaggcttcacgtgcctgcaacagatcctgcagactgcaggtttcgctctcctgcggaaccgcggcttgcggcagcggctgggcaacgtaaacgccgttgccagtgcggatatcgacccagccggtcatctccagcgcaatcaatgcttcacgcactgatgaacgactgacacccagctgttttgccagctcacgctccggtggcagtaaaccacctgccacaaagtcaccgcgcgtgataccggccatgatgacgttggcgatctgacggtacaggcgctcggtttttattactggcagcgtcatcaccctctcctctgattgcacgtaaaagcgatctcttcaccgatgcagtttgtcatgctgcgatccggatcacggccctgttttttccactatcatactcttggtccagcggcctgaccactgggccacatcacagttgaggagtaaaaatggaacatacatggcgatggtacggccccaacgacccggtctcactggatgacgcgcgtcaggcgggcgcgaccggcattgtgacggcgctgcaccatatccctaacggcgaggtgtggccggttgaggagattaaagcgcgtcaggcactgctggcggaaaaaggtctggtctggtcggtggtggagagcatcccggtccatgaggcgattaaaacccagcgtggtgactaccttcgctatatcgccaattatcagcagtcgatacgcaatctggccgcctgcggcattgataccgtctgctacaacttcatgccggtgctggactggacccgaaccgacctcgcctggacgctgccggatggcgcaaaagcgctgcgcttcgacgccgacgctttcgcggccttcgagctttatctgttgcagcgtccgggagcggaacaggattacagcccagccgagcagcaggccgccgctcagcgctttgccgccatgagcgcagaagagaaaagcaccctggtgcgcaatattatcgccggtctgcctggcgccgaagagggttacaccctggagcagtttcaggcgcagctgacgcagtatgacggcatcgacaaagcgaaactgcgcgagcatatggcgaccttcctgcgcgccattgtgccggttgcggaggaaacgggcgttaaactggcggtgcatccggatgacccaccacgtcctattctgggcctgccacgcattatttctacccaggaagatatgcagtggctgaaagaaaccgtggacagtctgcacaacggtttctgtttctgtaccggctcctatggcgtgcgtgccgacaatgcgttggtagagatggcggaaacctatgccgaccgcattaactttatccatctgcgcgccacaaaacgcgaggcaaacccggccagcttccatgaagcggcgcatctggcgggcgacgtcgatatggtcggcgtgatcaaggttattctggcggaagagcagcgccgccgtcgggcgggcaacctgcgggcgattcccatgcgtcccgatcacggccatcagatgctggacgacctgcataagcgcaccaatcccggttattccgccattggccgcctgaaaggccttgccgaaactgcgcggcgttgaagtagcgctgaaacagatctattttgccgattaaataaaacgtcctgccctgcgcccgccccaggacgggccagggtctctcctggccgctgcggcggatcggccttttgccctgcctgcctcccgttttcacctgattgttttgctgcatcgcaacgaaaaccaaacaatctgtcaaaaaatgcaatgtctggtcgataattgaccttagtcagttctcctgatcgcaaaaacgctaatctgcaccgcccggagagatgctatgctgcgccactgatcagcacctccgcataacaccaataatactcagaggattcagcggtgccgctactgaaacgaaaacgcgactacgccaggctggtgattattatttccggcgtgctgcctctgattattggcatttttttcaccgctctggatgcgcgccacaccgtgcatcagcagcaggtcaccgcggcgaatacgctgttatctcaggctgagagaatgagcgacagcgcctgggatatgattaccgtgctgcgccagtttcatcatcagccctgcagccagattgaaaaccagttgcagcgcattggctcgctcaacccctattttcgtgcgatcggtaaaatggagcaggatcacatcgcctgctcgtcggtgtatggttcacgcccaggcctgctgaaagagatgatcatgcgcgacgcgccggttgccggaaaagcctggtggagtctgtccattgccgggacatcgggcgtaccgaatcgtccggccgtgatttttatgcgcgatttgcccgatggcgagggattctgggcagtgattgatggccagtatctgatcgattttatgcgcgcgatcagcagcagccatctctatcatttcagcatgacgttcagcggcggcgcgccgatctcgtttggcgatccgcacatcgccgcgtccagctggtttgaacccatgatttatcaggctatctcccatcgctatccgctctctgtcaccctcattgcctcaccctctgaactgatctcggcctggcgtcaggtgatgtttatcatcatgccgatggccgctatcttctctattctgctgatgatgctgatggcgaactggctgaaacggcgtatttcatggcgcgatgagattcgccgggccatcaccagcggccagttcagggcgcactatcagccggtctacgacaaccggctgcaacgctgcagcggcgctgaagccctgctgcgctggacaacgcccgacggtaaaggcgtgcggccagatatttttatcggcgcagcagaagcggaaggcatgattgtgccgctgacccgccatctgctcgatttaattgcagaggatgtgcaggcatggcaggttgagccccatttccacctggccattaacgtggcggcggatcatctgcagcatcctgactttgtcgacgatatgctgcagtttgccgaacggatcaaagataagcagttcctgattaccctggagctgaccgaaacgcagcctgatcaaagatggcgctgaggtggctcgcaagctggagcagttacgtggttgcggaatgaaggtcgcgattgatgattttgggaccggtcactgttcgctgagctatttacagaccttcacgatagattatctgaaaatcgatcgcggctttatcaacgcgattgaatccctggaaggcagaacgccggtgctggacgccattatccagctcagccatgagcttgagctggaagtgctgggagaaggcgttgagaccgcgttacagttcagctatctgcaacggcgcggcgtggtctttatccagggctattattatgcccgcccgatggacaacacggcgctggttgcctggctgaccgatcggggcgaacagccgattgaacgggagctggctcttcaggcccggcaggaacccgacgtctgaaccagagcagatggcagctgaaccgccagtcgtgccacattcactcatctttctgctctccgccctgtgatgcaaagggatagccgcttccggtgccagcatggcccgtatcttcccttctttgcccctgattcgctgaaaaaaacggcggtcgtcacgctcagtgataatttttttgcggttgcaaacagctctatttgttgtaaaaacaggccggatgtagcccaaacatgacagatatcacacaaaaacggtatactctgtcgctgttcgcaataatcacaacagtaattattgtgtctgccggcgcataaacagtgcttatttacggctatgcttaaatttctcaacgcagcggtctgaacgactcacacccggctcgcgccgttgaggactttcgtgttccaatacagggtaattctatgaaattgcgtaggaagcgtgtaaaaccaattgggatcgatgatgtgactatcatcgatgatacccgtttacgtaaagccatcaccgcggcctctctgggcaacgcgatggagtggttcgacttcggtgtttatggctttgtggcctatgcgctgggtaaggtctttttcccggacgtttcaccgggcgttcagatgatagcggcgctcgccactttctctgttcctttcctgattcgcccgctgggtggactgttcttcggtatgctgggcgacaaatatggtcgtcagaaaatcctctccatcaccatcatcatcatgtcggtcagtactttctgtatcggcctgataccgtcctacgcctccatcggcatctgggcacctattctgctgctgttagcgaagatggctcagggcttctcggtgggcggtgaatataccggtgcctcaatctttgtggccgaatattcgcctgaccgtaaacgcggctttatgggaagctggctcgactttggttcgattgcgggcttcgtgctcggtgcgggcctggtggtgctgatttcctccattatcggagaagagagtttccttgagtggggctggcgtctgccgtttcttcgtcgcgctgccgctgggaattatcggtctttacctgcgtcatgcgctggaagagaccccggcattccagcagcacgtggacaaactggaacagggcgaccgcgaaggcctgcaggatggtccacaggtatcgtttaaagagattgcgaccaaacactggcgcagcctgctctcctgtgtcggtctggttatcgccactaacgtcacctactacatgttgctgacgtacatgccgagctacctgtcacataacctgcactacagcgaagaccacggtgtgatgattatcatcgccatcatgatcggtatgctgtttgtccagccaatgatcggcatgatgagtgaccgtttcggccgtcgtccgtttgtcatcatcggcagtatcgccctgatgatcttcgcgattcccgcctttatgatgatcaacagtggcgtactcggactgatttttggtggtctgctgctgctggcagtgatcctcaacgcctttactggcgtgatggcctcttcactgcctgcgatgttcccgacgcacatccgctacagtgcgctggcgagtgcgtttaacatctcggtactggttgccggtctgacgccaacgctggctgcctggctggtagaaacgaccaataacctctacatgccagcctactatctgatggtggtggcagtgattggtctgattaccggtctgtacatgaaagaaactgccaataagcccctgaaaggcgcgacaccggcggcttctgatatggaagaagcgcgcgaaatcctgcaggaacatcacgataacatcgagcacaaaatcgaagatatcgacgaagagatctcccgcctggaagcgaaacgtaaaaacctggtgcagcagcatccggatatcaacgagtaatcgttctgctctcccgccgcccggcgggagagttcttttcccctctcctgaccgcacacaaaccttcatccctcgcgggcaaagggagtaaactgttgtcacttttttcacctgcgtaagaatgaaaatgtctgattattcccttatccagcgcccaagaagattgcgcgccagcgcctcaatgcgtgaaatgttccaggagtcctcactgagcctgaacgatctggctctgcccatctttgttgaagaagaagtcgacgattacaaagcgattcaggcgatgcctggcgtgatgcgtattccggaaaaacgtctcgcctatgaaattgagcgcatcgccaaagcgggtatccgctcggtgatgaccttcggtatttcgcaccacaccgatgccaccggcagcgatgcctggaacgagaaacggtctggtggcacgtatgtcccgcatctgcaaagataccgtgccagaaatgatcgtgatgtctgacacctgcttctgtgaatacaccagccacggccactgtggcgtgttgtgtgatcacggcgtcgataacgatgctaccctggaaaacctgggtaagcaggccgtcgttgccgcagcagccggtgcggatttcatcgccccgtcagcggcgatggatggtcaggttgaggcgattcgccgggcactggacgccgcgggcttcactcagaccgccatcatgtcctactccaccaaattcgcctcctcgttttacggcccgttccgtgaagcggccggaacggcgctgaaaggcgaccgtaaaacctaccagatgaacccgatgaaccgccgtgaagcgatccgtgaatcgctgctcgacgcggcgcagggcgcggattcactgatggtgaaaccggcaggtgcttatctggatatcctgcgcgatatccgtgaacgtaccgaattgccgctggcggcttatcaggtgagtggtgaatacgcgatgatcaaatttgccgctcaggccggtgccattgatgaacgcaatgtggtgctggaaagcctgggtgcgattaaacgcgccggtgcagacctgattttcagctatttcgcccttgatctcgccgaacaaaaagtgctctgatcccctccttataaagagcgtgatggctatgtcacgctcttcttcttcgccgtaaggcaaacaccagaacctggcttgagctaaaaaaataaagggctctgtgatgaaagcacctcaaatcgctgccgacgaggcacaacgtttatcgcagttgcgtgcgctgaacataatgaacaccccagcggaagaacgatttgatcgtttaacccgtctggcgcgccgcctgtatgacgttcctatcgcgttagtcagcctgctggaagctgaccatcagtggtttaaatccgctcagggctatgaacccgcaggatcgccccgcgacatctccttttgcggtcatgccatcctacaggatgagatcatgatcgttgaagatgccacagaagatgaacgtttttatgataatccgctggttaccggcgaaccgcacatccgcttttatgccggctgtccgctgcgggcaccgggcggcgctaaaatgggtaccctctgtatcattggtcgtgaaccgcgtcagtttaatgaagaggatcaggccacgatgcgcgacctggccgccatggccgaagcggaaactggtcgcctttcagactgccacctgtgatgaactgacgcagatcaccaatcgtcgcggctttatgacgctgggacagatggtgctgaacgagtgccggctgaaaaaccggcccgcctgcctgacctttctcgatctcgacaaatttaagcagattaatgactcgctgggccaccgcgaaggcgaccgcgcgctgatggactttgccgatgcgatgaaagtggtgtttaagcattcggatctgtttgcccgtctgggcggcgatgagtttgtggtgctgtttaatggtctgcagcagcagcagagcgaagcgctgctcctgcagtttgaccgttatctgcaacagcaatcagtcagtctgaaccgccgttaccgcctgcaattctcgtccggcgtcgtggagtttgacgcggcgcatccgcaatcgctggagcagttgctgcacgacagcgatgagcagatgtacctcagtaaaaagcagaaacgcgtggcgatctaaggtcaggcgccgcagcgcctgacggttcagggacgcgccagatcgtcgagcagcgtctggttaaattttgccggctcttccatttgcggcgcgtgtcccataccggggaattcgattaagcgcgcccccggaatgcgttttgcgacctctttccccagtaccgcgtaatcacccagccgggctttcacctctgccggggcgatatcactgccgatggcagtcgtgtctgaggtgccgatcatcagagtggtgggcactttcagatcgccgaattcataaaatacgggctgagtgaagatcatgtcgtagattaaggcggagttccacgccaccttctggtggcccggcccgctgttgagtccggccagcatatcaacccacttgtcatattcgggtttccagcgaccgacatagtaggtctgctgctcatacttcttaatgccctctgcgctgagtttgagttcgcgctgataccactgatctacggatcgccacggtgcgcctttggctttccagtcctccagcccgatcgggttaaccagcaccagcttctgcgtctgttccgggtacatcagcgcataacgtgttgccagcattccgccagtggagtgacccataatcaccgccttcttcacacccagccgggtgagcaactggtgggtgttatctgccagctgctgaaaactatactggtaactggctggcttggtcgagctgcagaagccaatctggtcgggcgcgataacgcgatatccctgctgactgagtgcgcgaatggtctcttcccaggtcgcaccacagaagtttttaccgtgcatcagcaccacggtttcgccgttggcccgttgcgccggtttcacatccatatagcccatgctcagcgattgctgctgggatttaaaatcaaaatgctgcaacggataggggtattgaaatccttccagctgttcgccatacacaccagcggcactggcaggtgcatgagcaaataacgccagcgaggtgagcaaggcggcaagcggttttttcagcgcgtatgtcgggctcatccggggggttttctccaggttaaaggtgagccgtaagcctggcatgtcgcagccaaaaatctattgatgtgccgtgctatagccgtgattacagagattccggcaaggtaaaccgtgagtctggctgcggactcacggctcgttttgattaacgtcccgcggaatcacttattcattcacctacaattaccaacagattaatcacaattcatcttttttattaataacaccccctcaaatgaatatcttcagagataacgattaaaatcctgaaaaatctttacgcaaagaataagcacattaagataaatattttagaatcttcttaaatcaaacagggggttctatgaacgaaaataaatataatgaaagcgtgatcgtctctatcacggagtggattaataataatctggatcagcgtttaagcgttgatgatattgcagaaaaagcgggttactctaagtggtatttacagaaactttttgcccgttatcataatgaaaccctggcgcgatatattcgtaagaaaaagcttaacgccagtgttcatgatttaaaaaacagccgcacgcccatcatcagcctggcgctgaaataccattttgaaagccagcaatcctttacccgatcttttaagcagattatgggttgcacaccgagcgtctgccgtaaacgtctgatgaaggacgaggcaaagcagcagctggccgacgttgatgatccctgtgcgctgtgcagttacggtcgggcggaaagcataaagcagagctgtggcgtaacagtccggcctgttacgcgctcagcgcgcggatatgcgccggcagacgctttccacgatataggttaatcaggattcatccggctgataatattgcacaccaatcttaatacgctcacgtccctgggtgacgcgatgacgattagtgtcgcgcagtgaatagacacagccacaatattcctgctgatagaaactctcgcgcttgctgatttcaatcatgcgcgacgacccgccgcctttacgccagttaaaatcccagtacatcagatccggatacgccgccgctgcgcggactccgcagctgttaatctgcttcatatctttccagcgcgaaatacccaggcaactggtcatcaccggaaagccgttctcatgggcatagagtgccgtacgttcaaagcgcatatcaaagcacatggtgcagcgttcaccccgttccggtgaccactccaggccgcgcgcccgctcaaaccagttatcccggtcatagtccgcatcaataaacggcacaccaaatttttcggcaaagcgaatattctcctctttacgcagctcatactctttgagcggatgaatattcgggttgtagaaatagatcgtgtattcaatgccggatgccagcatcgcttccatcacctcacccgagcagggtgcgcaacaggagtgcagcaggacttttttatgaccgcccggcagaggcagcggctgacgctggaaaggttcagacataagcaccttcaatcaatagcagtaaagcggcagtgtaatgccgcaggcgggcagttgcaaaacctgacccgacgcgccctgttttgcgtaatcgtgccccggccgcggtttccctctcctgaaccaacccgctgatctctgatgctttcttatcgcggcaatgctgtgtggcaccggtgatagccggaagtgtgatcgcccccacactggcatcgactatgtttacataacattaacaatattgacacagaaaccccgcaaggagactcgcatggtcgcggcaaaaaaatcgggaaatcaacagaaccgctttacctggttcgtctgttttatggctgcgctgtccggcctgctgtttggtctggatatcggcgtcattgcaggtgccttgccgtttctggcgaaggatttgcagatcactaaccatcagcaggagtgggtagtgagttcgatgatgtttggcgcggcgctgggcgcactggcggcgggctggatgtcatcaaagctgggacgcaagaaaagtatgctggcgggcgcgacgctgtttgtcattggctcgctgtggtcagccttctcaccggatgtggagtcgctggtctgtgcccgcgtgatgctgggtctggcggtgggaatcgcctcttacactgcgccactctatctggcggagattgcgcctgaacgcattcgtggctcaatgatttcgatgtaccagttgatgctgaccaccggcattgtcgtggcctatctctccgacaccgcgttcagctacagcggtaactggcgcgggatgctcggcgtgatcgccattccggcggtgatcctgtttatcggcgtgctgtttctgcccaacagtccgcgctggctggcggcgcacggacgctttaacgaggcgcagcgggtgctggatcggctgcgtaacagcagcgaacaggcccgggaggaactggaagagatccgggaaagcctgcaggtgaagcagcgcggctggtcgctgttccgttctaatggcaatttccgccgcgcggtgtggctgggtatgctgctacaggttatgcagcagtttaccggcatgaatgtggtgatgtattacgcacctaaaatcttcaacatcgccggcttctccagcaccagcgagcagatgtggggcacagtgattgtcgggctggttaatatgctggccacgctgattgcgatcttctttgtcgatcgctggggtcgcaagccgatgctcaccaccagttttctggtgatggcggttggcatgggcgtgctgggaaacgctattgcacatcggcgttgaaacagatttccgcaaatactttgctgtcgcgatgctgctgatgtttatcgtcggctttgcgatggcggccggaccggtgatctggctgctctgttcagagattcagccactgaaagggcgtgatttcggcattaccgcctccaccaccactaactgggtcggcaatatgattgttggcgccaccttcctgaccatgctggatcaactgggtaatgccaacaccttctggttctacggcgcgctcaacctggtgtttatcgtgctgacgctgatgctggtaccggagaccaaacatgtgacgctggagcacattgaacgcaatctgatgaagggtaaagcgctgcgtgacatcggggcgtaaccgccccgcttcaggctaccactgcatttgctggccggcgtaatcgacgtagtgatgaccaccgcgaccgcgccactggatcagctgctggacgataccggcggcactctcttctgccgtcaggggcgcactctcgccgcccatatccgttttcacccagccgggatgcagcgtcagcagcgtcccgctctgcgcttccactgccggagtcagcgtgcggctcagcatattcagtgcggctttgcttgccgagtaaatcggcatctgcgcctccggattttcattcaggctgccgagctgggatgaggtcagcgccagcacgccatcctgtttcagcagcggcaacaggatctctgcgctgcgaaccggggctatcgcattggtcaggaacagctgcgccagcgcctgatcgtcactctgcgacaccttctggtgcgcaggcccggaaatcccggcgttaatcagaatcgcatcgaacgacttgccactgagctggctggcaaactgttgaaccgctgatgagtgggtcatatccagcgaatgccagtgaatgtctggccggttaccctgctccgggatgccactgcgatgcgtggccgtgacctgccagccctcatcggcaaaggcctgcgccaccgccagaccgataccgcgtgaagcaccaataatcagaacctctttttgctgagccatattcattcctcgttgattgtctcgtcacaagcttaacggtaaatctgcccaggcagcggccagttgtgctttttagccagacgaccgcactgcaggtaaaaccccacggcgtagcgctgttgatggttttccatcattaaatcgctttatcttttacttttaaccggttagaagagataaacagtctggcaggcagcagtcaatttgccattttcgcatggagtctgaatgaaaaagctcaccttagaggtggtggcaaaaatggcaggcgtcgggattgcgacggtcgatcgggtgctgaatgagcgcggcggcgtctccctggagaccagccgtaaagtcctgaaagccgcacgcgaagtggggctgaagcgtctgctgccagaggagtaccagcatccgtggcagattgaggtgttcctcagcaataacggctcatccttttttcaacagctcaccacccatttcagcgaggtcgccagtcagcttggctatcgccgcctgaaactacacaaaaccctggtggccgaagcgcagcctgagcagctggcgcaaagcattatcgcccgcagcagcacccgcgacggcatcattgtttttgcgcatgactcgccgcccatctatcgggcactggcgctgtgccgcagccgcaatgtgccggtgatcaccatcgtcaccgatctgcccgatgccgaccgcttgtgtcatgttggtatcgaccagtatcaggcgggacgcacagccggactgctgatgagtaagacagtgaatcagcccggcgacattatgatggtcagtggccgttttgattaccgcgcccatcgtcagcgcatcgcgggatttcgtgaggccatggagcagcgcgcgccgcagcgtcatctgcgtgaagtgctgtcgggtcaggatcagcgggaaaccattcgcagtgaactggctcgccatctgcgtccgtcgcaggcgattgcaggggtctataacaccgggatggggaatagtgatgtcagcgacaccctgcgcgcccaccagttgctgggtaaatgtacctacatcacccatgagctttatgatgtcacccgccagctactgctgaacgatgaagtggcctttaccctggatcagcatgctcagcagcatgcccgtttagcgattgatctgatgctgagtcatctcgaaaccggctatcagccggatgtctatcaggcgggcaaagtggcctttcggctgtttacggcggaaaatatggtgtgaggtggaatctgtttcccctgatgaagcgctgtcattaagggaaacagatcgagctcgattaacccgcggcatcccggcttttatcgtccgggctgtccgcatcgtcattaccctggctcttctccacttcctgcggatgtcccatcgaaagcgcagccgcactggccgggtcgaacagcgacagactctcaatctggtcaaccatgatcactttacggaacgacatcgcatctttgggtttcgagtcgagcgtgatgccatgctcggcgtaccacttgctgtagttatgttccaccgccagcttcagcgtcttgctgtcgcgatatccgctcagcatcgggatcagaacgatgtttttggtgctttcatattcaaaggtcgaggcatgaaccatgccgatgtaaatgcggcgcgacttcagcgtaatccacgccagttcgccctcttccatgcattgaaacaataattgctccacgccattggagcgtgacagtcgctgatagaggtctttacgaccagaaacgttcagtcgtgcgctgcctgcccagtttgagcgatagagacagagcagaatggcaaaggcgagcatgatcaccaccggagcctggatacccaggaagctccagttcataaactccacctgccacttcagatgaacgccggggatcatctggacggcgttggcgatgccggagatacagagcagcagtaaccagacgatgccggtcgcgaacacaccctgcaggacgaaaatacaaccgtaaagcgcgaccaggaaatagacatcccagcccgacgaacgacggattttaaagcggctgttcaaatcacggctggtgtaccagtaaccactgaccatcaacaccataaatattgcggtacccacctcacactccctttaacgtattcacgtggcgggaaaaatcttcatggacttcctcgctcagcgtgttaaccgagatattgccgttttcatcaatgatgatgcgctcaccttcagcgatagaatcgttgatatcctgacgggtcatgatctgcaaaaacttctcgggactggcaaagaccgacttaacaaatttaaacatggcgatccacttattggcctgaaaattgaagtatgtgaccgaatccacactctcgcctgtttaatttcgggtgaaatttcttaaaatcaattaattagcgaagcggtagtggcgttgcccatgccgttttccgctgaaatcttcaacgtaaccagcagtatggcgtagcagcatcgcatttttaccgtgcaggtctgcaacgacgttacatcgcctctctgcaaggaagcgctaagctcattggttagccgctttctgtcaccctgtctgaaacgcatcgaggaatgtttgcatgaaactacgaacactgggccgtaccggtcagcgcgtctccgaaattggctttggcgcatgggccattggcggaacctggggggaagtgagcatggaggatgccaaagccgcgctgaatgctgcgatggatgcgggcatcacctttattgataccgccgatgtctatggcgatggccgttccgaaaaaatcatcgcagaagtgctgaatcagcgcggcggtgaacgtccgtttgtggcaaccaagctggggcgtcgcctctcgccacatgtggctgaaggttacaatgctgaaaacctcaacgcctttattgaccgttcacgcgagaacctgcaaaccgacacgctggatttagtgcagctgcattgcccgccgaccgaggtctactacaacccggacgtctttgcggtgatggatgagatggtcgctgccggaaaaatccgtcactacggtgtctccgttgagaaagttgaagaaggtctgaaggcgctggagtttccaaacgtctcgtcaattcagctgatctacaacattttccgccagcgtccggctgaactgctgctgcgtgaagcgaaacgccgtgatgtggcgatcatcgcccgtgtaccgctggcgtcgggcctgctgaccggcaaaatgcgtgccgacagcgtgtttgccgctgacgaccaccgcacctttaatcgtaatggcgaagcgttcgataagggcgagaccttttccggcgtaccttatgaggtggcgctggaggcggttgaagagattcgccgctttgtcactggcgacaccaccatggcgatgtttgccctgcgctggatcctgatgaacgaagatgtcagcgtagtgatccctggcgcgaaaaaccgcgaacaggctgaagccaatgcccgcgccagcgatgtcggtgcgctctctgcagataccatggcggcgctgaagcagatctatcaggagaagatcgcgcctcacgtgcatcagcgctggtaagcgccttacaacgcctgggcgcaggcccaggcggaactccacgcccactggaagttatagccgcccagccagccggtgacatcagccacttcaccaataaagtaaagtcccggcactgcacgcgcctccatcgttttcgaggagagctgtgtggtatccacgccgcccagcgtcacttcagcagttcgatatccctcggtaccgtttggctgaatgcgccaggcgtgcagcgtctgcgccagctcggtttgctgtttgctgttgagctgcttcagggtgatatccggcaccaccttcagcgcctgcaatacttccaccagacgcttcggcaggattttcgccaggctgttcttcaggctgagattcgggtgtgcttcacgctgcgccgtcagaaacgcctcaagcggcgtggcaggcgacagatcgatggtgacgaattctccgggtagccagtagctggagatttgtaacaccgccgggccggagaggccgcggtgggtaaacagcatcgcctctttgaagcgtgtgccatcctgcgcatcgatagtggtctccagcgcgacgcctgacagcgtctgcaactgctccagcagcggcttgtgcagggtaaagggcaccagcgccgcccgcgtcggaaagacgctcagcccgaactgctccgctattttatagccaaacggcgtggcacccaggccaggcatcgacagaccgccgctggcgatgaccagcttctccgcctgaaccgtgctgccgttaagttgcagggtatagccgctttcatcgcgcgccacgctgagcacttcactgcgcagccgcagggtgacattgcctttgtcacattcggccagcagcagatcgacaatctgctgggcggagtcgtcgcagaagagctggcccagggttttctcatgccaggcgataccgtggcggttaaccagatcgataaaatcccactgggtataacgcgccagcgccgatttacagaaatgaggattgtgcgacagatacgccgccggttcggtgtagagattggtgaagttgcagcggccaccgccagacatcagaattttacgtcccggctttttgccgttatccagcagtaacacgcggcgtccccgctgcccggcctgggcggcgcagaacagccctgcggctccggcaccaatgatgataacgtcaaactgttccactacgactcgctcacttaactggaaaggcgcagattgtagtgatctgctcactgagacgccagcgtcaaaaaaatgccgcaaatgtgtcatattgtatctgtctaatatctaaccctttttctctgagttacccttacgccttacatcgaaaggttaaattagcgctatattttcctttcccatacagcacgttgtcgcggataatgcgccgcgttcatgtcctccaaaaatggcgtaacgtttatgctacatctgtttgctggtctagacctcagtactagcctgttattggttcttgccctgctgtttgtattgttttacgaagcgatcaacggtttccacgacacggccaacgcagttgcgacggtcatctatacgcgtgccatgcgtgcccagcttgctgtggtcatggcgggtgtatttaacttccttggcgtgctgctcggtggattgagtgtcgcttacgctattgttcatatgcttcccaccgatctgttgttaaacgttggatcggctcacggtctcgccatggtgttttctatgctgctggcggcgattatctggaacctcggcacctggtatctcggtctgccagcctccagctcccatacgctgatcggcgccattatcggtatcggtctgaccaacgccctgatgagcggaacctcggtggttgatgcgctcaacatcccgaaagtgctgaacatcttcctttctctgatcctgtcgccgattgtcggtctggtaatggcgggcggcttaatctttatactgcgtcgctactggagcaataccaaaaagcgtgcgcgtattcatatgacgcctgctgaccgtgagaagatcgacggcaagaaaaagccgccgtttctggacccgtatcgccctgattgtttcggcaattggcgtgagctactcgcacggtgcgaatgacggtcagaaagggatcggcctgatcatgctggttctgattggcgtggcacctgctggtttcgtggtgaatatgaatgcctccggttacgacatcacgcgaacccgcgatgcagtcaatcacctggagcagtattatcagcagcataacgcctcgctgacccacatcatccagatggcaccgcctaagctgcccacgccggaagaagtgccagcaaccagcccgcaggagttccactgtgacagcgcgcgcgcattacaggcggtacagggtgcgcaggtgttgctgaataacctgcagagctacgatcagctgacggttgatcagcgcggtcagatgcgtcgtctgctgctgtgtatctccgataccgccgataaagcggctcgtctgcaggaaacctcgccagatgacaaacgcttcctcaataagctgaaaagcgacctgcttggcaccatcgagtatgcgcctatctggattattgtggccgtcgcgctggcgctgggcatcggcaccatgattggctggcgtcgtgttgccaccaccattggtgagaagattggtaaaaaaggcatgacctatgcgcagggaatgtcagcacaggtgacagcagcgctgtcgattggcgtcgccagctataccggcatgcccgtctccaccacgcatatcctctcttcatcggttgccggtaccatgctggtcgacggtggcgggctgcagagccggaccatcaagaacatcgccatggcgtggatcttcaccctgccggtctgtattctgctgtcaggttcgctctactggattgccttaaaactggtgtgatgccagctaaaaaaagggcgacgcaagtcgcccttttttaatgccagatcgccagcgccaccagactaatgactaccagtccgcacagcgcactggtcagcataaactgcccacgcacccgctcgcagcgccggataaactcatcgtcgtgatgatcaagatagcgctttgcccagatataagtgaccagccgcacctgcttgctcggctggccatgagaggtgaaaaaacccgccccatcgacatactgatacagcagcggatcacaaccgcgtaagaccgccagcagagcgcgcagggatgaaaaatagcgcgccatattcacgatacacaccacgcaaagcgcccaaaaaagcgcaatagtgctgatcatattctccccctcccggctggaatcgcagcaacaggcccagcgtcagacactgagtccacctgcagaaataaccagccactgaatcaccggactgcgaaagtttttcgaccccctgagcggttgcgaatcggaccgccttttttcagtgtaggagaaatctttacattttttccaacgatgattttcgttcagcgcgagtaaatctggcatagccttgatcttattcataagccaggcggcaacggcagcatttacagtgggagaaggctatactgaggacataacaacatcatcacctgcaatgcaggtagacactttggtggcgctcatcgcccgctcgcgcaagggatttcgctaagctgtgacgcggcaggaacaccggatgccatccttaacctcgtgaaaggagttttatcatggcttataaacatatcctgattgcagtagacctttctcccgaaagccagttgctggtggataaggccgtctcgctggctcgtccgtacgatgccagaatttccctgattcacgttgatgtcaattactccgacctctacaccggcctgattgatgtcaacttaggggatatgcagaagcgtatctctgaagagacgcatgcggcgctgaaagggttgtcagatgcggcgggctacccgatcagtgagacgctgagcggcagtggcgacctcggccaggtactggttgacgcgatcagaaaatatgacgttgaccttgtagtatgtggtcatcatcaggatttctggagcaagctgatgtcctcagcccgtcagctgatcaacaccgtgcatatcgacatgctgattgtgccgctgcgcgatgaagacgaggcgtaatttcgccgtataaatgattaaagccggcgcagagccggcttttttatgctttaaagcggtgggtaaatatcaaagcgatggcttttggtcaccacggccgcctgcgtcacaatacccgccagcggcggggcgtagtctggccgtttaaccacgatgcgtttcttcgccagccggcgagcgggttccagtaatgcgtcagcatcttcatccggccccaccagcgactgaaacacccgcatctcctttttcaccagcgcacttttctggcgatggggatacatcggatcgagatagaccacatccggcggcggcgtgatatcccccagcgcctgcgcgctggccgcatgaatcagcgtcagccgatcgcgcagccaggggccaatttccgcatcctgatacccgcgctgcaatccatcttccagcagcgcagcgacaacaggatgacgctccagcattcgcacccggcaacccagcgccgccagtacaaacgcatcacgtcccagcccggcggtggcatcgaccacatccggcagataaccacctttgatgccgaccgctttggcgacggcttcgccgcgtccaccgccgaagcgacggcgatgggccatcgcgccagtgacgaaatcaacaaaaatgccgcccagctttggctcatcacgcttgcgcaattcaaggtgcgtcggggtctgcactagcgccagcagtgcctcttcatcgtgctccagctgccagcgctgcgctaaacgtgataaggcgccgtcttcggcgcctgattcatcgagcaaacagattttcacgaaccgacttatccctgaatgccgtaatgttccagcatcgcatcgagcttcggttcacggccacggaagcgtttgaacagctccatcggctcttcagaaccgccacgcgtcaggatgttatccaggaatgactgaccggtttcacggttgaagatgccctcttcctcgaagcgggagtaagcatccgccgccagcacgtctgcccacagatagctgtagtaacccgccgcatagccacccgcaaagatgtggctgaaggcgtgcgggaaacggccccattccggacccggaaccactgccacgcggcttttcacttcgcgcagggtttccagaatctgtgcgcctttctccggattaaactcggtatgcagacggaaatcgaacaggccgaactccagctgacgcaggataaacagcgcagcctgatagttcttcgccgccagcattttatccagcagctctttcggcagcggttcgccggtttcaaagtggcccgagataaaggccagcgcatccggttcccagcaccagttctccatgaactggcttggcagttccactgcatcccatggcacaccgctgataccggagacgccaggcgcttcgatacgggtcagcatgtgatgcaggccgtgaccaaactcatggaacagggtgatcacttcatcatgggtgaacagcgcaggtttgcctttcaccggacggttaaagttacaggtcaggtaggcaaccggcttctgcaggctgccatcggctttacgcatctggccgacgcagtcatccatccaggcaccgccacgtttatgttcgcgggcgtagagatcgagatagaagctgccgcgcagttcgccggtttcatcgaacagatcgaagaacttcacgtcaggatgataaacctcaacgtcgttacgctgcttcgccgtgatgccgtaaatgcgtttcaccacttcaaacagaccggcgactgcacgctcttccgggaaataagggcgcagttgctcatcgctgatggtgtagagatgctgcttctgcttttcaccgtaataggtgagatcccacggattaagctcggtcacgccgtgctctttacgggcaaaggcgcgcagctgctccagctctttttcaccctgcggacgggcgcgttccgcaaggtcattaaggaagtcgattacctgggacgggctttgcgccattttggtcgccagcgatttatcggcgtaggagtcgaagcccagcagctgtgccagctcgtgacgcagcgccagctcttccgccatgattgggccgttatcccacttaccggcgttcggaccctgatcggaggcgcgcgtcgcataggcgcgatacatctcttcacgcagcgcggcgttgtcgcagtaggtcatgaccggcagatagcttgggatatccagcgtcagcagccagccttcctgctctttggcttcagcctgtgctttcgccgccgccagcgcgctttccggcataccggccagctcgctttcatcggtaatcagcttgctccagcccatggtggcatcgagcacgttgttgctgtaagccgagcccagctcagagaggcgcgcggcgatttcgccgtagcgctgctgtttatcttttggcaggccgatgccggagagttcgaaatcacgcagggcattatcgaccgctttcttctgcgccagatccagtgcagcgtactgatcgccctctttcaggttgcgatacgcctgatagagcccttcatgctgaccaacccaggtgctgtattcagagagcagcggcagcgtctgctcataggcttcacgcagctccgggctgtttttcaccgcattaaggtggctgaccggtgagaagatacggctcaggcgatcgtcagtttccgccagcggctgaaccagattatcccaggtatacggcgcaccctgcgccacgactttttcgacttctgcgcgacagtggctcagcacttccgtcacggcaggcaccacatgttcaggcttaatggcagaaaaaggggggtagcgtaaaagatgtcagtagcggattggtcatagcgcagtcctttatagatgtatggggcgcagcgggtcgcgcaacgcaatctaagtaacatgcggcttagtgtagcgaaaatcaatggcagccaggatgaggtggggaagaaacgcgcgaatagcagcacggaagatgcacgcttttatctcatgcacgtaatgctggctggcgcgtcggggaggatttgcggtcgctttccgtaactgcgtgccgggaaccacacgccccgccctgagcggctcgcggtaatcccgatttgttatcacgcttctggcacatcaacaggtcatccctgatataatcgcggattctcatgcttttcctgcgtcggttgctgtgcgtcgttctgtgggtaatacgtgaggtaataattggtataaattgattttccatcaattaaaaccttataaattcaacaggataaacaatgctgagttatcgccatagcttccatgctggcaaccacgccgacgtgctgaagcacaccgttctgagcctgatcatcacggcgctgaaagagaaagagaaaccgtttttctacctggatacccatgcgggcgcaggccgctatcagctcagcggcgagcacgccgagcgtaccggtgaatatctggaaggcatctcacgtatctggcagcagcccgatgcgccggaattgctgcaaccctattttgatgcgattcgtgcgctgaaccgtagcggcacgctgcgctactatccgggtttcgccactgattgcccgccatctgctgcgtgaagatgacaaactgcaactcactgagttgcactccagcgactatccgctgctgcgtaacgaattcagcaaagacaaccgcgcccgcgtcgatcgtgccgacggttatcagcagttaaaatcgaaactgccaccgccgtcacgtcgcggtctggttctgatcgatccgccgtatgagatgaaaagcgactaccaggcagtggtgaaagggattcaggaaggccataaacgttttggcaccggcgtctttgcgttgtggtatccggtggttttacgccagcagatcaaacatatgctgcgcgacctggaagcgaccggcattcgcaatattctgcaaatcgaactggcggcccgtccggacagcgatcagcgcggcatgaccgcctccggcatgatcgtgattaacccgccgtggaagctggcccagcagatgaataccctgctgccgtggctgcaccagaaactggttccgacgggtaccggccactacgcggttaaccagatcgtacccgaataactctctttgtcttctacgccgctcactaccggtgcggcggcgttgtaccaggtctttaccatgtggatcatactggctggcgcgctggccgcgctgcaaccggcccgacggctggcattattattactggcgctcgccacactgctgggtttttatcaggacgtgttagcgtggccggtgctcctgctgtttaccggcaccgccgctgtggtggcactccgtatttatgaccgtgaccatcatcgacgacaaatagtgaccgaagcgctgctggtgctgatcgccatcgggttgctcctccatctttttccaggctttaataacccccttcaggcagaggatgtgcaggccggaccgcgcagcgtgcctttcagcttcgggtttaacttcgataaagcgcttattccttttgtactgctggcctgcctgccgacgctgtttcgcgcgcctgccacgccaccacgctatcgactacccgccgcactggcgctgatcgccgccattccgctgctgctgtactgcgcggtattattgagcggattagcgtttgagcgacatacaccggactggctggggccatttatgctcgccaacctgttctttgtttcgctggcggaagaggccctgtttcgtggctatctgcagcagcgattaaagcaggtagtgggcggcatccctgcgctgttactgagcgcgctgctgtttggtctggtgcatctgagcggcggcctgttgctggtgatcttcgccaccctggccgggctgttatatgggctggcgtggcactggagcggccgcttatggctggcgaccgccctgcactttggccttaacctgacccatctgctgtttttcacttatcccgcactgcatcattagaggttaaaaaccgccagatcccaggccagctcggtgcagggaaaaatcgtctggcactccgccagcaggcggttcatgtcttttgccagatagcgtgaactgaaatgggtggcgatcagccgttttgccccggcgcgttttgccacttcggcggcctgcagtgtggtggagtgcccgcgcccgttggctttttctaccatcgcggcctccagcgtggtttcatgcaccatcaggtcaacattagccgccagttgcagcgcgacctcagtaggtgccgtatcgccaaagatggccagcgttttgccgggtgtcgcggggccaagatagtcagcaccgttgattacccgcccatcttcaagcgtcacgcattcaccctgcttcagctgctgaaaccacgggccgcgtggcaccccttccgctttcagccgcgcagcatccagcaaaccgggtttatcatgctgttcaatgcgatagccaaaacactccaccggatggctcagcggccaggcgctgatacgaaactcaccgtcgtccagcgtccagcccgcctcaatctcaacgatggtcagcgggtagtcggtgtaagagccgctgatcgacagcgccgtctcaacaaaggtttttaatcccctggggccatagaccgtcatcggtgtggtcagcccggccattgaccggctggtgagtaatcccggcagcccgaaaatatgatcgccatgcagatgggtgataaaaatcttatccagcttgcccggtttgaggctggagcgcataaactgtaattgtgtgccttccccgcagtcgaaacagccaggtttcaccactcagcgcgcgggtaaaaacaatagacgtgacgttacgttgcaggctgggagcaccgccgccggtgccgagaaaagtaaggtgcatggtatgcttccctgtaagcgagtgaaaaaacagaaccctattacaatcataggcgcaaactttgcgtcatttcgacccgcagcgttacactcaaccccaattttttatgcaaccggatggatacttcaatgacccgacatttcgactatctcgccattggcggcggcagtggcggcatcgcctcaattaaccgtgcggctatgtatggccagaaatgtgccctgattgaagcgaaagagctgggcggcacctgcgtgaacgtgggctgcgtgccgaagaaaatcatgtggcatgccgcgcaaatcgccgaagcgatccatctctacggaccggattatggcttcgacaccaccgtgaatcgcttcgactgggccacactggtgaaaaaccgcagcgcctacatcgatcgcatccacaactcctatgacaacgtgctgggtaaaaacaaagttgaagtgatcaaaggctttgcccgctttgtcgatgcgcacagcgttgaagtcaacggcgagattatcacggctaaccatattctgatcgccaccggcggtcgtccggtccacccttctattccgggtgcagagtacggcattgattccgacggtttctttgagctggacgcgctgccaaaacgcactgcggtcatcggcgcaggctacatcgcggttgagctggctggcgtggttaacgcgctgggatcggaaacgcacctgttcgtccgtaaacacgcgccgctgcgcagcttcgatccgctgcttaccgaaacgctggtagaagtgatgaacagcgaaggcccggcgctgcacaccgaatctattccaaaagctgtgattaaaaacggcgatggcagtctgacgctgcagctggaaaacggcagcgaatataccgtggattgtctggtctgggcgattggccgtgagcccgccaacgataccctgaatattgacgccgctggcgtcgcgctggacgacaaaggctacatcaaagtcgataaattccagaacaccagtgtgtcaggcatctacgccgtgggcgacaacaccggtgcggttgagctgacgccggttgcggtcgcggcgggccgtcgtctctctgagcgtctgtttaacaacaaaccggacgagcatctggattacagcaatattccgacggtggtgttcagtcatccgccgattggtaccgtgggactgaccgaaaccgcaggcacgggaacagtatggcgacgaccaggtgaaggtttataaatcgtcatttaccgccatgtacactgcggtaacccagcatcgtcagccgtgtcgcatgaagctggtctgtgtgggtgcagatgagaagattgtcggcattcacggtatcggattcggcatggatgagatgctgcagggcttcgctgtggcgctgaaaatgggtgccactaaaaaggacttcgataacaccgtggcgatccatccgaccgcctccgaagagttcgtgacgatgcgttaattccccgaacagaatactattgcgaaaaactggtcatcagggccagttttttcctgcaactgcgctcaacgaaaattaatgcgcccgctgacgcgaaatgtaaaacctgcgtttctcttcatattatcaacacccagcaagagccaggctgattaacagcgaaaaaaccgaaccgacagtaattaaatccatttatatatgaaattatttaatgactaccgattatattcacaggcccggcgtccatttccacaggattatcgttagtgaatttatcgctgtgcttaatgaatgcctgaagtgatacgactgctaaataacctctccacgctgtcgcttttgaggagatagcctttcttcgaaactctcaggatcacatcatcacttaaacccagaaaaaagagcttcgactttaaattagacataacctgccagacccgctgcgtagaagaactcagtccatgtttatcccagacgttctccataagttccgaatccgtgacaacatcaatagtggcattttcaaaaagatactctaatacgtgcgacatggtttttctcaggatgatatcttcaccatacccattcagacaaattagtcgctttgtcttgtgtaaataaaccacgttctcttcaataagatagccaataaaatttacttcattacccggtagcatgatgttctccagaacaatgatgaaaacaagataataacttttattcaggtatttaaaaaacatcccttcattatttgtacatcactttttaatcagccctggccacgcctttccattgttcctggtctgtaatagcgatgcctcgatgatcgtcatgcatataaccctttgttgtgtgttaaaatcctggctatccacctcgccacatcgttaataaaaagtaataataaataagtctgttctggcggagaagcagactgaccttaatactcatccgacagagtgcaataagatgttgttgcttatcatcgccggcaagaaaacttaaatatttcttagttaaatcagaaaccaccgataaactgaccaggatggattgctgtctgatttgcctcatcttatgcgtagccgttatgaaatcatctaacgttaacgaagacaataaagtgggatttttattttagttcaaaacttacgggttttatcacggccatctgtagcagaatcagccaaaataaagcttaaaagaagaatcgctttggattgaaagacgattgcgtcatccgaacacgcccgcttcaacgctttcattagtttttttataatccataagacctgatatttctggccaatttttgatctgtatcaactggcaatatatcggtggaaaaagcaaagtaatggcggaaaaacagaagcaaaagatatgagacaggaatgttcttttcccgggaattaatcagatccgtttgtttattaagataattattaaagcgtccttatttagctattttgtaccctactaacggcaggagattgtcatctcattgtataccgagtcagaaataagcgtgagtgccccttagctccgtacaccctcgttaacgtgataaataagaatgagttattaatgcgccctgacctgtcagcatagtccgctgatatcaatattaaggggttgggtctggctctggattgggagatttaagatggcagagggcgcagcattaaccgggaccgggacaaagggtcaccttcgatctggtgaccttgcgccaggcagggggagaacggatcccccggtgcagttgtgcaccgcgccagtgcaactcagctcacgcgatccagccagcgaacataagcctgatcccataacgccgctggcgtgcccgccttgccaaggccaaagccatgcccgcctttgctgatctgaatcagctcaaccggcacacgattacggcgacaggtgtcgcgcatcagctcggtgttaaacggatttgaggtgtgatcgtcctcggcctgcgccagaaacgtcggcggatattgccgggttacgtagttctgcactgaccagttcgcctcatcctgcggcgtggcatttttgccgaccatcatcagatgggtattggtgtgctgataaggcgcttccagggtgatgaccggatagatcagacccacgctgtcgactttgggcaccacttcatccagcggatcgatggccggataggattcaaagtccggacgcgccgccgccagccccagcagatgcccacctgccgagaagcccagcacatgcaccttgcgctcaaaggatcgcaccagccggatggcacgctgcgcatcctgcagcggtgccagccgccccgcctgccacttctcatgcggcagccggtagctgagcacataggcggtatagccattggcattgagccagcgcgcgaccggccaggcttcgcgtcccatgccgatccagcgataaccgccacccgctgcaattaataccgcttcgccattgggattttccggtttaaagcgctgaatcgccgggctgacgatatttgaccaggaaccggtgctgttaatatgcaactggcccgatgggccgccgccgccgggcggatcgtccggccagaggggaataatgtcatcgcgggcaaatattttgccggtggtcatggagagcccgagcgctcccgtgccgagaataaagcgtcgacgcgtaatcataatgcctgttatgtgataccagaagagtgagcaaaccgttgcggcaggctgcagtagaatcaacagatgcaagtcgggtgccatggctggcgattatgtacgcaatggcccctgaaaagccataaaaaaacgcgcccggcaggcgtaatgctgatcagttaagcgacaggtgataacgcagtctggtgccgggcctgctctgaagcttaagtgcatgttgacagaaagggcacgaaagtggaggcctgagcgcctctgctgctgaaagggctatccgcagcgctgaggcgtgacggtgggccagaagtccacgccgggaagcgtggacaggtcggggccggccagggagggccgatccccgaacggttcgtcggcacgacgtcaaagccgaaggtaccgcgtgagcggcgcgaggacggcccggcagcagcagaggtgcgctggcccgcactgcggctcgctcgcccggaaaaaaagctgccacgtttgaccgtgacagcctttacaaatttaatcttaactgatcagtattagcccggcaggcgcgtttttatttaatccgatgcggttaatcttcctgctggaactgcgccatcacggcctgctcacactgctgttcgttaacgcgcagtttggcacgctcatcatctcccagctgcagccaggcactggccacttcacgcgcggactcttcatcaaattcaggctgattcatcgccgacggcgactgactgcgcgccacggtcgatttcatctgttcgacatactgatccgcactggcgacctttttctcgccgctgacaatgtggcacagctgactggcataaacattctgctcagtgtcagcctcgtccgccgccagcgcgctgccggtggcgaggatgctcagcagcactatctgagttactttcattcttaactcctgttagttcgggttaaaccttacgctgaagggcttctaggcgtttctgacgccagttcagcagcggcgacacggtggtgccgtggaccaccacgctgcagaccaccagcgttaacgccatattggtcataatttccatctgcgggccttccataccgtgcgtccaggcataggcgatgtagttcagactgccaatcccgcggatgcccagccagccaatcagcagacgctgccccagcggcagtccggcgcgcagcgtcaccagccagacggccagtggccgcaccaccacaaacagcaccaggccaatcagcacgccgtagatgttccagtgctgcgccagtgtgacgcccagcaccaccatcatgccagccgccagtaaacgttcaatagtatcgccaaaagagagggcgtcgcctactacaaaccctatcgacttcaccatattgttgtcgccctgatgcgccaggcgtttattagggttcaccagtgcttcagagggcagcacgcgctcgtcgtcagagagatcgtccggctgatggcgacggaatacgcccatctcagcacggcgtaatcccagcccggcggcgaaggcagccaggaagccggaggcacccagccactccaccagtgaataactcagtgcaatcagtgccagcgccaggaaatcattgggcgccacatcgccattggcattgcgcagtcgggtcgccagcaggccaatcaactgccccagcacgaaaccgatgatcagaccgccgccaattgcccagagcacctcgaccgcaccccagtgccccagcatcgccacgctcaggctttcgccattaaacagcagcagcgccagcatcagcaacggcagcgcggaaccatcattcatacccgcttcgctggagattgccacgcgcagcgagtcatcatcctgcgcatcgttgaccgagattaagctcgccagcaccggatcggtaggcgcaacaatggcaccaaacgccagcgcaatcggccagtctaatcccaccaggaagtgcgacagcagggtcatcgcggccacggtcagcagcatggcgggaaaagccagtttcagcccggtgtgccagcagttattttgcagcggctgacgcagcttgaggccggtgatgaacagcgaggcagccatggtgatttcagtgatgtgcgccacggcttcggaatgggtaacaatatcgatgtggataacatcaaatccccacgggccgcacagcatgcccgcgataaggaacagaccaaatgaggtgactggcccccggtgaatccaaccggaagccagcgacatcagcagcagaaggccgcccgtcgctgctgtccaggctaaaaagttcataatactccagattatttcgggtttatgaataagcctggcacattttttgacgggcgaggtgtcagtttttcaggtgacgactggcgaagcggaccgccagcgcggcggcaccggctaaggtcgagagcgcaaccacgccattccagccccagtgtgccagcgccagacttcccagcgccgcaccggtggccataccgataaacaccacggtaaacagcagcgcattcaggcgactgcgtgcttcaggcgccaggccatagaccagcgtctgatgcgccaccagcgtggcctgcactcctaaatcgaagccgatggtgcagaggacaatcagcgccagctgggctggcattggcagcagcggcagcagaaacatcagggcaaaggagatcattaccagcgcggcgccagcctgcgtgacccttgccggaccgatgcggtcagcaaaactgcccgccagcggtgccgccatggcacccgccgcaccggctaaaccaaatgccccggccacggcactgtccagatgaaagcggtcgctgagcattaacgccagcgtcgaccagaaggcgctaaaacccactgacaacagcccctgagccagtgcggcacgacgcagcgtctgatggtgacgccacaggtgcaccagcgacagcaacaggcgcggatagctcaccgaggtgcctggcgcgaaacgcggcagtacccgccacagcgtcagcgttatcagcagcaccgccagcgcggcaatcatatacatggtgcgccagccgaaatactctgccaccaccccgctgaccacccgcgacagcaggatccccaccagcagcccggtcatcaccgtgccgactgttttaccccggctgcgtttccggcgccagcgccgccgaagcgggtacaatatcctgcgccaccgtggcggtcaggccggtgataaaactggcaatcagcagcgcgctgagtccaccggaaaaaccacacagcagcagcgccgccaccagcattaagcctttgataaagataatggtgcgccggtcatggcgatcgcccagcggagccagcagcaggatgcccagcgcatagcccgcctgggtcagcatcggcaccatgccgaccgcgccgatgccggcgttaaactgcttgctgatgatatccagcatcggctggctgtagtagatcgacgcgacgctgagtccggcaccggcggccagggtaaacaccagcggcgcagagagcggttcattttgagtctgggtctgtatggctgacatgctgtaatcctcatcatttcgtcctgccattaaagcgcattgcggttatacgcggtagactgacatcaggcaaaaccgttatgcgtggtgcgtatgaacaaccctaacagcagcgatcgcatcgatctgatgcagacttttatccgtattgtggagagcggcagcttatccgccgccgccgcgcagctcggcacgacacaacccaccgtcagccgccgattgcagagcctggagcagcggctgggcctcaagcttatcctgcgcaccacccatgcactgaagcttaccgatgatggcgagcgctgctacgcccaggcgcggcagctgctggcgacctggcatgcgctggaagatgagctgaccggggccagcgatgacccggtcggtacgctgcgggttcgcgccccacacgcctttggtcaggatcagctgatcgccccgctggtggactatctgcaccgctacccccggctcaatattgagtggatgctgaatgaccgcacgcccgactttatggcagagaatgtggactgcgccattcaggtcggtgcgccaaccgatccttcggtggtggcgatactgctggcagaagtgccacgtattgtggtggccgccccgcacctgctggcgcagcagccgccgatagagcgggttgaacagctgcgcgacctgccgtggctggcactgaccagtttttaccgtaacgaagtggtgttgcagaagattgacgacggccagccggtaaacctggcgattacgccccggctgagcagcgacagtttatatgcggtgcgcaaagcggcactggctgggatgggagccgcgatcgtctcctcatgggcagtgcaggaagatctggcggatggcagcctggttcagctgatgcccgcgtggcaggcaccgccgctgccggtgtggctgacctatccctgggcgagttactacccggccaggctgcaacacttttttgccatgatcaaagaggtgatgccgcagctggcgggcacgcgtccggcctcacagccagcgggtcgttcagggggaacagagcggaaagggtaaagcaggcgcccgcctcagcgggccgccagaaaggttacttcggttttttatcgctgcgcgacatctgatccagccagcccatcacaaaggcggagagcacaaaggtcaggtggataatcacgtaccacatcagcttgtcgttttcgacgttgcgcgcttccataaacacccgcagcaggtgaattgaggagatggcgacaatggaggcggcgactttgtttttcagcgagccggagtccatcttgcccagccagctcagcttctctttatcttcgtcgatatcgagcttagagatgaagttctcataacctgacagcatcaccatcaccagcaggccgccaaccagcgtcatatccaccagcgacagcagcagcaggatcagatcgttttccgcaatgctgaaaatgttgggcagcaggtggaaaatttcctggaaaaatttaatggtcagcgccagcaatcccagcgaaagtccaatgtaaaccggggccagcaaccagcgcgatgcatacatcaggttttcggtaaaacgttccatacaatcccacgaataatcaaacaggtccgggagtataaccgatcaactgtgaagttatttcagcccttcgtcagaaatttcagggaccggcggcagcggcagcgagagacgaaatgccgcgcccccttcggccctgtttctctgcccagatctgaccaccgtggctctcgataatggttttacagattgccagacccagcccgacgcccggcaccgccgactctttgtcgccccgccagaatttatcgaatatccggcttaaatcgtcttcggcaatgcccggtccgctatcccagaccgagatctccagccgtgacgccgcacgccaggcgcgaatgccgcgtggtgcgctgttaccggcatacttcaggctgttctcaatcaggttggtgaagacccgctccagcagcgtgctgtcgcctttgatcagcacgatgtcgtccggcagatcgagccggacctcatgccctttcagtgatggtgccatgctgctcagcgccccgccgaccacctcttccagcgccagccactcctcacgcaggttgaggccgcccgactgaatgcgcgccatatccagcatgttgctcaccaaccggatggtgctcagcgtctgctcgcggatctgactggcctgcggcacatattttgagttgtcgctggccaggtcaagcatcagcatttccgcctgaccaaacagcacggtcagtggggtgcgcaggtcgtgggacagcgccgacagcagcgcattgcgcagctgttcacgctccgccgagagccgggacgccgcctcgctatgcgacagcgccatccgttccagtgcgttagcaatcagcaccgtaaaggtttccaccagccgctgctgctcggggatcatcagctgacgcaggttctgcggctccaccaccagcaaaccccggcagtgcgcgccacttttcagcggcaggatctgataaggcaccgccggtaaggtatcagtgcccgcacccgcaggctggcctttgctgtaactccatttagcaatcgcgcgatccggctcgctggctggtaacgcatcgcccaccggttgcagtttcgccctgctcatccggcagcagcagcaggcagcgcgcctgtaacgtggcatccagcacccgctggctggtggcggcgatatcctgcggcgttaacgcactgcccagcgatttcgccatctcatagagctggcgcgcccgctgctcgcggtagcgcgccacccgcgcctgataacgcacgcctgccgtaagattgccgacgattacgcccaccgccagcatcacgccaaaggtgaccagatattgcagatcggagaccgccaccgtgccggtgggggcaacaaagaagaggtcaaaggcgacgatattcatgaccgtggcgatcaccgacggccagcgaccatagcgtagcgccacgatcaccaccgccagcagatagatcatcacgcagttggcgggatcgaaaccgatcagcaccgactgcccggcggcggttacaaggatacagagcaccagcgccatcattacgccgcgcagctgaatacgccatttttcgctggtgacgcggccatccggcagcggatgcggcgcatccttcagcggctcatccagcgccaccaccagcagatcgagatccggccccagctggccgagccgttcggcaaaactgtcacgccgccagcgccgcagcgggcgacgaccggtgacaattttgcccagattgtgtgcgcgggcgtaacccagtaccgcttcggcttcatcgggttcagagagggtcgcggtttccgcgcccagctcctgcgccagctgtaacgtgcgcagaatcgcccgtcgccgcgcttccggcagccggtgcagccggggcgtttcgacatagaccgcgtgccattcactgccaagccgcgccgccagtcgggcggcggtgcgcaccagcttttcactgccgctgtcgtcgccaatgcagagcagaatggcgtcgcgggtgtgccagacgcgctcccgtccctgctgatcgcgccaggcgcgcatctgatcatccacccgatcggcggtgcgacgcagggccagctcacgcagggcgaacaggttacctttgcggaaaaagttttcgatggcgcgttccgcgcggtcgccaatgtagactttgccctctttaagccgctgccgcagatcgtcgggcggcagatcgaccagcaccacttcgtcggcgctgtcgaaaaagggatcgggcacggtttcgcgcacctgaatgccggtgacgccgcctaccacatcattgaggctctcaagatgctgtacgttgacggtggtcagtacatcgatgcccgcttccagcagctcctcaatatcctgccagcgcttgggatggcgcgagccctgcacgttggtgtgcgccagctcatccatcaggatcaccgccggatggcgagccagcgcggcatcgagatcaaactccgcatgacgcgagcggccggttgcgcgacgcggcagcagagttaaccctgtcagcagctgcgcggtttccggccggtcatgggtctctaccacgccgattaagacatccagaccctgcgcgcgcagccgctgtgcctcctgcagcatggcataggttttacccacgcccgcacaggcaccaaagtaaattttcagctgcccgcgatgactttcgcgattagcctgcagcagcgcgtcgggatcgggacgctggggtttcgtggttcatcgcttcctttacaccattacagttcgttgagcgccatattcagctgcaacacgttgagggtcggggtgccgaggaatggcatcagcggacgatgcgtcatcttatcaatcagcgcctcgacctgcggcaacggcaactggcggctggcggcgatacgcggtgcctgccaaagggcggcctgtggcgaaatatccggatccagcccgctggctgacgcggtgaccagttcaaccgggacggcggccggtgcctgcggattggcggcccgcagcgcagcgacgcgatcggctaccgctttgtccagcgccgggttgctggcggccagattgctgccccctgaggccagcggattataaggtttatcgccactggctgaaggacggccccagaaatagttgggctgggtaaagttctggccaatcagcgccgatccgcgcgccacgccatcctcctccagcagcgagccgctggactgggacggaaacagccactgcgccagaccggtggtgagcaaaggataaaccacgccggtaacaagcgtaagcagcaacaacagtaaaattgccggacgtaactgactcatttttctctcctcaggccatgcctgaaaacactaacagcagatcgatcgctttgatgccgacaaacggcaccagcaggccacccagaccgtaaatcagcaggttgcggcgcagcagcgcagcagcgctcagtgggcggtagctgacgcctttcagggccagcgggatcaggaagacaatcaccagggcgttaaagatcaccgccgacagaatcgcactggctggcgagtgaaggtgcatcacgttaagcatgttgagctgcggataggtcgccgcaaacgccgccggaatgatggcgaagtatttcgccacgtcgttggcgatactgaaggtggtcagcgaaccgcgcgtcatcagcatctgtttaccaatgtgcaccacttcaagcagcttggtcgggttcgagtcgagatcgaccatgttgcccgcctctttcgccgcctgggtaccggagttcatcgccaccgccacatccgcctgcgccagtgcaggcgcatcattggtgccgtcgccggtcatcgccactaaacgcccttccgcctgatactggcggatcagcgccagcttggcttccggcgtggcctctgacaggaagtcatccacgcccgcttccgcggcaatcgccgcggccgtcagcgggttatcgccggtgatcatcaccgttttgatacccattttgcgcagttcggcaaagcgctctttgatgccacctttgacgatatctttcagcgccaccacgcccagcacgttcgcgccctctgacaccaccagcggcgtgccgccactgcgtgccacctcttccacctgcgcattgacctcggccgggaaacggccatggttcgcttcgatgtggcgccgtaccgcatcgaccgcgcctttgcggatcagtcgatcctgcacgttcacgccgctcatgcgggtctgcgcagagaacggaataaagctggcacccatgctgctgagatcgcgctcacgcagattaaatcgctgttttgccagcaccacgatactgcgcccttccggcgtctcatcggccagcgaggcgagctgtgcagcgtcggccagttgctcttcgctgacgcccggcgcgggcaggaactgggtcgcctgacggttacccagcgtgatggtgccggttttgtccagcatcagcacatccacatcgcccgcggcttccaccgcacgcccgctggtcgcaatgacgttagcacccagcatccggctcatccccgccacgccaatcgccgacagtaagccgccgatggtggtcgggatcagacagaccagcagcgccaccagcaccgtgatgctgaccggcgttccgccccatgccgagaacggccagagtgtcacggtcgccagcaggaacacgatggtcagtgacaccagcaggatggtcagggcgatctcattcggggttttacggcgtttcgcgccttccaccatggcgatcatccggtcaaggaaggtttcgcccgggttggcgctacaggtgatcaccagccagtcagagagaatgcgggtcccgccggtgacggaggcgaagtcaccgcccgactcgcggatcaccggtgcggactcaccggtaatggcgctctcatccaccgaggcaccgccctccatcacttcaccgtcgcaggggatgatgtcgcccgcttccaccagcaccgcgtcgcctttgcgcagctcatcggcactgacctgctgccactcggcgccatagcgcgccgctgagagttttttggcaaagctggtctttttcacccctttcaggctgctggcctgggccttactgcgcccttctgccagcgcctccgccaggttggcgaacagcacggtgaaccagagccagaccgcaatcgccccggtaaagctggcgctgccgctgatccggccggtcagcatcgccagcgccagcagcgaggtcagaatgctgccgaggtagactacaaacatcaccgggttacggaactgcacccggggatcgagctttttcactgcatcccaggccgaggtacgcagcaatgctgcgtcaaataacgcctgttgttgacgactcatgaggattgtccctgaacaagttgcagatgctcagccaccgggcccagcgccagagcaggaataaaggtcagtgcacccaccagcagcaccgtgccgatcagcagtccgataaacagcggaccgtgggttggcagcgtgccgttacccaccggctgcacttttttcaccgccatcgcaccggcaatcgccatcaccggaatgatgatgccgaagcggcccagcagcatgcaggcagccagtaacaggttccagaaacggcgtgttagcactcaggccggcaaaggcgctgccgttgttgttggccgccgaggagaccgcgtagagcacttcgctgaagccgtgaatgccgggattggccatggcactgcgcccggcgtcggtcatcatcgccagtgcggtaccgatcagcaccagcgccggtgtgaccagaatcgccagcgcggtcatcttcatctcccacacatcgatttttttaccgaggaattccggggtacgaccgatcatcagcccggcgataaacaccgccagcagcacaaacagcagcatgccgtagagaccggcaccgacgccgccaaacaccacttcgcccagctgcatcagccacatcggcaccataccgcccagcgcggtaaaggagtcgtgcatggcattcaccgcaccgcaggaggcggcggtggtgatgaccgcgaacaggctactgttaagaatgccaaagcgcgtctctttaccttccatgttgatggcgctgtcagcacccagctggaggaagtgcgggttgccctgcagttcggcccacatgacgaccgataccgccgccacaaacatcagcgtcatcgcccacagcagcatgtggccctgacgacgatcacgcacgctttcgccaaacgcgaagcagagcgccgccgggatcaggaagatgctcagcatctgcaccaggttagtcagcaccgtcgggttttcaaatggatgggaagagttggcgttaaagaagccgccaccgttggtgcccagcattttgatcgcttcctgcgaggccaccggtcccatcgacagcgtctgctgcacgccttccagcgtggagaaactgtgataaggcgcgaagttctgaatgctgccctggctgacaaagaacagcgccatcagcaggctgatgggcagtaagacatagagcgtgatgcgcgtcaggtcgcgccaggcgttacccaaggtcgcagagctgcgattagcgaagccacggatcagcgcaaatgccacggcgataccggtcgcggctgagaggaaattctgcaccgtcaggcccaccatctgactgaaatagctcagggtgctttcgccgctgtaggattgccagttggtgttggtgacgaagcttacggcggtgttcagcgccagatgccagctcaggccaggcagctgctgcggattcagcggcagcacgccctgcatcagcagtattgccagcagcaccacgaaacccagcgcattgaacagcagaatcgccagcaggtagtgcggccagcgcatgtccgattgttgcgcgcccagcagtcgccacagcggcgcttccagccgggcaaacaccggcttgtcagccactaacgacgccagaccccgtccgagcggctgcgccagcaccatcagcagcagcagataaaatgcgatgagtaaaaaagcattggccgccatcagaaggcctccgcatttaacagggcatagatcagatagcccagtaacaacaccaccagcacaatgccggttattacgcccacgctcacaggaacctccagaggattggatttatggcttagcttgcgcggaggcgtataaagaaggggttaaaatgcagcgggcgggcgtaaaaatagtgtaaaaatggcgaaaaatcaggcgacttccagcgcccagatacgattgagatcgacgttaccccacagcgtgctgtcctctgcacccacaatgctgtcggtgcagaagctgtcgccaaggtcgagctcttccggtttcacttcacgctgggcgtgcagtgaccagaagacatgcacgcagggacgcatcagcgatttttcgcccgctttcaccaccagcgccacccggccggaggccagacgcaccagcgatcccaccggatagatgccgatggtccgcacgaaggagtgcagcaagccagggtcgaaatggccgcgccagctcagcatctggtgcatcgcctcggcgggtgtccagccgttgcgataggagcgggtcgaggtcacggcatcatagacatcgcacaccgccgccatgcgggcgtagagcgaaatcgcctcgcctttcaggcggtgcggatagccgctgccatcatatttctcatgatgatgcagggtgatatcgagcagatcgtcatcggcgtcggcttctatcagcatctgcgcaccgaccaccggatgctcacgcatcaccctgaaactcctcttcagtcagcttgcccgctttattcaggatcgccagcggcacggccgctttgccgacatcatgcagtaaaccgcccatgcccacccgacgcagctcctgctcatccagtccaagttttttacccagcgcaatcatcagcccgcagaccgccatggagtgcagataggtgtagtcatcatgatttttcagtcgcgccacgcttagcatggcggagggttcacgcgtgatcgatccggcgatttcatccaccagatccatcatataatcgagcttcaggccgttacccagccgcgcttcgttgaacatcgccagcactttcggtttgccctgcaaaaagatctgctgtgcctgatccagttcctggaaaaacggggtgcggccaatggttctcttcgcgaccgtggaggcgatcggcgcctgcaccgatcgatcgaggtcgatccagagctggcggatcccttcagtgcgaagcatggcgatttgtcggggatcggtgatcagcatctcattatgaatgcgctggtcttttatccaccagacctccagcttgtggataaacatccctgggcgcaattcatcaatggtaatcagctttatcacgctatcactctttaatatcagcgggtggtaaggtgatatcggcagccggacaaattttcttcaggctgttttgtgcgaaggtgagggtctggtgagtggtcagaggagaggcgtcctgcctcgcccccgtttcagcagggggttaaggcgccgctgtggttacactacccgggtcagcaccggctcaccacgggcaaacgccagcatattctcaaagaccaggtcagccatcgccgccatggtttcgcgggtgctgctggcgatatgcggcgtgatcaccacattgtcgcgctggcgcagtgcgtcaggcacctgcggctcctgttcaaacacatccagcccggcaccggcgatctgcccggtttccagcgcatccaccagcgactgctgatccaccacgctgccgcgcgcaatgttaatcagatagccctgcggtcccagcgcctgcagtacttccgcattgataatgtggcgcgtcgcggcaccgcccggcagggtcagcaccaggaaatcggcctgctgcgccagcgccaccaggctctcatgacgggtgtagggcacatcgggccgtgaacgcggattgtaatagtgaatcgccatatcaaacgcctgcgcgcgccttgccaccgcctgaccgatattgcccagcccgacgataccgcacaccttgccaccgattttgctgctcagcggaaagcggccctgcgtccagtgaccggcgcgtgtgaagcgatcggcctcgctgatgcggcgcgccacatccagcagcagcgccatccccagatcggcgacgcaatcattgagcacctccggcgtgttggtcaccacaatgccgcgcgaccgggcggcttccgtatcgatgctgtcataaccgacgccgttactgcagatcgctttcaggtttggcagcgcggcgatcagcacggccggtgcgcccatcaccgcgttgccgctggtgaccagcatgtcgatatctgcgccctgctcagccagaaaggctgcctcatcttccgcctcccacagccggaacgcggtgaacgtcttttcaatgttctctatcagctgcggtggcaggaatttccctctgatcagcaccttacattgctttaatgccatcttctttctcctgattgttataggatgccgggcgatcgctctcttcaccgacgcgttcaatcggtcccatcaccagcaggaacagcagcgccgctaccacgcagtgtgccgccacaaacgccagcccgatgctgtagctgccggtcagaccgacgatgatgccgaacagcagcggcgtggtgaaaccggcaatattgccgatgccgttaaaaatagagcctgccaggcccaccgcctctttgggtgcggtgtcgctgatcaccgtccaggtgcctgcaccggccgctatacctttaccgaaaaaggcgaaggacataatggcgataatgccgctattgcccggaatgatcgccgccagcaccagactggacgccatcagcatgccgacgatatagggcgttttacgcgcccaggagacgctccagccccgggcgattaacttgtctgacaggtagccgccgctgatcccgcccagaaaaccaaacagcgccggagccacggtggcgaagcccgcctccatgatgttcatgccgcgcgcctgcaccagatagatcggaaaccaggtaataaagaagtagctgagcgcgatgatgcagtactgaccgagataggcgcaccagagcatgcgattagtgagcagctttctgaacatcgctttactgaccggtggccgcgctttcagcgtctgcgccgagtcgatatccaccagcgcaccaccgtcaacgatgtggcgcagttcactctctgacacgccagggtgattgcgcggctcgcgcatccaggcagcccagacaaacaccgccagcaggccgatgccgcccagcacaaagaacggccactcccagccaaagcgcgacaccagccagcctgacagcggcgagaagatggcgacggcaaaatattgcgccgagctgaacagcgatgaagcccgtccccgctctgcgccagggaaccacataatcaccacgcgcgcattggcgggaaagctgggtgcctcgatcaatcccagcataaagcgcagaccaaacatcagcatcagcgcgccggtcatgccgctggagaactcgccaacgaatcccatcgccagcgtcgagactgaccagagcgccagcgtgacgccatacacttttttagccccgaagcggtcaagaaacagtccgccggggatctgaccgataacgtaggcccagctgaaggcagagaggatcaatcccagctggatcgctgacaggccgaactcctctttgatcgccgatccggagatcgagaggatcgaacggtcggcataagccacgaccgacagaaagaggatcaggcagaggatccagatgcgcacatgagacgtccggtgagtcgtttggtctttaagcatgagctgaattccttaaaaagcggcaggttgcgccacgaggtttttttcaggaataacgctgagatttcccgcttaaggaaatatagataggaggctaacgatggatcattgtgcggatgttgagatcgtcaggcccgattcaacggttttctgacaaccaccacaaaggccagtgcgatgctgcacaaaagcgcaaaaagccgcggctgcctgccgcagagtgtgcgccacgtcgaggatttcatcggcgcggccagctatgacgcggcgattttacggcaaagtgtggcggcgctagcaagagtgaaaagggccggttgtcaaacccggcgactgttcataagctgcaaatgataatctttgtccatttttacaataaatgaaaaatctattccactcagttaacctcgggagtctgcaatgaaaaaacgtgcatgggccatactctgtctgctctctctttccacgtcggcgctggcagagaaaattggcgtctcaatggcctatttcgaccagaactttctgaccattatccgccagtcgatcgagaaagaggccaaagcgcgtcagctggatgcgcagtttcgaagatgcacgcggcgacgtgggccgtcagaccgatcaggtgcagagttttatcagttccggggtggacgcgattatcgtcgatccggtcgactccgctagcacccctgccctgaccagactggcgcagcaggctcacattccgctggtctacgttaaccgtacaccgggcgataaaaccctgccgccgggcgtggtgtttgtcggctctgacgaacgcgaatcgggcacgttgcagatggaagcgctggcgaagcaggcgggttatcgtggcaaggtcgccattatcatcggtaacctcagcgatgcgggtgcgctgcagcgcaccaaagatgtggagcaggtggtggcaaagtatcccgacatgaaagtggtgctgaagcagaccgcaaactattcgcgtaatgagggcatggatttaatgctcaactggctgtcgaacggggaagagatcgatattgtcgccgccaacaacgacgaaatggcgattggcgcaaccatggcgattgcccaggcgaaaccgaagaaaaccattctggtgggcggcattgatgccacgccggatggcctgaaagccctggcaagcggcaaactggccgtcaccgtgttccaggatgccgtgggtcagggcaaaaaatcggtcgaggtggcgcagcagatgatcaaagggaaaaaagtcgattcccaccagtggatcccgtttgaactggtgacgcagcagaacatgcagcaatacagcaataaaaatccgtaatgaaaagcggagcggcagcgctgccgctccggttatcacttctcgtgcagcagtttcgccatcatcaccacatcgcgcagctgaccgtcgcgcagggcagcctgccgcatcaccccttcacgctcaaagcccagccgctcatagagccgcagcgcccgttcgttgtcgtgaaacacctccagctccatacgcgtaatccccagccagttacgggaatagttgagcgcggtgcggatcaggcgctcaccgacgccgcgaccggcgtaatcgggatgcacacccagcccaaagctgatgcagtggcgggtgcgcggcttgttatccacaaacagcgtcagctcaccggccagcacgccctcgatctccgcgacaaaggcgataaacccctcggcatccattctggcgatttttttctcccaggtggcaacgctgggaaacggcagctgcagcgtccagggatagacatcgggatgactgtagagtcgctgataggcggcggcatcctgcggtttcccgtgcccgaataatgatttccatattttctccttttagccgaatggggttcatgcactaagctgtagctctttaccggacggaaagagtatcgctatgttgtatcgccgttttgagcgttttatcaatatttttcatgacgcgcccaccgactcgcccccctcaacggtctggtcgttttacctctactatctgcggcaggtctggccgagtttcgcggcactgctggtagtgggactggcgtcagccctgattgaagtgtcgctgttcagctatctgagccgcattatcgacatggtcaatcactccacgcccgccagcctgtttcgggataactggccgatactgctgtggatgggggcggtggcgctgattctgcggccgatttttatcgccctgcacgacatgctggtgcatcaaagcatcagcccgagcatgaccagcatgatccgctggcagaatcacaactacgtgctgcgccagagcctcaatttcttccagaacgatttcgcgggtcgcatcgcccagcgcattatgctgaccggcagttcactgcgcgattccgcggtgcagctggtggatgccatctggcacgtgctgatctacgcggtgacttcactggtgctgtttgccggtgccgactggcggctgatgatcccgctgattctgtggatggtggcctacagcgcctcgctgcgtttctttgtgccgcgcgttaaagcgcgttcggtggtctcctcagagtcgcgatctaagctgatgggcaccattgtcgatggttataccaacatcgccaccatcaagctgttcgctcacagcgatctggaacggcagtatgcgcgtgaggcgattcaggagcagaccgaaaaaacccagaacgccggtcgcatggtcaccagcatggatctgaccctgtcggcgctgaacggcctgctgattgtctcgacctccgggctggcgctgtggttatggagccagtcgctgattagcgtcggggcgattgcactggcgacaggtctggtgatccgcctggtgaatatgtccggctggatcatgtgggtggtcaacggcattttcgaaaatattggtacggtacaggatggcctgaaaaccatcgcgcagccgctgagcgtgcaggatgcgccgcaggcgaagcagcttaaggtgacgcgcggcaacatccgttttgaggatgtgcgcttcgattatggcggtggccgtcaggtgattaacggctttaacctcgacatcaaacctggcgagaagattgggctgattggtccctcgggcgccggtaaatcgacgctggtgaacctgctgctgcgcctctatgacctgaacgcggggcggattgtgatcgacgatcaggatatcgccgccgtgacgcaggagagcctgcgcagccagattggcatgatcacccaggacacctcgttgctgcaccgctcaatccgtgaaaacctgctgtatggtcgtcccgacgccagcgaagaggagctgcagcttgcgattcaccgcgcccgcgccgatgagtttatcccgctgctctctgactcactgggtcgcaccgggctggatgcgcacgtgggcgagcgcggcgtgaaactgtcgggcggtcagcgtcagcgtgtggcgatagcccgcgtgctgctgaaggatgcgccggttctgatcatggatgaggccacctcggcgctcgactccgaagtggaagcggcgattcaggagagcctggagtcactgatgcagggtaaaaccgttatcgccatcgcgcaccgcctgtcgaccatcgcgaagatggatcggctggtggtgctggataaaggcggcattgccgagatgggcagccatcacgagctgctggcgcaaaacggtctctatgcccgcttgtggcagcatcagaccggcggttttgtcggcatcgattaatcgccgcgtcgatagggtaaggcgtcgcgggcttcttccgcccagccgcgcacgccttcccgctcctgcaccagaaaatctgccacggcatcgcgcaggccgggatgcagcagatagtgccaggagtgggtaatctgcggctcgaagccgcgcaccagcttgtgctcgccctgtgcgccggcatcaaaccgcatcagcccctcatccagggccaaatccattccctgatagaaacaggtttcgaagtgcagccggtcaaactccgccagacagccccagtagcggccatagagcgcgttgctgtcccgcagataaaacgccatggcggccggttgctgctgtaaacgggcgataaccaccacaatattctgcggcatgcgttccgccagcaggctgaagaagtcacgcgtcagatagggacgctgaccgcgcaccgcataggtgttggcgtaacaggtgtagacaaaatcccactgatcttcgcgcagctggtagcccaggtagcggtcaaactcaaagccgctctgcatcacctgctcacgctctttacgcagttgtttgcgcttgcgcgacatcagcgaatccaggaaatcctgaaaatcgcggtagccacggttatgccagtgatactgacagccgagccgggagagccagtcgggctgatcggccagcagctggttagcctgcgcatcggtaaagttgatatgtgccccgcttaagccctgctgtaacaggctctcaggcagggccgacagcagttgcgctgcggcagcggtttcgcccagcaggcgcgcaccgctgaccgggctgaaggggatcgcgcccagccatttcgggtagtagcggatcccggcgcgctgactggcatccgcccaggcgtgatcaaagacgtactcgccctgtgaatggcgtttgcggtagcctggcagcgcggcgcgggtcaccccctcctcccgccacagcagatgatcgggctgccagcccgcctctaaccgcacgctgccgctctgtttctaacgtgagcagaaaggcgtgacgcaaaaagggctggtcatcaggcaacagcgcatcccactcggcggccgggatctccgccagtgacgtcaggtgaatcagcgacatgaattactccagagaacgtcgggcagagagtcagtcaagcaggttttccgcgtcagcgaaagggttaaggcacgcaaagtgaaggctgcatcagcggagcccagcttctatactgcgactttatctccacaggacaccgccatggatcgactcgattgtgaccggatgtttgtcacggtgctggaaaccgggagcttttctgcggcggcgttgcgtctcggcaccagcagcagtcaggcttccaagctggtttcaaagctggagcagcggctcggcgtccagctgtttaagcgcagcacgcgcgccctgtcacccaccgatgtcgggcgcagctattatgagcgggtcaaaaacctgctcgatgcgtttgagacgctggatgccagcgtgcgtgaaagcgctacgacgcctaccggcaggctgaaaatcagcgcccccggctcctttggtactgtggtgttgtctgaggtgctggtggcgtttgcccggcgctatccgctgattgaactggatgtcagcttttcagaccggtccgtcaacatcgtcgatgaaggctttgatatggcgatccgtatcggcaccctcagcgacagcagcctggtcgcgcgcaagctgggtgaagtgcatgtgcgcatcgccgcctcgccggtctatcttgagcagtttggcacgccgcagcactggcgcgagatgccccagcatcagtgcatcatcgacaccaattttcgcgatccctggcactggccgtttgccggcggcgacggcgacggcgacggcgacggcgacggcgacggcagcgagattgtcaccgtaccggtccgcgggcgtctgcgcttcgccaacaccgaagcctgcctgcaggccgcgatggccggactgggcattgcgcggctgcccggttttatcgcggctcccgcgctgcaacgcggtgagattgtccggctgctggagaattttgacacgccaccgcttggcctgtttgcggtttatccgcccgcccgtcatctggcacaccgggcgcgcctgcttatcgacttgctggtgagccactttacccgttttccgcccgcgtaatttcttccagaatggaagaaatgattgtctttatgaccggattatcagccgtttagtcatcagttaagctgcttctcacattacagaggagtcgcgcgatgttagtagaaggcaaatggagtagtgactggcacccggtgcagtcgaccgataaacagggcggatttgttcgtcagacgtccggtttccgggattttatcagcagcgatggctccactgaatttgcggcagaagcggatcgctaccatctctatgtggcgctgatctgtccatgggcgtcgcgcgcgttaattgcccgcaagctcaaagggctggagtcgctgattagcgtgacggtggttgaaccgcagctcggtgcccagggctggcgctttggcaattttcccggcgcacagcaggacccgctgaatcacgcgcagtacctgcatgaaatctatacccgcgtcgcgcccgattacacgggccgggccaccgtgccggtcttgtgggacaagaaaaccggcaccatcgtcagcaacgagtccgctgacattgtgcgtatgttcaacagcggctttggcgatctggccgataaccgcatcgacctctatcccgccgcgctgcgccctgagattgatgcgctgaatgagagtctttatccgcgtctgaataacggcgtttaccgcgccgggttcgccaccacatcgatcggctaccagcaggcatttaatgacgtcttcagccagctcgacgaactggaagccctgctcagcgatggacgcaccttcctgctgggtgaacggctgactgaaaccgatattcgcctgtttcgtcaccctgattcgctttgacgtcgcctatcatggcctgttcaaatgcaacctgcgccggatacgcgactatacgctgctgaatcgctatcttaagagcgtgctgtcagtctccggcgtgcgtgagacggtcagcatcgatcatatcaaacagggttactactcaatcaaggcactgaacccgaacgggatcgttccggcaggcccggatctgagtgagtacggtctttaaaggagcaataatggcaaaagcactggtgatttttctgcatggcgtaggcagtaacggcgacgatctggcaccgattggccgtcactgggcgacgctgttgccggatgtgatttttgcctcacccaatgcgcccgaacgttttaccgccggttttggctggcagtggttcagcctggaggaggtgacgccagagaaccggccaggtcgggtacgggccgcgcgggcggcgtttgacgcgaccctcagcgacgttatcgcacagcacggcttcgccgaccgctggcaggatgtggtgctggtcggcttttcacaggggtcgatcatggcgctggatgcgctggcatctggccgttatccgctggcgggcgtggtcgccttttcgggtcgtctggcggttgacggtgaactgacgccacagcctcatctgcccgcgctgctgatccacggccaggccgatgaggtgatcccgtggcaggagagcgaatctgccgcagcacgactcagagccgcattggtgccggtagaagcgcgatttgaacccgccaccggccacaccatctccgctcagggtgccatgcacgccgccgcgtttatcgggcagtgcttacaggattaaccccagcagcgctttaatgcctgccaggcatgacgggcagcaacctcaggcggcaggcgtttcagcgcatcattaaagacttcaatgcccaccggcccctgatagcccgcgcttttgagcttatcgacaaagcgttcaatgtcgataatgccatcgccgggcagcagacgctggtgcttcgccatcgccatcaggctctgcttatcctgcgcgggaacggcggccatgtcacacagctgcacttcatagatgcgatcggccggaatgccgtccagttgcgaggcatcgccgcccagcgcgcagatatgaaacaggtcgaccaccagcccgatattgggctgatcgagccgctgcaatcgctgccacgccagcggcagggtgttatccacgctgcaccaggccatcggctcatacataatgcgcatgttgtagcgcgcagcttcagaggccatccagcgcaggtcatcatcaatctggtcggcgcagcaatcctcacgggtgctggccggcgcctgaatggtgtcgcagcccagcgcctgggcaatctgaataaactggcgcagctcttcgcgcttctgtccgcgcaacgcgctgggtgccccggtgaaatcgcgcagcacctggagattggtaaagccaggtccctgccgggcagcgatctcagccagtgccgccgcgccgccctcgcacgcctcgacatcctcgcgccagatctccacctgatcgaaaccggcgtcatgcgccgcctggagcttctggccgggttcaccgtttaacagcaccaggttaaggaatgtggggttagttcgcattgctcggctccttaatcgtccggaataatcggtgacgttcagcttctgcgcccgttcatgcaggatggtcgggcgtaaaacctgaaacagtatctacctcttaaggagtatgacaagcgccgcttagccggatcagcccagcatcgtgaccagtgcgaaaccggcaaacgccatcagcagcgaaccgatcacatgcaccagcgcgctggtcatcgcccagaaatagttccctgattgtagcaaccccattaattccgccgtaaaagaggagaaggtggtcagcccgccgcacagtccggtgacgatcagcagtttccagaatgggtcgaggtcgggatggcgaacaaaccaggccatcgcgccgccgatcaccagaccgccgatcagattcaccagcagcgtgcccggcggcagattgggaaagagcgcattaaagcgcatcgcaaagagccagcgcagtacacagccggcagagccgccgatcatcacagccaataacggtttcaacatgtcttgctcctgattgcagattgacgccgggctgagggggaaaggcagagataaactgcgcctgacacctcagctcccgcgaaaggattgagtgtcaggcgtcatcagccggtgtaaagcccaccggcggttgggaaaggtggcacgccatcaccttgagccggtgataatacgacgcccgtttcaggctggcaacagtgaggtcatggcggctgaaaaccttgacgcgcacgccacagacggagtaatgctgatggtttacagcctattgcggagaccctatgcgtaccctgatttttgataccgatatcggcgtggatgacgcctttgcgctggcctatgcggcgcggacgcagcatctgctggggattaccacggtcttcggcaacgtggcagtgggtcaggcggtgaaaaacgcccgactgttttgcgggaaaatggcgattaacgcggaggtctatcgcggctgttcacgaccgctggcgctgccaccctctgcgcccgccagactgcacggtgaagatgggctgggcgatgcgtttgataatgcctgcagcgatcaggcgccgggcgcggtgcagtttattatcgacagcgtgcgggcgcagccgcatcagatcaccctggtggcgattggtccgctgaccaatatcgccacggccattaatcaggcgccggatattattccgctggtgaaagagctggtgatcatgggcggcgcatttggcaccgacgggcacagtggcaacgtgacgcccttcagcgaatttaatatctggaaagatccgcatgctgccgatcaggtgctcgcctcggcgctgaacgtggtggtgatcccgctggatgtcacacacaaggtgctgatcagcggcgatgaggttcagcgtctgaatcagccggtgctgagtgcgatctgtcgcccttacctggcttacagtctggagaaagagggattcgagggtatggcgctgcacgacaccctggcggtggcgtggctcactctgccacaggcgtttaccctgaccgaaagcccgcttcgggtgatcacggagggcatcgcctgcggtcagacggtgcgtaagctgagcgcgctggcctcccgccaggatccctttaacggcctgcccgcccagcgtatcgcacttggcgtggatgctgacgcggtgcgggcgcacttctttcagaccctcaccgcgccctgaaccacgcgaaccgactggccgcgttaccggtcgaaatgaatcacgcctttgatcagctcgcggttgttgatgatttgcgcctcaaaggtttcatccagcgtggagaaggccagatggtgattcagcatcatttcggcgcgcagctggccgctggccatcagcgcacgcacccgatcgaaatcttcacggatggcgttgcggctgcccatcagggtggtctcttttttatggaattcactgtccgggatcaccagatcgcctttgtgcaggccgacataaacgatcgtgccgccgtgtcgcatcaggttgaccgcattgttcatcgccgccgggctgccggtggcgtcgatcaccttcagcgccagacggccaccaaactcctcgcgcagcgcgctgtaaaacgcttcatcagccggattcagtgccgccaggccgagctggtcagcaacatgctggcgacgaaattcgctggtatccgcgaccaccacctgcgcgccgctggcggcggcgatagcggcaacacccagcccaatcggtccggcacccaccaccagcacctgctcatccgccacaattgcggcacgacgcactgcatgggcgctgatggcaaatggctcaatcaacgcagccgcttccggcgcgacatcatccaccgccagcagcgtgctgaccggcacgctcaggtagtcgcagaacccgccatcctgatgcacaccaatcactgagatctgctcacagcagttggtcttgccgctctggcaggcgtcacagcgcaggcaggagatgtaaggcattaacgctacccgctggcccggctgaaagtcctccgcatcacttcccggcgccacgacttcggcacagatttcatggcccagcacccgtggatagctgaagaatggctgattaccggaccaggcgtggatgtcggtgccgcagattcccgcggtgaggattttaatgactacctcgccagcggcgggcgtggggatatcgcgggtggtccataccatcttacgtggttcagcgatgaccagtgctttcattgttgtcatggtgattctccggttgtcctgcaggcagttatggcaaatcctgcacgcgctgcggtgttcgtttgcgggaagtgtgaagcaccgcgatttttttgggctttgaatggtttttaatgcataaaaaaccggagagtgagatgagccgcagccagaatttgcgccagaaacgtcatcaaccagatgctggaaagcatcgctcagcaccacattcgttcaccgctgccgccccaggcagcactggcggaaatgttcaatatcagccggactacggtgcgccacaccctgcactatctgcatcagtgcggcgtgctggataaggtggatcaaacctgggttatcgtgcgcgatccgcgcgaagatgacggttttagcgcgttaacgccgccgattgagcagcaggccagccactttgagcagatgttttttaatatgattaatcagcggcagctggtgcccggcgataccttcagcgagctgcaactggcgcagcaggtgaaagtcagtccggtggtggtgcgcgaattcctgctgcgctttatgcgctatgacctgctggagccggtcagacgcggccagtggcggatgaaaaaattcacccaggattacgccgagaagctgtttgaactgcgcgagatgctggaaacccacgccctgagccgcttcctgaatctgcccgcaggcgacgagcgctgggttcaggcgcgggatctgctggatcgtcaccgatcgatgcgcgacaccatcgccagcaactatcgccactttgccgcactggatcgtcagatgcattcgctgattttatccgccgccaacaacccgtttttcaatcagtcgctggagattatctcggtgatctttcactcgcattatcagtgggacgagagcgacctcaagcagcgaaatattgtggcgctggaggagcatatggcgattctgaccgcgctgattggccgtcaggatgtcgacgccctctgtgcattacataaccatctggcgaccgctaaaacctcgatggtgcgctcaatcggtcagtacaattaaaaaccgattaaaaaccacaaagcattagctcccgcacgattcagaaacatctttgcaacatccttaaccctttgctcttagtctcgactgcaacgtcacggcggccttttgccgctgcgcgcagaccccttctcaccataacgataagtacccagtttcgggagagtgcaatggaaaagacttcagtaaccggccgcgacagcgcagctggcgacacgccatcagaccaggatttcgtgccgatgcgtagcgacgtggtgcgttcaccgcgtatccgcaagattcagatcacggcgatgctgctgttgctgtttcgccgccatcatcaactatctggatcgcagctcgctgtcggtcgcgaatatgaccatccgcgaggagatggggctgagcgccaccgaaatcggcttcctgctctccgccttttcgctggcttacggcctggcgcaactgccgtgcggcgcgctgctggatcgtaaagggccgcgcattatgctcggcattggcatgtttatctggtcgctgttccaggccgcctctggcctggtgcataactttacccagttcatcctggtgcgcatcggcctcggcattggtgaagcgccgatgaacccgtgcggcgtgaaagtgatcaacgactggttcaacattaaagatcgcggcatgccgatggggatgttcaatgcggcttcgatgattggactgtcggtggctccgccgattctggcggcgatgatgctggtgatgggctggcgtggcatgtttgtcacgatcggtatcctcggcatgttcctcgctatcggctggtatatgatctaccgcgaccgcgacaacaacaccctgagcgctgaagagatccactatctgcaggcgggcagcgtcgcctcgcgtaaagagccgatcagcttcaaagagtggcgcggcctgtttaagcagcgcaccatgtggggaatgatgattggcttcagcggcatcaactacaccgcctggctctatatcgcgtggctgccgggctatctgcagtcgacctatcatctcgatcttaaaagtaccggcctgctggcggcgattccgttcctgttcggtgcggcgggcatgctgctgaatggctatgtggtcgactcgctggtacgtcgcggctttaacgcggtgaaaacccgaaaagtctgcatcgtcagcgggatgctgctgtccgccggctttaccgccgtggtgacccgcgcgaccgacaccaccagcgcggtaacgctgattgggatggcgctgttctgtatccacttcgccggaacgtcgtgctggggattgatccacgctaacgtcaccgcccgtatgacagcgtctgtcggcagcatccagaacttcgccagctttatcttcgcctcgttcgcgcccgtcatcaccggctgggtgctcgacaccaccaaatcgttcagcatggcgctgatgatttgtgcctgcgtgacgctggttggcgcactcgcctacctgctgctggtgcgccagccgatcaccgacggcgaataatcacgactgacggcgcgactgttacgtcagcgccgtcagggtgaccccatgtttcgcaccataacgctgaatacccgtcatcaccttctccgcgctcagcgcgggtggaggtggcaacagcggtgcccgttcacgcagcgccgagtcgaaacgggcaaacgtcgcgaaatcacgcgggaaacgttcttcatccaccccgatgaatacgccttcatcacgtgcatgggagagcagcgcccgccagcggtcaatctccgccagcccgatgctgtcggtgccgtgagaaaaaagcatcatgtcgatgttgcggaacggcggctgtttttccaggaagcgttgcagggccgcggccgaaggctcggtgcaaaagaccagccagaacgggatggcgtgctgatgcatgctgcaccacgggtccatcagcaggaagctgtccaccgtcagccgggtcggtaaaattcccgccgccagataccagtcgcggtagatctctgccaccacatagctcatcgcctctggatcttcataacgaatctccatcagcttccagttctgagcttccgccagttttttcagcggcgaaatcagataaccatccagtccccactccgcttccggcacgtggtcagtaatggccggcggcgtccagcgctcgcgatcgatgccatagcgtgccagatattccgccacccgcgggccaccctgtaagtactctttttcggttgcgccgccgagcgcaccaaactggaaaaacgagcggtcgctggtgcgggttaccggccactgtcgggtacaatgattgataaacagcgttgatccggcgggcagacttcccatcaggaattcgttgaaggccagcggcagctcgcgcagttttagccggaagtagcgcatctgatcgagcatcaaccgatcctgattcgggtcctgcatatggtgcaccgccagccgtggccaggcagccagcagcgcggcagcaatctctttgccctgctcaaagctggtctgtgcatcatcgggatcgttattcgcggcccgcaccgggcaaagaaaagtctggggcaaccagggcacacccatcgccgccgccagatgcaccagtgcaccgttcgatgaaccgataaaggccgccggataatcctgttgcgggtattcactcaccatccattcggcgatcccttccacatccagttcacccgcctggcgcaggctgatgccttctgccatgccgcccagcgcatagccccactcacgcagtccggtcggtagccggttcagtgagggcaacaggcgatccagcgtcggtgactggctggggctggcaaaggggcggtcgtgcagcgcattggccagcgcaagcagcatggcggcagcagagtcaaagcgggcaatccctcttggtggtttactcatgttgatcctcctgctggatacgtgccaggaacgggcggatggcgtgacagaaactccacgggtagacgtagtgcaaagtgtgcgtcccgtcgcgtaatgtcagtctttcgctgcgcggcatcagggcggcgagttcatccagccagcgggccggacagacgggatcgcgcgagccccgcagcagcaacgtgggtgcgttaatgtaagtaaggcgatgctcaatgcggtcgcgcatcatggcgcgcagggtaccgaaggcgcgccgcaggcccgctttggcgtaatcgattcgggccagtggccccggtggacgacgggattccagccggccattacgccagtcgcgccagagctgacgcggcagactgcgggcatgacgatcgaccgtcggcccctgcagcaccagtcccgccacagcctgtggatgtttcaccgccagcgcggccagaatctggcagccaaacgaattgccgacccagatagcgcgctggaaaccgttatgctgtaaccacagccacagcgcatccgccagctgatccaccgacatgatcggcgcagaaggtggcagtgtgctggcgccaaaaccgggcagatccggcaccagcacgtgatagtcgcgccccagcgccagcgccagtggctccatcgcccggcccgacatcaccagaccgtggatcagcacgaccggcagtccctgagcctcattgggcgtaacgcgggtaaacatgcgccagtcaccaatctgctgataataaccggccagaccggcgtgatgactgtttcggcgacaccggcggcgtctccttaagctgccgccagcgtttcatgccccataacgtggccgccacacccaatccaacacctgccacaatcgctgcctgttttcgtcgatgcttctggatcatccgctgctcctggtttggggagaataattcagtgtaggtcgggatcaggcagcaggcgggttatcggcgcgatggtgtgaaaaagtatggggtttcgcctaagaagacgctggcattgcgggtgatgaactctggcgggggatgtgtctggtgtaagcgggaaggcaatgacggcagtgaatgatgtgtgtacgctgtgagcgagaagcggacatgagagatataattaatccgccatgagaatctcagattcccaggacttattaacccggtgaatgacgccattaaaagggagacagggtggcaatcgatcacaacggctttattgccctgccagaaaccaataaattgcagccagagttccggaatattgttgcacaggtcgtggcaaagctaatccaaagttttcctgagcttatacatagcctttatttgtatggcagtgtggctgaaggccgggcaaaaatcgggacgtccgatctggatatgacagtcatatttagcgttgatcccggcgaagcggctaaagtgcaaattactgaaatacaacgtaaacttgaaaaaaataatcctgttgtcagtaaaatcgattttgattgtggtctgttacaacaggtagtgcatccggataatctgcttagctggggatactggctcaaacatcactgtgtctgcgtttacggagaggacctgagtcaacgattccaggcatttaaaccttcaaaagaaattgctgtagcagtgaatggtgacttcctgccggtgctggaaaaattaataactcaaatgcagttatctgctgacgaaaataaaaagttgcagctacagcgtgctgctgcacgaaagacaatcagagcaaccaatattcttcgcagtgaacatgacaaacagtggcctgaaacactcgaggagtatcgctttacattcaatgcccgatatccagcgttagcaaaagaaatggattacttgctggcaatcagtaatacgcctcaggggagcatcgctgatttcaaaaggcgcgttatggcttttgcccgatggcttaacgtaacatttcatcacgggcaaggcttatgaagggaggattaacatctgggtagcctgataaacgcggagcaggtcaacggaccagagataatacgaatttcaggcaataaaaaacccgcactgggcgggtttcttttattatcagcagatcttatctgctcagacttatgtcttcatcgctattgtaagcgtcgctgataatgagcgcggtttactgcgctgtgacgttgccagctgcagggcctttggcgccattttcaatggtgaaggagactttctgaccttcatcaagcgttttgtagttatcaccctggatagcagagaaatgcacgaatacatctttgctgccatcatcgggagtgataaagccaaaacctttatctgagttaaaccattttactaaaccagtcattttgttagacatagatatttccttaatcgattagccactaagagcggcgaagatggcctgtagttagagatttacttattgggcacttaggaggaggctctcgaagaaggatatctgtggataacacttgaactgaggactactttactaaaactgctttcataaggtctgtgttccaaaccgatgacgcattaagacatagcgataataatttagcaatgtatatgtttatttattttaaccatttaaacgctcagatggctgaatggctgttttattttgactgctcaggaagtgcttcaggctccgctgtgtgcgaagaggagcaggctaatcctgtcataatgacggtgccgatttaacgttgatgcttaacaataaacagagccagtaaggtcacattgcgtaaaaatttccgcacggccagtgaagcgctgtcatcaccctcttcatctgtgagctttacctgctgcatgtcgaacgcccggctcttcggtatctttcatcctgataccggtcagtatccggacgacctgcccgccctcaccctgcatctgaaatgctggagatttgccacccgcctccattctggtgcagaagcagcctgccgcgatgagcgagaagcgggctaaaccctacctgtccgcccattttgggcatgctgactgtctcagtgaccgtgaacggtcaatcctacgagccggataacaacaggacggacaaccagtatgcaaaagaaagccgctggcatggcgacacggtaagcattcatcacatttgtcatgtaatgaggccccattccgaattcggctaacgtgatgaccagactcatcaggaacgccatgatgatcgccatataaagcgcaaatatgtaaggtgtcgtgcgcaccggcaagcgggttcgtaaggttttttttgttgcagcatcagtcatctgaatatcctgtttaacaaaagtagataagactgtggctaacttaacaagcttatgcggggggttgtagagcggttatgctttaatcattattaagtaaaagtgacgaattaacggttgaggatacgatggacattttagggctgattagcacttttattcgcgtggtggaaaacggcagtattgcagcggcggcacgcgctaaaggtatgagtccggcagcagtcagccagagtctttcccgtcttgaagcgcatctgggcgtgcgactgctatcgcgcaccacccgcagcatgaccttaacggaaaacggtaaacgctatttcgagaaagtccgtcacatcccacaggatatcgaactcgcctctcaggctgctgcgaatgaaaccaaaccgcagggcccactttgtatcgccacaacagccgcgtttggtcggtacgttctggctccccttatgcccgctttcaaagcgtctttccccgatatagatattgaactgatcagtaccgatcgcaacgtcgatcatcgcctggaaggcgtcgatgtcagtatccgcatcgaagcacagctgaatgatcaactaatcgccagaaaaattgcatcgttaccctttatattctgtgcggctcccgcttaccttgatcgcgctggtacgcctcagacgcctggagaacttagccagcacgcctgcctggttttccgctatcccaccgacagacggtttctgccatggacgtttatggtcaacggacagcctgttaatgcaaaacttaaccccagttttatcagcgatgatattgatatcatcgccagaatagccgtaaacggcggcggcattgcccgtctggcaagttttgttgctcagccactgatagacagcggtctgctaaggcctttgtcctggtcaggtcacagtggcgagagcaccattgagtccctgccgatgaatatctatgcctgtgtcaccgaaacgttcggcactcaattcgaaagtacggacatttattgaatttgtggccgatgcgatttaagacaggagcgtttttgccgggcgaaaattgtccgtacttttcggcttatccacccgcaaaagtaattcaccgctgccggtcgcggttatacagaaagcggcccttttgacgatgtgcagaaaggatataagtacgctttgagaaggggtttaacgcggtgagaatgggatccgaaagtatctggcagtcggtgaaaactgccagaattgaggaataaaaattcgttatcagtcactaattctgatgacgattttgccaaatgcaccacgggagagatgccggaaggcttcaaccgcctcattaaagctgtaaacctgttcaatgacgggtttaatattatgtttattgaggaacggattcatccgatcaaacgaggagcgtggtgcaaccgcaatgccccggatttttgtctgacggaaaattaacggcatcaaatcaagctgtgctgtctggccggtcagaaatcctacctgagcaatcgtaccggcaacttttgtcgcagcaattgactgattgatgccattgcccccggcgacatctatcgttacgtcagcgcctttaccatcagtcatttcaagcacttttctttcccactcagggtattttttatagttaatcccttcatctgctcccagtgatttaatgcgctcaaggtttgcatcgttactggaggtggcaatgacacgtgcaccataggcatgcgctatctgagcagcgaagaccgatacgccaccggtttccctgtacgagcacggtctgaccgggctgcagattgccgatatccattagcgagtaccatgccgtaagcgcagcgatgggaagtgtagaagcttcttcatcggtcatgctgtcaggcgctttaactgcgctgtcctcatgaataatcatgtactcagccagcccgccgggtaacggcattccaatacaccatgctggctcatcggccgcaggttcaccctctaaccagcgtgaatagagatgcgagttaacgcgatcacccgtgctaaaacgggacacaccctgccccgtggcaacaacggtacccgtggcatcagagacaggaatcagtggctttggaaccagatgaggctcatagaagccctctactattgccttatccctgaagttcagagacaccgcgccaactttaaccagaagttcacccggaccaggtacaggcgtttccacctcttcaagctttaagttttcaaggccaaaatctttcagtaaccatgctttcattttgtcatttcccatgtgtatgcatcgaataggacgatgataaaaaaagcagggaggcgtaaaaagccacgtaaaaggacttcagtgttactgcaggagaaacaatcggaatgagatataatccgcaatacactatttcggcaggaatattttttgcggagttaaatgatgcgctcgaacatgctggaattgatggatatttttgttcacgtcgttgaattccgtagtttcacccgggccgctgacgccttgcagctgcatcgccctgcggtcagtaagtccgtacaacaactggaagacaagcttggcgttaagctattgcaccgcaccacgcgcagtctgagtgtgaccgttgaaggggaggaaatttatcagcgggctaaaacgctgctgagtgatgccagcgatatcatggcttcttactcttcaaatcagcgacctcgtgggcagctgcgcattgatgttccactggcgctggcgcacagtatcctgatcccacaattaagcgagtttcaggctttatatcctgaaattgaaatagtcttaaccgcttcagatcgcctgacccatttaatcacagagggtgtggactgtgttattcgtctcggtgagcttgctgattcgaattttatttcgcgcagaatgggcagcctgcagatggtcacctgtgcagcaccctcttatctggataaatatggcactcctttaacacctgatgaccttaaagatcataaagccatttatttttttaatgaacacagtcgggacgtccaggaatggaaatttgtcatgaatggcgaaattgtttcacggcatccgggaagcagcgtacgagttaacaattctgacgtccttctttcctgtggcgtggcgggcctcggcatgcttcacgcattatatacggcattaaagccctgcctcgaaacaggccagctgaaggaagtattatcgggttatgcgactgtgacgaaaccggtttcaatactctaccctgaccgacgctatcttccgcctaaggtccgggtctttatcgaatggtttactgaaatattcaggaagaatcatcagggttaaccgtgaatctttgtttcggcacaggcaatcccgtgacccattaaaagtgcttgtttcctgtttaaggtatgccgccattttgtctggcatccggaaatctcccgggcagattagatcactgcagcaacgtcttttctggctcaaagtgacgcataacgggaaaatcagaaggagaggagtagcaacaaacaggatgcacccgaagtgcaaaaacgcgggtttaaatcagcagaagcaaaggcagaaaaagcagaaaaggtgataatcacaggtcgatccctgaccgcgattatcgagggtttcttgcggggtgcttagtacatggcacccggcggtacgtgtttgaaacgtctcaacgtaagcgcggaacacgtgtttaaaaatacgtttcatggaacacctgattcaaatttagttgaacatataccgaaaaagtatagctcctgcgcgttttaacagcaaataaatttgaaccagatcacaaaaatgacggttttatgtgcaaaagccctacgcggtgtagccgagatgctgcaacagaatggtagagccgacggcaatcagcactactccacccaacacttccgcccatttgcccagaatcggaccgataaagcgcccgactaatacgccagtcgtcgccatcaccgtagtggctgcaccaatggtcagcgcggtagtaatgatgttcacctgcaggaaagccagacccacaccaacagccagcgcatccaggctggtcgctaccgcggtggtcgccagtaccataaagccatggctttgcggggcttcacagggttctgcaacagcagtctgacggaagccttccatcatcatacggccacccagaaacgccagcaggatgaaggcaacccagtgatcccacgccatgatgtaacggctggcggccaggccaagcgcccagccaatcagcggcgtcagcgcttcaattgagccgaaaatcagaccggtacgcagcgcttctttaaaaccgggacgatgcaacgtggcacctttgcccagagcagcagcaaacgcgtccatcgacatgcccagcgcaagaattaaagtggcaataaaggtcatgatttattcacctggggcgaaaaagcggcaattcacgctgaattcaccacacaaagtgttcagttatgaaaaagtgggcgcagtctaccatgcaaacccaaagataaaaagacagtaaaatcagggatttaagtatagcaaaggctataactcttatcatccgctatgaatcgagctaagtcgatggtagcaaagcgttttctgaccattcctctggccatgtagcatgccggatgcgcacgaagcagcgcgccaccattgaaccgtgtcgccgtttaccggaaaatgccgggctgataaatatgggataccggttatgaataacccttttgaaacgttgatcgtgcctggtggcattttattgctgggctttctctcggcgctgctgctgcccgcgcccgcctttagcgtgacggtagcgcagcatctgttgcagatgttccatttgcaggacctgaatcagctttacacggtggtgttttgcgtctggtttttgctgctgggcgcactggagttttttgttatccgttttatctggcgtcgctggttcaggggctgaccgcctgcgcatcgaccagcgcctttagccgttcggcactgcgcgcataaccttcacgtggcagatgtgccgcccccagcaacaggcccgcaccgcgctgatccgcctgctgataccagatcgacagcggcgacggtgccatgccccactccaccgcctgctgcgcaatcacctgatccggtgaaccggcgggtaaacggacaatcaccgccagcccggcgcgttgcaggtcaggaaagtgaggatgcagcgccgcgatcatctgctccagccgctcatgatagacgcgcttcatgcgccgcagatgccgcataaagtggccatcccgcagaaattccgccaccgcgttgtgcagcaatccggaggaggcaggcgaaagcaacgcgcagacctcaccgaatcgggccatcagcgcgggtggcaccaccataaaaccgagacgcagttgcggcgtcagcgtcttgctgaacgtgccgatgtgcaacacccgcccctggctgtcgagcgcggccagtgccggcgcggcgcgattgccgggctgaagctctccgagatagtcatcttcgataatccagcgctgcgtgcggctggcccagttaagcagggcatgccggcgtgccaggctcatcgtcatgccaagcggcgcctgctgtcccggtgtgaccagcgcaaaagcggcatccggcgcgcgggcaatcccggcctcaacctgcaacccttcggcatcaaccggcacggcaaccggcgtgacgcgcagcgcttcaaccgcgcgacgcgccacccaaaatccgggatcttccagccatgctgttttaccctgaaaattcatcgccagcccaatcagtcccattgcgccagcatagccgctggtaataataatctggtccgcctgacagcgcaggccgcgtgccaccgccaggtaggccaccagcgcctgccgcaacgctaagctgccgcggggatcgggatagctggccggtctgctgacctgcatgcgcgtctgatgctgcagaatgcgcagccagactttggccgggaatgcatcgctggcaggaatgcccatctggaaggtcagcggtggcgcttcatactcctctgcaccctccagcagctggcgttcagcctcggcattgaccggttttaacggcggtaatgggctgacgaaggtacccgctgcgcctctggcctgcagaaactgaccatcaaccagcatgtcataactggcgcgaacggtgccacgcgccacgccgagctgagcggccagatcgcggcaagaaggcagacgtgcgccaggttgtaaacgtccttcaccaatcgcctgttcaataaactggcgcagttgttcactgaggccacgtgacgcgccgcgctgcagtgtcagcgtggaaagcggcgatggaccagtcagactctcattttttggcactttatctgctccattgaaaggctgaaaatcgccttatcaaccctgaatgaggcaataagatgagcgaacgtatcgattttcacagtgcagcaccggcaggcatgaaagcgctgggcggcgtatacagttatctggcacaaaccgatctgccgctcactttactggaactgctgttccttcgcatatcgcagattaatggctgtgcctactgcattgatttacataccaaagcactgaataaagcgggcatgggctgggataagatcgtgctgacctcggtctggcaggaatccggtacgctgttcagtgataaagagaaggctgccctgcactgggctgaatgcctgaccctgattgctcagcagggtgcgccagacggccgctataccgcactgaaagcgcacttcagtgaaaaagagattgtcgatctgaacatcgcgattggtctgatgaacacctacaaccgcatggcgataagtctgaaaaagttgcccgccagcgccagtcagtcataagtgaatccgatgcgtgcgccggtgtgcacgcattttcagactcacaaaaatgtaacattatttttacacaagcagcctttcagcctctcttcccccgattcccgttattccttactgcataataaatcgctaaatttcagcgaattaaataattccgcacggttcatatccattccgtcgttgcaccagcatggggcttttcagcaacatgccatttccgttaacccactgacttcacactaaaaaacccctaatacgccgctggccctgatgattaattcttatgctgaatcatttctgcatttaaaaaataaacaaatgtttaattcagatgcgagaatgttatattcagatgacaaagcataacgtgcagttaacgcgttattaccgctttaaccctatacctgagacttaacctttgagaaatagcgcaacgcgctcgtaagaagcgtgactatttcgcctgcaaaactgttgggcttcaggtcaacagaagaggagatgtcgcctcatgtgcaattcagctgtaaaccttgcgctcgcgatgagtgccatggcaaaggacaccactactaccgcgcaggagcgcaaagacgttgacgtgctgctgattggcgcaggtgtgatgagcgccaccctcggcgcgtggctgcaggatttagagccggactggtccatcgaaatggtggagcggctggatagcgtggccgaagagtcgtccaacggctggaataacgcgggcaccggtcatgcggcgctggcagagctgaactatacgcctcagcaggcggatggcagcatcgacatctctaaagcggtgacgatcaacgaatcgttccagatttcccgccagtttctgggcttatcaggtccagaaaggcaacctgcgcaaccctaaaagctttattcacagcacgccgcacatgagctttgtctggggtgacgacaatgtcgactttctgcgcaagcgctttaaggcgctgcagaaaagcaccctgttccgtggcatggcctactccgaagatccgcagcagattgcccgctggatcccgctggtgatgaatggccgtgaccgcagccagaaagtggccgcgacctggacggagatgggcaccgatgtgaacttcggtgaaataacccgtcagctgatcgcctcgctagagaagaaagcgaatttccagctgcgtctgcgccaggaagtgcgtgagctgaagcagctcgccgacggtcgctggcaggtgacgctgcagtgtctgaacagcggcacgcgtcgcacactgacggcgggtagaatatttatcggtgctggcggcgcagcgttaccgctgttgcagaaggctggcatcccggaagccaacggttacgctggtttcccggtgggcggttcattcctggtaacggaaaatccgcaggtcgtcgcgcagcacatggctaaggtctatggcaaagccagcgtcggtgcgccgccgatgtccgtgccgcacgtcgacacccgcgtgctggatggcaagcaggtgctgctgtttggcccgttcgccaccttctcgactaagttcctgaagcagggttcgctgatggatatgttcacctcactgaacagcagcaatatgctgccgatggtgaaagtggggctgaaaagttttgatctggtgaaatacctgatggatcaggtgctgcaaagcgatcgcgaccggatggacgccctgcgcgcctatgtgccgcaggcgaagcaggaggactggcgcttagtgactgccggtcagcgtgtgcagatcatcaagaaagatgagaaagagggcgccgtgttacgcctgggcaccgaagtggtcgcctcacaggatggctcgatttcagcactgctgggtgcatcgcctggcgcctctacggcggcaccgatcatgctggagctgctgcacaaggtctgtcctgagcagatggcttcgccggaatggcagaacaaaatccgtacggtgatcccatcctggggacgtaagctgaacggcgacgtagcgctgacagagaaagtgttagccgaaaccagccggattctgcagctcgactattcgccggttaccccgatggcagcaaacgatgaaggacgggaaaccgcgttcgtcgtcggcaaataattcagcgccattgataaaaaggctccgcactgcggggccttttttattggccggttacctggttgatccgggcattctctattagggttaaggcatcttttagctgcacgatcaggaggaaactgcatgtcttactcccctgcttcaccggaattcacgctgctcgaccgctactggcgggcagcaaactacctctccgtcggacaaatttacctgatggataacccgctgttgcgtgagccactcaggcctgaacacattaaaccgcgtctgctgggtcactggggcactacgccaggcctgaattttatctatgcccacctcaaccgcgttatccggaagcaaaacctggatatgatctacatctgcggaccaggacatggcggccccggcatggtggcgaatacctggcttgagggcagctacagcgagatttatccgcacatcacgcaggatgcggcgggcatgcagcgtctgttcaaacagttctcctttccggggggcattcccagtcacgcggcaccggaaacgcctggctcgattaatgaaggcggtgaactgggctattcgctctcccatgcgtttggcgcggccttcgataatcccgaactggttgtaccctgcgtgattggcgacggcgaagcggagaccggtccactggcctccagctggcacggcattaaattcctgaatcctgaacgtgacggcgcggtcctgccgattctgcatctcaatggctacaaaatcgccaacccgacgctgctgggtcgcagcagcgatgaagatttgcaccagttgttcagtggctacggctatgagccgctgttcgtctgcgggcatgagcctgaaaaaatgcatccgctgatggcggaggcgctggatagtgccttcagtaaaatcgccgcttatcagcgcgaggcgcgccagggtaaagccaccaccggggtgccgcgctggccaatgattatcctgcgcagccccaaaggctggaccggccccaaaacggtcgacggcaagaaagtggaagatttctggcgggcgcatcaggtgccggtcgcggcctgtcgtgaagatgaaggacatcgccagatccttgagacgtggatgcggagttatcagccagacgacctgtttgatgaacagggtcgcttaaagccggaactgcaggcgctggcaccggaaggtgataaacgcatgggatcttcgccttatgccaatggcggcctgttgcgccgtgagctggatgcgcctgaactcacggagtttgcctgcgatgtcagcgagccaggcgcccagatggcgcaggccactgagcatctgggccgctatctcagcgtgctgttccagcgcaaccgcgataatttccgcctgtttggcccggatgaaaccgcctctaaccgcctgacgccggtcttcgacgtgaccagccgtacctggctggaacgaacagagccttacgatgagcagctggcgcgtgatggccgggtgatggaaattctcagtgagcatcagtgtcagggctggcttgagggctatctgctgaccggccgccacgggctgtttaactgttatgaagcttttatccacatcgtcgattcgatgtttaaccagcacgccaagtggctgaaagtctcgcgtaaactgggctggcgtaagccgatctcgtcgctgaactatctgctctcttcgcacgtctggcgacaggatcacaatggctacagccatcaggatcctggctttatcgatcacgttgccaataaaaaagcggacattgtgcgcatctatctgccgcccgatgccaatacgctgctgtgggttggcgatcactgcctgcgcacctgggaccgcatcaatgtgattgtggcgggcaagcagcctgcgccgcagtggctggatatggcgagtgcggtgacccattgtgaagcgggcatgggcgagtggcgctgggcgggcaccaccccagagcatgaggagccggatgtggtgatggcctgtgccggtgatgtgccgaccatggagacgatggcggcggtggatctgctgcgcggtatgctgcccgaaactgcgtatccgcgtggtgaacgtggtcgatctgctggcgctgcagccgcaggatcagcatccgcatggcaaatctgatgcggaattcgacgtgctgtttactcaggataaaccggtgatcttcgccttccacggttatccgacgctgatacatcgcctgacctattcgcgtaccaactaccgcaacttccatgtgcgcggcttcaatgaagagggaaccaccaccacgccatttgatatgacggtgctgaacgagcttgaccgctatcatctggcgcaggaggcgattctgcgcgtgccgggcctggccgatgcgcatcctgagctgctggacgatctgcaggagcgcatcgctgagcatcatcgctatgtgcgtgaacacggtgaagatgtgccggaggtgcagaactggaaatggccgtcggccacagcacctggtgcacccgattaagcggccagcaaggcgtcggtcagcatccagatggtagtcgccaccagcgacagcgccatcaggctgttgaataactgacgcttccaggcaatctgcagatggctgcgcaggcgatcgcccagcgcagcccagatcagaatgcagggcaggttgagcagcataaagccgatcatcaccgtcagcacgccgctgctggcgctgtacaacagcgccacattggtcgccatcagccaggctttgggattgatcgcctggaaacaggctccgcccagcagcgtcatgggctgcggcttgctgcgcacttcaggtgctgccgcacggaaaatcttccacgagagccacaacagataggcacagcctgccagcgtcagcggcaggcgaatcgccgccatccagtgcagtaagacctccagtgcgacgccggcgatcaccgtttgcagcgcacaacctaccagtatgccaaacaccatcggcagcgtgcggcgcatgccgaaattgacacctgaggtcgccagcagcagattgttcgggcctggcgtaatcgacatgacggtaacgtaactgaagaaagagggatcgagcatggtgactctcctgaaaacagacagagttctatgctacggcggcaaaagggatggtaacagtgacacaaaatcactattgttatggttacagttcccgttaacagcaattgtacccatccaatccggaggctactgtgtcccttgctcccacttccgatcggcctctctatcagcagctggcagacagcttcgctgaggctatccatcagggcacgctgaaacccggcaaacgcctgccggcgatccgccgcgtcgcccagtcacatcaggtcagcgtcaatacggtactgaatgcctggcagttgctggaagatcgcgggctgattgaggcgcgtccccagtcgggctattacgtgcgcggcgtgttgcccgccgtgacccgccatggtcagcataaaacccgggtacgcgaccccagcagcagcaagctcgacctgatcgataaggtatttgcggcgcagaaccatcccgactacatcaatatttccctggcctgcccccaggatagcgagctgtttcctgcggcgcgtattgcccggattaccacctcactgctgcgccgtcatccgaacatgattgggcgctatgcgcttccgcccggtagtgagcgcttacgggaggagattgcgcgacgggcgctgcacgccggacagacgctcaccgccgatgagatcactcttactcacggctgcatggaggcgcttcagctggcgctgcgggcggtcacgcagcccggcgactgcgtcggactggagtcgccgacctactttttcctcttcccgctgctggcttcactgggccttaaggcgctggaaatccccaccgatccgcagcatgggctgtcgctggatgcgctggagatgctgcttcaggagcagcgaattaaggcgctgattgcgatgccgagcgcgcagaaaacccgctgggctgcggcatgtcgctggagaacaagaagcggctggcgaagttagtgaatacttaccacgttccgctgatagaagatgggctgtatgacgagttacagttcgactggccgctctcgcccgcggtaaaagcctttgatcgcgacggctgggtgatctactgcaccagcttcaccaaaaccgtggcgcccgatttccgtattggctggaccgccgctggccgttttcatgatgcgattgcccgactgaaagcggtgtcgtcgatggcagaatctgccctgctctctgaaacgctggcggagtttcttgcttccggtggttatgaccaccatctgcgcacgctgcgccgtcgctacgcggccaacctggatgaggcgcgggggctgatcgcccgctacttcccggagggcacccgcgcgacgctgccgcgcggtggcttcgtcttctgggtcgagttaccgggcagcgtaaataccaccgagatgtttgatcggctgctgcaggagcagatttgcgtcacgcccggcgcgctctattcgctgagcgagcgctacaaccatgcactgcgcctctcctgctgctatccgtttgatgcgcgctacagctgggcgatcagacgcgcgggcgaaatcgcctgtgaactggcgggagtatcctgcggcgaggctcagggtgtgccgttgcgaccccagacggtatagccgtggcgttcagtcaggcgttcgtaataggtgcgtaccgccggataatcagggtgttcgagcggcgtttcaaaccagcggttcaccgccagaccaatcggaatgtctgccagcgtgaaattacgtccggcaacgtagcgaccggttttttccagctgctgattgagaatgctcatggtgtgtgcccagcctttgctggccgcggccagcagacgtggatcctgatgagccggtgaatttcgcaccagcgacataaatgcgtagcgccatgaggtgttgagttcagtggactgccagtccatccactgatcgacaggcgcacgcgtttgcggatgatgaggatagagccactcgccgccataggcattcgccagatagcgcaggatggcgttggattcccacatcacaaagtcatcatctttcagtaccggcaccatcgcattggggttgagtgccataaattcgggcaggtgcgttgagcggaatccatcgccccactcttcgcgctggtaatcaaggtcaagctcgtcacacagccataatactttgcgcacgttgattgaggaggcgcgtcccaggatcgttagcattcacagtctccggtaaaatctttaacttattgataacgctgttagctgttataagcaatcatccggcagagaaaaggccgcactgaacccaatcgcaaggagtcaccatgaaagtcgcgtttaagcaagtcgatgtgtttacctcagcagcctttaatggcaatccgctggcggtgattatggatgctcaggggttgagcgacagccagctggcggcgattgcccgctggactaacctgtcggaaaccacctttgtgctgccgccacaacatgaagaggcggactaccgggtgcgtatttttaccgtggaaggcgaactgccgtttgccggtcatccgacgctgggcaccgcacacgcgctgctggaggcgggctggccaacccgtacgccgggtgaaatcgtgcaggagtgcggcgtcggtaacgtgacggtgaagattaatgagacgggcggactggcctttgccgcgccagctgccaccctgatgccatggcaggatgcgctgatgggtaacgccttaaacagcgatgcattcgatctgacgcaaagcccgaccgtggtggatatgggtatccgctggctgctggtgccgatggtcagcgccgaggccgtgctggcgctgcagcccaatgtcagcgatttgcagcgcctgattaaacatgcgggtgtctcgggcgtgatgccctttggccgtttgccctcgggcgagcatgaacagtatgaagtgcgtggcctgctggtggaaaatggcagcctgaccgaagatccggtgaccggcagcgccaacgcctgtctggcgcggtattttgcagccgcaggccataccacctcctatcgcgtgcgtcagggtactgctctgcagcgtgccggtcgggtgaacgtaacctttaatggtgagaccatctggattggcggtaataccgttaccgtcattgatggcaccattacgctgtaaaaggcggcgacgtcgcggggtgctttccgcgacgccaccagcggttaaatcccctgcccgcctgaggcttcaatacgctgagcggtgatccagccggtttcgtcactgaggatcgcgctgatggcgtcgccgatatcatccggcagtccgacccggcccagcgccgtcagcccagcaatctgatggttaatctcgggggtatcgcgcacccggccaccgccaaagtcagtctctatcgcgccaggtgccaggatattaacgcgaatgcgccgtttcgcccagctccttcgcctgatagcgcgtcagtacctccatcgcccctttcattgacgcataggtcgaggagccaggatagatcagccgggtcagaccgctggagatattcaggatgcggccgccgtcgttgatcagcggcagcagcttctgggtcaggaagtaaggccctttgaaatgcacattaaccagcgcatcaaattccgcctcggtggtgtcggtaaatggcttgtagtgtccgtgtccggcgttgttcactaaatagtcaaagcgctcacgctgccattgctgttgcaatgcctctttcacctgcccgacaaagcgatcgaactgaccggtttcgccgacgtccagcgccagcgccactgcacgtcgtcccagcgcctcgatctccttcaccaccgtctgtgcctcatcggcatggctgcggtaagtcaggataatgtctgtccccctggctgccagttttaacgcgccattacggcctaaaccgcggtttgcaccggtaattaacgccactttctgattcatctctcgcacctgttgaaaaattgaacacaggttaaggatattcgcgaattattgatctataaacagtgttaaatgcgcatcactgtttcaataaaaacaacaatcggtgaacaacatggacaaaattcacgcaatgcaggtgtttgtgcgggtggccgaaatgggcagttttactcgcgcggcagagagtttaggtgtccccaaaggcagcgtttcgcggcagatacaggcgctggagaatcaaatggcaacacgtttgctgcatcgcaccacgcgccgggtgcaactaacccaggacgggttggtctattacgatcgctgtctggatttattgtcgatgattgacgatatggacagcctgttccagcacgagcctgcctcgctcagcggtaaactccggattgatatgtctgtggccatggccaccagttttatcctgccacggctgccggaatttttgcagcactaccccggcgtagagattgagctgagcagcagcgaccgtcaggtagatgtgatccgggaagggtttgactgcgtaatccgcgtcggtgagctcaaagattctggcctgattgcgcgaaaaattggtacccataccttgatcaactgcgccagccctggctacctttcgcgtttcggcatgccgatccggctggaagagctgtcgcagcatgcgatggtgcattacagccagcaactgggtcaggcctcaccgggttttgaatattttgatggcaggcagtgtcactatgttcacaccggcggtgtggtcaccgtgaacagcaccgaaacctatcgcgccgcctgtctggcggggttaggcattattcaggtgccagccgccggaattcagacattactggaaagaggcgagctggtagaagtgctgcatcgctttcccgccagaccgatgccgatccacctgctctatccgcaccggcgcaatgtggcacgtcgcgtgcgggtttttatggagtggctgagtcaggtgttacaggagtacgtcacctgagcggctatactttgattttaatgataaacaggacagtgaaggtctatgacagacaagcaggaaaacccgcaggatacgcagccgcaaaagccgcttatcgatattaaaaccggcaacgagacggttgatcattcgatagtgcgcgtgtcgcgttttgccgcctggtttcaggcgatcccggcagtggcgcattttattcgcgcccttgaccgctttaacgatcggctcggcagccagtttggcgcggccattacctatttctcttttttatcgctgatccccattctgatggtgtcgtttgccgccgtgggttttgtgctggcatcgaaccaggatctgctgaccgatatcatcaacaaaatcgtcagcagcatcagcgacccgacgctggctaccacgctgaagaatacggtaaataccgccattcagcagcgtgccaccgtgggtattaccggtttactgctggcgctctactccggtcttaactggatgggtaacctgcgcgaagcgattcgtgcccagtcgcgcgacgtgtgggaacgcaaaccggatgacaaagagaagatctggaagcgttatattcgcgatttcctgtcgctgaccggtctgatgctggcgctggtgattacgctgtcgctgacctcggtagccggttcggcgcaggcaatgatcgtcagcgcactggggctggacggtatcgactggttacggcccgccctgaccattatcgccacctcgatttccgttatggctaactatctgctgttcctgtggattttctggatcctgccgcgtcataagccgcgtaagaaagcactgttccgcggcacgctgctggcggcaatcggttttgaggtgatcaagtttgtgatgacgctgacgctgccgaagctggcgacctcgccttctggtgcggcctttggttccgtgcttggcctgatggcgtttttctacttcttcgcccgtctgacgctgttctgtgcggcgtggatcgccaccgccaaatataaagacgacccacaaatgcctgaagcgggcagcgcgtcacgacacaaatcatcgtaatccgttaacaacagcggaaaatattacccctcggctattttttaaccagataacaggatgaatagctgaggggtcacttttatttagccctttcgtagagtatcccgccagatatcgtccggattaccccggtatcacccgacattcgtcgcacctcagaaattatcctctttttgcccgctgaagccagacgcggcgcgggttttcttcattgaatgcgctctggcagatgcgtaagattctttgtctgtatttacaaataagaaacagttatgcaagcctccctcacagacacgctcgacaaacagcaggatcccacgccggttaactcacgcagtaaagtggtgattgcctcgctggtcggaacggccatcgagttcttcgacttttatatttatgccactgctgcagtgattgttttcccgcacattttcttcccgcagggtgatgccacggtcgcgacgctacagtcgctggccacctttgctatcgcctttatcgcgcgtccgattggctccgccgtgtttggtcactttggcgatcgcgtgggtcgcaaagccacgctggttgcctcgctgctgaccatggggatctctaccgtggtgattggtctgctgccgggctatgaaaccatcggcgtgatggctccgctgctgctggcgctggcgcgttttggtcagggactgggactgggtggtgaatggggtggcgcagcgctgctggcgacggaaaatgccccggcgaagaagcgtgcgctttacggctccttccctcagctgggtgcgccgattggctttttcttcgctaacggcacttttctgctgctttcgtggctgctgaccgacgagcagtttatgcagtggggctggcgcgtgccgtttattctctctgccgtgctggtgctgattggcctgtatgtgcgcgtttcgctgcatgagagtccggtgtttgccaaagtacagaaagagaagaagcaggttcgggtgcccattgcggcactgctgagcaagcatctgaccgccaccattctcggcacctttatcatgctggcgacctatacgctgttctatatcatgaccgtctattcgatgagctacggcaccacggcagcaccggccggtctgggtattccgcgtaatagtatgttgtggatgctgatgctggcggtgattggctttggagtgatggtgccgattgccggtttgctggctgaccgttttggtcgccgcaagacgatgattaccattacgctgatgattatcgcgttttcgttcctgtttcccggcgatgctcggttccggatcgcaggcgctggtgatggcgtttctgttgctgggtctgagcattatgggcctgacctttggtccgatgggcgccctgctgccggagctgtttccgaccgaagtgcgttataccggcgcatcgttctcttataacctctcatcgattctgggtgcctctgttgcgccttatatcgcgacctggctgaatgcgcattatggtttgcaggcggtgggactttatctggcgtcgatggccgtgctgacgctgattgcattgctcgcttgtaaagagacgcgtaatcagacgctgtatgacgtttaatccggctggatgaaggtcagtgaaaacccggctgctgccgggtttttttatggagcaggctcacagagtacaaccgctctgaagggttaaacaatatcaggcgacaggctcagggagcatacgccttaagcgggttagctttctgtttgaaaaaaccggacctcgctgaaaggcgtattgatattggcagcaataaagaagcttaagggcacagggaatacggtcagaagaggaaagcgtcccgcgccagggacaaaaacgccgggagcgtttttgaacaacgcaaagcgttggcccggaaacgggcgcacctcagggatgaggtgcgtaatcgcgcgggccgagcatgccatggatggcggttttgcgtctttccgatctgaccgtattccatgtgcctgcactgtctcacagcagtgcaggcactaacttacaatcggccttgcctggtatggttcatcaacaaaaaaccccggcaagccggggtttgttttgctgaaaactgtgatgacggtaattagcccgcgacagcgatacgcttcatgtcggtcatgtagccacgcagcttacggccaacggtttcaatcggatgctggcgaaccgcttcgttaacgtcacgcagctgcgcgttatcaacctgcgtgccttctaccgctttacccagatcgcctggctgcagcgtggtcatgaactctttcagcagcggcaccgcggcgaaggagaacaggtagttaccatattcggcggtatcggagatcaccacgttcatttcatacaggcgcttacgggcgatggtgttcgcgatcagcggcagctcatgcagtgattcgtagtaagcagactcttcaatgatgccggcgtctaccatggtttcaaacgccagctcaacgcccgctttaaccatcgcaaccatcaccacacctttgtcgtagtactcctgctcttcgattttgccttcatactgtgaagcggtttcgaacgcggtctggccggtctcttcacgccaggtcagcaggtttttatcatcgttggcccagtccgccatcatgccggaagagaattcgccggagatgatgtcatccatgtgtttctggaacagcggtgccatgatggttttcagctgctctgacagcgcataagcgcgcagtttagccgggttagagaggcgatccatcatcagtgtgatgccgccaaacttcagtgattcggtgatggtttcccagccgaactggatcagtttttctgcgtaagccgggtcagtgccttcagccaccagcttgtcgaagcagagcagtgaaccagcctgcaacatgccgcacaggatggtctgctcacccatcaggtcagatttcacttcagcaacgaaagaggactccagcacgccagcacgatcgccgccagttgctgctgcccaggctttggcaatcgccatgccttcgccttttggatcgttttccgggtgaaccgcgatcagcgtcggtacaccaaagccacgtttgtactcttcacgaacttctgtacccggacacttcggtgccaccatgaccacggtgatatctttacggatgctttcgcccacttcaacgatgttgaaaccgtgcgagtagcccagcgcagcgccatctttcatcagcggctgaacagcctgaaactacagcggagtgctgcttgtctggcgtcaggttaaccaccagatcagcctgcgggatcagttcttcgtaggtgcccactttgaaaccgttatcggtcgctttgcgccatgaagggcgtttttccgcaattgcttcagcacgcagtgcataggccacatccagaccggaatcacgcatgttcagaccctgattcaggccctgcgcaccacagccaacgataacgacttttttgcctttcaggaaactggcaccatccgcgaattcatcgcgtgccatgaaacggcacttgcctaattgcgccagctggttgcgcaggttcaatgtgttgaaatagttagccatgggtactccggtaaggttgtatttgctttttttgttcaggaacggcgtgtcatgcagcgccgcgaatgaccccatcatatgacaggaattctgttgcttaaattgatatattaacaacgtcacattgcaataaatgcaacaccacccagaggcgacgcgcacatggatttacgggatctgaaactgtttcttcatctggcagaaagctgccacttcgggcgcactgcgcgtgctatgcacgtcagcccttccacgctgtcacgccagatccagcggcttgaagaagatgtcggccatgcgctgtttctgcgcgataaccgcaccgtgacgctgacagaagcgggcgaaacgcctgcgccagtttgcccagcagacgctgttgcagtatcagcaactgcgccatgtgatggatcttaacggtccctcgctcagcggcgagctgcgcctgttctgctcagtgacggcggcctacagtcatctgccgcccatcctcgaccgctttcgcgctgaacatccgcaggtcgaaatcaaactggataccggcgatgccgcggatgcggtggaaaaagtgcactccggcgatgccgatctggccattgccggccgtcctgaaacgctgcccgccagcattgattttatgccactggggctgatcccgctggtgctgatcgcgcctgcactgccctgtgccgttcgtactcaggcaacacagtcgcagcccgactggtcaaaaattccgtttatcctgccggtacagggaccggcacggcgacgtatcgatctctggttccgccgccagcgcatcccgaatccggtgatttacgccacggtctcggggcatgaggcgattgtttcgatggtggcgctgggctgcggtattgcacttttaccggatgtggtgctggaaaacagcccggatccggtgcgtaaccgcgtgctgctactggagaatattgactcggttgcgccgttcgaactcggcatctgcgtgcaaaaaaagcggctcggagagccgctgatcagtgctttctggagccagctgtaatcagctgcctgacaggaagaagcggaacgccgggttctggctttcgtcatgaaagtcgtaacccagatcggtgagatgctcttcgaagcgtggctcatcgctgccaagttcaaaagcggccagcacacggccataatcggtgccgtggctgcgataatgaaacagcgagatattccagtgggtgcccagcgtttgcaggaacttcagcaacgcgccgggtgcctccgggaattcaaagctgaagaggcgttcacgcagtggtttagaagggcgtccgcccaccatgtaacgcacgtgcagtttcgccatctcatcatccgagagatcgaccacctgataaccgccgctggtgagctcgctgatgatctcgctgcgctcttccacgccgcgcgtcagtcgtacgccaacaaagatgcaggctttgtccgcatcggcgtagcggtagttgaactcggtaatcgaccgtccacccagcgtctggcagaaacgcaggaaactgccctgctgttccgggatcgttacggccagcagcgcttcacgctgttcgcccagctcgcagcgctcagaaacgtagcgcaggccgtggaaattgacgttggccccggataacacatgcgccagccgctcgcctttgatcccatgctgctggatatactttttcatgcccgccaacgccagcgcgccagagggctccgccacagcacggacatcttcaaacagatctttcattgcggcacaaatggcatcgctgtcgacggtgatgatgtcatcgatgtattcctgacagagccggaaggtttcggtgccaatccgtttcaccgccaccccttcggcaaacagcccgacgcgcggcagatcgaccggatgccccgcctccagcgctgctttcaggcaggctgaatcttctgactccaccgcaatcactttgatttgcggcatcagctgcttgatcagcaccgcgacgccggctgccagacctccaccgccaaccgggacaaagacccggtcgagatgcgcatcctgttgcagcagctccatcgccagcgtgccctgtccggcaatgacggccggatggtcaaacggcggtacgaaggtgtaaccgcgctgttcagagagttctatcgctttggctttcgcctcgtcaaagttggccccgaacaggaaagcctcaccgccaaatgcgcgcaccgcatcaaccttgatgtctgccgtcgccagcggcatcacaatcagtgacttgatgcccagcttagtggcggagagcgccacgccctgcgcatggttaccggctgacgccgtcaccacgccgcgcgctttctgctcttcgttcagaccggcaatcatcgcgtaggcaccgcgcaccttgaaactgtgcaccggctgacgatcttcccgcttcaccagaatggtgttgccgagacgcgatgagattttttccataacctgcagcggcgtcacctgtgccacttcatacaccggtgaacgcaacactgcgcgcaaatactcggcgccacaaggcgcctcgggtagcggttgagactcggccattgttagcctcccagcttgctcttatcgcggacggcgcctttgtcagcactggtcgcgagtaatgcgtaggcacgcagcgcaaaggagacttcacgctgacgattgaccggcgtatacgccgcatcgccacgtgcctgctgctcttcacgacgggcgtgcagttcgttatccggtacggcgagtttgataccgcggttagggatatcgatttcgatggtgtcgccatctttgaccagcgcaatggtgccgccgttggctgcttcaggcgaggcgtgaccgatagagaggcctgacgtaccgccagagaaacgaccatcggtgatcagcgcgcagcttttgcccagccccatcgatttcagataagtggtcggatagagcatctcctgcatgcctggcccgccttttggaccttcgtagcgaatgacgaccacatcgcccgcaacgactttgccgcccagaatcgcttcaacggcgtcatcctggctttcatagactttggccggaccggtgaaggtcaggatctctttgtctacgcccgcagtttttacgatacagccatcttccgcgatgttgccgtagagcacggccagaccgccatcctgcgagtaagcattttcatgggtacggatacagccttcggcacggtcatcatccagcgtgtcccagcggcagtttctgtgagaacgcctgggtggtacgaatacccgccggacccgcgcggaacatatcttttaccgcctgatctttggtcagcatgatgtcgtactgatccagcgtttcacgcatggtctgctgcagaatattacgggcgctgctgtcgaacaggccggcacgatccagctcgccgagaatggcgaacacgccacccgcgcgatgcacatcttccatgtggtatttcggggtacttggcgccactttacagagctgaggcactttgcgtgacaggcgatcgatgtcggagatattaaagtcgatatcgccttcctgtgcggctgccagcaggtggagcacggtgttggtggagccacccatggcgatatccagcatcatggcgttctcaaaagcggccttgttcgcgatgttacgcggcagcatgttgacatcatcctgctcgtaatagcgcttggtcaggcttacgatgcgcttaccggcattgatgaacagctctttgcgatcggcgtgcgtagccagcagtgaaccgttaccaggctgcgacagaccgagtgcttcagtcaggcagttcatcgagttggcggtgaacataccggagcaggagccgcaggtcggacaggcagagcgttcgatctgctcactgtcggcatcgctgacgttcgggttggcaccctgaatcatcgcatctaccagatccagcttgatgatctggtcagaaagcttggttttacccgcttccatcggtccgcctgaaacgaagatcaccggaatattgaggcgcaatgacgccatcagcatacccggggtgattttgtcgcagttagagatgcagaccatggcgtcagcacagtgggcgttgaccatgtactcgaccgagtcagcaatcagctcacgcgacggcagtgaatacagcatgccgccatgacccatggcaataccgtcatccaccgcaatggtgttgaactctttagccacaccgcctgccgcttcgatctgctcggcgacaagtttaccaagatcacgcaggtgaacgtggcccggcacaaattgggtgaatgagttaaccacagcgataatcggcttgccgaaatcgtcgtcggtcattcctgtcgcgcgccataaggcacgggcacccgccatattgcggccgtgggtggtggtggcggaacggtacttaggcatactctatttactccagtaagaataagctcgcggacgtcagatgacgcccgcgctgtatctgattatgggttaaccggatctaaccagccccatttgtcttcggtttcgccggtgaacaggccaaagaatgcctcctggatgcgtttggtcaccgggccacgtttgccttcgccaacctgaatgcggtcaacgctgcgcaccggtgtaatttctgccgcggtgccagacataaagacttcgtcagccagatagagagattcacgcgacagggtctgctcacgcacttcaatgcccatatcacgcgccagcgtgatgatggcatcgcgggtgatgcccggcagtgctgaagaggtaaatggcggggtaaagagcacgccatctttaacttcaaacaggttttcgcctgcaccttctgagatcaggccattagtatccagcgcaatcccttcctgatagccgtgacgacgggcttcgctgcccaccagcagtgaggagaggtagttaccgcccgctttagcggcggttggcagggtgttcggtgctacgcggttccatgaggagaccatggcgtcgatgccgtttctccagggcttcagcgcccaggtatgcgccccacgggaacgccgcaatgatcacatcggtggtgaagccatctggcgggttcacgcccaggcccacatcgccgacaaaggccagcggacggatataagcacttttcagtttgttcacgcggatgacttcgcggcacgcttccatcagctcatcaacgctgcttttaatcgggaagcgatagattttggcggagtcgtgcagacgttgcatgtgttcgcgatggcggaacacaaccggtcctttgtgagagtcgtagcagcgcacgccttcaaataccgacgtaccgtagtgcaacgcgtgggacatgacgctgaccttcgcctcttcccacttaaccatctcgccattgaaccaaataaagtctgctttcttcgtgctcattgttattccctctcgcggctatgcgcggatttgttgtgttgtctgttgttgaatctgaacgcatgcaacgtcgatcaatttgcttaactgcgaagacagtaaatcgacggaacgctgactggcaacggtcatttcaatattaatgttttctgcgttggcgactgaggccatgttcatagaacagacctgaaaaccgcggtgacgcactacgcgtaaaatgcgctccaatatttcagggcggaaacgggcttcgatagacaattgatgctggttcatacagttttctccatcatgtttgcattgctggcacccggcggtaccagtggccagacgttttcatgctcatcaattgcaacatgcaggaagtaaggaccttcgctgttcagcagagcatcaagggcggcgtcgacctgatctttacgggtaatgcgctggccgggaatattgaaagcgctggccagcgtgaggaagtcggggttgtcggacagattggtttcactgtagcggccatcgaaaaacagctgctgccactgacgcaccatgcccagacgctggttatccagcagtacgattttgaccggcagcttgccgcgcttgatagtgcccagctcctggatgttcatcatgatggagccatcgcccgagacacagataaccgtatcttccgggcgtgcaacctgcgcaccgatggcggcgggtaaaccaaagcccatggtgcctaagccgctggaggtgatgaagttctctggcgcgctgaatgccatgtgttgcgccgtccacatctggtgctgaccgacgtcggtggtcactacggtattggctggtttgcgatcggaaagctgcttcagcaacagcggtgcatagatcgcttcgcccggatggtcgtagcgccatgggtgactggccttaagcactttcatctcatcgcgccaggcgttgatatgcagaggctgactcagggcgggcagcagtttcgttgagatcaccctgcagagagacgtgtgcacgacgtaatttgtttaactcagcgggatcgatatcgagatgaatcacgctggcatggggggcaaaggtgtccagcttgccggtcacgcggtcatcgaaacgggcaccgaccgcaatcagtaagtcacaactctgcaccgccaggttggcggctttagtaccgtgcatccccagcatgccgagatacacctcgctgtgggggtctacgctgcccagcccctttaaggtggccactgccgggatgccggtctcttctgccagcgcgcgcagtgccggaacagcctgtgccaggccaacgcctccaccaacatagagcattggttttctggcctgcgccatcagtgcgcgtgcttcctgaatcgcctgatgcggcagcgcgcttccctcttctaccggaaccagatgcggggcaggttctccctgcgcaatctgaatatctttaggaatgtccaccagtaccggacccggacggcccgactgcgccagcgcaaaggcttctgccatgatggcaggcagctcatctaacgattcgaccaggaagctgtgtttggtgcaggccagcgataagcccagcacgtcgatttcctgaaaggcgtcggtgccgatgaaggccgaggtgacctgaccggttactgccacgaccggaaccgaatccatcatggcatctgccaggccggtaatcaggtttgtcgcgccagggccagaggtggcgatacagacgccggttttgccggttgagcgcgcataaccgatcgccgccatcacagcgccctgctcgtgacgacacagtaggtgttccacgccgccgtcgtagagcgcgtcgtataccggcatgattgcgccgccagggtaaccgaatacggtatcaacaccctgcgcgcgtaaagcctgaactacccactgtgcacctgtcatcgctattctcctgtgtcctgaccggaacaacagaattttatgctactgttcattgtttgttccttgtggatttactgatatttcctctggtcgaaaaaaaacccccggacctttcggtgcgggggttttttcggattcgaggcttgatttctaagcctttctttctccaagcgttgccccgcacggtaggttaataaccaccaccacgctaatcacgaccaggctaatcacttgtagaagggctttcatgtgttgttcaattctttcgcttgttcgaagtaatgcctacagagttatcatagtcagggggcatgacacaactttttttacagagtttttttagcaccaggcgctaaatcgcggtctatcaatttgtaatacaagaaataattacataatgataattattcatcactttactgacgtaataatgttttggtgaatttgcgcgcatacacgcagcgttttaacaggtcgtgaaaaaacttctgataggttgtgcaatgacccgaatagtgctgatgatgccctggctttcctttgatgctgtcaccagactgacggtaacaaggagcgagtatgtcattgtcaaaagttctgacccgggcagcgctgggagtggaagccccgctggtgaccatcgaggcacacatcagtaacggactgcctgcgttaacgctggtggggctgcctgaaaccacggtgaaagaggcgcgtgagcgggtacgcagcgccattatcaacagcggttttgccttcccggcaaaacgcgtcaccatcaatctggcacccgcagatttacccaaagagggcgggcggtatgacttacccatggcgattgccattctggtcgcctctgagcagcttcctgccgacaaactgacacactatgagtttctgggtgagctggcactcgacggcgcactgtgcggtgtacagggcgcgattccagcggccatggtagccattcaggctggacgacagctggtcctctccaccgagaatcagtgtgatgccgggctaatccgtcagggctcgtcgctggttgcctctcacctcagcgaagtgtgcgcctttctgcgcaatgaactcacattaccgacagcccaatatcctgagcatcagggcgatgcacctgctgacgatctcgctgatatcattggtcaggaaacagggacgcagagcactggagatcactgcggctggcgggcacaacctgttgctgatcgggccccctggcaccggtaaaaccatgctcgctacccggttgcccggcatcatgccctctttaagcgatcaggaagcactggagtgcgcggcaatcgccagcctggtgaacagcaataccctgcatcgacagtggcgcacccggcctttcagatcacctcaccacagcgcctctctctatgctctgattggcggcggctcactgccacggcccggtgagatctccctggcgcataacggcgtgctgtttctggatgaattaccggaatttgatcgcaaggtgctggactccctgcgcgaaccattagagtcgggcgtcattgctatttcacgcgcccgggcgaaagttacctatccggcacggtttcagctgattgctgcgatgaatccaagtccaaccggacactatcagggacagcataaccgctgctcaccgcagcaggtgctgcgttatctcagtaagctatccggcccttttcttgatcgttttgatctttcgctggaggtgccgctacttcccagcggcatgctcagcggtcagcgcgccagggcggaagcatctgagcaggttcgtcatcgtgtggtcgcagcgcgtgacattcagttggctcgtgcaggaaaaataaatgcgcatttaaacaatgcagagattatgcgctggtgtcagccggctaaagaggatgcggagtggctggagtcagtgctggagaagctgggtttatctgtacgggcatggcagcggattttaaaagtggcccgcaccctggccgatctggctggggaaacagacatcacccggcatcatctgcaggaagctgtcagctatcgcacgatagatcgattaatgatccatctgcataacagcctgcaataaaaaaggggctttcgccccttctctgttaatcgtcgctgtcggtgaagtcttcaacggtgtccatctgcggtttaccgccagacagcgtatgaaaacgtttaggacgcttaatgcgggtcatatacttagaccatacacgttcagcttccgtttgcggctcacgcacgccacgacacacttcaataaacaaacgttcttcttcggttgcaggctcacgctttgataaatccagctcattaaaggcaaaaccgtggcgttcaagaagctgagcttctttaatagtaaagtcaccgtggcgtgagaaaccacgcgggtaatgtttgttatcaaagaaacgattctctgttgagaagctttccgccatgttacacgctcctgattttctaatgccgtgctgttaatggcgcggagtattagataggcttgacagagtgtaaaacaaaacatttaaatctatacgacaaacattttttgggagaacgctgtggatacggaattactgaaaactttcctggaagtgagcagaactcgccatttcgggcgtgctgcagaagcactttacctcacgcaatctgctgtcagttttcgcatccgtcagttagagaatcagcttggcgttaacctttttacacggcatcgcaataacatacgtctgacggcggccggagagcgactgctcccctatgctgaaagcctgatgagcacctggatgatggcgaagaaggaggtctctcacactcagcagcaccatgagctttcaataggtgccagtgcatcactatgggaggcttatctgacgccatggctacagacgctctacgagaatcgggagagcctgcacttagaagcgcgcgtggcacaacgacatctgctggttaagcaactccatgagcgccagctggatctgttgattaccactgaagcacctaagatggatgagttaaccagtcagcagattggtcatatttcactggcgcttttctgcgcccggcagagcgagaagcgtgaaaaatatgattatattaagctggaatggggagcagattttcatcagcatcagagctatctctccggggctgatgatgtaccggtactgaccaccacgtcggcacatgtcacccgtgaaactgctgcataccaccggagcgtgcgcatttctgccggacttctggcagagtgtgtacagtgagttgatggtgattccggatacgcccgtcgccgtgcgtccgctctatgctgtctggttgcagaacagcgatcagcaggcacatatccgtcagttgcttaaattcccgattctggtcaggcaaaatagctgaatttgcaggcaggacagtaggcagggaagatcagaggccagttagatttagctggtttttcttttttgctttttaaaggcaaaaaaaaatcctttgccgaagcaaaggatcgttttctggcaggggcggagggactcgaacccccaacacccggttttggagaccggtgctctaccaattgaactacgcccctaatagggtggcggaacggacggggctcgaacccgcgaccccctgcgtgacaggcaggtattctaaccaactgaactaccgctccaccgattctttcacagctgtcagcaactggctgatggccgtctgttcctgttattttccttgtcaggggaaaaggaacgaatttgatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagatatatccggtacaggctgaaaattgtgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccgggtaacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttacggataaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgcttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggtttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgctttgtcattccttattacggaggaataacgcgctgcgtcgtttcaattttcagcttgttccggattgttaaagagcataatacgtcgcagcacaccgtcgccggtatgctctgaggtatttcagaaaaaacagataaacggtatggtggagctaagcgggatcgaaccgctgacctcctgcgtgcaaggcaggcgctctcccagctgagctatagccccatacagttactgcagagaccactactaccactcaaccgagttacattcttcaggagaaggatgcaatttcttttcaggcaaggcatgcggaagggacgtttactcaggtaaacgaccgcgcgcataacgcagcatgagaagaaatttggtaggcctgagtggacttgaaccaccgacctcacccttatcaggggtgcgctctaaccacctgagctacaagcctgtagaggttttttctgctcgttactttttatcagacaatctgtgtggacactgcgcgggaaagtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccccatcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaaggagcaagctcctctgtgctaccgtccgacttgcatgtgttaggcctgccgccagcgttcaatctgagccatgatcaaactcttcaatttaagtttgatttgcttaaacaagttaagcggtgctcatctgtaaaacgtcataatgaatttcattatgtgttcactcgtgagacttgatattttttacgtccggagacgctgatatcaatcctgcgagtgcccacacagattgtctgataaattgttaaagagcatgccgcgatttactgcggcgcgggctgcgtatattacgctttccgcattgtcagtcaagcatttattttcgcttaactcactggttcgtatgatttcgaacctactcaacccggcgcttcgtaagccgttgtgccgtgtcagtggaggcgcattatagggagttctcggagggtgacaagtgctaatttcaaataaaattccgagtgctgattttttcagctaaaagccgctaaagcgccagtttttccagcaacaggaagccataacgccgtaaaacgggtgataattgtaccgcttcgccatccagctccgtacaaaatgcaacgttctgctgcgatgaatgcacttcaggtgcttcatgctccagcagccaggctgtgcgtcgtgcaattgccgcaccggaatcaatcagacgcgtcccttccggtaacacctgctgcaactcttcgcgcagtaaaggaaagtgcgtacagcctaaaacgaccgtgtccggtggttccgccatccgcagccacggctgaacaatacggcgcacctcattcagagcaacttccgcaccatggagcttcgcttctgccagttcaaccagctccgctgatcccagcatctctatcttgcaggaaccggcaaactgcgacaccagctcatgggtataaggacggcgcaccgtggcacgcgtcgccagcaagcccactacaccatttcgcgtcaggcgcgcggccggtttaatcgccggaaccacccccacgacaggaaaggcaaaacgttcacgtaaagcgggcaatgaaacggtgctggccgtattacaggcgatgatcactaacgagagaggatagctgcgggtaatggcctcaacgatagcgaccacccgatccacaatgaaagtctcgcttttctcaccgtaagggaagccagcgttatcgaaggcgtagagataatgaagatccggcaacagctgacggacctcatcatagacagaaagcccaccgacgccggaatcaaacaccagcacggtgggacgcaaatcagaagttgtagctgccgctgaggtaatactctcgtcctggtgtctgatagccatacactgtctcgtaatctttatcgaacaggttggcaattctaccacgaaccgtgagttgtgaagtgacaggatatgagacggcgagatcccacaggctgacgccccctaacttcacgcgacggctgggagagctgttaaagtccgtatcataacggtcacccagataatggtaggtgactgaccagtcaaactcatacagcgtccagtcgagctggtatttcacctgctgcttagcccggcgtacgagcggctgatcggtgctgccatcccgtgcgtcgacataatcataagagagctgatgcgccagcggcccggtgtcgaatcctgcggtcgcttcaacgcctttaatgcgagcctgcttaatgttgtagtaacggaaagtcgccggatcactatcaatcagattatcgatgtcgttgcgatagcctgaaacacgccagttcaccggtccgctcagcccttcaaagccgccttcccactgcttacttttttcaggatcgaggtcacggttgccataaaacgggctgtaaacctgcgacagattgggcgctttaaaagcggtgccataagaggcgaaacgcgcgatagccagagataaactcccatgaggccgccgtctgccaagtgttatgccagccaaactgattgttgtcgtcaccgcgtaccgcaccttcgagggtgacgctgccaaactgctgctggccggtcaggtagagaccggtattacgctgctcataactatctgacaaatagttcgtgcccggctcggtcgtctctttctgccagtcgacacccgtgctgatcgccccctgccccacctgcacggtgttgccccactgcagattgtactgggtgacatcatcaaaggtggacgcggcaccgtagcggccattgcgtggatcgtagttgatgtctttggtatggccataactggcgatgagctgggtagagtagaagtcacgattgaagcgtaacccggtgtcccaggtctggctgtagagctggcgggtatccgccagcccgataatattgaaattattatcgtaggtgtatgaaccgtcgtaggcggtgcggttatcaaacccgtagccgcgcacaaaaccactgagctcatcgctgaactgatgctcaaggttgccatacagggttttgctcatgaagccgtcgcgatcgtgctgcgccgggctaaagtcattgggataacccgccaccacgtcataccctttggtataagtgtagttgcctgccagagtgagctttgtcgcatcgcccagcatctgctgggttgagccgtcgtaggattgatagccgtttgacccgacgcccgccgtcagcgtggtgcccggttgcgatcggcccgtaatgatattcaccacgccgccaatcgcatcggaaccgtagactgcagaacgcgcaccgcgaatgtattcgatgcgttgcaccagtgacagcgggatctggctgaggtcagacgaaccggtgatgcccgcctgattaagccggatgccatcaatcaggatcagtacatgtctcgattcggtgccccgaataaacagcgaactctgctgccctaacccgccactttgcgcaacatcgacacccggcaggcggcgcatcacatccgtcaggcttttggcctgccagcgatcaatctcatcacgtgtgacaacggtggtgggtgccagcacacctgaaacaggttcagcaaaacggttggcggtgactatttgcgtatcatcattcccctgagcaaaaccgtattgcgcccagagagaaatcgccgttgcgctcagagcgaacagcgaagcagttttttttgtcatttttatcgcatccataagacgaagcaggatgccgcaggccgacaatcaatagcacgcgatgattgtacgagtagcgacgttacaccggcaggtcttcgggctgggaaccataagtgatgatgacttcccatcccacaggacagtgtctgcaattgcactcatcacgacattccttaccgctgcgcgtcagctccagattcacactggattccctattaactcgggcttgaggccggcgtctgcagtctacggagtggagatacggaagtccagactgccaaacatcttctcgctgcaggactggacatcagcaagtgaatgcctacaatcgcccgctggtaagctattaatcaggattgctcatgacacccgaacatctccccattgaagactatgacgcacagctggcggaaaaagtcagtcgtttagagacgatgatgatgccgtttgctgcgcccgacgtggaggtgttccgttcaccggtcagccactatcggatgcgcgccgaattccgcctgtggcacgacggcgatgatatctatcacatcatctttgatcagcagacacgcgagcggatccgtgttgatcagttcccggcggccagccagctgatcaatcagctgatgccaaagatgatcgccgcgatccgtgataaccgtaccctgcgtcataaactgttccagatcgactatctgtcgaccctgagcaatcagattgtgatttcgctgctctatcaccgcaaactggatgatgaatggcagcaggcagccgtggcgctgcgtgaccagcttcgcgcggaagggctggatgtgcagctgattggacgcgccaccaaaaccaaaatctgtctggatcgcgactacgttgatgagtgtctgccggtagcgggtcgcgagattatctatcgtcaggtcgaaaacagttttacccagcctaatgcggcgatgaatattcagatgctggagtgggcgctggatgtgacgcaggactcacagggcgacctgctggaactctactgcggtaatggcaacttctcgctggcgctggcacgcaatttccgccgcgtttctggcgactgagatcgccaagccctctgttgcgtcagcacaatacaatattgccgtgaaccagattgataacgtgcagatcattcgtatggcggcggaagagtttacccaggcgatgaatggcgtgcgcagctttaatcgtctggaaggaattgacctgaccagctacgaatgcgagacgatttttgtcgatccgccgcgcagcggactggatgaagagacggtgaaaatggtgcaggcgtatccgcgcatcctttatatctcctgcaatccgcagaccctgagcgacaatctgcagacgctggcggaaacgcacgatgtgacgcggctggcgctgtttgatcagttcccctatacccaccatatggaatgcggtgtcctgctgacacgtaaagcgtaaacaaaaacgggaaccctgaggttcccgttttttttatcactactgattacgcttgcgcttaaaacgcgtcgcaatccagaacaccagcgctaccatcagaacggtgggaacgaagttggagccaatatccgggtattctgcccgcaccagcgcgctataaaccagaatccccagcaggaaaaacgccgctgccagtcctggcataccgtccggcatattggtgttgaggtaacgctgatgcagacaccaggccgccagacccagcgcaatcagcggaaaaatcgaaaatggaacaaaggcgctgaacagcacagaaaacgagccgttaattgctaagccggtaataaaagccagtaccagtgtgcttttatcgcgagtacctgggtgggtcatggactgatccttactcattgctcttcgggtttttccagggtggccgccagtcgctcttgctcccggcggtaccagtaataagcgcctttggcgatcatacgcagctgtaacaccagccgatcctcaagcttacgtcgctgctcagcatcaacatccagtgcttctgcaccggcgctgaaaacaatggtcaccatcgcttcagcctgcgcttcggtaaaactgcgcggcatgcgattttcgacctcaagataatcggccagttcagcgataaagtgctgaatttcacgcgccacggcggcacgaaaagcggcagaggtgccggaacgttcacgcagtaacaggcggaaagcgttgggattgttgccgataaactccataaaggtcgacaccgacgttttaatgatgctgccgcctttggcaatacgctggcgcgcctggcgcatcagctgtcgcaacatcagcccgctttcatctaccatcgtcaggccaagctcatcaacatccttgaaatgacgataaaaggaggtaggtgcaatccctgcttcacgggcaacctcccgtaaactcagactggcaaaactgcgctcggcgctgagctgactgaaggcggcttcaatcagtgtacgtcgtgtacgttctttttgttgcgctctgacgcccattctctctgcctttagcggtgttaagcaggcactatatcaaaattttcagcgtacagattggcaatctttgtcaccgcctgtgaacctcactctttgtcaaaatgtgatgaaaatcgctgatagaattcagaagtgcgcgacgagatgttagaatctcgttgtaaaaatgtataaataataggacgtatcggtatgcaaaagtcttacgattacgatgccattgtgattggctcagggcccggcggtgaaggggcggcgatggggctggtaaaacagggagcgcgcatcgccgtgatcgaacgctaccacaacatcggcggcggttgtacgcactggggcaccatcccttctaaagcccttcgccacgccgtcagtcgcattattgaattcaaccaaaatccgctctacagcgatcatacccgactgcttcgctcctcttttgccgacatactcaatcacactgaaaacgtgatcagccagcagacagccatgcgtcagggcttctacgagcgtaaccgttgtgaactttatcagggcgatgcgcattttgttgatgccaacaccattgagattgagcaaccggatggcacgcgtgagacgctgacggcagagaagtttgttatcgcctgtggttcacgaccttaccatcctgacaatgtcgactttactcatccacgcgtttatgactccgactctattctcaatctgcaccacgaaccgggccacgtcattatttatggcgcgggcgtgattggctgtgaatatgcgtcgatttttcgtggcctgaacgtcaaagttgacctgattaacacccgcgatcgcctgctggcgtttcttgatcaggagatgtctgactctctctcttaccacttctggaacagcggcgtggtgattcgtcacaacgaagagtttgagaagatcgaaggggtggaagatggcgtcatcatgcatctgaagtcgggtaagaaagtgaaagccgactgtctgctttacgctaacggccgtaccggcaacaccgattcgctgtcgctggaaaatgtgggcctggaagcggatggtcgtggcctgctgaaagtgaacagcatgtatcagacggctcagccgcacatttatgccgtcggagacgtcattggctatccaagcctggcctcagccgcctacgatcagggccgtattgccgctcaggcgattatcaaaggggaagcgtcagcgcacctgattgaagatatcccaaccgggatttacaccattccggaaatcagctccgtgggtaaaaccgagcagcagctgacggcaatgaaggtgccttacgaagtgggccgcgcgcagttcaaacatctggcgcgagcgcagatcgttggcatgaacgttggcagcctgaagattctgttccatcgggaaaccaaagagattctgggaattcactgctttggtgaacgtgccgccgagattattcacatcggtcaggcgatcatggagcagaaaaacggtggcaacacgattgagtacttcgtgaataccacctttaactatccgaccatggccgaagcctatcgcgttgcggcgttaaacggcttaaaccgcctgttttaacgcggcgtcgaaatagtgctgcatgtgggttttaatcgcctctgccagctgttcataacggctgcgcagaggtgaacccggtcgatagaccagcgcaattgtacgctgtggcaccggtttgtagcaggtgagatagcagacgccatcgcggatacgctccggtgggactgccagcgccggtaacagcgtaatcccgctgcctgccgccaccatattgcgcagcgtctcaagactggtcgcacggaaatgggtatcttcatcggcgcccgcctcaaagcagaaaccccatcgcctggtcacgcagacagtgcccatcttccagcatcagcaatttctcgcctgccagatcggacataggcacccggtcgcgatcgcaccagggatgatcggcatagactgccagcttcatcggctcatcaaacaacggcacttcgataaaggcctggctctctttgaccagcgcgataatcgcgcagtccagcttgccgctatcgagctgtgccagcagctgctgcgtctgcgcttcgtgcagatacatctccagtttcgggaatgtctggtgcagcgtcgggataatctgtggcaataagtagggcgcggtagtcgggatgaggccgatatgcagcggacctgacatcgcttccccttgctgactggccatctctttcagcactttcacttcacgcagcaccgtacgcgcctgatccaccagcagcaaacctgcctgggtgaacagcactttacggctggtgcgctccagcagcatcacacccagctcatcttccagcttacggatctgcccgcttaacgtcggctgactgacatgacacgcatccgcggcacggcggaaatgacggtgttcagcaagcgaaaccagatattcaagatcacgaatattcattattaccctccaagccacgatagcccgtggcgatagatagaatagcaatgaacgattggccctatcaagagtggttgggaataatgcgcacatcaaatggaacgcggtatgtcaggagaaaaaaatgtttgcaagtcaggaaggtaaagctattccgtcagtgacttttcacacacgtcagggcgatcgctgggtcgatgtcaccactgaagcgctgtttaaagacaaaacggtcatcgttttttcactgccgggtgcattcacaccgacctgctcctccagccatctgccgcgttacaacgaattagcgggtctgtttgcccagcagggtgtggacagcattctgtgcatctcggtgaatgacacgtttgtgatgaacgcctggaaagcagaacagcgcgcagacaacattacctttattcctgatggcaacggcgagtttacccgtggcatggagatgctggttgagaaagccgatctcggctttggcccacgttcatggcgctactcgatgctggtgcgtaacggcgtggtagagaaaatgtttgttgagccaaacaagccaggcgacccatttgaggtctccgatgccgacaccatgctgcgctatctggcgcccgagtgtaaagctcaggagtcggtctcaatcttcactaaacctggctgcaccttctgcacccaggcaaaacagatgctgatggatcatggtattcagtacgaagagatcgtgctgggacaggatgcaacaaccgtgagtctgcgcgccgtttcaggccgggcgacggtaccgcagatcttcatgggaggtcgtcacattggcggcagtgaggatctgcagcaatatctgctgtcagcgtaagagaatctgagcgtcggccgggagagcaggcgctttgatgatgtgcctataaaaatgagtaattctgaagctagaggttggcgggcatttaatgtgcccgcttttttttgcctgttaattacgccagacgctgctttgcgtcaccgatggcacgcgcaacctgctgtggcgagacgccgccctgcgcattacgcttatccagacaggattgcagcgccagaatcggatagacatcctcgccaatcaccgcactgaactgctgcagctgtgccagcgacagcgcttccagcgccacgccctgcccgatagcggcaaccaccacttccccgacgatatggtgtgcttcacggaacggcacgcctttggcgaccagatagtcagccagttcagtggagtttgcgtaaccctgctcagccgcttcccggcagcgcgggcgtttaacctgcaggccatccagcaccagaactgacatgtgcagacagtcgagccaggtgtcgagcgcgtcaaacaacccctctttgtcttcctgcatatctttgttgtacgccagcggcagacctttcagcgtcatcatcatgccggtcagcgcgccctgcacccggccacacttgccgcgaatcagctccagcgcatccgggtttttcttctgcggcatcagcgatgagccggaggtcactttatctgacagttcgataaagcccgcttcaccggtgttgaagaagatcatatcttcggcgaagcgcgacagatgcaccatgccgatggcagcgtcagaaagcagctccagaacgtgatcgcggtctgatacggtatccagactgttgcgcgtggcagaagcaaagcccagccagcctgccagctgctgacgatcgatctcatacgcggtaccggccagtgcgccacagcccagcgggctgacatcgagccgcttcagcgtatcctgcagacggctctcgtcacgcgccagcatttcaacgtaggccaggcaccagtgcgcaaacgtcaccggctgcgcacgctgcaggtgtgtgtagcccggcatcaccgcatcctgattggcttcggcggtgaccaccagcgcctgctgcagatcacgggtggcacccagcagcccttcaatctgcaccttgcaccacagcttaagatcggtcgcgacctgatcgttacggctacgtccggtgtgcagttttttgcccagcgcgcccaccttgtcgatcagctggccttcaacccagctgtggatatcttcggcgtcgctctgcagaatctgctcaggatcctcacggacttcatccagtaacgtattcagggccgcttccagctgctgctgctcatcctgagtcaggacatttaccgtcaccagcgctttggaccaggcaacagagccaatgatgtcctgctctgccaggcggtaatcgaagcgcagcgagtcattgaactgtttaaaacgttgatccgctgcctgagtaaaccgtccaccccaaagtgccatgtgaaaactcctctgaatcgttaaacaaggggcggcataaatgccgcccctgaaatgaaactgtgaggcgaggcgcacctcgcctgaaaattacttcttctgctcgttcagggcgcggatacgcgaagagagcgagaacagacggataaagccgcccgcatgacggtgatcgtacacttcatcttcaccgaaggtggcgaaactcttccgagtagaggctgttcgcggaacgcttctgggtggctgtcgcctggcctttgtagagctgcagcaccacttcaccgttaacctcttccgccagcgattcggcagcggcctgaatcgacttacgcagcggggcgaaccagcgaccgtcataaaccacataggacatctcgtggccgagctgctcacgccatttgaagctatcgcgatccagcaccagctgctcaaccgcacgcagcgcattgaccatgatggtgccgccaggggtttcgtagcagccgcgcgatttaatccctaccagacggttttcaacgatatcaatacggccgacgccatgttttgcgcccagcacgttaagtttttccaggcactggaacggactcagtttttcgccgttaaccgccacgacccgacctttttcaacggttacggtcacttcttcaggctggtcaggcgcttcaagcggatcgacagtccagacccagcaatctttattcggtgcattggccgggctttccagcacgccaccttcggtggagatgtgccaggcgttttcgtcgcggctgtagattttctccagtgacgcggtggtcggaatgttgcgctctttcaggtagtccagcagcgcttcacgtgaacgcaggttccattcacgccacggtgccaccactttcagctgcggtgccagcgcggtgtaggtggtttcgaaacgcacctggtcattccctttaccggtagcgccgtgacacagcgcatccgcacccactttcagcgccagctcaacctgtgctttagcgatgataggacgcgccattgaagtgcccagcagataagtgccttcatagagggcgccagtctgcagcaccggatagacatagtcgctgatgaactcttcacgcaggtcaaccacgtggcattcagatgcgccggactgcagggctttcttctctacaccttccagatcgccgcgctcctgaccgatatctgcgacaaaagcgacgacttcacagccgccgtagttctctttcagccatggaatgatggccgaagtatcaagaccaccggagtaagccagaacgatttttttgatgttttgcgtttgcatttcgtaatccttgaatcagagtcgttaagcgagaatccgggtgccaatcgacacgccgttaaacaggtcaggcagccgctcagcgtgacgccagctggcaatatccaccgggcggcccagggtacgcgctgcatcaagcgcagcgtgcactttcacaatcatgccgtcggtaataatgccctgggtaatcagctgctcagctttgtcggcggtcatctcttcgatgcgctgacctttgccgtcgagaataccactgacgtctgacaacaggaccagatcagcgcccagcgtcgaggccagtgcggtcgccgcctggtcagcgttgacgttcatcaggtcaccgctgtcagttataccaattgagctcaccaccggcatataaccggccgccagcagggtgttcagtaatgccggatcgcccggcattgcgtggccaacgtggccgagttcttcatcaaacggtgtgacattcacgatgcccgcatcgcccaggcagaggcctaccgcgttaatgcccgatttttttgcccaggccagcagcgttttattcgcggttcccgccagcgcaccggtaataatgtcgatctgatcggctggcgtgacacgcaggccatttttcttcttcaccggcagcgccagctttttcatcagttcatccaccaggcaaccgccgccgtggacaataatcagcggacgctgatgggcgctgcggtaggtcagcagcgcttcaaacaggcgggccagcgcttcttcgctgtctaacaacacaccgcccagcttgataatcaatggattggtcatggtatatttgtccgttaaatcagtgactgcgtttcagggaagccgaaccggatgttcaggcactgtaccgcctgcgatgccgcgcctttcagcagattatcttcggctgccacgacaatcagatgctcgccctgcacttcaaaaccgatatcgcaataaggcagacctacaacggctttcagcgccggtacgccctgttcgtagagccgcaccagtggcttgttgtcataggcgcgatggaaaactgcggcgatatcttcacggctgacacccgctttcagacggcaggtaatcgtcgccaggataccgcgcgggaagttacccagatgcggagtgaagatcaccggcgtaccgaggtgcgcaacgatttccgggtgatgacgatgattgaacaggccgtaaggctgcaggctcacttcgcagaagctggtgccgacattggctttacgtccggcaccgctcacgccgctggtggcgttgattaccggccactgcgcctcgtttaacagtccggcatccaccaggggcttcagcgccagctgcgcagcggtcgggtagcaacctggcacagccaccagctgcgcctgctggattttgtcatgctgatattcggcaaggccgtaaacggctttgtccagccagtcgctatgctgatgggtgaagccataaaagcgggtataaaaatcagcgtcattcacgcggaacgcacccgacaggtcgaacaccacacagccagccttgagaaattccggcgccagatcgtggctgacttcgtgggccgtcgccaggaaacaccacatccaccttgtctgcccactcggccgcgctgctcagcggctgcagcggcaaatccaccacacctttcagctgcggatgaagatcggagaggcgcttgccggcatcagggctttgcgccgaaaccgccaaagcggttatgttgatatgtggatggcgattcaggaaggtggcaagctctgtaccagcataaccactggcaccaacgatcagcgtattcaacatcaggctgtaaccctttttacagtcgcacgttccgggtcacggccttgccccgttacccgccctgtcatctgcagtgatttaaggttcccttgcagaggacgttaatgtatttttattcactattactgcatgaatatggatacatcctaacccaaggaccgccaacagtgaagacaaaattaccgccttttattgaactgtaccgccagttaatcgccacaccgtcgatcagcgcaaccgatgccgcactggatcagagtaatgaaactttaatcaatttgctggccggctggttccgcgacctcggcttcagcgttgaagtgcagccggtgcccggcacccgcaataaatttaatatgctggcgcgtaccggaagcggtgcgggcggcctgctgctagcaggtcataccgataccgtttccttttgacgatggccgctggacacgcgatccctttaccctgaccgagcacgacaacaagctctatggcctgggcacggcagacatgaaaggcttcttcgcctttattctcgatacgctgcgcgatgtggatgtcagcacgctgagcaagccgctctatatcctcgctacggccgatgaagagaccaccatggctggcgccaaatatttttctgaatcgacgcagctgcgtcccgactgcgccatcatcggtgaaccaacctcacttaaaccggtacgtgcgcacaaaggtcacctgtcgaatgtgatccgtatcgagggaaaatcgggccactccagcgatcccgcgcgtggcgttaacgccattgaactgatgcatgagtcgatcacccatctgatgcaactgcgcaatacactgcaggagcgttatcaccatgacggctttgccatcccctatcccaccatgaattttggccatattcatggcggtgacgccgctaaccgtatctgtgcctgctgtgaactgcatatggatatccgtccgctgccgggtctgtcgctgaacgatctcgatgggctactgaacgaggcgctggcaccggtcagtgcgcgctggccgggccgtgtcacggtggctgaactgcatccgccgattcctggctacgaatgtccggcagatcatgaactggtcagtgtggtcgagaaattgctgggtatacccactgaggtggtgaactactgcaccgaagcgccttttattcagcagctctgcccaacgctggtactgggcccggggtcgattgagcaggcacatcagccagacgaatttattgatactgcatttattaagccgacaagggcgcttatcactcaggttgtgcagcatttttgccactgattaacagcaaatggggcatttcactgcattaacagtaaaatgccccttcattctgcgggatttagcaataagaataacttatcccgcttcggtcccgataaattctacgaatttccgttatttagccacaccttcagcgcactttaacgcatttgacgaacgcaacattacgtggctagataaaagacgatgttatgcccaccgggtgattatccagagcgtttcagaatgtggacaggcggcaacggagccggttccctgtagattagggggaacatggcgttgctgatttttctgctgcctgaaaggtcgggtgtagaagtttttcaagacgataagggtgtcagggtccaatgaacgaacaatattccgcaatgcgaagtaatgtcagtatgctcggcaaactgctcggggatacgattaaggatgcactgggagagaacatcctcgaccaggtggaaaccatccgtaagctctccaagtcatcccgtgcaggaaatgacactcatcgtaaagaactgctcaatacgctgcagaacctctccaatgaggagcttctgccggttgcacgcgcttttagccagtttctgaacctcaccaacgtggctgagcagtatcagaccatctcgcaaagtggcgagggtgagaaccatcccgaactgctgaaaaagacctttgataccctgaagcagcagaaagatatcagcgaaagcgacatccttgcggccattgagtcgctgtcgctggaactggtgctgacggctcacccgactgaaatcacccgccgtacgctgattcacaagctggtcgaagttaacagctgcctgaaacagctcgatcacagcgacgtctccgactacgaaacgtaaccagattatgcgccgtctgcgtcagctggtggcacaggcgtggcacaccgatgagatccgcaaatatcgtccgacccctatcgacgaagccaaatggggctttgccgtggtggaaaacagcctgtgggaaggcgtacccgctttcctgcgtgagctgaacgagcaggtagaagaggcgttcggcattaagctgccggtcgatttcgtgccggttcagttcacctcatggatgggtggcgaccgcgacggtaaccctaacgttacggcggcgattacccgccacgttatgcagctgagtcgctggaaagccactgacctgttcctgcgcgatatcggcgtactgatctctgagttgtcgatgtcagagtgcactgaagagatccgggaactcagcggcgatccggaagcacttgaaccttatcgtatgatcctgaaacgcctgcgcagccagttaatgactacccagtcattcctggaacgccgcctgaaaggtgaacgtctgccgcgcccggccgatctgctggtctccaacgatcagctgtgggatccgctttttaccatctatcagtcactgcaaaagtgcggcatgggcattatcgccaacggtcagttgcttgatacgctgcgccgcgtgaaatgtttcggcgtgccgctggtgcgtatcgatctgcgtcaggagagtacccgtcacaccgaagcgattgctgaagtgacccgctatctgggcctcggcgattatgaaagctggtccgaagcggacaagcaggccttcctgatccgtgaactgaactccaagcgtccgctgctgcctcgcagctgggagcccagcgatgaaacgcgtgaagtgctggagacctgtcgcgtcgcggctgaagcgccacagggttctatcgccgcctatgttatttccatggcgaaaaccccttctgacgtgctggccgtgcatctgctgctgaaagaagcaggcatcggctatgccatgccggttgcaccgctgtttgaaacgcttgatgacctgaataacgccaatgacgtgatgagccagctgctgagcatcgactggtatcgcggcttaattcagggcaaacagatggtgatgattggctattctgactcggcgaaagacgccggtgtgatggccgccagctgggcgcaatatcaggcacaggatgccctgattaaaacgtgtgagaaggccgggatttcactgacgctgttccacggacgcggcggcagcattggccgtggcggcgcacccgcccatgcagcgctgctgtcgcaaccaccaggcagcctgcgcggcggtctgcgcgtgaccgaacagggcgagatgatccgctttaaatatggtttacccgccgtcaccatcgccagcctgtcgctttacaccggcgcaattctggaagcgaacctgatgccgccgccggagccaaaacgcgaatggcgcgacattatggatcagctctccgccgactcctgtgcgatgtatcgcggttatgtgcgtgaaaatgctgacttcgtgccctatttccgctcagcaacaccagagcaggagctgggtaaattaccgctgggctcacgtcccgccaagcgccgacctaccggcggcgtagagtcgctgcgtgcgattccatggattttcgcctggacgcagaaccgtctgatgctgcctgcgtggctgggtgccggtgcggccctgcaacaggcgatggccgccggtcatcaggatcagctggaagcgatgtgccgcgactggccattcttctctacccgtctgggtatgctggagatggtattctcaaaagcggacctgtggctggcggaatattacgatcagcgtctggtcgagaaatcactctggccgctgggcaaacagctgcgcgatcagcttgatgcggatatcaaagcggtactgaccattgccaatgactcacacctgatggccgatcagccgtggattgccgagtcaattgcactgcgtaacgtctataccgatccgctcaacgtactccaggccgaactgctgcatcgttcgcgcgcgcgggaagcgaatggcgatgaaccggatgcccgcgttgagcaggcgctgatggtgaccattgctggtgtcgcggcaggcatgcgcaataccggttaacggtggtgcagtaaaaacaaaaaaagtcgggactctcccgacttttttattggctgaagcagagcggttaagccgcagcagcagcaggacgcacgcccagggtgtgacaaatggcgtaactcatttcggcacggttcagcgtgtagaaatggaaatccttcaccccttcgcgtgacaggattttcaccatatccatcgcgatattggctcccaccattttccgcgtttccggatcatcatccagaccggcgaacatcgcgctcatccagcccggcacgcgcacattggtcagcgtggcaaagcgttgcagctgtttaaagttagagaccggcagaatgcccggcacaatttccacgtcaatgccggtcgcgacacagcgatcgcggaaacgcagataactttcaacgtcgaagaaaaactgggtaatagcccggttggcacctgcatcgatttttcgcttcaggttaatcagatcggcctgggcgcttttcgcttcgggatggacttccggataagccgcaactgaaatatcaaaatcacccacctctttcagcagcgaaaccagatcgctgccgtacatttctggcttaccgctgccaggaggcagatcgccgcgcagcgccacaatgtgacggatgccgttgttccagtaatcctgagcgatggtgcgcagttcatcgcgcgtggcatcgacacaggtcagatggggtgcggcttccagaccggtgcgatctttaatgcctttgataatgctatgggtgcgatcacgctcacctgagttcgcaccgtaggtcacagaaacgaatttcggtttcagactgctcaggcgatcgatagaggtccacagggtctcttccatgtcgctggtacgaggcgggaagaactcaaatgaaacattaatttgcccgttcagctcagccaggctctggtttagcgcttcgcgctgattggcatgaaagaaactcatcctgcaccctcatcgattaacaatcggcctgcgaacatctacacgtttagacgtccagatgttcaaaatgacgtaatctgactgtgccgtcaacttaaaaatggtcaacagtcgtgatcaattttcaatcaacatgaaggcgattcaacaggggagagataacgcattgaaaacaggcgccgaagcgcctgaggaggaggagttacagcagttgtgcgaggcgattaatatctgactggatagcgcctgcggtgacatcccggcctgcgcccggtccgcgaatcaccagcggattatcgcggtaccagcggctctcaatcgcaaagacgttgtcgcacggcagcagtgaggccagcggatgttccggacgcaccgcttcaacacctacgcgcgccttgccgttagcatcaaaccgggcaacgtaacgcagcaccaggtccatctcctgcgcggcttcgagccgttgcagcatctgctcattcagctcttcgccattttcaaagaagtggtcgacagatccctgctgacagttactgggcaccagcgattcaacccgcacctgatccggctcgatgttgtagcctgcctcacgcgccaggataaccagcttgcgcatcacatcctgacccgagagatcggcgcgcgggtcgggctcggttaaaccctgctgccaggcctgatccaccagctcggtaaagggcaccgtgccatcaaactgcaggaacagccaagacagcgtgccggagaagatcccgctgatcgccaggatggtatcgccgctgtcgcgcagatcgcgcaccgtatagttgatcggcaaacctgcgccaacggtggcgttatagagccagtgacgtccggttttggtaaaggcatcgcggatctggcgccaggtctgactgtcagacgctcccgcgactttattggcgctgataacgtgaaaaccgtgactggcgaagtcgagatactgctgcgccagcggagtgctggcagtgacatccagcaccaccaggtcatcaaacgggtgagcacgcatccacaggaaacagcgactcttcatcgcgctctaccgcttcatcatcaaagaaggcgagtgcccggctggcttccagcccgtcatagctcagcaggctgcgacggctgtccgcgacgcccgccagcacaaattcaaagccggtacgcgctgacagcgtttcctgatcgcgggcaaacagctccagccagcgtgaaccaatattgcctttgccaaacagcatcagaccgatgcgcttttctgcccggaacagcgactgatgcaatccctgaatcagatgctgagtcgggccgacgcgcagcactgcgaccacgctgatgtgctcttctgactgccagatgaactcaattggctgatcctttaactgctgccagaagcgatgggtatgcagcggattgcgggtaacgcctgcgcccaccagcgccaccagcgccaggccgtcgcgcagctgcagatggcccggtaaaccggcatcctgtagcagcgtaaaggcgctgtttaccacttcggcggtgtaacagagctgcagcaattgacgatcgggatgaacgccaaacgccagcggacgcagctgcgcgcgcttcagcaacaggtcgatctctttgtgcaggatggcgaagtcatgctgctctggcagctgaatctcaatcaggcaaacatcatcatggctggtgacgatacgcgcgcccgtcccggaggccagcacgcgctcaatgcgggttgagccctgctccggctgataactgcagcgcagttgcaggtcgatatcgctgcctgaaaccggctgcagagtacgggtgtggagaaccggtgcagccaggcgcgccagctcgctggcttcatccagccttaacagcggcagcagacaggcatcagagactttgcggggatcggcactgtagacacccgccacatcgctccagatggtcacccgcccgacacccgccagtgcgccaatctgcgtggcagaatagtcggagccgttgcggccaagcaggacggtttcaccggcgtcgttgcggctgataaatccggtcaccacgatgcgcttatgcggatgctgcgccagtaaagtctgtagcagtggccaggacttcccttcatctacctgcggttgtgcggcacgttcagcgcgcagaaactcacgcgcatccagccagcaggcctgaaggtcacgctggctcagtaccgctgacatcaggcgtgccgaccagacttcaccgtgaccgaccacttcggcatagaccgcatcggtgatcggcgcatccagcagtgcggccagcttttccagatcacggataaacgcggtgattaaaggttctgcgacctcagcaggcagcagcgcactgatcagttcgctctggtagcgccgtaaggcctgttgcacctgatgcgcagagagccgatcgctctggctcagcttcagccagctaatcagctggttggtggttgagcctgccgcagagaccaccatcaggtcgcccggctggctgtagtccgccataataccggcaacgcgctgatagcagcgcgcatcggccaggctgctgccgccaaacttatgcaactgcctgatgttcggcgttcccgcgcctgctgaaatcgtcatgcttaaccctcggctgcgacccggaatgcattatccagatcggcaattaaatcttcgtgatcttcaataccgacagaaacccgcagcagcgtatcggaaatgcccgctgccgcgcgtgcttctgccgacatccccgcgtgcgtcatggtggcggtatgggagatcagactctctactccgcccagcgattccgccagcgtaaatagctgcagtgctttcaggaagcgacgcagcagcgcctcatcaccgtcgacctcgaaactcagcatcgcgccaaagccgcgctgctgacgtacggcatgttcgtgtccggcgttttccggcagcgaaggatgatacaactttttcaccagtttctgctgcttcagatactctacaatcgcgagtgcgttgcgttgtgcggctgcaatccgcggtgaaagcgtacgaatcccgcgcagcagcagataactgtcaaacgctgcaccggtcacaccaatgttatttgcccaccaggccaggtcggtagcgagttgcggatctttggcgatgaccgcgcccgccacaacatcggagtggccattgaggtatttggtacaggagtggatcaccaggtccgcacccagcgccagaggattctgcagcgccggactcataaaggtattgtccaccacgctgatggcacccgcagcacgcgcagcggcgcaaatcgcgctgatatctaccacgcgcagcagcggattgctggggctttcaatcaacaccagttttgggttttcatccagagcggcctgcagcgctgccggatcaccctgatcgacaaatttcacccgataggcgccgcgcttgctcaggctgtcaaacagccgatagctgccgccataacagtcatgtggcgcgaccagcagatcgccaggtttcagaaacaccgttgtgaccaggtgaatcgccgacatcccggtattggttaataccgcgcccgctcccccttccagttttctgccagcgtacgctgtacgacatcacgagtggggttgccacgacgggagtagtcatgcgcacgaggctcattgaaatccaggaagttataggtggtagagaggtggattggcgggacaacgcagccatattgctcgtcatcattcaaaccgctgcgcactgcgatggttgccggtttacgcgtcatgagcgaattgttcctgaagagtgaataaaatgtaggccacaggatatcaccctctaattagacgtcaatacatctggacatctaaatgtctttgcgtatagattgagcaaaaccgcaataaccgctaaaattatgcgtcatcgcctggcgttcccctctgtcagacagaggcagtgagcgaagaaaacccgccatatcaggggtcaggcaggaaaaaatcaggcataatccgctgatttcctaacatttaacgtttattaattaaggtaacccatggctgaatggaacggcgaatatatcagcccgtacgctgagcacggtaagaagagcgagcaggtcaagaagatcacagtatctatcccattgagcgtgctgaagattttaacggatgagcgtacccgtcgtcaggtgaacaacctgcgtcacgccaccaacagcgagctgctttgcgaagcctttttacatgcctttacgggccaaccgctgccggatgacgtcgacctgcgcaaagagcgtagtgatgaaattccggaagaagcaaaagcaatcatgcgccagatgggtgtcgatccggatacctgggagtattgatctttcagccataaaaaaacccagccgaagctgggttttttcttgccgccgaacccgcaggttcaggtgccttttaatcttattttttagcgcctggcacgctgaaacgcttgttaaagcggtcaacacggccaccagttgccacttcacgctgcttaccggtatagaacgggtggcatttgccacaaacgtccaggttcagttcgtgagtcagtgttgaacgggtgtggatctcgttgccgcaggtacatttgatagtaactgcttcgtatttcgggtgaataccttgtttcatgggaaacctcattgaaggccgtgtcgctctccgtgccaggctttaacctgcacagcaccacacgcgattgaacattatagggtgtactccggccagatatttctcaccgaaggcggcatattatacaggtaagtttcgattgctgcaaatatctgctgagatacccgccatcagggtcagcgtgtacactagcttccccgatcattgagccggaaagagagagttatgcccgtagtccaggtcgccctgcccgtccccttgccccgcctgtttgattatctgccgccacagggcgcgcagccggtcattggtggtcgcgtgagtgtgccctttggcaatcgcaggatgatcgggattgtggtcgcctttcgtgagagtagcgatctgccggaagcacaactcaagcgcgtgattgaggtgctggatagtgaatccctctatccagcgtcgctgtggcgcatccttaactgggccgccagctattatcattcgccgcagggagaggtactgagtcacgctattccggtactgctgcgtcagggcaaagcggcgcaggacaatcccttatggcgctgggaaatcaccgagcagggtcgggcgactgcgccagaaagtttaaagcgggcaccgaaacagcagcaggcgctggctgcactgcggcagcaaccgctctatcgtcatcaggtcagtgaacatgacctcacggatgcgacgctgcaggcgctacgcgccaaagggttatgcgaaactgcatgagcatcagccgcagatgcacgactggcgtaccacttatgccgtaaaaggcgaacgtctgcggctgaataccgatcaggcgatggccgtgggtgcgattcgggcagatgatgaacattatgcagcctggctgctggcgggcatcacgggttcaggcaaaaccgaggtttatctcagcgtgctggaaaatgtgctggcacgcggtaaacaggcgctggtgctggtaccggagattggcctgaccccgcaaactatcgcccgttttcgcgaacgttttgatgcgcccattgatgtgctgcactccgcattaaatgacagtgagcggctggcggtctggttacgtgcgcggcgcggcgaaacggcgattgtgattggcacccgatcggcgctgtttacgccactggcccgtcctggcgtaattattatcgatgaagagcatgacagctcctataaacagcaggaaggctggcgctatcaggcgcgcgatctggccgtcttccgcgcacatgaagaggatatcccgattgttatgggatcggcgacccccgctctggagacactgcacaatgtccgcagcggcaagtatcgccagctcgacctgacaaaacgcgccggcaatgccagaccggcactgcaacagcttatcgacttaaaaggcgtgcagctgatcggcggtctggcaccgggcctgattggtaaaatgcgccagcatctgcaggccgataatcaggtgctgctgtttcttaaccgccgcggcttttcgcccgccctgctctgtcatgattgcggctggattgctgagtgtacccgctgtgaccgctactacacgctgcatcagcaccatcgccagctacgctgccaccattgcgacagccagcgtccgctgcctaatcaatgcccgcagtgtggttcaacccatttgctaccggtaggcgtcgggactgagcaactggagcagcagctcggcacacttttccctggcgtgccggtgtcgcgaatcgatcgtgataccaccagccgcaaaggtgcgctggagcagcatctggctgacgttcatcgcggcggtgcaagaatccttgtcggcacccagatgctggccaaaggccaccacttccccgatgttacgctggtgtcgctgctggatgtcgatggtgcgctgttctcagccgattttcgtgcggcggaacgctttgctcagctctacacccaggtcgccggtcgtgctggccgagccggcaaacagggcgaggtgttgctgcagactcaccatccggaacatccgctgctgcagacgctgttgcaccagggctattcggcgttcgcccagcaggccttactggagcgacaggcagtccatctgccgccctggagccgccatgcgctgttccgcgctgaagatatggataaccagcaggcggcggaattcctgcaacaactccgtaatttgctggaggcaagcccgctgaacgataaggcgatgtggtttatgggtccgttgcctgcactgcagccaaaacgcagtggacgctggcgctggcaactgctgctgcagcatccttcccggcagcgtctgcaacagttgctgagcagttcgttgccgttggtttcaacactgcccgcggcgcgcaaagtgaaatggacgctggatatcgaccctaccgagagctgatttaagctgacactgcgagccagatcgaaaaatgtcgcataagtcacaatttttatgcaaattaagtaacaaccagccgggcaatcgttaacaatgttgcccggtttgccttcaggtcaggcagaaacagaattgaacgcgccataacgcgtcaggagcatgtgttggagcagaatcaacaaccgcccgccgccacgatgaaagatgttgcggaacatgcgggcgtctcaaccgccaccgtatcgcgtgcgctgatgaatccggagaaggtttctgcggccacccgccagaaagtcgagcaggcggttgccgccgtcggctacgcggcacatggccccacgcgcaacgcccgtcgtaatgagacgcgtaccatcctggtcattgtccctgacatctgcgatcccttctttagtgaaatgatccgaggcgttgaagttacggcagccgaagagggctatctggtgctgattggtgactgcgcgcatcagaatcagcaggagagaacttttctcaacctgatggtgacgcgacagatcgatggcatggtgctgctcggctcaaagttgccttttgatgccagcattgatgagcaacgcaacttgccgcctatggtaatggcgaatgagtttgcgccggaaatgtcactgcccactgtccacatcgataacctgaccgccgcatttgaagcggtaaatcatttactgcagttgggtcacacacatatcgcctgtatcgccgggccggaagagatgccgctctgccagtatcgtttgcaggggtatgtccaggcgatgcgtcgcagcgggctgacggtcgatcccacctatattgtgcgcggtgacttcacatttgaagcgggcgttgccgccatgaatcagctgatgaccctgccgcaaccgccgcgcgcgctcttctgccacagcgatattatggcacttggggcgatgaatcaggcccggcgctgcggactgcggataccggaggatctctctgtggtcggcttcgatgacattgagctatcacgttactgcgagccgccgctgaccacggtcacgcagccacgttaccagataggccgggaagcgatgcttctgctactggatgagttaaatggcaaacgggtcattagcggatcgcggctgctggatgccggtttaaccattcgtggcagcacggcgcgagcaaaaaagcgtgaaaaataagcgtatttgtctgattttttcagtagattcttaaggcgaacactgctggtcaaagttccgacccttaagtaacatggcggactccttgccgggcgcgtaaaaatcatcatttcgcccatctggcactatttttgaagggtataagaacgagagtggcacaaaaagattacgtaggccgcgggcgttcaacagggacgcgtcgcaaaaaaagccccagccgtggcaagaagagcaaaggcggttcgggaacatctaaattgatgattgtactggcggtcgcagtgttggtgacctttgccggtggtttatggttcctggcgcatcacaaaaaagaggacgtgccggtcattacggatcataaagccaacggcaatggcctgccgccgaagccagaagagcgctggaaatatattaaagagctggagaaaccgtcaggtcactgtgccgacacctatcgaaccctcttcgggtggcgaagtgaagtcgcagacacagctgaccgacgagcagcgccagttgctggagcagatgcaggcggatatgcgtcagcagccgacgcagctcaacgaagtgccgtggaacgaacagacgccggcgcaacgtcagcagacactgcagcatcagcagcagttgcaacaactgcagcgtcagcagcagcaggttcagcaacaacagcagcagcaacaggttcagcagcaacgtcagcagttgcaggctcagcagcaacagcaacgccagcagcagttgcagcaacaacaacagcgccagcaacagcagcaattacaacaacagcaacgtcagcagcagcagcagcagcagcagcagcagcagcagcaaaacgtacagcgccagacgcagccagcacctgttacgcgtgaaccggaagtgcagccaaaaccgcaggagaccgcgaaagcgaaaccggcggagaaagcctcttcgcagcgctggatggtgcagtgtggttcgtttaagggcactgaccaggctgaatcggtgcgcgctggcttagcctttgaaggatttgaaagccgtattaccaccggtggcggctggaatcgtgtggttatcggtccttataaagaccgcgcctccgctgacagcaccctgaagcgcctgcgcagttccggacactccagctgtattccgctctccgtcgggggttgaaacccgtcaaacccgccccatatctgttgcatgatactccgcgcccggtgcgcggagtccttttccgactgcaacaaggggtctgcccgtgacaacaatagtaagtgtacgacgcaacggccaggtagtgattggcggtgatggccaggctacgctcggcaataccgtgatgaaaggcaacgttaaaaaagtgcgtcgtttatacaacgataaagtgattgccggatttgctggcggcaccgcagacgccttcaccctgtttgaacttttcgaacgtaaactggaaatgcatcagggccatctggtgaaagctgcggtggaactcgccaaagactggcgtactgaccgtatgctgcgtcgccttgaagccttactggccgtcgcagatgaatcagcttcactgatcatcagcggtaacggtgacgtcatccagcctgaaaacgatctgatcgccatcggctccggtgggcctttcgcccaggcagcggcacgtgcgctgctggagaataccgagatgggcgcacgcgacatcgtcgaaaagtcgctgaatatcgcgggtgatatctgcatctacactaaccacaacgttaatttcgaagaattaacgtctaagtcgtaagggtataaatatgtctgagatgactcctcgcgaaatcgtcagcgaactgaaccgctttatcatcggccaggacagcgctaagcgcgccgtggctattgcactgcgtaaccgctggcgccgcatgcagctcgacgaagagctgcgccatgaagtgacccctaaaaatatcctgatgatcggtccgaccggtgtcggtaaaaccgagatcgcgcgtcgtctggctaagctggccaatgcgccgtttatcaaagtagaggcgaccaaatttaccgaagtcggttatgtcggtaaggaagttgactctatcattcgtgacctgaccgattcggccattaagatggtgcgcagtcaggcgattgaaaagaacaaatatcgtgccgaagagatggcggaagagcgcattcttgatgtgctgattccaccagcaaaaaacaactggggccagtcagagcagagcgctgaaccctctgcagcacgccagtcgttccgcaagaagctgcgcgaaggccagctggacgataaagagattgagatcgacctggccgccagcagccctggcgtcgaaatcatggcccctccgggcatggaagagatgaccagccagctgcagtcaatgttccagaatctcggcggccagaagcagaaagcccgcaagctgaagatcaaagaagcgatgaagctgctgatcgaagaagaagcggccaaactggttaacccggaagagcttaagcaggacgcgattgatgccgttgagcagcacggtatcgtgtttatcgatgagatcgacaaaatctgtaagcgcggcggccagaatgccggcggcccggatgtctcacgcgaaggcgtttcagcgcgacctgctgccgctggtggaaggctgcaccgtctccaccaagcatggtatggtgaaaacggaccacattctgtttatcgcctcaggcgcgttccaggttgccagcccatccgatctgatcccggaactgcagggtcgtctgcccatccgtgttgagctgcaggcgctgaccgtgaacgatttccagcgcatcctgaccgagccgaatgcctcgattaccgtgcagtacaaagccctgatgaataccgagggagtgaacattgagttcaccgaagagggtattcgccggatcgctgaagccgcatggcaggtcaacgaaaccaccgaaaacatcggtgcgcgccgtctgcacactgtgctggagcgtctgatggaagatatttcgtatgacgccagcgatcgtcatggtgaatccgttaccatcgatgctgactatgtcggtaaacatctggatgaactggtggctgacgaagaccttagccgcttcattctctgatccactgattcagcgcttttcagaagcccagcccacccggctgggcttttttatgcatgttcttgatcgaacgatgcttttttcatactgatgattttgccaacaatctgcatatagcgatatacttacccttcctgtggcaaacagacgaaacccttatgaaatacgatacatctgaactctgcgatatctaccatgaagaagtgaatgttgttgaaccgcttttttcaaattttggtgggcgcacttcattcggtggtcagattaccacagtgaaatgctttgaagacaacggcttactctacgatctgctggaagagaatggccggggtcgggtactggtgattgatggcggcggctcagtgcgccgtgcactggtggatgcgcagctggcacgtctggcggcaaccaacgagtgggaaggtctggtgatttacggttcggtacgccaggttgatgagctggaagagctggagattggcattcaggcgattgccgcgattccggcaggcgctgcgggtgaaggaattggcgaaagcgatgtgcgcgttaatttcggcggcgtcaccttcttctccggcgaccatctctatgcagacaacaccggtataattctgtcagaggatgcgctggacctcgaataggccagacatgaaaacgggtgcctgagcacccgtttttcacatcagctgaggcttcaaacctcttccatttttcccagcaatgcacgcagacgtttcctgccacacgtgttgctcttctttcagatgctgattttcacgcatcagcgcatcgtggttgcccgcgacttgttgcgcatcgttacgcagtgagttgttctgctctttcagctcttcgatttccatctgcaacagggtgatggtatcaatcgcctgctgtactttcgcttccagtttctcaaacacttcaaatgacatctttctgacctctcctaaattcctgcaaggcgttgatgatgccagcttaagccagcaacgttgtcccgattgtatgtagcctcaccccgcaagtccagcaacgcggccgctgcgggcgtagtctgtaacacttttcagccaatccctgaatttacgctgcgctgactgcgacggctttctggtacgggtgcgttatccccgtcctcaggcgcgaatattggctaaggaaagccagaatacgcgaaaacgcgcatttttatgacgcagtacacaaaaaacgatttcgctatttctcgtttatgttcgttaacgataaattcacaccagccctacattaaagctgggtgcctcatggaatgagaacaaaaactgataaaatttaacctcgcttcaggaaccactattatgagtcagacaactaacacgctcaaaggtcagtgtattgccgaatttctggggacaggcttgattattttctttggtgcaggctgtgtggctgcactgaaactcgccggtgccgccttcggtcagtgggagatctgcatcatctggggtcttggcgtttccatggccgcctaccttaccgcaggcatttcgggcgcgcacctgaacccggcaatcaccgttgcactctgcctgtttgctaattttgaaggacgtaaagttctgccttatatcgtatcgcagattgccggtgccttttgtgccgcggcgctggtatacggtctctactacagcctgttttttgattatgagcagagccaccagatggtgcgcggcacggttgaaagtctcgacctggcaggcatcttctcaacctaccctaatccacatatcggtgtcggccaggccttcctggttgagatggtcatcacggcagtattaatggcggtcattatgggtctgacggatgacggcaacggcattccacgtggcccactggctccactgctgattggcctgctggttgcggttatcggtggctccatgggtcctctgaccggcttcgcccttaacccggctcgtgatttcggaccgaagatcttcgcatggctggcaggctggggtaacgttgcctttaccggtggtcgtgacatcccttacttcctcgtgccgatttttggcccgctggtcggtgcctgcctgggtgcagtaggttatcgcacactgattggtcgctacctgccaggtaccgcccaggaaacctgcaagcgttccagcagacaaaccggttgcacgcgctcagcagcgtaaagcgtaagtttcaccttttatcatcaggacagaatttatgactaccacagataaaaaatatattgtcgcgctcgatcagggcacaaccagctcccgcgccgtcgttctcgaccacgactctaatatcgtcgcggtatcacagcgcgaattcacccagatctacccgaaagcgggctgggttgaacatgatccaatggatatttgggcttcacaaagctcaacgctggttgaagtgctggcccatgccgacatccgctctgatgagattgcggcaatcggtatcaccaaccagcgcgaaaccgctatcgtctgggaaaaagagaccggtaagccgatctacaacgccatcgtctggcaggatccccgcaccgccgactactgtcacaaactgaagaaagagggtctggaagagtatatccagcacaccaccggtctggtgattaacccttacttctccggaaccaaagtgaagtggatcctggatcacgttgaaggctcacgtgagcgagcaaaacgtggcgagctgctgtttggtaccgtcgatacctggctggtctggaaaatgacccagggccgcgtgcatatcaccgactataccaacgcctcccgtaccatgatgtttaacatccataagctggagtgggatcagcgtatgctggatatcctggatatcccgcgtgaaatgctgccagaagtgaagtcctcttctgaagtctatggtcagaccaacatcggcggtaaaggcggtacacgtattccaatcgccggtattgccggtgaccagcaggctgcgctgtatggccagctctgtgttcagcctggcatggcgaaaaacacctacggcaccggctgctttatgctgatgaacaccggtactgaagcggtaacctcaacgcacggcctgctgaccactatcgcctgtggcccgcgcggtgaagtgaactatgcactggaaggggctgtgtttatcggtggcgcctctattcagtggctgcgcgatgagatgaagctaatcagtgaagctgctgactctgaatactttgcgatgaaggtgaaagacaccaacggcgtttacatggtgcctgctttcaccggtctgggcgccccttactgggacccgtatgcccgtggtgctatcttcggcctgacccgtggtgctaatgctaaccacatcatccgtgcgacgctggagtctatcgcttatcagacgcgcgacgtgctggaagcgatgcagaaacgatgccaacacccgcctgcaggcgctgcgtgtcgatggtggtgcggtttccaacaacttcctgatgcagttccagtcggacatcctcggcacccgtgttgagcgtccggaagtgcgtgaagtcaccgcgctgggttctgcttatctggcaggtctggctgtcggcttctggcaggatctggatgaagtccgctctaaagcagttattgagcgtgaattccgtccaagcctggaaaccaccgagcgtaacttccgttatgctggctggaaaaaagctgtagcccgcgcccaggcgtgggaagaacaagagtaatatcaatgcccgcgaccgttgctgtcgcgggccttttccccgctccactcccccgctgtgttacactgcctgcctgttttttgtcaggtagatgccatgaaacgagaacttgccattgaattttcccgcgtaaccgaagctgccgccctggcaggctatcactggttaggacgcggcgacaaaaatgcggctgacggcgcggctgtccatgccatgcgtcatgtcctgaactccattgaaatcgacggtcagattgtgatcggtgaaggcgaaatcgacgaagctccgatgctctatatcggtgaaaaagtcggtaccggccgcggcgatgcggtcgacattgcggtcgatccgattgaaggcacccgcatgacggcgcttggccaggctaacgcgctggcggtgatggccgtaggcgataagggcagctttctgcacgcacccgacatgtacatggaaaaactgattgttggccccgcagcgcgtggagagatcgatcttgacctgccgctggaaaccaacctgcgtaacatcgccatcgcgatgaataagccgctatcacagctaaccgtatcgattctggcaaagccgcgtcatgacgcagtgatcagtcagttgcagcaactgggcgtgcgggtgtttaccttcccggatggcgatgtcgccgcctccattctgacctgcatgccggacagcgaagtggatgtgatgtatggcatcggcggcgcaccggaaggcgtggtctctgcggcggtgatccgcgcgctggatggggatatgcagggccggttactggcgcgtcaccacgtgaaaggcgacagcgctgaaaaccgtctgctgggtgagcaggagctgcagcgctgcgcagagatggggattgaagcgggcaaaaagctgatgctgaatgagatggcacgcaatgacaacgtggtgtttgccgccaccggcattaccagtggcgaactactgaaaggcattacgcgtcagggcaatatcgccaccagcgagaccctgctgattcgcggtaaatcacgcaccatccgccgtattcagtcgattcactatctcgaccgtaaagatccggcgctccatccctttatcctgtaaccggctggttgccgcgctccggctgacgtgagagcggcaaccagcagagcagcatcaccagcgccgtgaaaaacatcagcatgccaaggctgaactgatcgcgctgcggcatcatggctgacagccacgccaccaggcccgatcccagattctgcatcccgccaatcagcgcgcccgcgctacccgccagccaggcataaggctccatcgcgcctgaagtcgccagcgggaacagcatgccagccccaaagaagaacagcgcagccgggaccagcagcgtccagatattcatcacgccgaaccatgccgggatccacatcaggatgcccgccagcaggcagctatttacgccccaccacatcagactgtgccatgaaccctgctcgcgaccggcaaaccaggcaccaaaaaacgctgccggaatcggcaggatgaacaggatgctgacggtcaggctgtgcaggccgagcacgccgcccagcagaaacgccacagctcgactcaaataccgcaatcccggccagcgcgccaatcagcagcacaatgtagcgaacgaaattcgcgtcgctgagcaggcgggcgtagcgtttaaagaaaggtgtcacttccgcgctctgcggtcgggtctccggtagccagcgtgccattgagacggttaccgccagacagagcagcagcagaaaggcaaagcaggcgtgccagccaaagagctgagtcagcagtgcaccaattactggcgccagcagcgggctgaccagaatgcccatattaagcaggctgttagcgcgccgcagtgcgtgcccctcgtagagatcgcgcggcatggtgcgggccatcacgccagctacgccggtgcccagtccctgaacagcgctgccgaacaccagcatatcgagcgacgtcgccatcagtgccgtaattgcgccgatcataaagatcatcatgcccgccaggatcaccggacgacgaccgatgctgtctgacagcgggccatagatcagctgggatccgccataggtcatcagataggccgccatcacacgctgcagcgcgccatcccgcacattcagagcatccgccatcaccgacatcgccgggacgtagatagtctgtgccatctgccctactgccaccagcacaatgagcatcaccagcagcgggcgattttcgagtttagtcatcatgattatgcaaaatttctttctgtgaaaggaggttaaaacagcggttcacccgccagtcatcttgttatggcgggcaaaatatcaggattagatgacaaagcgagaggtaagcgaaaaggtcccggcttgcgcctgtcaagtttatgggccagcctgtaaagacaaagcaacagtttgtcgattagagcctttgccccggcgcaggctggcaatctcaccgggcagccgcgaaaatagtgacctgcctgaataatcaacaaccagggagtgattatggctgagtgggtcaatgctgaagtaaaggaagtgaaaaactggacggatgcgctgttcagtctccgggtaaaagcgcccatcgatccctttatcgccgggcaatttgccaagctggcactggaaatcgacggtgagcgggtacagcgcgcttactcttacgtcaatgcgccgaaagatgatctgctggagttttacctggtcaccgtgccagagggcaaactgagtccgcatctgcaggcacttcagcctggcgatcaggtgatggtcaccaaagaagcggcaggattctttgtgctggatgaggtccctgaatgcaaaaccttatggatgctggcaaccggcaccgctattggcccctacctgtcgatgctacagcagggcgaagggctggatcgctttgaaaacatcgtgctggtccatgctgcccgctatgcggccgacctgagctttttgccgctgatgcagcagctgcaacaacattatcaaggcaagctgcacatccagacggtggtgagtcgcgaagagatcgccggttcgctgactggccgggtcccggcgttgatcgaaaacggtgagctggagcgcgccaccgggttaagcctggatgccgacagcagccatgtgatgctgtgcggcaacccgcagatggtgcgtgacactcagcaattactgaaagagacgcgcgagatgcgcaagcacctgaagcgcaagccgggccatatcaccagcgaacattactggtgagccgtttgccggtatctcaccggctgagtcgcggtaccaaaccggttagcgccgggggtaccgcgaaagagaccgagatcgagcagcaggccagccagtaacacaaacggaatggcgcgacccaacagccagggcagtatgccgtccagcatgctccagttttccctgccaccagcagccaggcaacaatcaccagaaatccccagtagccgcggcgattacgatcgtgcaaccgtttaacgataaccgcgctggcgggccacagcaggcagaccacgccaaaggccgccatctgagtatcaagccagtcgttagccgctaacgcgaataacagggttgttgtcagcaaccagaccgcctgccagatccagaaatcacgtcgtcccagccggccgcgccaggaaaaacaccattgttgtaacgtcatgcattatcatccagagagaagagaaccgctgcggttttgacctcgcggataaaaaccgttttaatttgcgcctgagtttacgggttaggatcgacaaaatgaagaatttgcctggcgcactgctgttatcgtttgcgctgacggttccggtctttgccgccgatccgccaccgcaggatcgggccgatgcgttgcccaccgccccctatctgctggcgggcgctcccacctttgatatgactatcggccagttccgcgaaaagtataatcaggccaacggggcgctgatgctgccggaatatcgcgccattgataatcggggtgacaaaagcaccctgacgcgcgccgccagcaaaatcaatgaaactctctatgcgtctaccgcgctggagcccggtaccggcaaaattaagacgctgcagattacctggctaccgttgccaggtccggatcagaacgcctcacagcaaaaagcgctggcctacatgaccgccatgttgcgcttctttgtaccgggactgagcgccgatgagggacgtaaaaagctggagggtttgctgaagcaaggtaaggatttaccctactttgcgcaggtcgagggcgcgttgcgttttgtggtggctgacaacggcgacaaggggctgaccttcgccattgagccggtcaaactggcgctcgccagcccctgatgatgaggccgaaaatgacgaaaagcaaagccatcgctacatttgatctctatactgtctggcagacaacgctgccagctggcagcgatttttcatgtatcgctttatgcggaggatagaatgcgacatccactggttatgggtaactggaagttgaatggcagcaagcagatcacagctgaactgatcgccggtctgcgcaaggaaactgtctggcgttgagggttgtggcgtcgccattgcaccgccagctctctatctcgagcaggcaaaacacgccatctccggtagccacatcgcactgggtgcgcagaacgtagacgttaacctgtctggtgcgtttaccggtgaagtttccgcagagatgctgaaagatatcggcgcgaaatatatcattatcggtcactcagagcgccgcacttaccacaaagagagcgacgaattcatcgcgaagaaatacgcagtgctgaagtcagtgggcctggtaccggtgctgtgcattggtgaaaccgaagcggaaaacgaagcgggtaaaaccgaagaggtctgcgctcgtcagctggatgccgttctggaaactcagggcgccgaagcgtttaaagatgcggtcatcgcgtatgagccagtctgggccatcggtaccggcaaatctgccacccctgctcaggctcaggccgttcacaaattcattcgtgaccatatcgcgaagaaagatgcggctatcgcagaacaggtcatcatccagtacggcggctcagttaacgataaaaatgcggctgagctcttcacccagcctgacatcgatggcgcgctggttggcggtgcctcattgaaagcggacgctttcgctgtgatcgttaaagctgctgcggctgcaaaaagcgcctaagcagtaaacgtaccgattaaaggcggcttaagccgccttttttatgggcgctatcagctgacaggcgtgatcctgtacctcctccgccgaaccgctgttcagcagcagccagtttcgctctatcgccatcagcaccagtcgtccatcacttaattcagccagtgccagcccatatttccccatctcactgcgcgcctctggccgctcatcggccagtcggataaacgcactctgccgggtcagctcgtccggggtcaatgcacgcagccagtagcggtgcttacgcagcgtgatgctctgccaccgcccgctaagctgcggcgtcagctgatcaagctgctgacgcacatcgggtcgcaggcaggagatatgaatatggagctgattctgcgtgcggccatactgtgaattgatagccagtgacaggacccgatcatcaataggtgagccgcgtcgctgcgcaagcagagtccgctcatcccatgcaagggcaaagtagttgggcgtagcggattgcagtaaccgcgggctttcgatgccggtgatcctgtcgagcgggatcagcagatactgcaacggcccgtgcatatctttcagcatggcatagcgatgccgctgatcgacgcgctgacagggcgcaggtttctccaccactctgctggtgaggcagacatttctcgctgacgatctgccacagcgcatcactgttctttttgaaatgcagtgcggcagccagcatccccgcaatgaccagtaccagcagaaccgcaaccaggcgggttgcacgacgatgtgtcggcataacaacgcttcctgaatggcttagcagcctgcatcctcgcctggcgagaaaaaaatgtcacggggaattctggcagataacccagcggctgggcggagaaggagaaaaggcgtggttgtgggggataagcggtcagcgcaggaatgcgctgaccgcaacgcattacggtttcatgacctggtcatagctgccgccatcggcgaagtgggctttctgagcctgtgtccagccaccaaacttgtcctgaatggtaaacagcttcactggcgcaaaggtgctggcgaatttcttcgcgacttcagcatcacgcggacggtagtagttctgtgcagcgatagtctggccttctggcgagtagaggtatttcagataagcgtcggcgactttacgcgtccccttttcatctaccactttatcgaccaccgacacggtcggttccgccagaatcgattcgctcggagtgacaatctcgaacttgtctttgcccagcttgttaaccgccagataggcttcgttttcccaggcgatcagcacatcaccaatcccgcgctcaacgaaggtgttggttgcgccgcgtgcgccggaatcctgcacttcaacgtttttaaacagcgctctgacgtaagccagcgctttagcctgatcgccgttgttatgatccagcgcccagccccaggccgccagatagttccagcgtgcgccgccggacgttttcgggttaggggtgataacagatacgcctggcttcgtcaggtcgctccagtcatggatgcctttagggttatctttacgaaccaggaagacaatggtcgaggtgtagggcgcagagttgtccggcagacgctgaatccagtttttatcaatacgaccgcgttctgcaatggcatcaacatccgattgcaacgccagtgtgaccacatccgcccgaatgccgttaatcacggaggttgcctgcttaccggaaccgccatgcgactgacggaccacgacattatcgccggtttcctgtttgtagtgcgcactgaacgctttgttgtactgttcgtacagctcacgcgttggatcgtaggaaacgtttaacagctgaatgtctttcgccagaacgctggttgaggccagcaacagggtaacgccgatactccacttgttcattacgcactctcccaatgtcgttatgggctaagcgtgacataaaccaatacagagctaaaagaattaaaaataagctgttataaccatggggaatatagaggcggggtgccggggcgcgccaggtcgcacaccccgaagaggaattaatagagttttttcgcggtgtcgagccagtcgcgtttgaacggacgcttcatattttcaatggcgtcgacgatgtcgtgatgcaccatcttctcgttctgaatacccacgcaacggccgccgtaaccctgcatcagcagttcaatggagtaggcccccatgcgtgaggccagaatacggtcatacgcacaaggtgcaccgccacgctgaatgtggcccagaacggtagaacgggtttcacgcttggtttctgtttcgatgaaacgcgccagatcgtcgatatcgcagatgtgctcggtaatcgccacgatagcgtgctttttacctttggcgatgcccgctttgatttccgctaccagctcttcacgagtatacgggaactcaggcagcacgatgaactcacagccacccgcaatggcggctgccagtgtcagatcgccacagtagcgacccatcacttccacaatcgaaatacgctgatgcgatgaagaggtatcacgcaggcggtcaatcgcttcaaccacggtttccagtgcagtgaaataaccgatagtgtaatccgtttccggcaacgtcgttatcgatggtgcctggcagaccaatgcacgggaagcccatttcagtcaggcgcttagcccccatgtaggaaccgtcaccaccaataacaaccagcgcatcaatgccgcgctttttcatgttctcaatggcaacctgacgcacatcttcattacggaattcagggaagcgtgctgagcccaggaaagtgccgccgcggttaatcatgtcggaaacgctgtagcgatcaagattgatcatgcgatcttcgtacaatcccaggtaaccgtcatagatcccaaaaacttccagtccttcactcagcgcggaacgcaccacgccacgaatagctgcgttcatgcctggggcgtcaccgccgctggttaatacaccaatttttttgatcatgacaacctctggattgttcaaaactaagggttaatcctgcctgtcgatcgctgctgaagctcattttacgactcgcgcgacacgtgatggcagatagtatatcaaaggcttgctgctgaattgattcaggtcagacaacttttcactattttttgcagcaatgttagcgttacgtcatccctgccgtatcgatttgattcatttaagttaaaaacctaaagaatcctctctctcgaacggtaccacagaacagggatcctgatggataattacgtctgagccgggaaattctttgcgtaacgccttctcaacctgatcggctacccgatgcgcctgcaccagtggcagctgatcttccagttccagatgcagctgaataaatttggtcggcccggactgacgggttcgcagatcgtgaacgccctgcacctgcggccagtttgtcgcaagcgtcaggatttgctgccgttcctcttccggtaacgcgcgatccagcaatgactgaaccgcctcgtagcccatacgcagtgcgctgtagagaataaaaataccaatgcccagcgcaaacagggcatccgcccgggcaaagccatagctgctcagcaccagcgcaaccaaaatagcgccattcatgatgacgtcggactgatagtgcagcatgtcagcccggatcgcctggctgcgggttttacgaaccacccagcgctgaaaggccaccagcaccagcgttgagctcagcgccaccacggtcactacaataccgacgccgggcgcccgcaactcattgggcgtcgccagatgctgcaggccggtcagaaacagaaacagcgccgacccggaaataaacatactttgcgccagcgctgccagcgactccgctttgccgtgcccgaaagtatgatcttcgtcagcgggctgcagtgcataacgcaccaccagcagattggtcagcgaggcggcgatatccaccagtgaatccaccagagaggccagtaaactcaccgaaaccggtgtaccaccaggcaaaaattttcacgagcaacagcacagacgcaagaatggtcgcgccgagcgcagcacgctttaccagtcggccataagagggttgcatgccaggttccctgtgcggcatcagtgaagatgcgcaccaaaatgaatgaatggctcaagtttaacatcgggaggcgggcactgcttagcgggtcgatcaacggatcaggcttttttgggaaggcgcgacaggtacaaaaaaacaagccccggcctctgtgggaggtcggggcaaagtgtcatacacatcagtaccaggccacattcaggcccaggtctgggctgagaaaggggcggcgactactttttgccgccttttttcccggcttctgatgctttttcacgatcgtttttgaaatttccgccgccgctactctggccgcctttcttaccggcttcagacgctttttgcggattatctgcgaaattacctgaaccaccacgatgctctgccataacttactccgttaatagattcattcaggactacataatgtggttgctgctccctgagacttcgcaaagacacttaacttccctgcagtgacaggattaagtgtagagggtgcgcctgaaccggcaagcgtaacgcgggggatttatctcattgaaaaatataattaaatctttctatgcctgcctgtaattcattcactttcagtgagttataatatttaacaggcggtaaaacccttaccggtacgcttaaatttaagtcatgacctgaatagtaaggaatcggtgagacttacccataaaagctcaacaagcgctaatcaaacaggggttttattgcggggtgatgattccagtcaaaataaaaaaagtgaaaaaaagataaaaaaaacccccaccatcatggcgggggaagacagggatgtgtctatggcaaggaaaacagggatactatgttactggttactgctggtactactcactgcctgcagcgatgacgctgactgcaaattcgaaaactgtcgcagctcattaagtcgccgctggtaattctgctgtaacgccgactgctgggctggcgttagcagctggaacatttgattctgtacgcgcgccatctcgacctgctgttcaacctgaactctggcgatcacttccgccttctcgcggatggccgcttcgttaaactggtctgcagtcactaactcatgtagtgctgcgatatcgtcaatatggacgaccggacgctcatgtcgggcctgttgcatcaggtctcgcatctgctgacgttgctcttcagtcagttcgatgccatcgaacatgtggctttgcggattttgcgtcatactgcctgtcggcaatccgccatgatgcatctcgtcaatcgtcgtcgcatctttagcacctgcgctggcgacactcagagccatcgctgaggcaaggacgacggcggttaatttgcgcatcgtgtactccagtttcgttccgttttgcgattcaacgagagccagtgtacggcgacagctgcaaacatccgtcagggggtgtaaaactacgtaaagcgatggataggtgcgccaggaacacggtattttgcctgcggagggctacaaaaatgaataaaatcctgttggtagatgacgatcgcgaattaacttcgcttttaaaagaactgttagaaatggaagggtttgaagtggtggtagccagcgatggtgaacaagcgctgaacctgctcgataactcaattgatctgcttttactggatgtcatgatgccgaagaaaaacggtatcgacaccctgaaagaactgcgtcagcaacatcaaacccccgtcatcatgctaacggcgcgcggcagcgagctggatcgcgtactgggcctcgaactgggcgcagatgactatctgcctaaaccgtttaacgatcgtgaactggtggcgcgtatccgcgctattctgcggcgctcaaactggagtgaacagcagcagcaacacgacaatagctcgcctacgctggaagtggactgcctgcgtctcaatcccggccgtcaggaggccagttttgatgatgtgacgctggatttgaccggcacggagttcaccctgctctatctgctggcgcagcatctgggccaggtggtgtcgcgtgagcacctgagtcaggaagtgctgggaaaacgcctgacgccttttgaccgcgctattgatatgcatatctccaatctgcgtcgcaagctgcctgaacgccgtgacggtcatccctggttcaaaactttacgtggccgcggctatctgatggtttcggcatcatgattggaagtctgaccacccgtatcttcgccatcttctggttgacgctggcgctggtgttgatgctggtgctaatggtgcccaagctcgattcacgacagatgacctcgctgctggagagtgaacagcggcagggaatcatgattgagcaacacgtcgaagcagagctgtcacaggatccccctaacgatctgatgtggtggcgtcgtctgtttcgggcagtggaaaagtgggcaccgccgggtcagcggctgctattagtgacgagtgaaggtcgggtgatcggcgcgcaacataacgaaatgcaagttatccgcaattttatcggccagtctgacaatgccgatcatccgcagaagaagaaatatggtcgtgtagagctggtagggcctttcgccgttcgggatggcgaagataactaccagctttacatgattcgtcccgccaacagttcccagctcgatttcgtaaatctgctgtttgaccgtcccctgttactgcttatcgtcaccatgctcatcagctccccgctactgctctggctcgcctggagcctggcacgtccggcacgtaagctgaaatatgctgccgacgaagtcgcaagcggaaacctgcgtcagcatccggaaactggaatcgggcccacaggagtttctggcggcgggttccagctttaaccagatggtcagtgcgctggagcggatgatgaccggtcagcaacgtctgttatcagatatcagccatgaacttcgtaccccgctcacccgtctgcaactggctaccgcgctgctgcgtcggcgccagggtgaaggcaaagagctgggccgcattgagatggaagcacagcgtcttgatggcatgattaacgatctgctggtactgtcgcgcacccagcataaaaatgcgctggtcagcgaagcgatgaaggcgaatcagttgtggaatggggtgctggaagatgcccgcttcgaagcggagcagatgggcaagaagatggatattccctatccgcctggcccgtggccgctttatggcaacccccatgcgctggagagtgcgctggaaaatatcgtacgcaatgcgctgcgctattcacacacccatatcagcgtcagcttctccgtcgatatttccggcatcacggtacacgttgatgacgatggtcctggcgtgagtccggaagatcgtgaacagattttccggcctttctaccgtaccgatgaagcacgcgatcgcgaatcaggcggcaccggtcttggcctggcgattgttgaaacggcagtgcagcaacatcgcggctgggttaaagcggatgacagcccattgggcggcctgcggctgaccctctggttgccgctctactcctccgctcgtcaataatttgttatgcttcggcccctgtcatcgggggccttatgcttaacattgtcttgtttgaaccagaaattccgccgaataccggcaatatcatccgcctgtgtgccaatactggctttcagcttcatctgattcagccgcttggttttgcctgggatgacaagcgtttacgccgcgccgggctggattaccacgaatttactgccattaaattccacgccgactatcaggcgtttatcgcctcagagtcgcctgagcgtctgtttgcgctgacgaccaaaggtacgcccgcacacagtgccgtagcgtaccaggctggcgattatctgctgtttggcccggagagccgtggacttccggctgagatcttagcggctttaccggctcagcagaaaatccgtatcccgatgaaagcggaaagccgcagtatgaatttgtcgaacgccgtatcggtggtggtctatgaagcgtggcgccagcttgattatgcgggcgcgctgattaaagactagatgccgtcgccaaactgaaaacccgccaggctgccattaaagtgctgatccatatccatcgacggcttttcactgcctggcttaccaacgattcgcgcgggtacgcctgctgcagtggtgtgcggcggcacgggctgtaacaccacggaaaccggcaccgattttggctcccttgccaacttcaatattgcccaggactttcgcaccggcaccaatcatcaccccttcacggattttcgggtgacgatcgccgctggttttgccggttccgcccagcgtaaccgattgcaggatcgagacatcattctcaaccacggcggtttcaccaatcacaatgcctgtggcatggtcgagcatgatgccgtggccgatgttggcggcgggatgaatatcgacggcaaaggagacggagatttcattctgcagataaaccgccagcgcgcgccggccttcattccacagccagtggccaatgcggtaggcctgtaaggcgtgaaaacctttgaggtagagcagcggcgtggagtatttatcgactgccgggtcacgctggcgcaccgcctgaatatcgtacgccgctgacataatcatcgacggatcttcacggtaggcttcttcaacgatttcacgaatggcgatggcgggcataatcgggttagccagcttgttggccagcatataactcagtgcgctaccgagattttcatgcttgagcaatgtcgcgtggaagaagctggccagcatcggctcacaatcagccagggcgcgcgcttctgctttgatattattccagaccagttctaactcatcagacgacattgctgttttctcccgataaaaaaagcgcctgaatgggcgctgcaggtgatgatgctacgcgtcctgcgttagccagtgctgttttcgtccttccttgttcgtcccagcagactcaatgctgcatctctcgccggcttttcgcaatacagcacctgataaatctgctcggtgatcggcatttccacaccaaaacgggctgccaatgctttgacttctttggtgtttctgtagccttctacaacttgtccgataatgcgttgcgcgctatctacatcctcgccctggcccagcatcatgccaaaacgacggttacgcgactgattatcggtacaggtcagcaccagatcgcccagacccgccatccccataaaggtggtgggatcggcacccagcgcggcacccagccggctcatttcagccagaccgcgggtgatcagtgcggtacgcgcattcgcgccaaaaccaatcccgtcagagatcccggcaccgatagcaatcacgttttttaccgcaccgcccagctgtacgccgatgaagtcagggttgttataaacgcggaagctcttaccgcagtgcagcttctgctgcagatcctcagcaaactgcgcatccgttgcggccagcgcgatagccgtcggtaatccggcagccagctctttcgcaaaggtcggtccggagattacagccagcggaatgtcatcgccgacaatttcccgcgccacatcctgcagcagacggccggtctctttttccagccctttggtcgcccagacaatacgcgagtcggatcgcagatgaggcttgatctgctgcagcacctcgccaaacacatgactcggcaccacgatcaataaatcgcggctggcagcaatagctttagtcagatcaggttcaagagaaagatggtcggggaacgggacatcaggcaggaaagcggtgttgcaacggtcactctgaagctgcgccagatgcgccgggttatgtccccacaacagcaccggatggccgttgcgggccagcgtaatcgccaaagcggtgccgtatgaaccggcaccgatgacgctaatcgaagcgtgagttgtcatcaggcatcctgatgtggttcagcaccttcttcaccttgctgctgctgcaggtagttcatgaacagcgcatcaaagttaaccggtgccaggttcagctgcgggaaggtaccacgtgataccaggctggtaatgcattcgcgtgcgtacgggaacaggatgttcgggcagtatgcgcccaggcaatgtgccatctgcgttccttcgataccgctgatggtgaaaataccggcctgctgaacttcacacaggaaagcggtttcttcgcccacggtggcggttacagtcacacgaagtaccacttcgtaaacttcgtcagccagctgagaagatgcagtgtccagatccagtttaacgtccggttcccactctttctggaaaacctgcggtgcatttggcgcttcaaaagagatgtctttggtgaatacgcgctgaatctggaattgcatttcgttggtgttatgttctgacatgtgaccaaatcctatgtatgagattgtccggcgtaaaattacgcctgcagtaagggatctaaaccttcgcgattatcgagtgcgaataagtcgtcgcagccaccaatgtgctgcgcatcaataaaaatctgaggcacggtggtgcggccgctacgcttgatcatctcttcgcgtttcgccatgtctccatcaatggggatctcctgaaacgatacgcctttttgcgttaacagcgccttcgcccgatggcagtaaggacaggtcgccttggtatacacttcaacatttgccatgatcagcacctctgtaagattatttgccgcgaactaacggcagattttcgccgctccagccactgataccatctttcagcactgaaacccgctcaaagccggccgcgctgagatgcgcagcagaatcacccgcgctttgtccggttgcacacaccacaattatgggctgcgctttatgctttgccagttcgtcgatgttgccttttttaatctcagcggctgcgacattcagcgcacctgaaatatggcctctgcggaaatcgtcgcgcgaaacgcacgtctacaactaccgcgtcctctttgttaatcaggcgggttgcttcaccgcggctgatcgtttttaccttagagaacattcctttaacggtagtcacaatcaccagaacgagtaaaacgacccatgccagactcaggatggggtgattgcttgcaaactgcataatttcttgcatgaggggtaacgactccagaccgggctaataagctaaaacaagggttctgagtatacctgcgccacttcgcatgtacagatgctatgcggccagagtatcgatttgtgcttcattttccaaaaaaagtggctgaatagcaaaaatggcgtaaggcttaatccatgtcattgtgaaagtggacataactggaaaagcaaatgccagtggggagcactggtaagcggcggttcatcgtggaataatcattggcctatgaagggaaaaacaaccgtttcgcacacaaggacccgtcccaacggcgataacctgccgttgttcacacacttgtccagcctctcccttagcctgctttgtgcgggggcactgttattgcctgccgccgccgttagtgcagaagacagcaaatctcagctgcaatctattcagcaaaacatcgctgaaaaagagaaaagcgttaaagcgcaaaagcttcagcgcagcaaattactggatcagttgcagagccaggaaaaaatcatcgctcaggcgagccgtcagttgcgtgacacccgcaatagcctcaacgccctgaatgacgaaatcaaacagcttgccacctccatcgcccgccttgaaaaacagcaaacccaacaggaaaacctgctttcagagcagcttgatgcggcgtttcgtcagggtaagcacaacggtgtacagctgttgatgggcggtgaagagagccagcgcagcgagcgtattctggcctatttcggctatctgaatgcggcgcgccagaaaagtatcgaatcgctgcaacagacgcgtcaggacttagctcagcaacgcgccacgctggagcagaagcaacagcagcagaaaggattattagcgcagcagcagggccagcagcagaagctgcaacaggcgagcgaagcgcggaaaaaaaccctgacgacactggaaagcgcgctggaaaaagatcaggccgatctggtcgagatgcgtcagaacgaaagccgtctgcaggataagatcgcccgtgcggaacgcgaggcgcgcgagcgcgccgcccgtgaggcgcgtgaggcggaaaaagtgcgtcagcgtcaggcgcaggcgaaagccaaaggctccagctatcagccgactcagagcgaacgcgaactggtggcgcgcaccggtggactcggtcgcgccggcgggcaggccttgtggccggtacgcggacgcattgaacatcgctttggtgaacagctgcagggtgaactgcgctggaaaggactggtgattgatgcgcgcgaaggtaccgaggtgaaagctatcgccgatggccgcgtgctgatggccgactggttacagggctacggcctggtggtcgtgctggaacatggtaaaggcgatatgagcctgtatggctacaaccaaagtgcgctggtgagcgtgggtacgcaggtgaaggcaggacagcctatcgcactggtgggcaccagtggtggccgcggtactccgtcgctctattttgaaatccgacgtcagggacaggccgtcaatccactcccgtggttaggaaaataggttttgctgcaacttcgaaaaatccccgttctgttgagcgccctgctgttcagctacgctgcgcaggcgggcaaactggccattgtcatcgatgacgtaggctatcgccctgccgaagagaacaaggtcctgcagatgccgcaggccatttcagtggcggttttgcccaacgcgccacatgcccgtgaaatggccaccaaagcgcaccagagtggtcacgaagtgttgatccatctgcccatggcaccgctgagcaaacagccgctggaaaaagataccttaacgccggagatgagcagcgaagaagttacccgcatcatgcgcaatgcggttaacaacgtgccttatgccgtaggtctgaacaaccatatgggcagcaggatgacctccagcctgcctggcatgcagaaagtgatgcaggcgctgaaccactacaatctctactttctggatagcatgaccatcgctaacagtcaggctgttcctgccgcacagggcacccaggtcagggtattaaaacgccgggtatttctggatgacagccaggatattaatgccatccgccagcagttcagtcgggcggtgaaactggcgcagcgcgacggttacgccattgccattggtcatccccaccctaacactgtgcgggtgctgcagcagatgctacccacattgccagccgacgttacgctggttcgtcccagtcagctgctgaacgaatcactgcacagcaactcacggccgcctgtggcgccggcaaaaccggtgacaccgcgcttccagcctgcagacctgtgtaaaccgaaacagcctctggcgccggttcctgccacccgagccttaacggtaatagctgaaagtgtgaataacagcccgctgtttaacacgctaaaaaatctgttctgaatttgctatgaatgctaagtgttcagcttagcgttcatttatacgcagaaattactataatcctgggtcgggcgataacgtgctgtgcgggaacagtgatagggatgacgattattaaacaaaaaatcctgctgctggataacggcagagagtggggcggcggcaccaacagtatgctggagctgttgaagcgtatcgatcgtcaaaagtttgatatcacctgctgcttctatcacaactacagccgtggcaacgacgaaaccattgaggccacgctgaatgcgctggctatcccggtcttttttattccgcaaatcaggcagccacgctgggcaaagtttgttaaagaagtcgcgcgggcactgctgttttttaataaaaagctcaagaagcgcgccatcgatcagattgatactcactggcgcattatgcccaatgccagcaaaatcaattcactgctgcagctgggaaagtttgacacgctctatatgaataaccagcccagcaccaatgtggaaggttatctggcggcgcgcagcctggatgttgcggtagtgcaacactgccgtatcgatccggtactggaaccgcggctggtcagcatggtcaatcaggattgccaggcgatcattgccgtgtcacagggcgtgaataacaccctgcgcagccacggtgttgatgcggaacgctgttttaccgtcaataatgctatcgacatccaccagcctctgcccgaccgccttgaagtacgccagcgctttaaactctccccttcgacctttgtgttcggcacgatcggctcgctgatattgcgtaaatctaatcaccatattctgcaggcgctgggccgttttaaacgcgctaatcccgatgccgactggaagatggtggtggtcggagcgggtccggaacttcagcatctgctgcaactcgctaccgcagagaacatccagcagcatgtggtctttacgggctttcagaacaacgcgctggattacctcaccgcctttgatgcgtttattcttgcctcacgcagtgagggcttaccaagggttgtgctggaggcgatgctggtgaataccgccgtagtgggatcccgcgtggtcggcactgccgaattgatcagtcatgacgaaaccgggctgctgtttgactatggcaacgtggtgcaactgacccagcatctgaccgcgctgtggcaggatgcggatttacgtcaacgcctgatcaatgcggcagcgaaacgcgtacgtgaacagtacgctattgaaacttatatcagcggcgtcgagaatattttgcaaagcgtcgtgaaaaagaaacctcatgcttaattttttaaatccccgttatcgtcatatcagggcgagtcataacctgccttattcgcataaagaggttcagggcactgtaccggtcacttctgtcgtgatcccctgcaccggcgcggactatatcgaagaagccctgctcagtgccgattttgcggcgcgctttgcgacagaggctgaagagatcgtaattgtcagcgatcagccggctcacgcctttggcagcctgccagtaaaaacccgcgtggcaacgctggatgtcccgcatcgggaagagagctatcgctacaagcagatctatcgcagtcgtttgattaaattgcaggcgcccttacaggctaaaggcgacggcattctgatgatcgattccgacctcaatctgcttaagatgcccgagattatgatgaagcccggccatctctattccagttttcgtcaggggaaaatgattgccaagctggctgatgccccggaagaggcgattcccgcctactacccgcacagtatccggccctggctggtggatcacgtgaatggggcttacctggcggccacccgtgaggtctggcagcgcatttcgccgctgtggctgacgctgtttaatgatacctggaatttaatgaacgacagccagccgcctactgaccagctgccgctcgcggtgttgctggacatgctggatattaaaaccgtcaatctgggcgaatgggctaactggccggtctcaaagaaaattggcggtcagtcggcggtgatcccgcctgaagtggtaggcgcacatggcggctttccgctgtcggaatggcaaaaatacctcgccgatccgcaacagccgctgaactttaaaggccaggactacacgcgcaaagtgcgctacctgaccgatgaagagaaaaaacaaagctaatcatgcggccgccctggcggccgttgttttaatcccagctcagtatcacctttcccgatcgtcctgaacgcatctcatcaaagccctgctggaaatcgtcgattccatagcgatgggtaataaccggcgttaaatcaagcccggactggatcagcgccgccattttataccaggtttcaaacatctcccggccataaatgcccttgataaaaagccctttgaagattacctgattccagtcgatcgccatttcacccggcgggatgcccagtagtgcaatccgccctccgtggttcattacctccaacaatgaacggaaggcaggcggtgcaccagacatctccagcccgacatcgaatccctccgtcatgcccagcgagtgcatcacgtctcgcagatcctcattcgccacattgaccgcgcgcgtgacgcccattttgcgcgccagtgacagacgatactcattgatgtccgtgatcaccacgttacgtgcgccgacatggcgacagaccgcggcggccatgatgccgataggacccgcgccggagatcagcacatcctcacccaccagatcgaacgatagcgcggtatgcacggcgttgccgaatggatcaaagattgccgccagctcatcggaaatgttgtcgggaattttgaacgcattgaaggccgggataaccagatactccgcaaagcagccctgccgattaacgcctacacccattgtgttccggcataaatgggttcgcccggcacggcaattacggcagtgtccgcaggtaatgtgcccctcgcccgagacccgatcgccaatcgtaaagcctttcacttcctgtcctatcgcaaccacttcccccacatattcatgaccgacaaccatcggtaccggaatggttttgcgcgaccagtcatcccagttgtagatatggacatcggtaccgcagatagcggttttgcgaatcttaatcagcaaatcgttgtggcccggctccggaaaccggcgcatcggtcaccatccagatgcccgtttccttcttcagtttggcgagtgctttcatgacggactcctcaggcgataacgcccagttgtttgccgatacgggtaaaggccgccaccgcacgttccagctgttgctgggtatgcgccgcagagatttgggtgcgaatgcgtgcctgaccttttggcaccaccggatagaagaagccggtaacgtagatgccttcctgttgcagcaggcgggcgaactcctgggcgacgctggcttcacccagcatcaccgggataatggcgtgatcggctcccgccagcgtaaagcccgccgccgtcatctgctcccgaaagtaacgggcgttgtcccacagacgctgacgcagcccgtcgccttcgctgagcagatccagcacccgcagcgaggcggcaacaatggccggggccagcgagttagagaacagatagggacgggaacgctggcgcagccactccaccacttctgcttttgcggcggtgtagccaccggaggcgccacccagcgctttacccagcgtgccggtaatgatgtcgacccggcccatcacatcgcaatattcatgggttccgcgtccggcgttcccgacaaagcccaccgcatgggaatcatccaccatcaccagcgcagagaactcgtcggccagatcgcagatagcgggcagattcgcaatcaccccatccattgagaagaccccatcggtggcgatcagaatatgacgcgcgcctttatcgcgcgcttcctgcaagcaggcgcgcagctgcgccatatcgttattggcatagcggtaacgctgcgctttgcacagccggacgccatcgataatggaagcgtggttcagtgcatcagagatgacggcatcctgcgcatcgagcagggtttcaaacagaccgccattggcatcgaaacaggaggagtaaagaatggcatcctccatgccgagaaagtctgccagccgcttttccagctgcttatgactatcctgcgtgccgcaaataaagcgcaccgacgccataccaaaaccatgcgaatccatcccctctttcgccgcctgaatcagcgccggatggttcgctaaacctaagtagttattggcacagaagttaatcaccgccgggttatcgccaaccgcgatctccgtctgctgggcagaggtgatgatccgctcctgtttaaacagtccttcctgacgtgcatcatcaagttgctgacgaagttgttgataaaattgcgcaggcatcattgctctcctcagatggcaaaaatctggcatatcttactgaacaggccgcttcttcacgataaatcgcccaacagaatgtcatttttgcagcatagttcacgccacaaggatgtacgcacaaagcgttacagagtcatctggctgtctgcaccctgatgaaatgttatgatgtgaggtattcgtgtgtgaaacctcctgtttcaccccacaacgttgaaggtaacaacatgattatcgtaactggcggcgcaggaatgattggcagcaacatcgtcaaagcgctgaacgatcgcggtcacaccgacattctggtggtggataatctgaaggatggcaccaagtttgccaatttagtcgacctggatatcgtcgattacatggacaaagaagagttcctgatgagcgtgatggcgggcgatgatttaggcccgatcgaagcggtgttccatcagggcgcctgctcctccaccaccgagtgggatggcaagtacatgatggagaacaactatcagtactccaaagagctgctgcacttctgtcttgagcgcgagatcccgttcctctacgcctcttccgcagcgacctacggcggacgcaacgagaatttcattgaagagcgtcagtatgagcagccgcttaatgtttatggctactctaagatgctgttcgaccattacgtccgtcagatgctgccggaagcgaactcgccggtatgcggcttccgctatttcaacgtctatggaccgcgtgaaggccacaagggcagcatggcaagcgtggcattccatctgaacacgcagatcagcaacgatgaaaatccaaaactgtttgaaggcagcgacggctttaaacgtgatttcatccacgttgatgatgttgcggaagtgaacctgtggtgctgggaaaatggcgtctccgggatttacaactgtggcacaggccgcgccgagtccttccaggaagtggctgacgcagtactgaagttccaccagaaaggtcagatcgagtacatcccgttcccggaaaaactcaaaggacggtaccaggcctatactcaggccgatctcactaagctgcgtgccgccggctacgacaagccatttaaaacggtggcgcagggcgtcgctgactatatggtctggctgaaccgtaacgcataaaggaagctgctccggcgatgaaaattctggtaatcggcccgtcgtgggtcggcgatatgatgatgtcgcaaagtctctatcgcaccctcaaggccgaacatcccgatgcggtgattgacgtgatggcacctgcatggtgccgtccgttgttgtcacgcatgccggaggtgaatcaggcgctggcgatgccgcttgggcatggcgcactggaaatcggtgagcgtcgccggttgggcaaagtgctgcgcgccagtcactacgaccgcgcttatgtgctgcctaactccttcaagtcggcgctggtccccttctttgccggaataaaacgccgcgtcggctggcgcggagaaatgcgctatggcctgctgaatgatttgcgcgtgctggataaagccgcatttccactgatggttgagcgctacgttgcgctgggctacgacacacctgttgcttcggcggcgcagctgccccagccgctgttgtggccaaaactgcaggttgaagagcaggaaaaaattgaaacggccgcacagtttcagctcgccgcgacccgtccggtcatcggtttttgtccgggcgctgaatttggtccggccaaacgctggccgcactatcactacgccacgctggcccgccagttgattgctgaaggctttcagatcgtgctgtttggctccgccaaagatcgcccgaccggcgaagagattatcgcggcgctgcccgaagaggctcgcggccactgccgtaatctggcgggtgaaactcagctggaacaggcggtgattctgctggcacaatgccgtgccgtggtcagcaacgactccggcctgatgcatatcgccgcggcgctggatcgtccactggtggcgctctatggaccaagcagccctgactttacgccgccgctggcaaagcaggcgcgaattattcgcctgattaccggctatcacaaagtgcgcaaaggcgatgccgaacagggctatcaccagagcctgatcgatattcagcctgaacgtgtacatcagacgctgagcgaactgctcgcgccacaggaggtgccatgcacgtcctgattgttaaaacttcgtcaatgggcgatgtgctgcattcgctcccggcactgaccgatgcaatgcatgccattcccggcatccgtttcgactgggtagtggaagagaatttcgcacagatccctggctggcatcccgcagtagataaggtgttaccggttgcgattcgccgctggcgcaaacactggtttggcagtcagcagcgtgaagagcgcgtgctgtttaagcgcgcgttacagtcacgtgattacgatatcgtgattgatgcacagggcctgatcaaaagtgccgcgctggtcacccgcttatcgaaaggggtgaaacatgggcaggacagccgcagcgcgcgtgagccgttcgccagttggtggtatgacatccgccatgaggtcagtaagcgacagcacgcggttgagcggacgcgcgaactgttcgccaaaagcctgggctatgaaaagccgcaaagtcagggtgactacgccattgccggacacttcctgcatcatctgcccgctgacgcacatcattacctggtctttctgcatgccacaacgcgtgacaacaagcactggccggaatcacactggcgacagctgattgagcagatgcagcccagcgggttgcgggtgaaattgccctggggtgctgaacatgagcatcagcgtgcgcagcgccttgcagaaggatttgagcatgtcgatgtactgcctaagctgacgctggaagcgatagcacaacagctggcgggcgcacgggcggtggtctcagtggataccggattgagccatctgacggcggcactggatcgccccaacctcacgctgtatggtccgaccgatcctggactgattggcggttacgggcagaaccaacaggcactgagcgccccgaatcataatctggcagagctgactgctgacacggtggcagagaaactgcgagccgttattacggaaaacatgccatgaactatgtgctgatctacctgcttctgctgcctttccgggccataatgcggctgttttaccggccaaccggacgcagcctgatcatccagacggcaaagattggtgattttattaatatcaccccgatgctgcgtgcgctgggtcagtctgagttgctgatcagcaaagcggtggagccgctggcgcgtcacgatgacacggtcagccgctatttcctgattgaagaggcgaagcgcagcttttttgccaaactgaagctcgcgttcactctgatgaaccgctatgacaacgtctatctggtgcagccaaacagcgtgaacctgtttttcgccgcgctctgcaacgcatcgaacaagcagtttctgcgcacctatgtgcgtaagtcctaccataagaccttctatcgcagcgccagcggtattgtcgaccacaccaaaacggatttaacgctcgacagctacctgaagctgattaatcgtgactaccgctacaccgatttccctaagcatgcgacctcaccgctctggcagccgcctgcgccgcccgccgcgctgcttaatccgcgcagcggtattaaaattggcatcagtatttctgctggtaaccgggctaaaaccattcctgccagcatctggcagcagctgatggcgtcgctggctgacctgccctgcaccttttatgtgtttggcccaccggctgagcagccgtggctggatgagttactgagcctgaccggcccgaaagacaatatcgtcagtctgattggtgagctaaaactggaagaggttccgtgggccattgcacagatggatttctacatctcctctgactctggcaatgcttatattgcggatgcgcagcagataccggtgatcatgctttacgggccgtgtgaagtcagggaacagcgtccggtcaataacgttttgtttatcggaccggataatattgctgcgtcgacgttcgtttttgccacccgttttcagtttgatcagcctgctgaaaaattattcgggctggatcacgataaactgactagaatacaaacgtttattactcataatctggaatagtgaagcgtaatggcaattacccctcttgctgaggccgttcagcaaagtcagctgctggttaacacgcttgctgacacggatgataatccggttcatgttgcgtttggcatcaactacgcctacgcgcgtggcctgggcattacgttgttttcacttctcagccatcatcctgataccgctttccacgcccatgttttttcagactcgctttgcgaagaggatgtggaaaaactgcgttcactggccacgggccatcgtctggcgatcacgctgcatatctttaaccgtgcctgggttgatcagctgcctgcggtcggacgctatcccaaaagtatccactaccgtttcctgatcccggaaaccgtggcgagctacagcgatcgggtgatctatattgatgctgacaccctggtggtgggcgactactctcccctgttcacgctggatatcactgattacacgctggcggcctgtaatgacacaccgcgagcgcgacataaccagtgcgcaaggctggggctgaagcaccaccactatttcaactccggctttatgctgattaatattccacgctggctcgaaaggcagaccaccgcgcgcattaccgacgtgctggtaacgcggggcgcagagtttggttttcccgatcaggatgcgctgaatatcgtgctggaggatgaggtcctgatcctgccagaccgctataaccacatttacgacatcatcgccaataaagtctgggatcactcgggcgtgcctgaagagacggtaatgattcactacaccggtaaatgcaaaccctggcatgcatgggctggcagcgatctttcccagcgctactatagctattaccagcgctcaccctgggcttcacaaccgcttgatacgccaaagcattataaagaaatgaagcgattcgcccgcgtaaaatggcatcagaaacagtatgctgaaagcctgagctggatgatgaagtatgtcagtctcaagttttttaaacagagtgagcaatagcacactcaggtttatcagattgatgcgggcgctgttatttcagcgcctgactttcccgtcacttatcccgccggctgtttgccacgacctctgtaataacgacgctgacagcaagccagcataataatctgtttacctgcacgaccacattgcgtaaaaaaagcgcatatagcgcattattattgtcgggcgtggtttttagtaaagcagggatgcaacatcgttttataattgtgaactccctgatttcactctgctgatttggaaatgatttatgacgaggcaacgccttttcgcagtgaatacaatgctggtgcagatattgtcatgagtacttctcctctgctgagtatcattaccccgatgtacaatgcgggcagcatgtttgatgagttcatgcagtcactgctggcgcagacgctgactctgcttgagatcattatcgtcgatgacggttcaaccgatggctcaggcgagcgcgccgatcagtatgcacagcagcattctcacattcgtgtgatacatcaggaaaatggcggcgtctcgcgcgcccgcaacgccggactggcgattgcccgcgggaaatatgtcaccttccctgatgcggatgacaccatgcaacccgatatgtatcagacgctggtgacactggcggaggcagataatctggatgcggcacagtgcaacgccgagtggtttttcaaacacagccagcgggtaaagccgctgattccgctggatcgcctgcgcagcacgccggtgctgagcggtgccgactggctgaataccgcgctaaaaacccatcgttatatgcatgtggtctggctgggcatctatcgccgggaactgattgagcagcatcagttgcagtttgaacccggcctgcatcatcaggatattccctggaccaccgagtttatgctgctggcaaaacgcgtgcgttataccgaggcggtactctatcgctactatatgcatgacgcctcaatcagcaatcgcaaacgtaccggcgagcgcaacgtagagtatcagcgtcactacatgaagattgcgcgactgctggaagagctcaatgaccgctatcgtgaccgcgtgaagatctacccgtcgtttcactatcaggtgacccatgaagcgctcagtgtttgccacagtgtaagacgtgagtctgacgcccgcgcacgccaggcaatcattgccgagctgtttcgccacccggacacacctgcgcatgttacgcaacgcccggggaattaagcagtggtatcagttgctgttgtggctggcccggctctatcgctggcgtgataaataacctttgaggctggctttatcctaaaaagggtttgccctacaatcggttcactgaattctgagaactcttgtttatggccagcctgactccagcaaacatctctccaaaaaatatattactgattaagctgcgccatcatggtgacatgctgctcacaacgcccgccatcaatgcgcttcatgagcgttatccgcaggccagcatcgacgtgttgctctatcaggagacgcgtccgatgctggaagcgcatccggctatccgccatttgcacgtcatcgatcgtaaatggaagcaggagggcacctggcgcaagctgggccatgagcgtgcattaattcgcgccatacgtgccgcccattatgatctggtgattaatctggccgatcagtggcgggctgccctgattacgcgtctctccgcggcgccagtacgtatcggtttcgcttttaaaaaacgcgataacgtcctgtggcgatggtgtcacaaccagctagtctccacacacaatcacagcaagctgcataccgttgagcagaatatgtcggcgctggcccccctcggcatcagcagcgacggcgcacgtgtctcaatgcactacagcgacgctgaccagcaaattgtgctgacccgactggcagagcatcaggtcaccgcgccctatattgtggtgcagccgacctcacgctggggctttaaatgctgggaagaggagagcgttgctgccacgctcgatcagctggcgcagccgggccgcaaagtggtgctgaccgccgggccggacaaacaggagctggcgatgatcaaccgcattcgggcactgtgtgcgtcgccggatgtggtttcgctggccggtcagtttactctgccacagctggcggcgcttatcgatcatgcccgactgtttattggtgtcgactctgcaccaatgcacatggccgccgcacttgaaacgccgtgtattgcgctgtttggtccgaccaagctgcagcactggcggccatggggcgacaataatcatgtcatctgggcgggggattatggcccgctgccctcacccgattccatcgacaccaaaacagaccagcgttatctgtcggccattccggtgaaggatgtggtcgcggcagcgaggagctatctgaatgagtaagttacggctggcgattgtccggcagaaatatcgtccggatggcggtgccgagcgttttatctcgcgcgcgctggaagcgctgggcagcgagcagctcgatctcaacatcattacccgcagctggcagggcacacccaatcctgactggcatctgcatatctgtaatcctgcaaagctgggccgggtatcccgtgagcgcggttttgcccgtgcagcacgcgcctgctgggagcgcgaaaagttcgatattgtgcaaagccacgagcgcatcgcgggctgtgatatttttcgcgcgggtgatggtgttcatcgcgtctggctggaacagcgcgcccgcatcgtctcatcgtggcaacgactgagtgctgtgctcagcccttatcatcgctatgtcctgcaggcggaagcggagatgtttaactctccgacgctgaaagcggtgatctgtaattctgagatggtaaagcgcgatatcctgcgctgtttctcgctcgacgccggaaaaatccacgttattcataatgctatcgatgccagccgtttccagcccgccacggaagctgcacgtcgcgccacccgtcagcagctggcgctgcccgatgcggccaccgtactgatttatgtcggctccggctttgaacgcaaggggttgaaagcggcgatacaggcgctggctgccagcgaccgttatctgattgtggtgggtcaggataagcaactgcaacggtatcagcagctggcaaatcagcttaactgtctggatcgcctgcgctttgtcggcgtacagcaggatgtgcagccgttctatcacgcggctgatggcctgctgctgcccaccctctacgatccttttcctaatgtggtactggaggcgatggcctgcggcttaccggtgattaccagcactggctgcggtggcgcagaatttattaccgctggtcaggatggcttcgtctgtgatgctttggatatcaacgggttaaatcaggctgttaatgcaataccggcgctttccgtcgattcacgaatgggcgacgcggcgcggcgcaaaattgaaccttatggtccacaacggctggcgcaggcgctgacttcgctttatcagcaggtcctgagcagcaactgacaatgtgggatgagtgcatgcggggtttctgataacatgccgccatctgattttaatctgcttttagacgcgaatttgctgtaacggtaactatgacgaccttttacaccgcattgctctacttaattcagccactgatttggctgcgcctgtggctgcgcggtcgtaaagcgcctgcctatcgcaaacgctgggcagaacgctatggctattgtgtcggcaaagttaagcccgacggcattgtgctgcactcggtctctgtgggtgaaaccctggccgcgatcccgctggtgcgcgctctgcgtcatcgttacccgaccctgccgattaccgtcaccaccatgacgcctaccggctctgaacgcgcgcaatctgcatttggcaaagatgtgcatcacgtctatctgccttatgatctgccgggttcgattaatcgttttctggatacggtcaacccacgcctggtgatcatcatggaaaccgagctgtggccgaatattatccgcattctgcaccagcgtaatattccgctggtgatcgccaatgcccgcctctcggcccgatcggccaaaggctaccgcaagctgggtaaattcatgcgccgactgttgcagagcatcacgcttatcgcggcgcagaatgcggaagatggcgaccgcttcctgagcctgggcctgaaacgttctcaactaacgattaccggcagcctgaagtttgatatttccgtgacgccagaactggccgccagagcggtgacgctgcgtcgtcagtgggcgccgcgccgtccggtgtggatcgccaccagcacgcacgaaggtgaagaggccattgtgctggatgcccatcgccgcctgctgcagaccttcccggatctgctgctgattctggtgccccgccatcccgagcgttttaacgatgcccgtgaactgacgcaggaacgcggcttcagttttatcctgcgcagcagcggcgagatcccgtctggctcaacgcaggtggtcatcggagattcaatgggcgaactgatgctgctatacggcattgccgatctggcctttgtcggcggcagcctggttgaacggggtggacacaacccgctggagcctgctgcccatgcgcttccggttctgatgggaccccatatctggaacttcaaagatatctgcagcaagttgcaggaaggccaggggctgatcaccgtcaccgacgtgatttcgctggaaaaagaggtcaccaacctgttacaggatgatgattaccgccgttattacggacgtcatgcggtagacgtgctgcaccagaatcagggtgcgctacagcgtctgctacagttactcgaaccgcatctgccaccacgggcccactaatgtcagcacgccaacgtctttccgtggtgatgatcgccaaaaacgaagcggaactgctgcctgattgcctggcctcggtcagctgggccgatgaaattatcgtgctggactcaggcagccatgacaacagtgtcgacatcgccacacaggctggggcgaaggtctacctcaatgatgactggcagggctatggtatccagcgccagcgcgcgcagcactatgccaccggcgacatgattctgatgatcgatgcggatgaacgcgtgacacctgaactgcgcgccgcgattgagcaggtgctggtcgcgccacccagccgtacggtttatagcctgggccgcagtaatctgtttctcggccgctttatgcgccatagcggctggtatcctgaccgagtaatgcgactctatcctcgcaccttccgctacaatgacaatctggtgcatgaatcactgcagagtgacggcgcgccggtggtggcattacccggcgatctgcagcatctgacctgccgcgatttaatcgcctttcagcgcaagcagctggcttatgccgaagcctgggctacggagcgccatcggcgcggtaagcgttgcagcctgttttctctgttcagccatacgctgggcgcgtttatgaaaaccctgctgctgcgtgccggttttctcgacggaaaacagggctggattctggcggtggtcaatgcgcaatataccttcaataaatattcagccctctgggcgctgaatcatgcttcggcaaaagggcgagtatgatcacgaaagccatctatcccggaacgttcgatcctgtgacgctcggccatctcgacatcgtgacgcgggcagcgcagatgtttgatcaggtcattctggccgttgccgccagccccagcaaaaaaccaatgttcagcctggatgagcgcgtggcgctggccggtgaagtgatagcccatctgcccaacgttgaggtggtcggattcagcgacctgatggcgaatttcgcccgtgaccagcaggcgaatgtgctggttcgtggcttgcgtgcggtgtcagactttgaatatgaaatgcagctggcgcagatgaatcgtcacctgctgccaacgctggagagtgttttcctgatgccgtctgaaggcttctcgtttatctcatcttcgctggtcaaagaggtggcgcgtcacggcggcgatgttaccgccttcctgcccgcgccggtgcatcaggcattgctggctaaactggcttaatgctggcagtttcgggcaccagtaggtgctgcgctgcccgtgtctgccgctgacaatcggcgtaccgcatgcccggcagggttcgcctgctcgcccataaacctgtaactgctgtgcaaaatagccaggtttaccgtcgctctgcaagaagtcacgcagtgtggttccgccctgctcaatggagcgtaacagcaccgctttgatggtattgaccagcagttccgcttcggcctgcgacagactgccggcagcacgatcgggaatgatcccggcggtaaacagtgactcgctggcgtaaatgttgcccacgcccaccaccactttgttatccatcagccactgcttgatgagcgtccgcttgccgcgtgacttctcaaacaggtaagcgccgtcaaactcctcgctaagcggctccggcccgagatgtgccagcacgctgctgcccgccagatcgctgctccagagccaggcaccaaagcggcgcgggtcggtgtagcgcagcactttgccgttgctcatgaccagatcaacatggtcatgcttcgccgctggcagctcttctgacagcacgcgcaggctaccggacatgccaaggtggataatgatccagccatgcggcagctccagcagcagatatttcgcccggcgctgcacactgagcaccggctgatcgcttagcgccaggatctcctgcgaaacaggccagcgcaaacgtgaattacgcaccacggcgtgaaggatggtttcaccgaccaaatgcggttcgataccgcgacggctggtttcaacctctggcaactctggcataccctctcctcagcgttttacacaaacaaaaaacccggccggagccgggtttttagcagaacactaaaattacttaattttagcttctttgtagagcacatgctgacgtacaaccggatcgaactttttcagttccagcttctctggtttagtacgtttgttcttcgtggtggtatagaagtgacctgtaccagcagaggaaaccagcttgatcttctcacgaatacctttagccatgattcagttccttagtaccttagtacttctcaccacgggcacgcatatcggctaacaccgtatcaatgccctttttatcaataatacgcatacctttaacagatacacgcagagtaacgaagcgcttctcgctctcaacccaaaaacggtgtgagtgcaggttcggaaggaaacggcgtttcgtcgcgttcattgcgtgggaacggttgttacccgtcaccggacgctttccagttacctggcagactcgtgacatgtcaatatctccaaaaatcaaatcagctcgagctttaaaaattaggtttgggccgcctcgtcaggcttgcagcccgccaggcgaattccatggaacccgctaagctggcctaaccgccaaacccgagattctcaaaggtggcgtagtatacgccgctcagcccaagtgctcaagtcccgaacagataaagatcccgaatgatcgggcaaaaagccgccacctggcgtgaaatttccccctgtcagagccatccccgctcggcaaaggagacatattcgccatgaccaatcaccagatgatcgagcagacggatgtcgagtagctggcaggcttcgctgactttatgggtcacttcacggtctgcacggctcggctccgccatgcccgacgggtgattatgcgccagtatcagagcggcagcattgagcttcagcgcttcccggacgatctcgcgggggtgaacttccacgctgttaatggaaccagagaacatattttgtgcccgcagcacccgatgctgattatccagaaacagtgccatgaagatctcacgctcctgatgggctaacagactttgcagatactggcgcgtgatttgtggattttccattgcgctttcgcgggccagcttactggcgaaaaaacgcttcgccagtttcggcaatcgcatgaagctgtgccagcttggcatcgccgacccctttgatttcaccgaatgccgctttgtctgacgtcatgagctgataaagcgagccaaaaccgtccagcatctgtccggccagctccaggacgttctgtccaggcgatccggtacggagaaaaatggccagtagttcggtatcgctgagggcatgcgcacccagcttccggagtttttcccgtggtccctttattttcatgtccgctctccctgagatgagcctcagcatggcccatcatgaagagtgcagctatcagtgaagctgcaatctacgagacggctcgcaaacgcagtcagtgaaaaggcgcatccgcgcttttgtgataaagtccgtgcattcgccgccgcgagcggcagagagcttagtgaggccaacatcatgatgggattagccggcaaaaaaattcttcttggcgtgagcggcggtattgctgcttataaagcacctgagctggtgcgccgcctgcgcgatcgcggtgctgatgtccgcgtgatgatgacagagggtgcgaaagcatttattactccgctcagcctgcaggctgtctccggctatccggtatttgacgatctgcttgatccggccgcggaggcagcgatgggtcatattgaactggcaaaatgggccgaccttattgtgctggcaccggccactgctgacctgattgcccgtattactgccggtatggcaaacgatctggtgacgaccgccgtgttagcgacggcctcacccgtggcagtggtgcccgctatgaatcagcagatgtatcgtgcggcggtgacccagcataacctgcagagcctgcaggcgcgtggcgtgctgatttggggaccggacagcggcagccaggcctgcggcgatgtcgggccgggccggatgctcgacccgctggtgattgttgaccatgcggtgcagtgggcctcgcccgtcaacgatctgcaacatctcaacattatgattaccgccggccctacccgtgaggcgctggacccggtgcgctacatcactaaccacagctccggcaaaatgggctttgctattgccgacgccgccgccagacgcggtgcacaggtcacgctggtcagcggcccggtcaccctgtctgcgccagcgggtgtgcggcgaattgatgtgaccagcgcgctggagatgcaggccgccgtcatgagtgagatagataaacaacatattttcattgcaagcgcagccgtggcagactaccggccagccgatattgcggccgataaaatcaagaaacagggcggcgatgataacgtcacgctgaacctggtaaagaatcccgatattgttgccggcgtcgctgcacttcaggaaaaccggccattcgtcgttggatttgctgctgaaacacagaatgtggaagaatacgcccggcaaaaacgggtgcgcaagaatctggatctgatctgcgctaacgacgtcgctaaagccggacaggggtttaatagcgacaccaatgctcttcaccttttttggcaggatggagaaaaacgcttaccgctcagcgataagtctctccttggccaacaattaatagacgagattgtcagccgttatgatgaaaaaaatagacgttaaaatcctggatccgcgcgtcggcaaagagtttccactgccgacctacgcgacttcaggttccgctgggttagatttacgcgcctgcattgatgatgttctcgacatcgcaccaggcaccacaacgctggttccgaccggcctggcaattcatattgccgaccccgatctggccgctgtgatcctgccgcgctcaggccttggccataaacatggcatcgtgctgggcaacctggtgggtctgattgactccgactatcagggacagctgatggtctcggtctggaatcgcggccaggaaagcttctcgctgcagcccggcgatcgcatggcacaactggtctttgtaccggtggtgcaggcggaatttaacctggtcgaagatttcgacgccagcctgcgcggcgaaggcggcttcggccactccggtcgccagtaacccgcattaccgactttcacttacgcccgttattttttcctcatcgccacaggacgcgtttcctgtggcagatgcgtaggtgttgcctgtttttaggtgaatttcaggggtctttaaggtcatggcagaaaaaaaagtcgcgaagcggaatcgtcgcgaagagattttgcaggcgctggcgcagatgctggagtcgggtgatggcagtcagcgcattaccacagccaaactggcagccacggtgggcgtttccgaagcggcgctgtatcgtcacttcccgagtaagacacgaatgttcgatagcctgattgagtttatcgaagacagtctgattacccgcatcaatctgatcctcaaggatgaaaaagagaccatgacgcgtctgcgtctgatcgtgcaactgattctgggatttggtgagcgtaatccgggactgacgcgcattctgaccggccatgcattgatgtttgagcaggaccgactgcagggacgcatcaatcagctgtttgagcggattgaagtgcagctgcgacaggtgatgcgggaacggaaaatgcgcgagggcgaagcctttcaggctgatgaggcgctgctggcaagtcagttgctggcattctgtgagggtttactgtcacggtatgtccgttctgagtttcgtttcagtcctaccgcagactttgaggctcgctggccgctgattgccgcgcagctggcgtaaagcgcaaaagaaggcgggcattgcgcccgcctctgttaaatcccgtacgctttctgataggcacgtacctgagccagatgatcggccatctcaggcttctcttccagccaggcaatcaggtctgccagcgtaataattgcggtcactttgcagccgtaatcacgttccacttcctgaatcgccgacatttctccgcgtccacgctcctgacgatcaagcgagaccagcacgcctgccagagtggcgttgtgcgcaccgataatatccatcgactcacgaattgcggtgcctgcggtgatcacatcgtccaccagcatcactttgccctgcagcggactgccaaccagcaggccaccttcgccgtgatctttcgcttctttacggttaaagcagtaaggcacatcgcggtcatgatgatccgccagcgccaccgccgtggtggtggcaatcggaatgcctttataggccgggccgaacagcagatcaaactcaacagcgccatccaccagcgcctgcgcgtagaagcgtcccagcagcgctaaatcccgtccgctgttaaacagaccagcattaaagaaataggggcttttacgcccggacttcaaagtgaactcaccgaacttcagcacctgcttgttcagggcaaattcaataaactgacgctgccaggctttcatttctcactcctcaaataaagaaaaggcgactctgaggtcgcctgttacatcaattttccagcgctgctttctgcgcctgaattaattcctcaattccgccccgagccagcgccagtagcgtcagcaactcttcatggctgaacggttcgccttcggcagtgccctgcacctcgatcatgcggccatcttccagcatcacgacgttcatgtcggtttctgcggctgagtcttcaacatactccagatcgcacagcgcttcgcctttgacgatgcccactgaaatcgccgcgaccatgcccttcatcgggttcgctttcagtttgccgctggccaccagcttgttcagcgcatcagccagcgccacacaggctccggtgattgatgcggtgcgagtgccgccatcggcctgaattacgtcacagtcgagcgtaatggtaaattcacccagcgctttaagatcaaccgcggcgcgcagtgaacgggcgatcagacgctgaatctccagcgtacgtccgccctgcttgccttttgcagcttcacgcgccatacggctgtgggtcgaacgcggcagcatgccatattcggccgttacccaaccctggccctggcctttgaggaaacgcggaaccccttcgtctaccgaggcagtgcaaagcactttcgtttcgccgaattccaccagaaacggaaccctctgcgtgtttggtgtaattgcgggtcaatgtgactggacgcacctgttgtgcgctacggcctgctggacgcatgggtattctccggcttgctaatgattggctgcgcattatacggacttccttgtccgctgtctcttacgctggtctgacgcaggcatcagatgaaattccccgccagctgtggctaaatgcgcgttcctttctctctgataaaaaagacatatggccgccattcttcatttcctgctggcgctggtggtgatttttgcccttgcgctgctggtcagtcatgaccgtaaacagattcgtctgcgctttattgttcaactgattgtggtggaagccgcgctgggttggttcttccttcactctgccgggggtctggcgctggtcggttcgttcgccggtttctttgaaacgctgctgggttttgccgcacagggcacggagttcgtgtttggcggaatgagcaaacaggggctggcatttatcttccttggcgtgctctgcccgattgtctttatttcggcactgatcggcatattgcagcactggcgcatcctgccgctgctgatccgtattttcgggacgctgctgtcgaagattaacggcatgggcaagctggagtcgttcaacgccgtcagcacgctgattcttgggcagtcggaaaacttcatcgcttataaagggattctgggtgatatcccgccgcgccggctctacaccatggcagcgaccgcgatgtctaccgtttcgctgtcgattgtcggtgcttatatgtcgatgatcgaaccgaaatatgtggttgcggcactgctgcttaacatgttcagcacctttattatcctgtcgatcatcaacccgatgaaaagccaggatgagcagcctatcgcgctggataaactgcatgaagagcagagcttctttgagatgctgggtgagtacatcctggcaggcttcaaagtcgcgatgattattctggccatgctgattggctttattgccctgattgctgccgtcaacgcgctgtttgcggcggtgttcggctacagcttccagcaactgctcggctacctgttctatcctctggcctggctgattggcattcccaaagccgatgccctgcaggcggccagcatcatggcaaccaaactggtggcgaatgagtttgtggcgatgattgaactgcagaaagtcgcggcaggcatgagtgcgcgtggactgggtattctgtcggtgttcctggtctcgttcgctaactttgcctctatcggcattgtggcgggcgcaataaaaggcctgaatgagaaacagggaaatgtggtttcccgttttggctggaagctggtctatggctccacgctggtcagtttgctctccgcagcctttgccggtctgtttatctgattattcaacgggcggcaattctgccgcccgctttcgccttagaatccgacgcagacgggtgcatccacccgcataaccgactcctgaccaaaccgttttttatagaggctgcgtaacgcctcaatatcaacgttggtggcggggtcgatcccgtggatcagtatcaacgccttactgttctcccgtgccagctgaccgttctcgcccagccattgccctttggcatcatagaccgacaggcccgctttaaaccgtggcgtgacctcattatccacgaagttcatccagtcgagtgaactcaccctgccgccatcaggcttgctcagtccaaaccacaacgtggtctgcatcatcatgtcgccacccgcacagatgggttgcggtttagtgggcggcgagtggcgtgcctggcaacctgccagcagcagagccatcacaacaggaagggcaataacgcgagacatagatcagtcatcctcacaaagggtcaacggccatcataagtggctgtcgctgaaagcggaaatggttcgttattttcctgtgcgacgcttatgcctgttatgccgtggctcgcctcgctatacttcacccatctttccgcaaatgagtaccgcttatgatccgcagtatgaccgcttatgcccgcagcgaagccaaaggcgaatggggcagcgccgcctgggagctgcgttccgtgaaccagcgttatctggaaacctacatccgcctgccggaacagtttcgtgggctggagccggttatccgcgagcgcattcgccagcgtctgacgcgcggtaaaattgagtgcaaccttcgttatgatgccgatcccagcgcacagggcgaactgatgctcaacgaaacgctggcgaaacagctggtgcaggctgccaactgggtaaaaatgcagagcgacgaaggcgcgattaatccgctggatattctgcgctggccgggtgtgatgtctgcgcaggaacaggatctggatgccatcaacacccagttgttgcaggcactggatggtgcgcttgatgactttattgcggcacgtgaaagcgaaggtaccgccctgaaagcgatgattgagcagcgtctggaaggcgtctcgcaggaagtcagcaaagtgcgcgcgcagatgcctgaggtgatcaaatggcagcgtgagcggctggtcgccaaactggaagatgctgaagtccagctggaaaacaatcgccttgagcaggaaactggtgatgatggcgcagcgtgttgatgtttctgaagagctggatcgtctggatgcgcacgttaaagagacttacaacatcctgaaaaagaaagaagcagttggccgccgtctcgactttatgatgcaggagttcaatcgtgagtcgaacacgctggcttcgaagtcgatcaacgccgaaatcacgacttcagctattgaactgaaggtgctgattgagcagatgcgcgagcagattcagaatatcgagtaatttccacacctgcacagtacatcccacaagcccatgttaaatgggcttttttacttttccatgatgcccatattccactgtcaaagttcactggttttgggagtaaagtggggaaatcgtctgcttaaccagctattaatgaatagtcagaatggtgtagtcctgagtctggtttaacaggtcagttatatgggtaacattttttcctgtgaggtcagggatagtcattggtcataatgaaaggtgggacttacactccttcacttttccgaccatgccgtttagtattacatcagtctgcttaatacctgcgactggtagttatatgaacagggctgtagcaaagaagcattggattttacagatatgtcgatattaaaataatttagcattcgattaattacattatttttcaggatgaaacattaatatcacaaggaagtcatcatgccagcattgaagtttcctgccaccatttttcaaacgaagcacaagtttaacgattacagcactgatgatatgaagtgtggagatctcactgaaaaacagctaagaagtgatttagacctggatgatgtttcaaatgtcgtcaatccctggactggaaaggaagtatcaatatttaacgcctttcagaatacccgtcgaaaatccagaacggaaatggctgaacttcttttcaatgagtttcttcgtctttctatgcctgcatattaccctgggcaacatcaaatattcaacaatctcgtaaagcatctttatcacggtaacggaaaaagctattccagtccctttcttgatagtgcatataagacgctaatattaggtggtcaaacatcgccactctcaccacttacagtaatcaaatcttcattagataaaattattgttgatggacaaaaaagcttatcagttacagataaagatttaataacacaagctataggcaattcaatacttcctaagtttaaccgttgggctgacagtttcaatggattaggtatgtcgatacatgatattcatgctacaaacatactgataaaccagctcgatataactgacaatggttatatcgcaaaaataacttttacagggcaggatcatttcggtctcgataaaactgacatccagaatcctaaatttcattttatcagagcctttcgtatatggtttatccttcaaagatgggaatactttgcatttaagccttttttaaccaatatgaaagctgagtttgaaataaatagcaggagaaactaatgcgaattaaaaagattattatttttattgtggcattggcaatgttactattgttttacgtgagcttctttagttctccaaaggtgcttgcaattcatggtcctgaagctaataaagaattattagttaaaaatatgcctttcactgatagcgataaaatcgaatggtgggataataatggagttaaaaccatctcttcccctgaaacttacaatgtttcaatctggaagtttgatgggaagtatcaaaagctcgctcccaggaactcaggggcttttccagaccatgatactgattacttattatgcttcgacgacatgaaaacagaagaaaattgtatagacaagtcaacctggatcatggaaatcactaagacaaaggatggttacacttactaccgtcttgatggaaagtcttactatcgaaaaccatccggtgaaactggtcaaaggtgaaagatttacgacaaccatcaagccagtaagctgatgagcttgtagctgtgctcatcggaaactggattgatgagtagaatagtaaatcgtcataaaaaaccaaaataagaagctgatttttataagatttactcaaaatcatcattcatatccagaagatcgagtaatttccactcaacaaagcgctcgcagtagcgctttgttcccctgtcaggcgctgtcagcacttaaagagttagctccttccgtcaattgatcgctttttcagcgcggccagcatcagaatcaggtaaagataaataaataatcatttccagactgttcctgaaacggcctcgcttacaattaaagctgctttcaggcttagattaagcagttgaaaaataatgattttataggattaatgtacttttatagccggtattaacgcctctccatgaaacaggtcaatcctgtagatgccggagtttccctttctttgaaggcactttttgataaaatgttggtcgaaatcagtacagctgtaccgccttaagactcatggaagtgctctttgtgcgatgcatccctctatcccatgaaggttgttaatgaaaaacaccggaaaatttagcagttcgctgctgcatccgcgttattggtttacctggtttggccttggcgtactctggctgctggtccagctcccctatcctgttcttatgcgtctcggtgccggtgccggcaaaatctctcgccatttcctgcagcgccgcgagcgtattacccgtcgtaacatcgaactctgctttccgggcatcagcgaagaaaaaacagaacatatgattgccggcaatttcgcgtcgcttgggatggcgctggctgaaaccggtattgcctggttctggtctgaccgtgcggtaagacgtctgtttaaagtgtcgggaatggaaaacctgcatgctgcgcagaaagaaaagcgaggcgtgatgctgattggtgtgcatttcatgtcactggagctgggcggccgcatcagcggactctgtcagccaatgatggcgatgtatcgcccacacaataaccaggcgatggagtatgtgcagactaaaggccggatgcgctcaaataaagcgatgatcgaccgtcgtgatctacgcggtatggttaatgccctgaaacagggtgaatcggtctggtttgcgcctgaccaggattacggccctaaaggcagcacctttgcgccgctgtttgcggtggaaaaagccgccacgactaacgggacttttgttctgtcgcgtctggcgaagccagcgatggtgccgattatgctgattcgtaatccaggaaatgatggctaccatttgatcatcgaaccgatgctggaaaattatcctcatacggacgaggctgctgctgcagcttatatgaacaaagtaatcgaaaatcagatccttcgcgcacccgaacagtacctttggctgcatcgtcgcttcaaaacccggccaccgggtgaaaagtcgctctacgtctgagttaactgataaagcaggcctcgtgcctgctttgttgttttaatccgctgaacgacatctgctttacgtccactctctcatccccgtttgctgtgctctcatactgcctctgccgttatagctacctctacagtttctgctgttcagcacacctgtctgcttccggcaggctggtatcaaagagataattaaggaatgatgaatccccttacctcgtcaatgccggacaatcttatggatatcaacgatacacagcagtggcagcgtccgctgattgatgatcgccttacgccctatattgaagtggatgcagagcgcctggagcagaaacctgcagcatatgcagcgcaaagccagtgcggcaggcgtcgcgttgcgaccccatatcaaaacgcataaaagcgtctggattgcgcagcgtcagatcgcgtccggtgcacagggtgttaccgtctctaagcccagcgaaggcatcagctttattcagggcggtgttcgtgatctgctattagcctatccgattgtgcaaccgcaaagcgtggctgaattgctgcgccacgccgtgcttcatcaggcaaagctcaccctgattgcggacaggctgcagggcgtggcggctattgctgatgcctgccagcagcaaccggaatgcgacctggcggtagcgattaaggttgatgttggattacatcggataggtgtcaatcctgatacagatgaagcggtgctgattgctcaggcgctgcaggacaaagggttacgctttgccggattagtgtcacatgctggccacgcttatggtgccgggaatgccgcggccattgcggatgtcgcccggcaggaaacggcattgatgcagcgagtacaggcaaaactgcaggcggctggttttaccgactgccctctctctgtaggttcaacgcctacggcgctggcagcagagattgcaccctgcatgaatgaaatccggccaggaaactatgcactactggacctaatcgcctgccgtctcggattaagtcacgtcgatcagctggcaatgagcgtcattacccgtgtcgtggcggtgaacgatcatttcgcgattgtggatgccgggtcaaaaatgctgagttcggataaagggccacacggcaccaatgccagcggctttggtgtggcagccgacgaagcgggtcagacttatgaagtgacaaaattatctgaggagcacggttttctgctttatcaggatcgccgccctgaagtcggcacgctgctgcgtattttccctaatcacagttgtgccgtgatggcgcagtcggacggctttgttctgcggcacgctaacggccatagcgaagatcatggggtttctgcgcgcggcaatttcatctgagtcagtggcagacagcatcatccgttgtctgccatttgtacgaaaccctttcaacaacacacttctgctgttacagcgttttaacaagcctgaccacatgctttaatgcctttttagcttattcaccggaggttacatgctctcctctcgcactctgagcctgacgattccacgtcactggttagatctttatgaaaccatctggaagccagagtttttcccaaagtgggcttccgggctgacgcacagcgcgttagaaacccgatggcaatcgctggcgtgctaaaggcccccagggcaatgtgaagatccggttctcgccacataatccgtttggggtaatggatcactggattgatagcggctcgggaaaggagatctacgtaccgatgcgcgtgatagcaaacgaacagggcgccgaggtgatggtaacggtttatcgccagccatttacttcagatgaaaaatttaagcaggatattgaatgggttagcaacgatcttgagaaactcaaccagcttcttacacaataaatcaatgacttagcgcgcctttttctctgcatttatcactggccgttaatgaaaaaaaatagaaaaactttcgacgataaagcataaagcgcttatctgattactcatcatccttacgcatttatcaccaaccctgcttaagcatcgctgccaggaaaaatcctggcaaaatcctctgaaaggcaggcgaccccctctgatttcgggcctcctggtttgccgcacaaacaatttctgactgacccatacattaatcattaacaatcgtttattagcaatctgctgaggatttaatatttatcatgcataaagtgaaaccatttatttctgtggtcacgtaatcagacttttcttatggtgttaaattaaataaaacaatgtataaatcattccacacacagcaatacccataatgataaagcaggaaaaaagtcatggaccgctcaacgtatcctttgttatcagaaaaagaatgcgttgagattgccgcaaggatgctggcaggagaatataaaactacaacaggatttattcgtgatctggcggaattcttattcgctgaagggaattccgccatgacacgaaacagcgattttaccagggatatcttttttatccaggcatcatttgattgaatccataataacatggcaagcctgtaaagcgttttcaggacttcggccggaaaaattgcactaactaacggtgttacagcaacctctccttgccgttacacaactatttaattctcacagagtcgatggactctaacgagtatattatggcaatacgtgaaagcagtctgaatggcgcaaaatggtctctgctctcttcaatcaaaattattggcatcggcgtattacaactctcgttgctggcgcagattctgcaggcaaatgagctcaatctgctggcgatcgccgtgatagctttactggctatcgatactctggccgatcggggcttctcaaatacgctgatccgccgctcgattctctctatcaatgacctctccacgatctactggggtaatatgttgatgggggtcgcggtgtttggtctgttatttactggcagccacctgctgaccagcctttttgatcagcctgaactggcattaatgctgcagatggtttcagtggtgtttattatcatcccacagggtcagcattaccgtgcgatattacagcgcgaaaaacaatatacccgtatcgcttttgctgaaacctcctcggtattagccggacttgccgtcaccttatttaccgtctggctgaccccttcagtattgtgtgcgatctggggttatctggccatggcatcgattcgtatgctgatttactgctactatggtcgttcatggttccagccggaataccgttttagcctgaatgcattttctaaaattcgtgcaagaaacaaataataaaataagtctgtatggtgggctctgagcatccgaaacgatgcgttggcgtgctgttaaccagcacgccttttctttttatttagtctgtcgcaatatttacctgatcgattcttttcccgcagcatccagcccttttttatctcctgtataaactggttttcgaccaacggctatctggcgatcgtcgtcagctcaccgcccgccctgggtcggaaaaccccgcgccggaacgcgcaaaccctctgtacgttgtttcctctcaactttttcaatcacctgccgcggtcccttcgcaaaaaagtctttctatgatgacgccagcgctggctggtataaactgcgctcatcccggacgccgattgccagaaaatcttcggcgccgtctctcaagcaatgccgtagtcttgccgccgtcttactggagtctgctatgttactgaccgttctctacattattggtattactgctgaagccatgacgggtgcgctggcggcggggcgtcgcaaaatggatctgttcggtgtcatcattatcgcgtccgtgaccgccattggtggcggtttcggtgcgcgacatcctgctgggtcactatccgctgggctgggtgaaacatcccgaatacatcatgattgttgcagcggcggcggtagtgaccactttcctggcacccctgatgacgcatctgcgcaaagtgtttctggtgctcgatgcgttaggactggtggtcttttctattatcggcgcgcaggttgcgctcgattcaggacacgccatgattattgccgcgataagtgcggtcattaccggcgtctttggcggcgtgctgcgtgacatgttctgtaatcgcattccgctggtgtttcagaaggaactctacgccggtatcgctttcgcctctggctggatgtatatcctgctgctgaaaaccacactggcgcatgaagcggtgattatcattaccctgttgttcggattcttcgcccgtttactggcgctgcgcttccgtcttggtttgccgattttcaactatccccatcccgagcattgaggatgcgggaattccctgctgtctcagaaaagcgatcagcgtctgcaggcgggcatcatggaactgcgcaaccaggcgctttgccagcgccgcaccgacacccggtaaagcttgccagtccctgacatcccgctgcgttaagctctcccactgctgatcgggcagcgcattgagggccttccgcggcagtgaaacacctaaggcatccacccagcgacgaagcggctgctgacgggtgagattaaaacggtgccagagctgacccgcccgctcccgagagaggcccgttgcggcggcgatctgttccggtgttaacgtcagccagccgaacaggtgcgtcatactgccggtttccagtaagtgcagccaggtgctgcgctcaacgccaggaatattcagtaccgttttctgactgagccagcgtaattttgccagtagctgcttctggcattcagcgctgaaggtgtaacaactcagcggcgtgtagcgcgacgcgtcgggaggctgaggatagtgccgctctgccacgcgccagatcacccgctccagccggggaatgccctggcctgccagactcagtgtgatgacatctcccgccacgatatcgctctcctgccagcgacgcagcgatccaacattgacccgcctgaccgtcttatcatccagctgtaccggctgcagattaagtaccgcggctatcttcccggttcggccgactggaaaatcgacggagagcacttcagcgctgacttccggaggctgatatttccaggcaacggcccatgttccctctccaggcagccagtttttgcccgcaggtcgcaggctctgatgaacgacgacaccgtcagtgacaaagggcagctcagcatgaaaccagcgctcccgccacgctgcaacctcctcttcgtctttaacgctgtggctccattttgcggcaacgcccagtccccagcggctgagttgctgaaggcgttccctcatcgtggcggggccatctggccaggcccagataaaaatatcgagcgagtccagcagaggaaacccgctgcttgctcatcatggcgcctgctacctgtgagcgcgcattcctgccgccatgaaccgcctgctgatgaccggtcatcgacagaaacagctcaccctgcagcacaacctcttcaagtccggtctcgatctgcagcggaatcgcagggatccaggcggctttagccagccactcttcaccgcgtaatccatcaccacgactcaacagtgaaaccagtctgccgtggcgataaaccagggaaacggcaatgccatccactttcggctgcacccagagatcgtgccgcccctgcatccagtaagccagggccagcttgtcgcgcatcttttttacgcccgtgtgggcgaccggatgcaggtgctcaccctcacccggcagttgcggtacgtaagcaggctgcggagggttaaagcagtgctgccagtgattcagtcgctgctgcagactgtcataatctgcatcagccaccggactctgcccctgacgatagtaagcatcatcccaatgctgcagctgctgttgcagacgacggatctcttctgtcgcccgggtgggagtccagaccggacaaagggcgctatgcgcaggccataggacgatccacagagcagccgcaaacagcggccagccgaatcctttcatgatctctctcctgacgttttgcagcattcaataccggtgcttcagcgtcagccagaggtgatgttcagctatggaaggaatgccgtcgcaatcaggggataattacagtcgtccgacagagatttgcgcgaagatgcgcaaaagttgggtgttgccgctgcgcaaacgctgcgtggcggcgggaagctgtgtatactgtgcaggaaatcgactccgcttttaatcaattcaagaaaaccatggctcaaggcacgctctatattgtttctgctcccagcggcgcaggtaaatccagcctgattcaggcgctgttaaagacccagccgttgtatgatacgcaggtctctgtttcgcacacgacgcgcggtatgcgtccgggtgaaacccatggcgaacattacttttttgttgagaagcatgaatttgagcagatgatcgcggaagaggctttcctcgaacatgccaaagttttcgacaactattacggtacctcgcgccatgctattgagcaggtgctggcaactggcgttgacgtgtttctcgacatcgactggcagggtgcgcagcaaattcgcaccaaaatgcctggcgcacgcagcatctttgttttgccgccttcgaaagaagagctcgatcgccgtctgcgcggtcgtggccaggacagcgaagaggtgatcacgcgtcgcatggctcaggcggtagcggaaatgagccactacgccgagtatgactatttaattgtgaatgatgatttcgatctggcgctgtccgatctgaaaaccattattcgcgcagaacgtctgcgtatggcgcgtcagaaggcgcgtcacgatgctttaatcagcaaactgttggcagtctgaatacagtttcagtatgatgcgcagtcatttcttcatctgtggagtagcacacctatggcacgcgtaaccgttcaggacgcagtagaaaaagttggtaatcgttttgacctggtgttggtcgctgcacgtcgtgcacgtcagatgcaggtaggcggcaaagatccactggttccggaagagaacgataaacctaccgttatcgccctgcgcgaaatcgaagaaggtttggtcaccaatcagattttagatgtgcgtgatcgtcaggaaacagcaagagcaggaagccgctgagttacaggccgttaccgctatcgctgaaggtcgtcgttaacagccacctgcaggtcgcccttgtatctgtttgaaagtctcaatcaactgattgaaaaatacttgccagaggagcagatcaagcgcctccagcaagcctaccttgtcgcacgtgatgcccacgagggacagacacgctccagcggtgagccttatatcacccacccggttgccgtggcctgtattctggcggaaatgaagctcgaccatgaaactctcatggccgcgctgctgcatgacgtgatcgaagatacgcctgccacttaccaggacatggaacaactgttcggtaaaagcgtggcggaactggtcgaaggcgtttccaagctggataagctgaaattccgcgacaagaaagaagcgcaggcagagaacttccgcaagatgattatggcgatggtgcaggatatccgcgtcattctcatcaagctggctgaccgcacccacaatatgcgcactctcggcgcattacgcccggacaaacgtcgccgcatcgcgctggaaacgttagagatttacagtccgctggcgcaccgcctgggtattcatcatcttaaaacagagctggaagagctcggttttgaggccctctatccgaaccgttatcgggtcattaaagaggtggtgaaagccgcgcgcggtaatcgtaaagagatgatccagaagattctttctgagatcgacggccgtttgcaggaagcgggcattccctgccgcgtcagcgggcgtgaaaagcatctttactcgatttaccgcaaaatgacgctgaaagagcagcgttttcactcgatcatggatatctatgcctttcgcgtcatcgtgaaagatctggatacctgctatcgcgtttctgggccagatgcacagtttgtataaaccgcgtccgggccgcgtcaaagattacatcgccatccccaaagcgaacggctatcaatcgctccatacctcaatgattggtccgcatggcgtgccggtcgaagtacagattcgcaccgaggatatggatcagatggcggaaatgggggtcgctgcgcactgggcttataaacaggcgggcgaaagtggcaccaccgcacagattcgcgctcagcgctggctgcaaagcctgctggagctgcaacagagtgcgggcagttcgtttgaatttattgaaagcgtgaagtccgatctctttcccgatgagatctacgtctttacacctgaaggccgcattgttgagctgccaaccggtgcgacgccggtggatttcgcttatgcggtccacaccgatatcggccatgcctgcgttggcgcacgcgttgaccgccagccttatccgctgtcgcaaaccctgaccagcggtcagacgattgaaatcatcaccgcgccaggcgcccgtcctaacgccgcctggctcaactttgtcgtcagctccaaagcccgcgcaaaaattcgtcagctgctgaaaaacctcaagcgcgaagactccgtcaatctgggtcgccgcctgctcagccatgcgctgggcggcagccgtaaactggctgagattccgcctgagaatatcaggcaggagctggatcgtatgaagctgacctcgcttgacgatctgctggcagaaatcggtctgggcaatgcgatgagcgtggtggtggcgaagaacctgttgcaggctgacagcaacgccatcagcagcaacagcaagcgcggtaaactgccgatcaaaggtgcagatggcgtgttgattaccttcgccaaatgctgccgtccgattcccggtgacccgattgttgcccatgtcagtcccggcaaagggctggtggtgcatcatgaatcctgtcgaaatattcgcggctaccagaaagagcccgaaaaattcatgccggtcgagtgggataaagtcaccgagcaggagttcgtggcggaaatcaaagtcgacatgtttaaccatcagggcgcactggctaacctgacggcggcaatcaacacggccggttccaatattcagagcctgaataccgaagagcgtgatggccgcgtttacagcgcatttatccgcctgaccgcacgtgatcgcgtccatctggcgaatatcatgcgtaaaattcgcgtgatgccggatgtgatcaaagtccatcgtaaccgtaattaggcatgaacgatcaacgatttgcccggattcaggcgatgctggcactgcgccagcacgatctcacggtctgtatggagcaggtgcataagccgcacaatgtttccgcagtgatccgcacggcggacgccgtcggcatccacgaagtgcatgccgtctggccgagccagcggatgcgcactcaggcttccgcatctgccggaagcaacagttgggtgaaagtggtcacccatcccaccatcggcgatgctgtaaaaaagctcaaacaacagaagatgcaggttttagcgacccatctctctgccgatgccgtggatttccgtgagatcgattatacccttccgacctgcatcctgatgggccaggaaaaaaccggcatcaccgaagaagcactggcgctggccgatcggcagattgtgattccgatggtgggtatggtgcagtcgctgaatgtctcggttgcctgcgcgctgatcctgtatgaagcacagcggcagcggcagaaacgcggggttgtacctgcgcgactacagcctgctggacgaagatgagcagcaacgtctgttgttcgaaggcggattcccggtgctggcgcgggtcgcaaaacagaaaggtttaccctatccgcgcatcaatgcgcagggcgaagtcgacgccgatcccagctggtgggcaaccatgcaatcgaccggtaaaagaagatgaaaggccgtctgctggatgccatcccgctcagtaccctgaccggcgtcggtgccagccaggcggcaaagctggccaaaattgacctgcataccattcaggatctcctgcttcatctcccgctacgctacgaagatcgtacccaactctatgccattgatgatctgctgcccggtatctgggccacagtagaaggcgaagtgctgcacacagatatcacctttggtcgccgccggatgatggtgtgccagattagcgatggcagcggcgtactgacgatgcgcttctttaatttcaatgccgggatgaagaacaacctgtcgccgggccggcgcgtcaccgcgtatggtgaaattaaacgcggtcagcgtggcgctgagattatccatcccgaataccgaatccagggcgaacagagcaatgtgacgctggaagagaccttaacgccggtttatcccaccaccgaaggtattcggcaggccacgctgcgtaatctcaccgatcaggcactgacgctgctggagagctgcccgattgccgaactgctgccgcaggaactgagcggcggtttaatcagcctgccagatgcgctccgcacgctgcatcgtcccccacccgatctaaaactcagcgagctggagagtggtcgtcatccggcacaacgcagattgattctggaagagctgctggcacacaacctcagcatgctggcggtacgcgccggtgctcagcactattacgctttaccgatgcttccccggcacaaccttagcgaccagctgctggctgcgctgcccttttcaccgaccaatgcgcagaaacgcgtggtggcggagatagagaaagacctggcaaatgactttccgatgatgcggctggtgcagggtgacgtcggctcgggtaagacactggtcgccgcgctttctgcgctgaacgttatcgcacatggtaagcaggttgctctgatggcgccgaccgaaactgctggctgaacagcacgccagtaacttccgccagtggtttgcgccgctgggcattgaagtgggctggctggccggaaaacagaaaggcaaagcccgccaggcacagcaggaagcgatagccagcggtcaggtggcgatggtggtgggcacacatgccctgtttcaggagcaggtgcagttcaacggtctggcactggtcattattgatgagcagcatcggttcggcgtccaccagcgactggcgctgtgggagaaaggtgaggagcagggcttccatccgcatcagctgatcatgaccgccacaccaattccgcgcaccctggcgatgaccgcttatgccgatctcgatacctcaaccatcgatgagctgccgccgggacgtacaccggtgaccaccgtggctatccccgatacccgacgcgatgagattgtggcgcgggttgagcatgcctgccgcgaagggcgtcaggcctactgggtctgcaccctgattgaagagtcagaattgctggaagcacaggcggcagaagccagctgggaatccctgaaaacggcgctgcccgacttaaacatcgggctggtgcatggccgtatgaagcctgcggaaaaacaggcggtgatgcaggcgtttaaagcgaatgaactgcagctgctggtggcgacgaccgtaattgaggttggcgtggacgtgccgaatgccagcctgatgatcatcgaaaacccggagcggttagggctggcgcagttgcatcagctgcggggccgtgtgggccgtggtgccgtggcatcacactgtgtactgctctacaaagcgccgctgagcaagacggcgcagaagcgtttacaggtgctgcgcgacagcaatgacggcttcgtcattgcccagttcgatctggagattcgcgggccgggtgaactgctgggcacgcgtcagaccggcaatgccgaatttaaagtggccgacctgctgcgcgatgcggcgatggtgcccgaagttcagcgtgtggcgcgccacatccaccagcactatcccgagcaggccagcgcattgattgaacgctggctgccagagaacacccgttataccaacgtctgaatgatccccatctgattcggcttttttatccctgccgggcaaacgattgcttttagcctgcggatgattacaatcgccacattattttttgggaagaacagaagatgtccactaatccgcagccagaacagccttccgccacgcaaagcgaactgatttatcgtcttgaagatcgtcctcccctgccgcaaacgctgtttgccgccggtcagcatctgctggcgatgtttgtcgcggtcattacccccgcgattctgatttgtcaggcgttagggctgcccgcagaggatacccggcacgtgatcagcatgtcgctgtttgcatcgggtgtggcatcactgctgcaaatcaaaacatggggaccggtgggttcgggcctgctgtcgattcagggcaccagcttcaacttcgttacgcccttgattatgggcggcatggcgctaaaaaatggcggcgctgacgtgcctaccatgatggcggcgctgtttggcacgctgatggtcgcctcctgtaccgaaatggtgctgtcacgcgtattgcacctggcgcgccggatcatcacgccgctggtttccggtatcgtggtgatgattatcggcctgtcgctgattcaggtggggctgacctccattggcggcggtttcagcgcgattaacgaccatacttttggtgcgccgaaaaacctgatgctggcaggggctgtgctgctggtgatcgtgctacttaaccggcagaagaacccctacctgcgcgttgcctccctggtcattgccatggcggtgggctatctgctggcctgggcgatgggcatgctgcctgccgccggcatccccaccgatcagccgctgatcgtggtgccgaccccgctctattacgggctgggcttcgactggaatctgctcatcccgctgatgctggtgtttatggtgacctctctggagactatcggcgatatcaccgccacctcggatgtgtcagagcagccggtcagcgggcccctctatatgaaacgcctgaaaggcggcgtgctggcgaatggcctcaactcctttgtctccgcgctgtttaatactttcccgaactcctgcttcggtcagaacaatggcgtgatccagttgaccggtgttgccagccgctacgtcggctttgttgtcgcgctgatgctgattgtgctggggctgtttcccggcggtcagcggactggtgcagatgatccctgaaccggtactcggcggcgccaccattgtgatgttcggcaccatcgccgcttcgggtgtccgcattgtgtcacgcgagccgcttaaccgccgcgccatcatgattattgcgctgtcgctggcggtgggcctgggcgtttcccagcagccgctgatcctgcagtttgcgcctgactggctgaaaaccctgctctcttccggtattgcggcgggcggtattaccgctatcgtactcaacctgatttttccgccagagaagtaaggccagaggcaggcttcggcctgcctgctaattattcggatttacatccaggctgttgagctgtaacggtaattcaggcataacaacctctcaccggatttaactcgggaaggatgctatgaaatttattggaaagtttttcctcaccttacttttgctgctgcttttcaccctggtcgtgatctatgttctgttgcagacacagtggggtgcaggctggtttagccgttgggtgagtgacaaaaccgaatggcatctctccctgagtaaaattgaacacaatttctcctctccctctcatatcattctggatgacttcagctttggtcacgatggacagcctgcagttctggtggcgaaacgggtcgatctcggtctggcactgattcagttcagcgatccgctgcatttcagcagccttgagctgcgagatggagaagtgaatctggccaatctggcgccaggcagcgcgctaccgattcaggccgatcgcctgcaactcaacaatatgcgtatcgacagccccaacagcgcgttaccgctgtttgctcagcaggttaatggcggcattctgccgtggaaacccactgcccttgatatgctgggccgcgatgcccgcttccagatgagcgcaggcagcatgacgctgaataatgtgccgggtgaaaacgtactgatccagggcagtgtctcccagggtcggatgcgctttgacaatattggtgccgacctggcgcgtggctctatgaccggcaacggtgagcgcgatgcccagggcaactggaaaattaatcagctgcgcctgaacgacatccgtctgcagaccaccagcagcctgaaagatttcctgcatagcctgcaggttgtcccctcgatcgccattacgcggctcgacatgaccgatgcccgcctgcaggggcctgactgggcggtaacggatctggatctgacgctgagaaacgttaactggcagggtgatgactggcaaagtaacgatggttcgctggcgctgaatgccagcaattttatcaacggtggattcgaactaaatgaccccatcgttaacctggacttctcaccgcagggcgtggcgctgacgcagttcagttcacgctgggcgaatggggtgattcgggctgacggtgactggtcgcgtagcgataagcgcctgacactgaaaaacctggcggtggcgggactggaatacactctgccgcaggactggcgcgatcgctggcaggcgacactgcccgcgtggctggatagcgtagaggtgacgcgcttcacctctaaccgaaacctgattatcgacatcaatccggcttttcccttccagctgacctcactggatggatccggtgaaaacctgctgctggcgcagcagcaccagtgggggatctggtcgggtaagctcagcctgaacgcggcagaatcaacctttaatcgcaccgacctgcgtcatccgtcgattgcgctgagcgctgaccagcagcagattcaggttacggagctgagtgcgttcagtaataagggtctgctcgaagggacggccaccgtaggccagcagccagcccgtccgctgacgctgcaactgacaggtcgtgctgtaccggtgaatgtgttgcagaaactggggatggcccgcgttgccgttaaccggtgacagtaatatgcagctgcagctgaacggtgcattaaccgcaaatcagccgctgcgcccgacggttaatggcagtttgtcggtgacaaccgacagtcagcaactgcagcagactatgcaggcaggcgaggtacgttaacaacagatcagggccgctgaagcggccctgatgattagttgatacgcgcgccggaccccccctcttccagcggcccgtcaggatcggcgggcaggacgatatagaccccttcaaacaccgcgccacactcatcattgccaaaaagctcaacttcgagctgcacacgcgctttacgcccgcgcgccaggcggtcgagatcgccgcttaatgagcccagatcggcaatcgcgccaggccgtccgctgatggggtggctatagcgaatgtgcgcatccgccagaataatggtgccacccagatgacgctcgcgcagcagcaaccagatcaacccccagccggtcagcgttgccagcgaaaacaggctgccagcgaacagcgtctggtgtggattctggttgcccgcttcaggcatggtggtgataaatttttgcccggtaaactgcagaatacggacgcccatcttttcgctgagcgggatatgatcataccaggcctgttgcagctgaccgcaccagtcggcgcgatgcaggatatcgtcgagcgtgacgaccggtttaatcatcaaaaagtgacgaaccggcgtcgtctgcggcgcggtaatctcgccctgattgatgtagccgagtttagcgaagaaagcgacagcatcttcgcgggcgctgcaggttacccgcttagccccttcctgacgcgccacggattccagcgtcatcgccaccagagtacccagtcccttgccctgaaccgaaggatgaacggccatgaagcggatagcggcctcattgtcggcattaatatagagacggccgatggcgaccggatttccctgctcatcaaccaccatctgatgatgcgccagcgcatcccaggcgtcacgttccgacccctgcggctgacgcagaggtttacgcaacatctcccagcggaactgataatagatatccagctcttccgccgtctgtggcacgcgaaggtgatacatgtaatgtttctcccgctcggatgtgtggccagttccctgccgctcagctgacgctctcacacctgtaaccagaacgtcacaggaccatcattcaccagcgagacctgcatatccgcagcaaaacggccattagccgtggtgatgccctgcttgcgacagcagtcgctgaaatattcatacagccgctcggcttcagcgggctcggcgccacccgaaaaggagggacgcatccctttttgggtatctgcggccagcgtaaactgtgacaccaccagcacgcttccgcccgcctggcgaacactcaggttcattttgccctgctcatcactaaagaggcgatagcccaatacgcgttctgcgagacgttccgcacgcgcgttgtcatcgtccttttccacgcccagcaaaaccagtaaaccggcatcgatttcaccgaccacttcctgattgacgctgacgctggcgcgctgtacgcgttgaatcaatgcaatcatgtttcctcgcgttgctcctctttgtgttgctgctttaactgccgatagtcggctaacgcaacggtgatttcagcgcctaacaacacaatacaccaggtccagtagacccagagaaacagaatggggatcacggccagtacgccgtagatcagctgataagaggggaacatagtaacatagagcgcaaagccctttttgcccagctcaaacagcgcaccggcaaccagcgcgccaatcagcgcatcgcgcggcggcactcgctgggtaggaacgatgctgtagagcaaccagaaggcgagccacgacagcaggagcgggaaaatacgcagcatctgatcgaccaggctggtgacgcctgtcgcgttaatccagcgcagcgacagcagataggagctgatcgccagactggcaccggccagtaacgggccaagtgtcaggatcatccagtagaccgcaaaggaatagaccatcggccgcttcttgttgctgcgccagatggtgtttaacgcggtatcgacggaatgcatcagcagtaaggcggtaacaatcaggccgaccgctccgaccgccgtcatccggtttacgttagccacaaactgctcaagatagcgttgcagcgtgttacctgcagccggcatcagattggtaaagacaaagtgcttcaactgcacactgatatcagagaagaccggaaacgccgcaaacagggcaaacaccaccgcaatcagcggcaccagcgccagcaatgagacataagccagattaccggcctgggtcgtcatgccatcctcatcaatgcgtttccacaacagtttgagccacaaccagaacgcatgcagcccgggacgaaatttacgtgacatcatgaattactgttgacctgcaaaccagttgggtaccgttttactgtcagtaaccagtacactttcaatacccagggcgcgggccgcctcaatattctgtggattatcgtcaaaaaataccgcctgatcggcagccacaccttctgcgtccagcacatgctgataaatccgggcttccggtttacgcatgcccagctcctgggagagatagagcttgtcggctgcctgctgcacgtccggatactgtgttggccagaattcgcaatgcagtttgttggtgttagagaggatcaccacccgatggccctccagccgcagccggttcatcagcgccaggatttccggacgcacgtcaacgaataccgcctgccagccagcggcaaactgttcatagctcagcgcgatttccagcttttcacacagcgccagcgcgaaatcttcatcgctgatctcgccacgtttcgtgttgttcaaacgcctcatccatctggaaatggctttgcagcgaggccagcggcacacgactaaggtcactccagacacccagcacgcggttaaagtcgatatcgataatcacattgcccaaatcaaagatatacagcatggtgtgtctccttctgttccctggagtattcactctagcggcaaaagggcaggctgaacaggcactcgcggagagaaaagcgtaaacggcagcgggcaggtaaaaagcgcgacatatcccacaaataatcgctggcccggctgaagaggcaggaatttcaggcaaaaaaaaagccccgcaggcggggctttttatcagttaaaggcgcaattatgcgtctttaggaccacgtgatgcacgtttacggtcattttcagtcaggtgacgtttacggatacgcactgactgtggtgtaacttctaccagttcgtcatcatcgatgaactcgatcgcctgctcaagagtcatcttgattggcggaaccagcgtcgtggcttcatcagtacctgaagcacgcatgttggtcagtttcttaccggtcaggcagttaactgtcaggtcgttagaacggctgtgaataccgatgatctggccttcatagacttctgcaccgtgacccaggaacagcttaccgcggtcctgcaggctgaacagtgcaaacgcaactgctttaccctgaccgttggagatcagtacgccgttctgacgctggcccacttcgcccgcacgaatgtcatcgtagtggctgaaggtagagtagagcagaccggtaccggaagtcatggtcatgaattcgttacggaagccgatcaggccacggcttgggatcacgtagtcgagacgtacgcggcctttgccatccggatccatgtttttcagatcgcccttacgctcacccatggcttgcatgactgaaccctggttgttctcttcgatatccagcgtaacgttctcgaatggctcctgtttacggccatcgatttcgcggaagataactttcggacgggataccgccagttcgaaaccttcacgacgcatgttttcgatcagaactgacaggtgaagctcaccacgacctgatacgcggaacgcgtcagcatcttcggtttcttcaacgcgcagtgccacgttgtgaaccagttctttgttcagacgctcaaggatctgacgtgaagtcacgtacttaccttctttaccgcagaacggtgaggtgttgacgttaaagaacatggttacggtcggctcatcgacgctcagtgctggcagcgcctgcacgttctgtggatcacagatggtgtcagagatgttcagctcgcccagaccggtgatagcaatgatatcgcccgcttctgccaggtcgctgtcgatacgctcaagacccaggtgagtcaggactttaccgactttaccgttacgggttttgccttcgctatcgatgatagtgacttgctggttaggcttaactttaccgcgcttgatacggccgatgccgatcacgcccaggtagttgttgtagtccagctgagagatttgcatctgcagtggggcgtcagcctcaacctgcggaggcgcaacgtggtcgacgatcgcctgatacagcggggtcatatcgtcagccatgtcggtgtgctcaagacctgcaataccattcagcgcagaggcgaaaatgatagggaagtcgagctgctcatcagtagcatccaggttaacgaacaggtcaaagacctgatcaacaacccaatccggacgcgcaccagggcggtctactttgttgataaccacaatcggcttcagaccatgcgcgaacgcttttttggtcacgaagcgggtttgcggcatagggccatccatcgcatctacaaccagcagcaccgagtccaccatggacatgacgcgctcaacttcaccaccgaagtcggcgtgtcccggggtatcaacgatgttgatacggtagtcattccacttaatggcggtgttttttgcgaggatggtaatcccacgctctttctccaaatcattggagtccatcacgcgctctgttgcttcggtacgggcatcaaaagtaccggattgttgcagcagtttgtcaaccagggtggtctttccatggtcaacgtgcgcgatgatggcgatgttacgcaaattttcgatcacagctttgcctcaggcattagaaatagcgcgttattgtacactgattaagcggaagactgaacacgatcacacttttcactgaaagtttattgcatggaggccaatttgccctgttaccggtgcagaaaatgcactaagttggtctgatgcaccaaaatagtgccatcagacgaccgttaagcaccacactggtgcaataaaacgatcgtggtgcagccgctttatgacaaaaaggtgcaccacaaggcgatttaagcatcatcaaaaaagttggcacagaattcgctttatctaaatcaagcgtaaacgccagacagatgtcggttgaagagcgtgccggaagaggttggtcagggagttgttttcccgcaacgtattccggaaacgacgtttcctcgccatgtagataatgaaagaccatttccaggagagttgagtatgtccgctgaacacgttctctcgatgatgaacgagcatgaagttaagtttgttgacctgcgttttaccgataccaaaggtaaagaaacagcacgttacgatccctgctcaccaggttaacgctgacttcttcgaagaaggcaaaatgttcgatggttcgtctatcggcggctggaaaggcattaacgaatcagacatggtgctgatgcctgacgccaccacggcggtcatggatcctttcttcgaagattctacgctgatcatccgttgtgacatcctcgagccaggcaccatgcagggctacgaccgcgatccacgctctatcgctaagcgcgctgaagatttcctgcgctcttccggcatcgctgataccgtactgtttggaccagaaccagaattcttcctgttcgatgacatccgtttcggctcatcgacgtccggttcacacgttgctatcgacgatatcgaagcggcatggaacaccggtaaagagtacgaaggcggtaacaaaggtcaccgtccaggtctgaaaggcggctacttcccggttccaccggttgactcatcacaggacattcgttctgccatgtgtctgaccatggagcagatgggcctggttgttgaagcgcatcaccacgaagtggcgaccgcgggtcagaacgaagtggcaacccgcttcaataccatgaccaaaaaagcggacgaaattcagatttacaaatatgtggttcacaacgttgcgcacgcttacggcaaaaccgcgacctttatgccgaagcctatgtttggcgacaacggttcaggcatgcactgccatatgtcactctccaaaggtggccagaacctgtttgccggcgataagtacggcggcctgtctgaaatggcgctgttctacatcggcggtatcatcaagcacgctaaagcgatcaacgccctggcgaacccgaccaccaactcttacaagcgtctggtcccgggttacgaagcaccggttatgctggcttactctgcccgtaaccgttcagcctcaatccgtattccggttgttgccagcccgaaagcgcgtcgtatcgaagcgcgcttcccggatccagcggctaacccatacctggcgttcaccgcactgctgatggctggcctggatggcatcatcaacaaaatccatcctggcgatgcgatggacaaaaacctgtatgacctgccaccggaagaagaagctgagattccaaaagttgcaggctctctggaagaagcgctgaatgcactgaacgaagaccgcgagtttcctgacccgcggcggagtattcactgacgaatcgatcgatgcttacatcgaactgcgtaaagcagagatggatcgcgttcgcatgacgccacacccggttgagttcgagctctactacagcgtttaactggtcagacgttttttgttgccgtggaaacttttagcccatcttcggatgggcttttttctccgcgaattcaccgttcattcgccctcttttcggcttaaagactaaaatgcacctctttagtgcagaggaacgctgtatggcaactggctctctgcccgatgcagggcagattctcaacgcgttaatcaacagtattttgttggtggataacgatctggttattcattacgccaacccggcggcgcagcaattactggcgcaaagctcacgcaaattgttcggcacgccgttaccggaattaaccggctacttttcgctgaatatcgaggtgatgcgcgagagtcttgaggctggccagggatttactgacagtgaggtcacgctggtggtagatggtcgcgcgcacattatgtcgctgaccgcccagcggttacccgatggcttaatcctgatggaaatggcgccgatggataatcagcgtcgtctcagtcaggagcagttacagcacgcccagcaggtggccgctcgcgatctggttcgcggcctggcccatgagattaaaaatccgctgggaggattgcgcggcgcggcacagcttttatcccgcgccctgcccgatccctcgctgaatgaatataccaaagtgattattgaacaggccgaccggttgcggaatctggttgatcgtttgctggggccgcagcagccgggcatgcacatcacgcagagcattcatcaggtggccgaacgggtggttaatctggtgtcgatggagctgccggagaatgtctcgctggtacgggattatgatcccagcctgccggaactgccgcacgatcccgatcagattgaacaggtgctgcttaacgtggtgcgcaatgcgcttcaggcgctgggcgacgatggcggcaccattattatccgcacccgcacggctttccagctgacgctgcacggcacgcgttatcgcctggtggcacgtattgatattgaagatgatggccccggcattccggcccagctgcaggatacgctgttttatccgatggtcagcggacgcgaaggcggtaccggtttaggcctctccatcgcccgtagcctgattgatcaacattcaggaaaaatagaatttaacagttggccgggacacaccgaattctcggtttacctgcctattcgccagtgaggtttctatgcaacgagggatagtctggatcgtcgatgacgatagctccatccgctgggtgcttgaacgcgcgctcactggagccggtttgagctgtgcgacttttgacagcgcaagcgaggtgctggatgccctctcaaccaagaccccggacgttttactgtcagacattcgcatgcccggtatggatggcctggcgctgctgaaacagattaaacagcgtcatccgatgcttccggtcatcataatgacggcgcattctgatctggacgcagccgtcagcgcctatcagcagggtgcctttgattacctgcctaagccgttcgatattgatgaagcggttgcgctggtcgagcgtgctatcagccactatcaggagcagcagcagccgcgtaatcagccggtcagcggacccaccaccgatatcatcggtgaagcgcccgcgatgcaggatgtgttccgcatcatcgggcgattatcgcgctcgtcgatcagtgtgctgatcaacggcgagtccggtaccggtaaagagctggtggctcatgcgctgcatcgccacagcccgcgcaccaaagcgccctttatcgcgctcaacatggcggcgatccccaaagatttaattgaatcagaactgtttggtcacgaaaaaggcgcctttaccggggcgaaccagatccgtcagggccgttttgagcaggcggatggcggcacgctgtttctggatgagatcggtgatatgccgctggatgtgcagacccgtctgctgcgcgtgctggccgatggccagttttctatcgcgttggtggctatgcgccggtcaaagtggatgtgcgtattatcgcggcgacccaccagaatctggaattacgcgtacaggaaggcaagttccgtgaggatctgtttcaccgcctgaacgtgattcgtgtgcatctgccaccgctgcgtgagcgtcgtgaggatatcccgcgtctggcgcgttatttcctgcaggtggcggcgcgtgagctgggtgtggaagcgaagattctgcatccggaaaccgagacagcgttaacccgactgcactggtcaggtaacgtgcgtcagctggagaacacctgtcgctggctgaccgtgatggctgcgggtcaggaagtcctgattcaggacctgcccggagaactgtttgaatccagtacgccggagaatccggtacagtcgctgcctgacagctgggcaacgctgctggcacagtgggccgatcgcgctctgcgttccggtcatcagaatctgctgtcagaagcccagccagagatggagcgcacgctgctcactactgcgctgcgtcatacgcagggccacaaacaggaagcggcacgtttgctgggctggggacgaaacacgctgacgcgcaagctcaaagagctgggcatggaataagcggttcagtacgggctggtgaagtctgccagcccgtttcttcagataacgcgggagaactgctgctgacgcgctttctgacgcagatagcgatcaaagcacatgcagatattgcggatcagtaaccggccaattcccgtcacctccagccccgtagcggtttgttccaccagcccatcggttatcaacggtttcagcagcgccaggtcctcagcaaaatagtcgctgaagcgaatgccccattgcgcttctgtcgcggcaaaattcagcgagaagttgcaaatcagcgtttttatcacgtcacgacgcaggcaatcatcgtcggttaaggcgatgccacgccacaggccatttccctgctgttccacacaattgtaccaggtattaaggtctttctggttctgcgcataactgtcgccaatcatgctgatggcagagacgccaagccccagcaaatcgctgtcgccctgcgtcgtatatccctggaaattgcgatgcagctgccctttgcgctgcgcgatggccagttcatcctgcggcttcgcaaagtgatccattccaatgaactggtagccctgctgagtcagggttgcgatggtctgctgtaaaatatccagcttttgctgagccgatggcagttcaccctctttgattttacgctgtgccgcgaacatcgccggcagatgcgcatagttaaagacgctaagacgatccgggctcagcgccagtacccgctccagcgtccaggcgaagctggcgggcgtctgcaggggtaaaccatagatgaggtcaatgctggtcgagctgaacccctgttcacgggcacgcgccatcagcccgaaaatcacctcttcatcctgtacccggttaacccgctcctgcaccgatttgttgaagtcctgcacccccatgctcagccggttgaatcccagcgatcgcaggtgatcaatcacatccagcgcaatttcccggggatccacttcgatcgacatttcggcatcatcggccacgctgaaatgctgcttcagtaaacccaccagccgggaaatctgcgcattgtcgaggaaggttggcgtgccgccgccccagtgaagctgcgtgacctgacgctgacgaaacagcggcgcacgctgaataatctcctgctcaagcacatccagatagcgatccgctttgtggcgctgacgcgtcactatcttattgcagccgcagaagtagcagagacgatggcagaagggaatatggacatagagcgacagcggacgatcagggtaacgcgccacggcacgctggaagtcgttttccgcgtactgctcgctgaaactccagcgcagtgggataggaggtgtaacgcgggccggcataattgtatttttcaattaacgcctgatcccactcaatctgctgcgatggcatgctcactccttccggtgacgtcgtctgagagaaggtcgcgaagaagaggagataaaaggtgagcgggatgagacccgacgtaaacgttgcttcagacgcgacaggcgtcgtagtttaaacaataaccacagcagataacatgtcgccagcagcgcgaaaattgatccaggccaaaacattgtcgtttacctgttaagcgcggcatgcgggtaacgcatgccgatcaaatttgcttagttgcctttcagcagacggtacatatcttcttcagcctgctcatcttcggcatcatccatcacaatgcctaactgctccatcagttcgtcgatacgatccagcgaggcatccagccagccctgatcttcagccgacagcgtttcgccattttccagccgatccagcagcgcatccagacgttcgtcattttccagcttcgccagctcttcttctggtgtcagacgcactttcttctctgctgccggtttttctgcgcttttctttggtttaacggcggcggtttttccttcagcgatcagggccaccggttttttactcccgatgcgcggatctttcacgctgtccgcctgacgtccgccattgttttcggacgcagccggattagcacggctgccagatgcatgtccgcgatgctttttatcacgtttgcgatcgcgtgcttcatggttgatatcgtcacgcgatttgcgtttggctttgacggcaggtttgccgttagcagctcgtgcaggttgcttcatagtattcggtcccggctttttttattcagtatagaattgcggcgaaatctagcagaaagtagacaaagaaaaaaggcgacagctcaagctgtcgccttatttcataccttcataagaaggaatcatgttttaaatccttttcggctcgtaacatcccggttaatcccgcgcctgctcaactcctgagctattccttatccctgtctggccgcatccctgaccctgttccattccatcgctcataaccctcctggtatccctgagcgcatcatcctgatgtgtgctgccgtgcactgcacactaatgtagaccaactggtaaaagcctcaagtcagtgtcaaaaatagttagttcaaaaaaagaacgttttaagataagggtttgaattacatatttttttatttttagtaattaaagtaaaaagcgaaataacccgcaccgtgaatggcaaatctcttacaaagtttgttaccgagatgcgattgagcactttcgcgtcataacgcgtataatcgcccgcattgccttaatgcgttttctggagtgtcaccttgtctgaattgaattaccacgttacccactttgtcatgagcgcgccggatatccgccatctgcctgccgataccggaattgaggtggctttcgctggccgctcgaaacgcgggaaaatcgagtgcgctgaatacgttaaccaatcagaagggtctggcgcgtaccagtaaaacgccgggacgtacgcagctgattaacctgtttgaagtgaaagaaggtaagcgtctggtcgacctgcccggttacggttatgccgaagtcccggaagagatgaagctgaagtggcagcgcgcgttaggtgaatacctgcaaaaacgtcaggcgctgaaaggactggttatcctgatggatatccgtcatccgctgaaagatctcgaccggcagatgattcagtggtcagtggaaagtggcattccggtgctgttgcttctcactaaagcagacaaactggcctcaggtgcccgtaaagcgcagctcaatgtcgtgcgtgaagccgcactcgaatttgttggtgatgtgcaggtagagctcttctcatcgctgaagaaaatcggcgtggataaggttcgtcagaagctggacagctggtttaatacgcttgaacctgcggttgaagatcaggacgcggaagagtgagtggcaaccttgtgccggtgatgctgacggtacaaaaagcccaataaaaaacgccccagtcacagaatgactggggcggctaaattcagccaaatccgattacgtgaagtaaaaggtctgaaagatagaacatcttacctctgtaccctacgcgacgaactttacctgattttctgtgcgtgacaaaggcttttttgttgcttacttacatgaaacaggactttttttaccatgcacgtcacaaaaatagcgttgcgatgtagtttaatgacgaaaaaagtgtttagaccataagcagttagaaaagcgttttctctcagtgccagcgttaaccacgctaaaccggtcaactaaacgattttcttatacctgattcagggccggttctgttcttcagaaccgaccacacgcatcgaatcagtgggcttcatcccagttgtcacccacaccgacttcaaccagtaaaggtacgtcgagctgtacgctaccttccatcaacgcacggattttctggctcgcctcttcaaccgccccggctttgacttcgaacaccagttcatcgtgaacctgcatgatcattctgacggcattgtcgttttgctgttccagccagttatccacggcaatcattgcccgcttgatgatatccgctgccgtcccctgcatcggcgcattgatcgcggcacgtttcagcggctttccggcgaatggcgttaccggatttaatatcgggcagccacagccgacggccttccagcgtttcgacatagcctttactcgccgccagctggcgtgtgttctccatatagcgcaggacgcccggatagcgttcaaagtagagatccatatactttttcgcttcacccgcaccgatattcagctgacgcgacaggccaaaggcgctcatgccataaatcagaccaaagttgatcgctttggcgctgcgacgctgttcgccgctgaccttatccagcgccacgccaaacacttcggatgccgtcgcgcggtggatatcttcgccctgggcaaaagcgtccagtaatcctttgtcctgagagagatgcgccatgatacgcagttcgatttgtgaatagtctgccgccacaatgcgatggcctttggccgcaacaaatgcctgacggattcggcgtccttcatcattacgcaccggaatgttttgcagattcggatcggcagaggataagcgtccggttgcggtgacggcctgatgataagaggtatgtaccctgccactgatcggattgatcatcagcggtaatttatccgtataagtagacttaagtttggataagccgcgatgctccagaatcactttgggtaacggataatcaagtgccagctcggctaacacctcttcgctggttgacggcgcgccgcctggtgttttctttgtgggcttgatgccctgtttttcaaacaggatcacctgaagctgcttggtggatgagaggttgaagggttcccccgccagctcatgcgctttcaactcaagctcagccagtcgggccgtcagctctttcgaatgctgcgccagaatagactgatcgatcagcacaccgttgcgctctatgcgcgaaatcaccgtcagtaacggcatctcaatctgttcgaagacttttttcggacccgcttctttctccagctctggccacatcttcagatgcagctgcagggtcacatctgcatcttctgcagcgtaatgggatgcctgctctaatgcgatttgattgaacgtcagctgatttttgcctttaccggcgatctcctggaaggtcacggttttatggttaagccagcgagcggccaggctatccatgtcatgtttgcccaccacgctgttgaggatataggactcaagcatggtgtcgaatttgataccggccagttcaatgtcgtagtttttcagcacgccgcgatcgtatttcaggttctggccaactttccatgcgctctcatcttccagcaagggcttgagctgtgccagaacggtagcgcgatccagttgatcaggcgcatcaagatagtcatgggcaaccggcagataggcggcttcaccgggtgccaccgcgaagctgatgccgacgatgttagcgctcagggtatccagcgcgtcggtctccagatcaaacgcaaagacttcgctgtttttcagcttctccagccagctatcaaagagatcctgatccagaatggtgacataaccctcggtcggtaacacgctgctggtttcaaccaccagggccggttcatcggcctgcgctttttgcgcctgcgtagtgctctttttaccctgcagccatttaccgtcctgcaggtcactcagccagcgtttgaactcgtaacgactgaacagggcctgcaatgcctctgtatcgggctcagtgactgtgagctcttcacagggcagcgccagctcaacgtctgtcttaatggtcgccagctgataagagagaaacgccacatcacgattctgctcaagtttggtcgccatggttttggcaccacgaaagccgagatcggccactttgtccagattgtcatagatcgtctgcatgctgcccagcccctgcagcaacgcctgtgccgttttctcaccgacgcctggcacgccaggaatgttatcggagctatcacccatcatggcaaggaaatcgatgatcaatgcgggtggaacaccatatttctgctcaacctcttctggtcccagaatggtgttgctcatagtgttaatcagcgtgatggcgggcgtgaccagctgcgccatatctttgtcgccggtgctgatcagtactgagagaccctttttctccgcttccagcgccagcgtaccgatgacatcatcagcctcgacgccgctcacagccagcaacggcagccccatcgcccgcaccatctcatgcagcggctcaatttgtgcacggagctcgtcaggcatcgggggacggtgagatttgtaatgctcaaacagctcgtccctgaaggttttgcctttggcatcgaataccacagcaacgtgactcggattgtattgcgccagcaggcttttcagcatgttgagcacgccgtacatggcgccagtgggttcacctgcactgttggtcagcggcggaaacgcgtgatacgcgcgataaagataggatgagccatcgaccagaatcaggggattttctgctatttgcgccataagtctgtgtagtcttcgttgctatgagttgggctataaggatgccacaatcaggcagaaatggtgaactaaggcgtgccacgtctggagtttttcacgcttttggggacaggatcgcaacgatcgttctgtggataactttgtgcgtaaaaattataacgcgctgtttttcaggaaaataaataatcgacgcttgaataaaaaccataaatttcattggtttatttaatttccgtgacccgatcgctatttttaatagcgcgatcccttgtgtggatattaaatttatgccctggagatggacaaaaattggcccgttgttcaaaggcataaaaaaaacgccagcagagctggcgtttaacgggggtgtgaggctgattacttctggcttaccaggaatttaactacgttcgcatagtctgcaacgaaattatccatagagctggtatcaagaccgccgttgttaaccatgtatttgccattcacgaaaatagcaggcacaccacgcagatcaacatcagcagcggctttttgctgctgtgcaaccagcgcttttacggcgaagctgttccaggctgcatcatagtccgccgcagagataccggccgctttgacaaaggtctctttcagactggcaggatcggtgatggtctgcgttttctgaatgccatcgaagatcggtgctgtcactttatcttcaacgcccagcgccatcgcgacagcccaggcctgggtcacgaccggccccaactctccaccgagaaaatcgacgtggtatttcaccatcttagtgtcagcaggcagattctttttcaccgcgtcattgacgtgataaatacgttcaaactgatagcagtgcgggcagaagaaggagaagaaactccatcacctgaggttcgccggccacaggtttaggcagactcacatattgtttaccttcagtgaactgggcagcagatgcgctgaatgccagcactaaacccatcagtgcaaaccaaatttttttcatcgtgaaaaattctcctgactacgtcattaatattgcggtgtcagctgcagaggaggttcctgcaacagcttctcctgctcggtaaagagtgaaatttgcctgcgccagaaatcttcatctgtcatccaggggaaagcgcgcggaaaagcgggatcctgccagcgtcggacaacccaggccagataataaaccatgcgcatggcgcgtaaaggttcaatcagtgacaattcattaatatcaaaatcactgaactcactgtacgcctccagcagtatatcccattgaatacgctgttcctgacgatcgccgctgatcagcatccagagatcctgcacggccgggccattacgggcatcatccagatcgacaaacagcggtccgtcacgccacagaatattacccggatggcagtcgccatgtaatcgtagcggctgccacgtggtgtgccactgttgttgcagcgtgtttcccagcttatcgatagcctgtagcagtgcgactttaagcgatgcaggcactaacagagagtgctccagcacctgccggggttcatgcagatattcatccagaccgatggcaggccgatgcctgaacagcgctttacgcccggtctgatgaatgcggcccaggaagcggcctacccactccatctgatcttcgttgtctgtctcatattgccgtccgcccaggctggggaatacggcaaagaagaagccagcgtgactgtgcagtgtctcaccctttaaccgcagtggcgccgcgatgggcacttcgtcagccagcagatcaagtgcgtactgatgttcttcagcaatctgttcggcacgccagcgctgtgggcgataaaacttcgcaacatagcggcgtttttcgtcgtcgctgaattgataaaccctgttctcgtagctgttcagggctgtcagacccgattcgacgcgaattcctgtttcccagagcgcatcaagcaacacgtcgggattcaatgtctggaagttaaaagcagcgtcgctcatcatgttacctgtagttgcccttgcaaatagcagccaaggataacactactcgtcctgtttaatgacaccccgtgcgcggagcagtgctgttttgaaatcaacttcataatcttttttcaggcctgggatctcatcatcgctggctgagtcacgcatcttgagatggtaaattaatacatcatcggttaattcacttaacgggccacggaaaccagattcctgagccagtttctgcaaaaatgtgaccagattaagatcaggctctttttgccaggcgggttgcagcaactcgattaactcgtttaaacgatggcatttcattcagatttctcctttcacagtgcgtcatcagcgagggcacagtcatgacaatattaaccggtatcattctggccggtggtcagggccgccgtatgggtggtcaggacaaagggctagtacagctggatggcaggccgctttatcagcatgtccttgaacggctcaggccacaagtcgacattgtcatgattaatgcgaatcgtaatattgatcgctatcagttaagcggatgtcgggttattcaggatgtttttgatgattatcccggtccgctggccgggatctacagtgggttgctcgccatcgacggtgaatgggccgctttttgctcctgcgatacgcctgcaatacctctctacttcgtcgaaaaactggtcgatcaacgcggtgaggcgccggcagtctgggtacgttcacagtcgcgcgatcatcctacgctggcgctgattcatcgggaaatggctgcacctctttatgactatcttcaggctggagaacgacgtcttatgcattttctgcgcgaccacggtggccatgctgtccggatggatgaggatgaggctgccttccgcaatatcaatacgcctgatgacctgaacaacagaggctgacatgtcattacctatacttgccattgtgggctggagtggaaccgggaaaacgacgctattgcagcaggtgataccgattcttggcgataaaggtatccgcgcaggattgattaaacatacccatcatcagatggatgtggatacgccaggcaaagatagctatctgctcagaaaagcgggtgccagtcaggtaatattggccagttcagagcgatgggcattgatgtgtgagacgccggaaaagcagtcgattaatctgccttatctgctcagccgcatggatcacgctacgcttgaggtcgtgctggtcgaaggcttcaaagatgaacccgtacctaaaattgttttatggcgggccgggatcaagggtgggatcgaggaaactgcttgatgagcaggtaatcgctgtcgccagcgaccagaaattaacgctgaacgtgccagttctggatataaatcgtccggacagcgttgcagacttcattgccgactggcttgagaaacgctgaaatggatgttgtgatgcagtttttcacgatctgcagacgtaaaaaagccccgcacttccgtgcggggcttcttcacttatttaatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagaatatccggtacaggctgaaaattctgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccggattacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttgcggataaccccatcaattaaccttccggcaccgggcaggcgtcacaccgtatacgtccactttcgtgtttgcacagtgctgtgtttttaataaacagttgcagccagctggtatcttcgactggcttcggctcggggagtaaatccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgtttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgttttacaacgctgcgaattgcaagcatttgagagactcgaacgcatcgccaaatcattccttattacggaggaatgacgcgctgcgtcgtttcaattttcagcttgttccggattgttaaagagcaatatcttaaacatgactcgtaagtcatctttaagatatgtgggtaacatctttcacctgtcaccaagctttggcgtcccctaggggattcgaacccctgttaccgccgtgaaagggcggtgtcctgggcctctagacgaaggggacaattaagtctgtcttcgaaagacactttgctcgttattttctatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccctatcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaagagcaagctctctgtgctaccgtccgacttgcatgtgttaggcctgccgccagcgttcaatctgagccatgatcaaactcttcaatttaagtttgatttgcttaaacaagttaagcgttgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctatttcagaagtttttctccggcggcgcagtctcctgtgcctctcaacccgcttcgcgttgccggtgtgccgtgttgatggatgcgcattatagggagttgtctgagaggcgcaacccataaattgcataaaaaagagcgttcgctgcattccacagcaaaagcggctgttatacgcagttacacacaatgttatccacattagtcgggccagataaatttaggcgagcatcacgcaaacgttttcgctacaatgccgggcgaagttccggacaccccttttcggggcgttacctgaggtttttgattttttcttcctgtatagagaagagaaaaccgctgtaaagcctgatgtaacgctcttatatacgcgaaacaaagccaagggataaaccaccatgcaacaaactcgtcctgtacgccgcgcattgctcagtgtctctgacaaagccggtatcctcgaatttgctcaggcgctctcaagtcgcggtgtcgaaactgctctccacaggcggaacagctcgcctgctggcggatgcaggtctggctgtcacagaagtctctgactacaccggtttcccggaaatgatggatggacgcgtcaaaaccctgcatccgaaagtgcatggcggcattttaggtcgtcgcggccaggatgatgccataatggcgcagcacgacatcagcccaatcgacatggtggtcgttaacctctatccctttgcacagaccgtcgcccgtgaaggatgttcactggaagatgcagtggaaaatatcgacatcggtggcccgaccatggtgcgctctgctgccaagaaccataaagatgtggcaatcgtggtcagcagcggcgactacgaagcgatcattgccgaaatggatgcccatgaaaatggcctgacgcttgagacccgtttcgatctggcaatcaaagcgttcgaacacaccgccgcgtatgacagcatgatcgctaactactttggcagcctggtgcccgcctatcacggtgatcgtaatcagcccgccggccgtttcccgcgtaccctgaatctgaacttcattaagaagcaggatatgcgctacggtgaaaacagccatcaggatgctgccttctatatagaagagaacatcactgaagcttcagtggcgactgcccggcaggttcagggcaaagcgctctcctataacaacattgctgacacggatgctgcactggagtgcgtaaaagagttcagtgaacccgcctgcgtcatcgtcaaacatgcgaacccttgtggcgtagcgaccggtgactctctgctggcagcctatgagcgtgcttaccagaccgatccgacctccgcatttggcggcatcatcgcctttaaccgcgagctggatgaagcaactgcgcaggccattatcagccgccagtttgttgaggtgtttatcgcgccagcggtttccgaggccgcgctgaaaattaccgccgcgaagcagaatgtccgtgtcctgatctgcggccaatggcaaaaccgtactgctgcactggatttcaaacgcgtcaacgggggtctgctggtacaggatcgcgatctcggcatggttgatgccagccagctgcgcgtcgtcagtaaacgtcagccaaccgaacaggagctgcgtgatgcgctgttctgctggaaagtagcgaagttcgttaagtctaacgccattgtttatgcacgcgacaacatgaccatcggtatcggtgccggacagatgagccgtgtctattccgctaagattgccggcattaaagcagccgatgaagggctggaagtaaaaggatcagccatggcgtcggatgccttcttcccgttccgtgatggtattgatgcggcagccgcgtcaggcgtgagctgcgtcatccagcctggcggctccatccgcgatgaagaggtgattgcggcggctgatgagcacggcattgccatgatcttcaccgacatgcgtcacttccgccattaatcgttctggagagaaacagatgaaaattttagtaatcggcaatggcggacgtgaacatgctctggcctggaaagcagtccagtcgccgctggcggaaaccgtgtttgtggcaccgggtaatgcgggcaccgcattagagcctgcgctgcagaatgtcgcgattagtgcaactgatgttcctgccctgcttgagtttgcccggcgtgaaaagattgatctgacgattgtcggccccgaagcgccgctggtaattggcatcgtggatgccttccgtgaggccgggctggctatctttggtccgactcaggctgctgcgcagctggaaggctctaaagctttcaccaaggatttcctagcgcgtcatcagatcccgagtgcggaataccagaacttcaccgaggttgagcccgctctcgcgtatctgcgtgagaaaggcgcccctatcgtcatcaaagccgacggtctggccgcaggtaaaggcgtaattgtggcgatgacgctgcaggaagctgaggatgcggttcaggatatgctggccggaaacgcctttggcgatgccggacatcgcattgtgattgaagagtttctggatggcgaagaagccagcttcatcgtgatggtggacggcgagcatgtgctgcccatggccaccagccaggatcacaaacgcgtgggcgatggcgataccggtccgaacaccggcggaatgggtgcctactctccggctccggttgtcaccgatgagatccaccagcgcgttatggatcaggttatctggccgaccgtgcgcggcatggcggctgaaggcaacatctataccggttttctctatgccggtctgatgatcgatcacaccgggcagccgaaagtgatcgaattcaactgccgcttcggcgatccggagactcagccgatcatgctgcgtctgcagtcggatctggtcgatctttgcctggccgcctgtgacggtaagctggatcagaaaacgtcacaatgggatccccgccctgcgctgggtgtggtcctggcggcgggcggttatccgggtgactacactcagggcgatcagattcacggtctgccactggaagaagttgctgacggcaaggtattccacgccggaacacggctggaagaggacctggtgctgacaaacagtggccgcgtgttgtgcgtaaccgcgctgggcgacgatgtggccgcggcacaaaagcgggcttatgagctgacacagccaatctcatggcagggcagcttctgtcgccgcgatatcggctaccgcgccattaatcgcaaataagttcagggggcaccaggtgcccccttttcaattcacatatcttcttctgtcggctgctgtgagcagtcatcctgctgactgacccgcaatagctgtatcccttccggcgcttcaagccatgacaccatcagcggtgttgatgcgcggcgttgctgctgtgtcagcatctgcagagcgtcggcgtcaaaagcgggtctgacctgctggccttcgcaactcttcagcacattgtttcccagccagtgtccctgtctgaggaacacctgaccgcttaatagcgcatcgctgaggttacgcatccgctcggcatcaaacttatagagctcaaccgcatccgggctgaccgcttcacgccggcctgaaagctggcgctgcataaagttaagaccgccagcctggtcaaagcgcagggtcacatcatcaggctggttgcccttcacctgacgctggatgctgatcaacgactcttccagccagacataatccgtcacttcaccctcaccgccactgaaacggcgtatagaaggtgcggatatggaccgactggtggtcgctgtttttacgccagatacgaacaacaccacgatcggcaagatagccactggcagaaaaggggggaatatccggagtagagctgcaaccgaaaagaaacagggagagaaacagaacagataaacgctgaaacagcggggtcatgatggctggcctcttaaacaaaaggggcgaaacgccccctgttttaaagcttaaccgcagtgcgacgtcttacttaacggcgtctttcagcgctttaccagacacgaatgccggtacatttgctgcagcgattttgatctctttgccagtctgcgggttacgaccggtacgctcagcgcggtggttcactttaaaagtaccaaaaccaaccagttgtacagcatcaccatctttcagagactcagtgatcgcagccagagtagattccagcgctgcctttgcctgggttttagacaggtcagctttttctgcgatcacatcaatcagttgagtcttgttcataagttatccttaaagtgtatttatcgcttgctaagcaacgagtgcgagggaaaagccatattctggcactcttctgcctgcacgcaccgatagccacaattttcagccccccaaatgtagaccagacagggggccaatgtgaagcctccaggcgcgctaattcgggcctgaagtcacgttttatcgccttactgctggaaatttataccgatgttgctaattcccgcttcacgcaggtcagatcgcagacctttaatcaattcaaggtcgcgctcttcacactccgccagcaggcggaaaatctcccactgaaggtcccactcatcgatgatagccgggttttcacgcagctcttcgtcggtcatttcgcgtccagcctgggtcatttccagtatggcgatagtagtaattgaggtctcgctgacttcaattgcatgctcaagagtttcaccgctcagctgcgcatgtacgacttcgctcaatgccacacaggcatcgatagccggataaacgccgtaaacctcaaacgcatcaccatcaggaatggcggcttcgagcttttccagctggctgtcgaagttaatcttcgcatctttgaccgtcaggttttcccagatcagatcaaggatacggcgatagagtgccggatcggcaaattcagtctgctcgcagaacgcacgatagttgggatacatgcgctcgcacaggcaggccataaaagtaaggtgctgccagctttccagcttcgccagacgcagatgaacgggattttgtaacataaaggtggctcttattcgtttcgctggccgcagtgtaactgcaaaaccgcagcacaaacagtgttaaagcgcgttttgccagcgctggaaagcggttcggttcgaggcaaccgcgtcggcccagcgggtcggtttccggcagccggtaaccacgcgtacagttttcgacccactgcagcgcggtatccaggctgacacgatggccggtggcgacaaacagcggattacaccgcagcttgctgcgccatacccagcctatctgctcgcctttgtcgatcagtggctgacgactgccaggctgcgcatccagatcggcaaaacggccacacaggcgacttttcgcgacaccaatggtgggcacatcgaccagcaggccaaaatgtgacgcgacgccaagtcgtcgtggatgcgaaataccgtgtccatccacaaacagcaggtccggcttttgctccagcatctgccaggcggccatcagcgctggatattcacggaatgagagaaagcccggaatataaggcatggtggtctcaacgcgtgcgatgcggtgctccaccagctttaaggagggatactccagtatcaccatcgccgcccgggtgatggtgccttcctgctcaaatccaacgtccgccccgccgataaagcggggtggcagcacatcaaagtcatcttctcgcaccacatcagcggcgcgttgtaactgctcagcgcgaagtgcggcaatatccatgattactcctgatgccagggacgtgataaacggtgtaccgcctcaacaaagacgcccgcattttccggtggcacatccagatgaataccatgacccagattaaagacatgcccggtgcccgagccaaagcgctccaggatcccagccacttcctgttcgatacgctcaggtgccgcatagagcatagaaggatccatgttgccctgcagggcgactttgtcgcccacgcgacggcgtgcgtcatcaatatcggtggtccagtcgagacccagcgcgtcacaaccggtggcggccatcgcttccagccactgtccgccgcctttggtgaagagcgtcaccggcacgcggcgaccgtcgttttcacgcagcaggccatcgacaattttgtgcatgtaatggagtgagaattcgcggtaatcacgaccggtcagcacgccaccccaggtatcaaacaccataacggactgcgcaccggcgcggatctgagcattgagatagaggatgacgctgtcggccagcttatccagcatcgcgtggagcgtagcgggatcggcatacatcatcttcttaattttggtaaacgccttgctgctcccgccttccaccatataggtggccagcgtccacggactgccggagaagccaatcagcggcaggtcgccgttcaggttcttacggatggtacggacagcattcatcacatagcccagctccatttcgggatcgggtactggcaaacgctcaacgtcagcgcgacaggtcacagggtttgagaaacgcgggccttcgccggtttcaaagtagagacccagtcccatcgcatccggaatggtcaggatgtcactgaagaggatggcggcatccagcggataacggcgcagcggctgcagggtaacttcacaggccagctcggcgtttttacacagcgacataaagtcacccgcctgggcacgtgtcgctttgtactccggcaaatagcgcccggcttgtcgcatcatccagaccggcgtgacatcaaccggctgacgtaacagggcacgcaaataacgatcgttcttcagttcactcatctcaacactctctcaataacaggcgtgtagtgtagcactttcacacttcggcgcggcacagggcgacggtatcttcaatcaggcggcgcgccacggtgcctggcggtggcagcaacggcagctcatcaaaacggaaccaggccgcatccagcagctctttaccatcgtgctgcagatcgccgctgtcatactccgccataaaggctgtcatcagcgattgcgggaagggccacggctgggaggtaacgtaacggacgtttttgacgcggatattgctctcttccatcacttcgcgggcaacggcctgctccagcgtctcgcccacctccacaaaacccgccagcacggtgtagaccttgttgcgatggcgggcatgattcgccagcaggatttcatcaccgcgacggatagccacaatgatgcagggtgcgatctgcggatagtaacgctcgcgacaatggctgcagagacaggcaaattcatgtttgctttggtgcatttcatggccgcaatagccgcaccagcgatgagaaacggtagaattccgccagttgcacaccgcgacccaccagctgaaacagcgccacatcctgatcgatcagctgtcgtactgagaacatatcggcagaacgcggctcacaaatcagccagactttttcgccctgccactcaccgatggtccgggctttactgccggtcaaaccaaatttttcggcgtttccgtggggtaaatcaccttgtggtaaccaaagtttctgttcatggctgacaatccaccatccagcgtctacgcttgagatttcgcattgcatttatttcgtcatccttagcgtcaactcgcacgctgaagtcctgatgttaagtgtgtagataaacaactataactcacatggagttagatatgcttaaccagttagacgtcctggctgaacgcgtaggtggcagtaatgaactggtcgattcgtggcttgaagcccgtcgtcagctactggtgacctattatcacctggtcggacttaaaccaaacaaagaggcgctgacgcgtcttgatgagcaggctctggacaacttctgtcacggtctggtcgattatctttctgcgggtcacttcagtatctatgaacgcgtgatcagtgaaatgagtggcgacagcccgatgattgccgccgcacagatctatccaccgctggaagccaatactgagcgtctgatgcagctgtatgacggccacctgcagcaggcgatcgacgacgagaactgcatgaccttccagcaggcactctccgaagtgggtgaagtgctggaagcacgctttacgctggaagataagctgattcagctggcatgggacaaccagcttgtccccccgccggttgccaatgacagccatatcgcgcgtccggcttaatcatcatctccggcaaaggggttgagattatcccgtagcccttttatgctgaacaggttctgaggagagtgctccaaagaaccttttttatttttgctttgaaatataaggtttttacgcctggctctgttatcagacacccgcgtaaaaacagcttcttgtcggagtgcccaagttgggctgagaccgttaattcgggatccgcggaacctgatcaggttagaacctgcgaagggaacaagagtaaatattctctgtataccagcatgcttacgctgtctatacggttactccttccgaactccggacaagcatcgttcccccttaacaggaagattgctatgtctgaccaaaaaacaacccgtcgtgaacagcgtgcccaggcgcaggaatttattgattccctgcaaagcggcagtgcatttccccagtcccgccgcatctggattaccggcagccgcgaggatattcgcgttcccatgcgtgaaatcgtgctaagcccgactcacatcggcggcagcaaagaacagcctctctatgagcagaacgaagcggtaccggtctatgacacggcgggtgcctatggcgatcccgcggcacagatcgatgttcatcggggcctggaaaagctgcgcgcccgctggattgctgaacgcgacgacagcgaacttctcgaacagaacagctcaggctatacccagcagcggctggctgacgaggggctggatcatctgcgtttcgatcaactgctgacaccgcgccgtgcccgcgcaggctgctgcgtcacgcaattgcactatgcccgccaggggatcatcaccccggagatggaatttatcgcactgcgggaaaacatgggccgtgagcgaatccgcagtgaggtattgctgcaacagcatcctggccacagttttggcgcgcatctgccagccagtatcacgcccgagtttgtgcgtcaggaggtcgctgccggacgtgccatcatccctgccaatattaatcaccctgaatcagagccgatgatcattggccgcaactttctggttaaggtcaatgccaacatcggtaactcggcggtgacctcttctattgaggaagaggtggaaaaactggtctggtcgactcgctggggtgccgatacggtgatggatctctctaccggtcgttatattcatgaaacgcgcgaatggattttgcgaaacagcccggtgccaatcggtacagtgccgatttatcaggcgctggaaaaagtgaatggcgtggccgaggcgctgaactgggaaatattccgcgatacgctgcttgagcaggcggaacagggtgtcgattacttcactatccacgctggcgtgctgctgcgttatgtcccgatgacggcgaaacgtctgaccggaattgtatcgcggggtggatctatcatggcgaaatggtgcctgtcgcatcatcaggagagcttcctgtatcagcacttccgggagatttgtgaaatctgcgccgcctatgatgtctccctgtcgctgggcgatggccttcgtccgggttccattcaggatgccaacgatgaggcgcagtttgccgaactgcgtaccctgggcgaaactgacccgtattgcctgggaatatgacgttcaggtcatgattgaaggcccggggcacgtcccgatgcatatgatccgccgcaacatgaccgaacagctcgacctgtgcgatgaagcccccttctacacccttggcccgctgaccaccgacatcgcgcccggctatgaccatttcacctccggtatcggtgctgccatgattggctggtttggttgcgccatgttgtgttacgtcacgcccaaagagcatctgggtctgccgaacaaagaggatgtgaagcagggattgatcacctacaaaatagcagcgcatgccgccgatctggcgaaaggccatccgggtgcgcagatccgtgataacgccatgtccaaagcgcgctttgagttccgctgggaagatcagtttaatctggcgctggatccccatacggcgcgggctatgcatgatgaaaccctgccgcaggagtcgggcaaagtggcccatttctgctcgatgtgtggccctaagttctgctcgatgaaaatttcacaggaggtgcgcgagttcgcagcacgtcaggatacgcgcgccgagcccgttgaagtgggcatggcgcagatgtcagaccgttttcgtcggcgcggcggtgagctttatcatcccgccgatgccattaaggaggagtaacgatgcccgcatttcccgctaccgccccgcgcctggggctttatccggtggttgatagccccggctggattgaacgcctgctgaagataggcgttcgtacgctgcagctgcgcatcaaagatcagcccgatgaggtcgccgagcccgccatcgctcaggcgattgcactgggtaaacgctatgacgcgcgcctgtttatcaatgactactggcagctggcgataaagtatcaggcttatggcgtgcatctgggtcaggaggatctcgatgttgccgatcttgcccggattcatcaggcaggattgcgtctggggctctccacccatgacgatgctgaactggatcgcgcactggcaatccagccctcttacatcgcgcttggacatattttcccgacgcagaccaaagagatgccttctgcgccgcagggcattgagcagctgaagcggcatctgacgcgcctgacgcatatccccaccgtggcaattggcggtatctcaattgctcgggcacctgacgtgctggcaaccggcgtgggcagtattgcggtggtaagtgcgattacccaggcagatgactggcgtgaagcaacacgtactttgctggcgctggcagagcctcaccaataaggatttgtggaagctgtcccgcatagcggctgcaaaaccagtaatgccagcgtttctgccgggaaagcggtgcgcaaaagcgtaagttgccgctggcgtgctctgatccaaaaccttaacgtggcctccgtcaggttaaggttatctgaccagggccggttccctcctcttgccggccctgcttcttcttttcgctatgcgagagttgaagctgaaatctgcgtctcatgctggcacgagatcatggcgcgttcgacggctgcacccacaagcgccagcgccttttcagtctgctcgttgatcggcagcccgtagtttaagcgcagacagttacggtatttacccgaggccgaaaagagtgagcctacggctatctgaatttttgactcgcgcaattcgcgattgagccggaccgcatcaaacgcttcggggagttctatccacatcagaaaaccgccctgaggacgggaaacgcagatgccgcagggaaagtagtggcgcacccagcagctaaaggtttcatagttacgatgatagatttgccgcatccggcgcagatggggctgataatggccctggcggataaactcggagaccgcatgctgaggctgtgtggcggtggaacctgtgacgatatatttcatgtgcagtacacggtcgcgatagcggccgggtgcaacccagccgacacgcaaacctggcgccagcgttttggaaaaggagctgcacagcagaacccggccatcgagatccagcgctttaatggtcgctgggcgcggatattcccaggctaactcaccataaacatcatcttcaatgaccgccgcgtcaaaccgctgcgccagggcaagcaatgcccgcttacgcggctcaggcatgataaatcccagcggattattacagttcggcacaacaacgactgctttaatcggccattgatcaaacgccagttccagcgcttccaggctgatgccggttaccgcatcagtcgggatctcaatggcacgaatgccaaatccgcgcagggtttgcatgatcccgtgaaacgaaggcgactcaacagcaatgatatcgcccggctcgcagaccgcacgcacggctaccgataacgcttcatggcagccggtggtaataacaatgtcatcggcggtgagctggcaaccgctatctatcgccagtcgtgcaacctgttgccgcagtgcgagaacaccatagaggttgtcataattgagcagcgcgatgtcctgcttctgagcctgtcggctgaaggctttccacagcggcttaagcgtcggttgggtcagatcgggcataccgcttcccagctgcaacacatcatcttccagacggctgttaatcagctccagcaccgcatcccactgcgttacctcaaccggccgctgtgcgggacgggtcagcgcaggcatcgggggcgtcgccttacgcgaggccacaaaatagccagagcgcgactgcggcgtaatcatctgcttctcttccagcagatgataagcctgctgcacggtgctgatactgacgccatgttcggcactcagactgcgtaccgagggcaggcgctcaccactgcgatataaaccttgttcgatacgctgagccagcagcgtggccagatgttcatatcgcgtcattgtatttcctctgactcaggagctgagcattaaccggtacagttatgcctcttttttaccattcagatcgccattaccgcaatctgtatgttaaagaaaggtgatttttgcgtctgtatcatacagagcgatccgctgagaatagtcctcagacaattcactgagggcactatcatgggatacgacgagaatcgcgcagctaaaccgtttacaggcacgccttaccagttggttcgctatctttggcgcagttataaacgctggcagctgaggcgtgagacgcgcgtcatcctgtcgaagctgagtgacagtcagctgaaagacattggccttggccgcaacgactggaatgtctgaatcagagacaaaaaaaaaccctgccgaggcagggtttttatcaggtaaaggacgattaatcgtctttgttgccgccgagaccggcgttcaacagttcagccaggctggctgaggcttcatccgcagtaacctgcggtgcaaccggaacttcacctgccgctttacggcgcatacgatcctgatggtacgcataaccggtaccggccgggatcagacgacccacgattacgttctctttcaggccgcgcagttcatcgcgcttacctgctactgctgcttcggtcaggacacgcgtggtttcctggaacgatgctgcagagatgaacgattcggtagccagtgacgctttggtaatacccagcaggtcacgcatgaaggttgcgccaacttttccgttcgcttccagatcacggttagagatcttgatgcgagagaattcagcctgctcaccttccaggaagtctgcacttcctgcgctcacgatggttgctttacgcagcatctgacgaacgatgacttcgatgtgcttatcgttaatcttaacgccttgcagacggtaaacttcctgcacttcgttagtgatgtaacgggtcaccgcatgcacgccacgcaagcgcaggatgtcatgtggagactctgggccatcggaaaccacgtcaccgcgctcaacacgttcaccttcgaacacgttcagctgacgccatttcggaatcatctcttcgtacggctcactgccatccagcggagtgatgaccagacgacgcttacctttagtctctttaccgaaggagatgatgccgctgatctccgccagaatagctggctctttcggacgacgcgcttcgaacaggtcagcaacgcgtggcagaccaccggtaatatccttggtaccgccagattcctgcggaacacgcgccagtgtgtcaccagcactgatcttcacgccatcttccagctgaacaatcgctttacccggcaggaagtactgagccggcatgtcggtgcccgggatcagaacgtcgttgccgttggcatcaacaattttcagcgcaggacgcagatctttaccgcccgcagtacgttcagcactgtccagaaccaccagcgaagaaagaccggttaagtcatctgtctgacgggtaatggtctggccatcaaccatgtccgtgaagcgaatgaaaccgcccacttcggtgatgactggcatggtatgcggatcccagtttgcgacggtttcgcccgctgcaacctgctcaccatcacctttcgccatggtagaaccataaggaactttatagctctctttggtacgaccaaattcgtcgatcattttcagttcaacgttacgcgaggtgatcaccagcttacctgccgagtttcgttaccgacttagcgttggtcagcttgatggtacctttgttcttcacctgaatgctggattcagcagccgcacgtgatgccgcaccaccgatgtggaacgtacgcatcgtcagctgtgtacctggctcaccgatggactgtgccgcgataacaccgatcgcttcacctttgttgatgatgtgaccacgtgccaggtcgcgaccatagcaatgcgcacacacaccaaagtcggtttcacaacctactactgagcggactttcaggctgtcgactgagttcagttccagcacgtcacaccagtgctcatcgagcagcgtgttgcgtggaaccagaatgtcagcagtacccggcttcagaacgtcttcagcggtcacacgacccagtacacgttcacgcagtggctctttaacgtcgccaccttcgatgacaggtgtcatcatgatgccttcgtgtgtaccacagtcatcttcggtaacaaccagatcctgtgcaacgtcaaccagacgacgcgtcagataaccggagttcgccgttttcagtgcggtatccgccagacctttacgagcaccgtgggttgagatgaagtactggagtacgttcaacccttcacggaagttcgccgtgattggtgtttcgatgatggagccatctggcttcgccatcagaccacgcataccggccagctgacgaatctgtgcagcagaaccacgcgcaccggagtcagccatcataaagatgctgttaaaggaaacctgtcgctcttctacgccgtcacggttaataacggtttcggttgagaggttttccatcatcgccttggcaacacgttcgttggctgctgcccagatatcgatgactttgttgtaacgttcgcctgcggttaccagaccagactggaactgctcctggatctcagccacttcagcttccgcttcggtgatgatttccactttcttctctggaataaccatgtcgtcgatgccgacagacgcgcctgaacgggctgcgtaagcgaaaccggtgtacatggtctggtcagcaaagataacggtcggcttcaggcccagaatgcggtaacaggtgttcagcattttggagatagcttttttgcccagcgcctggttaacgatggagaaaggcagaccttttggcacgatcatccacaggatggcacggccaacagtggtatcgatgatgctggttttagcaacccactcatcctgctcatttttctcgtgttcggtgatacgcaccttaacgcgagcatgcagcgatgcgaggccagcgcgataaatacgctcagcttctttcgggccagtcagcaccatgccttcgcctttggcgttaacacagtcacgggtcatgtagtacagacccagtacaacgtcctgagaaggaacgatgattggctcgccgtttcgcaggtgacaggatgttgttggtcgacatcatcagcgcacgtgcttccagctgggcttccagcgtcagcggtacgtgaacagccatctggtcaccatcgaagtcggcgttgtatgccgcacaaaccagcgggtgcagctggatcgctttaccttcgatcagaaccggttcaaaggcctgaatacccagacggtgcagcgtaggcgcacggttcagcagaaccgggtgctcacggatcacttcgtcgaggatatcccagacaaccgcttcttcgcgctcaaccattttcttcgcggctttgatggtggtggccaggccacgcagttccagcttgccgtaaatgaacggtttgaacagttcgagtgccattttcttcggcagaccgcactgatgcaggcgcaggtatggacctacggtgataaccgaacgaccagaatagtcgacacgtttacccagcaggttctgacggaaacgaccctgcttacctttgatcatgtcagccagcgatttcagcggacgcttgttggaaccggtgatcgcacgaccgcgacgaccgttgtccagcagtgcatcgaccgcttcctgcaacatacgcttttcgttgcgcacgatgatatccggcgcagccagatccagcaggcgtttcaggcggttgttacggttgatcacgcgacgataaagatcgttcagatccgacgttgcgaaacggccaccatccagcggtaccagcggacgcaaatccggtggcagaacaggcagcacggtcaggatcatccactctggcttgttgccagactgtacgaacgcttccagcagcttgatgcgcttggtcagttttttacgtttggtttcggagttagtttcgttcagctcttcacgcagctgctcgcactcctgctccagatccatgtttttcaacagggcctggatcgcttcggcgcccattttggcgtcgaactcgtcaccgaactcttccagagcgtcaaggtactgctcttcagtcagaatctgacgcttctcgaggttggtcatgccaccttcgattaccacgtaagattcaaagtagagcacgcgctcgatgtcacgcagtggcatatccagcagtaagccgatacgcgatggcagtgacttcaggaaccagatgtgcgcagtcggcgacgccagttcgatgtggcccatacgctcacggcgtactttagtctgggtcacttcaacgccgcacttctcacaaatcacaccacggtgtttcaggcgcttgtatttgccgcacaggcactcatagtcttttaccggcccgaagatacgggcacagaacagaccatcgcgctctggcttaaaagtacggtagttaatggtttctggctttttcacttcaccaaaagaccaggaacggatcatgtctggcgaagccagcgcaattttgatcgcatcaaactcttcggtcttagtttgcgctttcagaaacttaagtaagtctttcacggattagctcccgtcggagtgagactcagagggcgtccaaccgaaattgaacgccccgtaaccagtacaattgcgagcgctttaaaccctgcgctttcaggcggcggcgaaccgcagcctgaaaagggggttactcgtcttccagctcgatgttgatacccagcgagcgaatctctttcaacagtacgttgaaggattccggcatgcccggttccatctgatggttaccgtcaacgatgtttttatacatcttggtacggccgttgacgtcatcagacttaacggtaagcatttcctgcagggtatacgcggcaccatatgcttccagtgcccatacttccatctcaccaaagcgctgaccaccgaactgtgccttaccacccagcggctgctgagtaaccaggctgtaggaaccggttgaacgtgcatgcatcttgtcatcaaccaggtggttgagtttcagcatgtacatgtagccaacggttacctgacgttcgaactgctcaccggtacggccgtcaaacagggtaatctgaccggaagaaggcaagccgccgagctgcagcagctctttgatttcgctctctttcgcgccatcaaacaccggagtggcgattggcatacctttcttcaggttctcagccagacgcaatacttcgtcgtcggagaaggtgttcaggtcaactttctgacgcagatcgctacccaggtcataggcgcgctggatgaattcgcgcagtttcgcgacgtcttcctgctttttgagcatggcgttgatcttctcgccgatgcctttcgctgccatacccaggtgggtttccagaatc

SEQ ID NO: 15 - DNA, 613256 bp, Pantoea agglomerans NY60
tttgtgccccatacccagatcgggatcctgcggctgtttacttaagcggaaccagatgacatcgcgtgctgcgccgaattcctgtccggtcagtcccgccgcttcgcgaacgcgtgaatggcggccatctgcaccgaccaccagtttacagcggatgtgcagttgctgattcccgcgggaagctatcacaccactgaccttgccattttcaacattcagcgactcaaaagaggtcgactgcagcaggctgaagcccgaataccgggcgctctgttcagccatatagttcaggaaatcccactgcggcataaaggcgataaaacggcactgaaccggcaggcgtgagaaatcggccatcgtaatactctgtccgccgatttccgcctccagcttttcagcacgctgatgcggcagcgtcaggaaagattccagcagaccgagctggtgcataatttccagcgtcgagggatggatggtgtcaccgcgaaaatcgtggagaaaatcggcgtgcttttcgatcaccaccacgcgcaggcctgcgcgggcgaacagataacccagcattaatccggccgggccaccgccgacgatacaacagtcagcggtgataatttcagtggaatgtggctgcatgtcagctccctgtcacgccagtattgctatgattattgcgtcgaccgtggcgacgttgccgcagtcggtcggggatattgtgctcaggctaatcactcaatgcgattaatatcaactgaaaactgccgaagacccgatcctgtcctcagcagtcaggagaccatcatgaacgtgatccgcaacacgctgtttattctgccgctgttaagcccgctgattgtggcagccgcaccctacgacacgctgaagtttgcgctgcgtcagcagcagataactgacgatctgcgccagaagtgccagttatcaccagccatctccgatgaaaaactgcgtcagacgtttcttaacgataagcagaaccagaagcagaatcaggtcacgctgactgcggcggctcaggcgctgaaaaaccaggatgatccagcctaccgcgaacgcatggcgcaagtggtttgtccaccacagacgaattaaccctttaccccgatgaaattgatcctgacgtttgttttcaccttatcactcagtaaactggggcgctggtctggttgaacaagaatgtctctcaatgaatgaagaatcaccgcagccggtttatgttccccgctccatcgcggcgcgcagccggatgtttcgcgccctgctctatcgtgataaaacgccgctggcgatgctgttctgtgccgcgctggtcggtacgctggttggcctggcgggcgtggcgtttgcccgggccgttgaaacaatacagcagtggcgtgctgacacgcttataccatcgcagtttcagggctggatgctctacgccgccgcctttgccatctcggctctgctggcgatggtgggctattttctcgtcaggcgctttgctcccgaagcgggtggctccggtatccctgaaattgaaggtgcgctggaagagctgaggcctgtgcgctggtggcgggtgattccggtgaagtttctttggcggcatgggcacgctgggtgccggtatggtgctgggccgggaaggcccgacagtgcagctgggcgggaacattggccgcatggtcattgatattctggggatgcgcagcaatgaggcacgtcatacgctgctggcaaccggcgcggcggccggtctggcggcggcgtttaatgcgccgctggcgggcatcctgtttatcatcgaggagatgcgtccgcaattccgctataacctgatttcaattaaagccgtgtttaccggtgtgattatggccagcattgtgttccgctgtttcaacggcgaagaggcggtgatctccgtcggcaagctggctgatgcgccggtgcaaacgctgtggctctatctggtactcgggatgattatcggtatggtcggtgtcctgtttaaccgcctgatatttatcacgcaggacctttttgcgcgcttttatgccggtaaaacggcgcgcgtggtgctggccggtgcattgctgggcggcggttgcggtattctggctctgatgtttgcacctggcgcaggcggcggttcagaactgatcccacaggcggtccatggcgtcttcccgttcaccctgctgctgatcatctttctggtcaggctggtgaccaccctgctctgttttggctcaggtgcgccgggcggtatttttgcgccgatgctggcgctgggtacgctgctcgggacagcctttggagtggcaatgacggacctgttcccgttttatcatctggaagcgggcacttttgctatcgcggggatgggagcactgtttgcggcgtcggtaagggcaccgctgaccggtatcgtactggtgctggagatgaccgataactaccagctgatattaccgatgattattacctgtctgggcgctacgctgctggcgcagtttctgggggggaaaccactctactcctcaatactggcccgcacgctggcgcgtcaggcagaagctacccgcccgtaggggcgggtgaccggcttaattacttaccatcaaaatagtcagcaggcatctgtccgggtgcctgattgatcacttcatcgttatctggaccttcatttttcatataggtcactttcgcaaactctggaatgatcacatacggataagccgggccttcatcgcggaagcggtgcatatcctcaatgaagtcattctgataacagatagttttttccggatgctgaccttcaccggcaatccactgcgggaagaaaattgtgccgtgaaccagggtgcgattcagatcaaaaagcaggctgacgcaggtgccggtgggttcatgccagtctactttgtagatgccaggggcgaactgaatcgcgtgcattttctggttggtcacccagcggccacctaccagtccctgatgaatgcggtagtcgcaggtggtttcattgcgagcgtaccactcatatttccagccattatcgtaggtatagacaaaatgcgtaccgacgaactgtgaaagatcgctggagatattctctggagattctgcagacattttaacctctgtttgaatagcgcacttaacaggcgcagatgaatttcaaaagaaagctatagcgcaataactcagtgaatattgactatgacgcagattgatttttttgccatctgaaaacggaaaaggttcgcaatgggtaaattaaaaacccattaaaaaatccttcccggacccctgaggcaatagactccagaaaagagatactttcttatgaatttctagtggaatcttatagatgcatagttgttaggtgagatatctatcagtcatctatcaccatgctgagtaagtctttcttcagtatattttagatatagagcttatttttcaataatttaaaaatttataacggatgtattttcctttttttgggttgattatgttttcatcattactttgccagataagaccctgtcgggacaatttgaacatggggacgttgatgtggcgttgctgacgccagagcccacgccaccgacattgcatacgcggcaactgttcaatgaagaatatgtttgtctgctgaatggaaatcatcctctggcgggcagtgcgacgctgtcgctggatgagttctgtgcgcaggatcatgcgctggtttcgtggcccggcggaaattttcatggggttaccgaccaggctttggctgcgattggccaggcccgccgggtaacgctctcagtttgcagttttctggtgctcccggaaattttgcgcgtcactgatttggtaagcgtggtaccgaaacgactggcgatcgacactacgggtctggtcatgttgccagcaccgctgatcatccctggcttcagtaaaatcatggcctggcataaccgaacccatcatcacaaagggcatgagtggctgcgtgaaacgactggcgtccgtggctaaaacggtggtgtattaacagagatagcggactgcggctcactgttttgcgattttgtttaagcaacaggcaggataacggggcgttatatcgcattctgtccgacgtcgaaaaggcaaaatcgcgctttgctatgtcgatagcggggtaaaaattgatgctggggaattcaggaaaaagagtgttgaactgaggaaaaaatagcagaaaaataaatcgcgcgtgaaacactttaaatattatcgataaaagctgctttgataatgttaattactcatatttacgttctgaaaagaactgatacacatcgtaaaatgataaaagccctgactgaaatagccagggcttttaaggtactacagattttacgtttaccattaactaacttaattgataggtactacttcggtactgctatttatgaacagatcctgcggataataatgatcacgatactgaaatgtcactattattatcggtttcaaccacctgatagtctttcaggagacaaagacaggtcaggcccgtataaatctgcacacccccatcgcgatatatactctttgatgcgttgccttactttcattacgacgtttaaaccgcaatcgtatcctgtcgtaacgtaacgttcagaactacgaggccttacatcatcgcgacgcgatactacatacttcttaaagacttacttcgactccatttaacagggttatcttaactaacgaacagttttaaagaacaatgtttaacagaaccaccgacaagttcaactcacaaatttgtcgggcctttttactttactcataatgcttttgtttccggtttatcagggcaactgcacgccgctgatgagtcctactttacggatataaaaaacgatgtcaacactggttttaaaaacatgtttatatttgcagtgaatttttcaggcaatcatttagctctgaaacgcccgtaaatttattatcaatgttaagaaaaattgagtcctaatctattcaacctgaataattaagcaggtcactatctatcctgacacttaacggtagcaataaaaaaaggcgcccgcaggcgccctcaaaactcagcatgctgtaaagatctttatttcgccaggcttgccagtaaaaccttcgcggtctcggctgatgaacctgggttctgaccggtaatcagcaagccatcctgaaccgtataggactgccagtcatcgcctcgtgagtagagacccccgttctgtttcagcacatcttcaaccaggaaacggcaccacctcagtcaggccaacgccctcttcttcactgttcgtgaagccagtaactttctttcctttgaccagaggcgtgccatcagcatttttcacatcacgcaggacacctggagcatgacagaccagcgcaaccggtttgcccgcctgcagggtttgctcaatcagcgaaatggagtgtttgtcgtttgccagatcccataaaggaccatggccgcctggatagaaaacggcatcaaacgcttcctgatcaacagtatcaagcttgacggtcgaggccagtactgcctgagcagcagaatcggcatggaagcggcgggtctcatcagtctgagaatcgggttcatcactttttggatcgagtggaggctgtccgcccttcggtgaagccagggtaatctctacgcccgcatcaagaaatgcatagtaaggtgccgcaagctcttccagccagaaaccggtcttcttgccagtggtgcccaactcatcatgcgaggtcaaaaccattaaaattttcatttccgctccatataacagttagtcggtttcaggtgtaaggatagtcagaaccagcgtctgagccgctatcttctgcgttgacccgttaatcatggcggggttacgaatatttatgaaatttatttcttcaatttcagttattcacatagcattatagcttaatgaaatacgatttgaatttactgccagttttgctggtcatgatggaagagcgcaacgttactcgcgcagcggaacggcttggtataacccagccggcgctttctaatgcattaaaccggctgcgtgaaacgctcaacgatccgctatttatccgcgagcgttacgggatgcgaccgacgccgaaagcggaacagctggctcaggtggtcggtgctgcgctgtcatcgatcgacaaggttattcttggccagcaggactttgatccgcttcatgccacccggctcttcacgcttgcgcctaacagctatgtcgaattcatcatgatgcctgccatcgtggctcgtctgaggagctgtgcgcccggcatccgactccgcctcactccttttggcaatgacgtcactgaaaccggtgtgatttcaggtaataccgatatggtgctgggccgtatcgtggagccgcccgacaatctcgtcgttcagcacctgatgaatgaaggtctggcctgcgtgatacgcgccgatcatccgctggtgggcgaaaacctcagcgcggagcaatatgagcagctaaagcacgtcaacgtttctgccgcctggccgtatgcgcgccggtttatatcaggcgcttgaacagcgaggcctgcgtcgtcaggttgcagtctccgtcacacactttctggccgtgccggaaatgattgcggtcacggactactgcgcgaccctgccgcgtttgatctgtcagcacctttcacgcgatcagcggctcagaatcattcccgcgccggttgatctgggcacctttccggttgaaatgggctggcatgcacgctatcgcgacgatcctgcccatcgctggttcagggcgttgataacggagacggcacagtcgctgtctgatcctcagataaacaattagcacgatcaccattgccgcactaatagttaatattgatatcataacctgagttactattattcccatcggaggcaaacatcctcccaattcataactcaggaatatgacagtaaagccgtgttgaaccctgctttgactgggttttgaatcgtgattgttaagcctgaacttaagtatgtacaccgctatgtacacaaaacaacacaatagccttctgattaaaaccaaactgtaggtgacgacggtttcgtaaacatccatgacgagcaccatcacttctctagcagtattctccccttagcccttcccctatgatcgtccttccgtcatgagatgtatccccgaaataaccaccttgccatttatttttttcgcgagctggcgagcttgaactctatcagatgccaagctaagcctcggacgtccggttaattgacatgtatccgtaaagcgtattaatgcgcatcatgtttaccggatttgccatcatcgtgccattcgagatggccggggctgctttataatgcagctaaggtccgctaagagcgaggagcggacattgctaacagcagtctgtgtgaatcaacagggaccaggtcagtctgcttctagcacaatagagccttaatgagacctaaacgcacattatttgatttcgtagaatcatcatcaccccggtgggactggtataaaaggtgtgaccgagctggtgaaacttcgggcaggttagtccaactctgttacactcagggcaggcatgattttatagtttcagccaggttagtgctgctactgaaatcaggcaaaaactataaccactcaaaagcaatactgcttgtccgctgcgacggactcttatcgccaggcagcaggaagtttgatatgttcagaagtgaagaagaaaagatcaatatcgttattggcgaagccatattagcgctgcttgaggacgacggtgtcttcagcgcttacaccctttcccgacagttgaaacagatgcttgaggtggagacagaggctgcccgtcgtgaaatcattaaagaggcaataaggcagaccagcagacttctcgccacagccctctattccggtaatagcagtgctgaagtaaagcgattatcgcgcgaattttcttgccagcaaaatattgggtactagtatttatccggaattttactcctcctgttacgttctgcctcaccaggtcagtgtacccggtgactcagcatctgaatcgcctttatgatgtttacccgcacacgcgggtccgcggtgcttttgctgagcagtttccagtgcatttatcagttcatctttatctactgtggctttctgactgagcagcctgcgggcagtactaccaatgagatctagtgctttttcattgttatcctcgtccgaattcatgaatatccccgttaaacgaaccgctgtaaatatagcattatgtcagataggggaaggtaattgtgtccttatcggtgagttgataacttcataagccccgagggccaaagagagcagctttcaggcagaggctcaaacctatgacctgctccccgtaaactaacataccatgatgcaagcaacgtccgcttctggcacaaagctgacgttgatagcttcaggattgcaccgcctgcccgtcgtgtctatttttaaacctgcagcaatattttcagttcaatgcatgccgccagttcatcacaacgcgctgaaagctcaatgatcatgccggttatggtattcagcattaccgatttatctgccaaaaccagttgccagacagcctcacccattattgtgcatgctgccttacacgcctgttcctaaaacccaattatctgcatcgaactcaaaaagctgactttaaaacaattatgcagcactacaacgatattgcgcacacctccctgagctgtatggccccggcttctccataaagagtcaggatgttatgcccctaaacaggattaccgacgttaagctgacacgctgtcttcatcactcatgattgattgctattgtccggcatctttaaactaaacattaaaataacagcactgccaccacaatattcattttaatgcattgaaatataatgggtaattttcacttttctgaattgtacctgactgaaaatggcctcctctaaacggttgtgcatgccgaatcatgcatcccacttttaatcaggagttcagatgttattcagaaaagcgtccatggctttgctggccaccacaattttgtgtaccaatgcgttggctgaggatacggatgtaaggcctaccatgtcttttggttaccagcgtggccatattaaagattttggtgaaattcagggcggaaacttcaggtttcagtatgagacatcatcaccgtggggtttcatgggatctgtatcggtgatgaagaagaactggcaggatgctgatactgagtgcagaaggagtaatgcacaatgcaaagaggattataatgcaaaacatcggttagacagacaggcagaatattactctgctctgatcggcccgacctatcgcatctcagagaaactcagcgtctttgccttaggggggatttcgcatacgaaagtagataatccattaatcttcgatgatcataacaactctcagatgaaaaatggttccacttcatccaaccagtttgcatacagcacagggctgacatttgatgcaaccgaaaatctggcactaactgtgggctttgaaggatctcaggccgcgtttgcatcaaaaaaacataagatgaccagtgtctttgtcaatgcgggatatcgcttttaagtattaattcagtggctcgtttccggacgagccactttcaactattgcctggtgctgctggccagtctatttttttcattacacttgcattcagcctgtatacttcagctaaatgttttttccaggcgtcgagtttctgtttctcttcttcatttagtccgtatacatcctgcactaccgccagcatgcgtatttcggtatcggctttttccatcagcgcattctttattgcctgattatcctcaatagtgctgtattcctgttcagggatatccgtccagacgggcattccttccttgccagacccacgctgtttcccttctgggggggtaccggtaaactgttgccagacttcatcagaaacaggaataatatcctcctgccagataccgtttcctctgtaagcggcctcctcatccagaaaataaaaggcattactttttgcactgaaacccacctgcataatcaataccccatagccagccagtagaatgcgggttcaccattgccggcgtgcagggtaaagtttaattgattaacatctgatataaatgaattgtctttactcattttatgtctgccacattgcgtaattaatacgagggaacagtagttgggaaaagctgccgggtaattaatttcgcctttgcttgtttcatgcagtcctccctgaataacgagcttactgaccggatctttccagatgaaagggaagccttttgtcttatgaacaaatgatgctgaacggcctgccagccatgaatgcagacttccgccgctccatgcttctccagcaatatcgcctttagtagtgacttctgctttcccaatcttcaatggcatgtcggtgctcagtgagccttcaacgtttaacggaccttttacttccccgccgcttacgggaatatagcggcgatcaagatcaccccagtcaatatgctgctggttattacacaggacccaggcattcagagtcgcattccactcaacttcattttgctggcagctgcttagggtacccttcctgagtttctctggcgtcatcgtttaagactggacaggccgggaaatcaccgacacggagtttgcatgcccctgcattagtcgcctgtgtgcgaaagaacagacgcatgccatcggtgagctttgtgacgggtggctggcagatcagatgaaagttatcaccctcgcttttaactttgccactgttaagacgtccctgctgcacagcagcaatgatgccatcctcaggaagaaaaggcgcatgctcagccatatgtatcgctgaagcatcaatggatattgcgccgttatctacggtaattacccatgctgccgtataaccgggatccggtgtcggggatatctgttcaccttttcgggcggccatacccgcttttaatgagacatgacagccaccggatcttaccgtgttttgtggtgcgccgctgttatctggtccgctgaaagcgatcgccggatcagcagcattgtaatatggcagcacagcgggccccgtgtccgtgtcggcataagccacctgaatgaggtagttgatgctgtgcccctgcatggcgggtgcatcaagcctgaaaaggcagggtgccagactcagaccctgcttcagaatagtattgatgttatcggcagccaatgacgagtaaggcgtgccatcaatatgctgcagggaataaatctgcccctccccgacctgaacagtcatggaagccggtgcggaaggcttacataccagaccacatagccaggtactctcacccagaaaggctgacgccagtttcgccagccctgtcatggcgaatttattggtattaagcaggtcggtttcgagcggaatagcgcccggataaacaatctgacgatccataaagttacccattaaaaaaggccaccttcagggtgaccattgcatgattgttaacgaaggaagagagattaatgaattctcacccagaccagcgtgccttccggtttgacggcttcgatcgcagcataaatctgtgcatccgtaacactgcccgtaaccattccccgggagacatattgcgcgcgcgaagcactgccatagcccgctgttgaaattccgtagcctgccacccgggggatgccctgaccgcgcggacgactgacgtccacaaatgcctggtaaggcagataacgtgatccatatccacccgcagcaccataaccgattgcaggtccgccatacgcacctgtatctgcagggcgtgacggctcgaacacgactggtgtgttcccggtcagcatctcaataatgctggtaacggcctgacgcgtaccccgctcgcgaagcagattcgtttttatctggatccggaaggggtcatcagacatacctgaatctctggtcaggccagtgccaaagaagtcataggctgcaacgtccagccagccatcgctcgccgtggagatgcgagtctgcttacgtgcgtagcgatatagggtgtagcaccaggataacgctgtggcacaggctgaaagcgcaccttcaaaaatcggtgtgtcatcactgaaccagcctgccggcagcagcgcatgaagccggttgagaaagtcgttcctgtcacctttagccattcagctcaccgtaatctgacctttgcgaataacctgttttggcgaggccgcaaggtcagcgttaccgtcattgagggtaaggtatgtcacgttcgtgaccagtggactggccgcataggccgctctgatgatccgggtgtaggccagaagctgtccgggatgaaggtctgcaatgtattgcgatacggccgcctcaatcagaccggccaccttagagtgatctgcttcattatctgtcgtaaatgaaagtatgacctttgcatagatgaccaccggcctgaaaaccccaaaggtgatggtaaatccgcgcacagcgtcaatagccctgtatgcacgatcaagcaattcgcgtggcggcataccgctgccatcatcaataacggcataaaaatagcccggctgtggtctgccgtcccaggagacattctcggtcagggtatagctgacgccgcgctgaacattgctgagcgcaaacgcaatcgccgctcttgtggcttttgataatgaagcgatccacattctgaatcgcgcgcggaaatcgtcgtcagattcagcgtcctgaccgcccacaaacgccgctgggttagtcaccttatcgacatataacacagaacccgtaataagggtgacggtacccggctgcgcattacctgcagcgcctgcggtatctgccctcaccggtacctccagggaaatgacacccgctgcgatgatatagcccgactgtccgggccggtcggcaataaccgtgtagctctgtgtgcaatcgagggtggttatctttgtcccgaccgggataagggcctggctcgcgggtgtaagacgggagaaacgtcacgttaccggcagcctgtacagcagagcgacggaaaaaaccaaagtctgccatccagctgtccaggtcttcgccggagcatgtcgccgcgcgggttgtcaccagcagctttacaatcagctgctggagccacatgaccacaccggcattggattcagccagtgaacgcagaatgctcccgatggaaaaatccaccagctttgctgcccgagcctgtatcgctgtgacctgttcgccgacgagttcagtgaaggatttgacgttgagcgatgacatccgcttacctcgcgacatcgaagtggagagtttctggcgtgccggtcagggcatcggtgtagacaatggatacgctgacacccccttcaatcaggaccagtttcacaactggcggtggatagtgcgcgacggcctcttcaagcagcatctggccgctgatgagcgacttccactcgcccggctgtacagcttcaccgacttttttacccagcccggcaccgtattcaggatgaaacagataatcaccggggttggtcagcagtcgtcgcagaatacgttgcttcgtgcgaacgctgcccagagccgtgcgcagatcgcccgtagaggagggcgcaagatctcctccggtaaaatgataaaggtcgtgcataggttaccgttgcagagtggctttgatttgctgttctggcggggctgtaaagttgccctgacctttctcgagatgtgtgtgaccgctataaacggtacgaatatgatgaaccgtgccatagcgaccattgctgtcgctgatctctttaccgaccgtcagattttcatctatccggacgtcgccaccagtaaagtgatgtgctggtgcgtcataaatgagtttttccttcgcactcagcaggacgtccccgctgttgagaaactttaaaagcgatccgccctgatgcaccagccagaattcaccggaaggggggcccgggcagcggtcttcatcgttataaaactgccctgccgccatgccaaccccggccaggctggaatcaaactcaacctcagctacggcaccaatcatcggtcctgccgcaagcccccagccgtttcctgcccagggcgtgctgagggggatccagccggtttcctcacccgtcggctgcagcagtaccttcactgtgtagttatccgggtcataagccgtgataatgccctgacgtgtgccactcttacccgcattgctctggcgcgatgtcgccgccatgatattcagcagcgccctcaccgctcaacacccggcgccgtgctgtagttcttacccgacatctgcatggtgtagcctgtttcccagctcagcgtacgtcgcacccgatcacaatggtaaatctggtcgaacgggcttcgtgtaccctcaatacgtacatgcatgtaaggcatgagcaggttgtcacctgccgttgatccgctgacgttcatctcgtgctgtatcacctgccggtagatggactgtgccagcgcatgggctgcttcaggcgttaatccgttacgtatgacacgataaatctgcgtgtcagatgaggcgcttccgggaactgttcgcttaccagggtttgggtaagaggcactgaactgtttattcttgcactttgcattccagctgagcacctcaaccgacactcccctggcaattgtcagcgcacgtgaaaatgtcaggtcatcggagacatggcagcggggatacgcctgctcaccgggggcctgccagcggataacataatcgtcatcaccggcagggtcgcgtcggggttcgaaatgcaggctgtcaccttccacataaaccgaaaagttttcgatgcccgccaggctggttatcaggtcccattccgtctgttcgcctgtcaggtgtgtcgaatcgatctgatagtattcaccgacgcgctgtgtcgtcgccgtcacaaccggtgtcaggccgtgacgctgcgccagcgtggagactatctgtgaactggtgagatttttaaagctttcacccggtgtcttcgcatcaatcagctttgcggtgaaatcgcgcccttctgctgaaatctcaaagcgtgccggttcgtaatgccaggtatcaatgctgcctgtgatgtgtcttttctcgttaacaccggtctgggttactatcgaaatgaacagctcggtcctgatcgtggtctgaaccgcccaccagttaagcagctgcatgtccggcggcagtgctgaaatcgccagtgtaagctcaaacgtccctgcaccacgaaaggcattgttctcaacgctgaatgatacaaatggcacgtctgtgccatttaaaacacaacgcccgctgacttggcgggtgcccgattcggtaatggggttgctgacgttcatcgttaactcgccgagctggtgggtattttcagcgtgtgaatgccgctcagctgcggatcggccaggtcattggcatcggcaatactggtccataaagaggcgtccccatactgctctgatgccaccttatacatattgccaccggacaacgttaccgctctgacgccattggcggcctgacctgaatttacatttttgttaagcctgcctagcacattctgaagatgatacagggccggaatgcgggtcgcgtggtctgactgaagaagcagattactgacggtttttgatatgggattgccgggtaccagtccacccagcgaggtaatctccagtgccgcagcctcgagcagtgccagctcatgctgaatgatgttccgggctgcaatcaggggtctgacaacggactgaatctgcgcaacagtagcatgcgcaaagtccgttaccttcttaaccgcctgatgcagatttctgattgcctgcgtaacggcatcaacgttgatgatactggcaaggcccagcgcgcggcccaggtcgctgtcaatcagctcccgcagcgccccggtcagggcatccactttcgctggcgagccctcattgcggacaaccgcgacctcaatggaataggggcggcgccagacatattcgtagaccggactgaacgcggtgatgaccaccgtgaaacgatagtcatcgagcgtcaacagaaccgggtgcccggcatcccgcatgcgttcaagcgcgctgacacgctcacccgcctgcgagcccgtgatgatgccagaccaagtcagtggctcatactccgtgcccagcacatcaataatgcggtggccgccaatcagctgatgccggacggttttctgtctgccgtgaatgacaacctgttcggggacctcaaattccataaactcgaagtcgcccagcataagccgggtaacagtcggatcgataccctgagcaaactgcgtgagagaattcagaagagacatactgcgagtgcctgtttcagatatgactgacaatgaaaaataggagccgccatctgtcgggaggcatgcgaattttcagagcctgaccgttcaggctgcctgcaaaagatgtccggacatcaaatatggtgcaaaaaagcatctacccagacgttattcagtccggattttattctgctgcaggtcagccagatgatgactgtcatttattccggccagtgcgatgttgacggcctcttccagcaagtcataagtaacctcgccagtcagcaccctgtccccgataatggttgtcggcgtacctgagtaatgaagccgtctcattaacgccttattcacttcgataatgttctgtgtatcaagcggataagttgtgactttcattccggcagcatgcagggctgaataaatacgcaggtcgtcacccataccgctgtctgacatcagcgcatggtgaaaagcatggaatttttcaggttcttcgatccagacggctagcgccatgcgcgtaacagcggttgacgcttccggaccgtatgaaatcagtttgtaggtgatcgcaatctgaggataggcctttaaaagcttttccagattactgtccagtcgtttgcaatgaatacagtcgtagttcacgaaactgacaattttcagtacaggttgctcagcaccgacgacaggagagagcggatcgttcagcagtttattgcgcatcagagcatctgtctgcgatggacgctgcggctgtttctgcggtaatgccagtgtttgcctgatgatgcgccactccggcagatgccggccctgcgcccatgagcatcagcaataaaacgaattcattaagcataatcctgctccacagataatctcacggttgccgtagcggaacgcagtgactgcgattttcattacctcactaacagtgaaatcagcatggccaaagcggcgttcagaattctgaataccggcaactgtgaaggtgttagctgaagaagaggcagatagggcctgccagcaggagtgtgaataaaatcaggctgtcatcagggcagggagaggctgccagcctgaccgggatacaccatcagcatggatggatcgaaggtgctggtggatgacggtgctctggctgcctgcttactgatgccactcatgacagtggccaccagtacctgtcgtccttcatgcgtcatcagcagatttacgggctgcccgttattaacgccagaaactggcggtatcgggggatacctgccggttttacgaaacgcctgctcaagaagatgctgtctgtcgaagtccgcctgggcaggcatccagggtttataggcaacgccgtggtcaagcgcattctgacgtgccagtctgccacgctctgccatttcccggctctgcgataccgtgctgcccggatacagggcggcaagcgttacggcagagattatgcccggcagaccggtcagcgcggcggtgagtcctgtcagacctgtagtggcgcttctgccaataagcaggtcaatgccccagcccgccagtttaagtggtgtcagcagtgcgcccgcagcatgtctgatgagccagaatccgccactgatgcctgcaaggccggtcacggccagcgccgcctgccccgcaaacttcgccatctcaggatgccggtgcgcaatgtctgccatctgctgaagagagtgcgtgagtgtttccagcccctgcgtgaatgtgtccagcagaccgccgtccttccccattacccgctgcaggtcctgccatttcttgtgaaagtcgatcgctttgccgttgtaagtgctgccgaccgcaccataggcatcattcaggccgcgcgcgactccgtaggcatcaatgcggtgatgaatggtctcaagctgtttgtcgatgagactgaacatcttgccgccggtacgcccgaatatcagggcgttctcacgctgcttctgttcttcggtgtaatggtgcctgcggtagagtggcaggatgacgttttcatagtattcgacaggcgactggctgaagagctgcgcgttgataagtggattgccccggaaacgcttcacgccgcccaggctgtttagctctatcttgctggcatcccagatgcccatcgtcatcaggtcgtgggtgacctgattaggcagcttcacaatcccgtttaaccggttgtaagcagtcatcaacgcatcacccgctgaactccccttcagttcaccgataatcggctccagctcagcaaacagggctttattgctcaggttaaaggccgaagtacccgccttggccataaactgacggtactgggtaaaatcgacattgccgcctgaagactgaatggcgcggaacgctgcgtccatcagttcatcaaagcgctccgggcttttcaatccacccgccgtctcggtgaagcgcagcatatccatctgcttcgctgttgtggcctcacgctgatgctcatccagcccgcgggaggcgaaggtgatacgcgccagcaccggtgccgccagtttcgccgcacgcagctgctcatccagcgtttttgcgccggattcgctgaataccccctgcgcttccaccagatatttcatcatgtcagtggccgaggagccccggactcgtgtggtttctgcgaaacgcagtgcttcatctgtcgcagcctgacccatgccgaaactgtctgaacttctcggtcatggtctggtagcgggcagcctcatcaacaaagccctgcaacattctgaaacccagatagccggtggccagattggtcataccctctgaaaaggagcctccgccaggtggccggccattaccgccgccatgccctgcaccgccgccaccccagccgcccggcggcacgccattatgccagccatgccaccagccaccctgtcctgaaggcggaagcagtgcgagtctcacgccaggggtgccatatccaccgctgccacctgcagcggcggcccccgctgccagcacgggcagtgtcatggctgcaccgtaaccacccgccagcaacggggcattacgcgaggcccggttgatacgctgtgtctggtcagcaatctcgcggatggcaccggcatattcacgcgcgccgcgtgacgcgccagtaaattcattattcaaagagcgattaagagcccgcagcgcggatgtggcctcacgggccgctcgggttagtgctttgatgttcctggagatagtaacgaacttcttattcagctcgatcgcatcacggctcacctgcagcagattgcgtgtaatctggtcatccagtgcaaggcgcacggctacacggtaagcctgaacatccatgggaacctcaatttacggacataaaaaaacccgccggagcgggtcgggttttaagaaaataacattaagattcggagcgacagggactctataagagcctcataccattccttcactgttggatcgaattgcaaaaaccatagactgaagtaaacccctccaacaccagcgagcatatgcaagctaagattgaaccagtatgcgtgaggccggtcggcctttttaataagctcgcatcgggtcgtacctttgaaagtcttggtgtagacaccagatcggtagtaattgattgattgcttgaccattacaagccccgacaaaaaaatagcaactacagtgaaccaataaccgtaatccatgccaaaataattccttttaaaacagagcattaaatttaatcaacgagatgtttgcgtttaattatcagacacatttttcggctctgtatttccgtttaatctgccagaaccagacactttacaccattagttccagctcatcatttgagcattcacaaattccaatcattgcgaaaagacctgtttttttatcaggattcctattcccaaacttaagcgtatattgccaatggggtcttcccgtatggcaaggtttaagaatcataaatgaaaaaaacaatcgtcgctctaatcactctggctcttcttgcaccaactgtcagctttgcacgcggtggtcattacgctggcggacatggctctgcccataagtatggcaagtataaaaatgctcgtaccggcaaccattatgagaagcgacactgagtaatcgtattgcatctttactgaaagcccactctagtgggcttttttaatatgactaaaagagtgaacataccaaagaacagcttaagttttcagtcaggttgccgaaaatcaatagtacggctgagccaatcttgtgaaagacgattatgtcagtagaaaccacttaccggcactttaaaaaaggctgggctgaaacgccacatgggatacttagtgatgctcaactccgtttaatcgctggaaagtgtcgccgggacgaaatagctgcaattcactttgtgataaaactgtgcaatgccgaatcttgctacatgccctgactgggatgttgaaatgcaatacctgcttcgccaaaacattcacactttacagcgcctgcttgctcagattgatttgctaagcaaccaatgagcagtgttcattccctgaacataatcaggactgctgccgatgccaaaggcatgcaactcaaggagaaacgcttaatggaacaactgaaccctcttgcagtactgtcgtcgatcatctggtttttgatgtttatcccatgcttgcgcatggctcagaaagcgggtttcggatggaagatggcgttgctcctttcctgtccgggtatacatttcatcatgctctacgtcttcgcttacaggaagtggccgaacgcgccttatcgataagcactgatcatctgtcaggatatggcaatcagacctatccgtgtatctttgcctaattaatcaacgcatggatgagcataacgttggattctcccaaaattagcgtcatagaatttatcaggcgcataaatgaaggcagtacaaagcccattctttgtcgatgcgatgatggcaaaaaatacatcgtaaaatcaatgccattaatgccgcccaagcatcttcttgcagaattcatttctgcttgcctagctcaagatcttggtcttccactacctgattttaccgtcgtttacatccctgatgagctgctagaattctcgccagaactcaaatgtgacattaatccgggatacgcgtttgctacgctttacattgaaaatgccgtttctttaacatttgcacagtcaagaaacgagcaaattgtcccgattgacgatcagaagagaatcttcttgtttgaccgatggatcatgaatggtgacagaagcctcactgcaataggaggcaatgtgaacatgctctacgacgttcagcatgataggtattaccttattgaccataatctagcctttgatcaaaatgcgaacgctgctggagatttcgagtaccacgtttactctcacaaatcgaggaagtggacctttgacatggttgatcgtgtcgagcataaagaaaaacttctagaaacctattgccgtatgcctcacttctgggaagatgtaccggatgactggcgtagtgatcaggatttcaacaacattattgacactacgctcattagagccgagacagatgatttttggagtagcatcacatgacaacgccttgcttatacagcatcgttcgatattcaccctatccggaaactgaagagtttgcgaacgtaggtgtggtcgtgtgcgctccaaaggagaattttttcgatttcatgatcacaaatcgaaatgactctcgcgtaaggcggtttttccacgacgattgcattttccctttagctaaagatgcattttttagagagctgggatttgccaagaacactgcccttgagataagcggtgcgcagtctctttctcagtttttccactactttactgcaaaacgcgaatcaatctttcacttcagccaagccagagttgtactttcaaacaaccctagagaagaaatgaaaaaaatctatgatcgttatgtaaatcatagtgattacaccaaagcacgtagagaagaggttttagctaaagaacttaaaaggagcatcgacagaattgatgccctaaaaaacatgttcaaaaatcagacaattaacgggacgcttgctaagttttctatgcctcttgtcgccaagagaagtgacgtcatatcacgagcgatcaagccgttagcttttgagcaatctgaacctggaaagatgatggagcatggtgacacatgggtaatgagagttactcgtgctgcagaagaaaagttactcgaagtaaaagatgtgttatttactattgaggaacctctctcaccgaccttggcgcaagttaaagtgcttgattctataaagctcaatttagacaagcataaaattgcgcatgttcctgctagcgatcatcgtgcggcaattgaatttgcatcgaacatcatcgttgatcgtccatgattatagggcctttaactgggcccatagtattgtgttcagctgcattctttgggttttaaattgtagcccgcacaccccttaatgagattaaattttttctttaatttcatgttattaaatttgatctcatcaggaaatgttagcgttatagcacttcaccccaatcctagaataccggcaaatctttcctgatttagtagacttagaaactgcctgatatcaccatgcccatcgcctccctcaacgggtcaatcttcctcacatatgctggtccgatgaacggtctcggtggtatgtgttgggtgcctacctcctgccagagcccgatttcacttttggtcccgacgatggccgccagtcccactacttcactctcgattgagtcccggagttcgcctgagcgcagaagcggttcgtcttcactgaaaccctgacgaacgcggtcggctttggttgattcagccagtggcgcccaggcgtcaaacagtccataagcgggctggtacacgccgatttcttctttcgccgtttcctcaatctctttgacgataacgcggaaacttacctccagcccggtagcgattgaggctgaggcagaagacagttcacgtgcaaactgctcaaggtccactacttactctcctcccaccttcgtgtgctccagttgtaggtgccaccctcgagctcgccgatgaccacacccatggcaatgcgctcatggggcatcagcgctgtcaggcctggaaaaatcacgctgaacggaaccccggctttcatcagccagcactggtttataaacccggggttctgcgctagttttttgcggcggtctccgtggcctcatcgtccctgtcgttcgacatgtcacgcagggaggcactgaccgctttcagtccgtttttgcccaggatggcgagcatgctttcaatctgcttcgggttctgcggtaccgggtattcttcgccgtcaatgtcagctacggccgccgccggaaaggcatacatgttcatgtacatcacattgatagccatttccgggccgaccgctacggtcagacgggattcctgcaccgggtccagctcacgcagggtgatgacgcgcccgctggcatccctgacctggtttggctttaccggcgattccgccacggcgggcgacgtctcatgcactctgacctgcaccattatttattcctcagttcacttttttacggcggctggctgtccatgacagggtctggctcaccgttttctcgccctgcttgttaccggcatcggtgaggtgaaacgacacgccctcgtagcggtacacgctgatggtgccgtttgcctcggttatggtttcggtaatggtgccgcggggctgatcgatgccgttgtagtagttgtcttcccacttcgcccagaagtcatcgagcgtggcatccatacgttcagccgtaatggtgccattccagccaacggggatctgcagttcatcggtaatgccattgagcggagtgattttatgggtcgagacctgcggctttgagtcaaaactcatgattttgggaatgcgcagtttccccgtgggcgtgatgatatcgacggcaatatcacgcccgatggtatagccaagggttggcatggtttatctccggagtaatgagtcagtcagtgttcagcgcgataagctgtctgagacggagatggacacgctgccgcccccttccagattcacaaggaagtagcgcaccacattgagatactttacctgcacatcggcggtcatgtagcccagtgccacgcgcgcatccgggttattggccgcatcgaggcgcaccgcaaaggcaggtccgccattcgggtcgccaatcatcttcagcgtctccagatttgacaggaaagactccagcgtacttttggtttcccggcgcaggtctgtggtctgattgtcacccaccacgctgccgaagcttgccgcaatggtcagcgacaggaagttggtcatgcgggtgtaggtatcatcgttctgggtcggattcgatgacgtattgcgcccggagcgcatcccaaagtaactgccgcccggacacggattggtgatgacatcaaggcgggctgagttgatggccccgatttccggcacggagtaaggacgtcccgccagctgccgctcagtggcaatgatgccggggatgcgcttgttgagcgtggagatatgcggtgcccgggcggcaatgtttgccgcttcaaacgtggcgggcgcaatcatgcggcttgtgccgtttgcggtatctttccagtaaggccagtcacccactatcagcttgaaatgccagtcgtccacgcctgagctgttaagcgcttcagacaccgccttacagccagcggaggccgggccctggccgatggcatatgcaccttcggagcgcgcaaacgccgccatcgcaggccagcatgctttatcggtcacatcggcaaggttgatgacctgtgaatttgtgccacgcagggcatacatacccttacgcggagcatcagtgccgtctgtaccgagtagcgtggcatccgtgataccggtcgcgccgtcggtgcccccgctgagtgtgatctctttaaccgcggcctgtgcgggcgcttcagattcggttactttcgcgcgtaccagctggctgggaccgcggatattcatctgaccgtgatttacggcctctgccatcgctttccacagcgcatccccttcaccctgcaggttatcaaagacttcggcactcacgcccggcagactgatggtcagctttttcgagttcaccgcggtaccgctgccgatacctgcaattatctggtttccccgcgtcccgctgtagagtgcggtcagcagcaggcctgacttgctgccattttcacagagccggccactggcggctttatcctgaccgtttgtcacacgcacacagttcaggttcgccgcaccgagctgaagtgaaatggcagccgctgtcgccaggtcatacttacggttttcaggcgtgcccagaaagaatgcaatgtcgttatctgacgtgatacgaaaggcgctatttaccggcccccagcctgccacacccaccagccccagcccgtcagtgggtacaccgttaatgtaacgtgcccggggcggaacaacctgaacatacaggtcaggtgccgtgagtgcagacgtgctgagatcgccggttgaataaatcggcatgagtgagactccggatgagtgaactgatgctggaaaaagggtttacggtgtggtctgctggccgttaacggtgacgaccgtgctggtcacctcaggtgcggtaatggcctgggtggtggcgtaattcacgctgaaaatcaggtcgcgccggtagacatgccagttctctgacctgtcggaatcagactgccgggtataaaggagctgcgcgggcgcgccgtcgttgaggtcaatgtgacactgttcagagagcgccgtatcaatggcgctgccgatgcggtcccgaaggccgggcgcaggtgcccagacagtgatctgaaaatcctttatctgcctgtgcagctcttttacagccttgcccgcggtggtaacggaaatactgagatgctctgccagcgggatgcagacactgctgagcacagtgaatgacttcggcagtgctgcagacagcgcgtgtattgcccgtccagccgtggttcccgcccggaaatggaaactgaacgttttcctgttaagggttatctgcacgttagtcagtgccgacgccacaccggcaacacttatcgcggtgccgttcactgtgaactgcagcgagggtttgcccttcgccatcaaacggaacggcctgccaagcgccgtgctgattttacgctcagccggcagcggccagatggagacatgtacgccaccgctgttgatatcctgctgaagtgtgcccggcaccggccagcccggatagattttcactgcggcattaatgatgcccggaagcccgctgccaccgggatacacaacatctgaaatacgctctgccaggtaacgggcaacatcatcggtacttgccatgttacaccgtcacctgaagcgccgtcaggcgccagcccatgtctgtgagttccgtgccgctgacgacataacgctgcccggcttcatccgtcacaaaatccccggcatgaagagacaggcctctgaatgcaggcatgagaatattgtgccaggcactgcgcgtctcacccggcaacttaagcgggctgtgctcaccgccacggctgagcagaatactggcgggccagctggccatgatgagcgtctcgcaggcatctgtggtgccgccataattctgcagtccgctatcagaacctgcctgcgcggtacgccggacgctgacaagccgctcagctctgacgcacagaatgggctgtaacagtggcatggctgccacgtaaaaagtcccctcggtggataccaggatatcgccggtctcaaaccccgccgcatcgaagatgcccagacgtatggcctgtccgaaccgggcagcgcgcatgtagccgtaatcggtggtgaatgaggccgacagctcccgcagcggctgcgcatccagcggactgaacggtgatactgcccggtaatgacgggccgtactgcccaggcgtttcgcggccttcccgttacccaggttcaccttcgccgccagctgatgtgcgtccatatcagcaccgtgtcacagttaatacgccattgcccagcgacgggcccggcgggataccgagcagtccgcagagctgacgccgccagtgattgtagagccgcgtgcggtctgacacttctgaccggttgcgctgccagacagccgctttatccgtatcaaggttatctgctgcccgggtgatgccactttccagaccggccagtgtcgtcagatagttcgccacaatggcttcctcctcagccctcagcgacgtcagccggtgagccagcgtctggaaccggcctgatgtgacctgcgcgtaagccgcatcactgcgatcgtcaggtgacgtgtcaccggtcatgggatagcccatatagcgacgtgcgtcggcctgctgctggtgtgtcagcatatatgacctcatctgaaaggattttgtctggaatggctgacccggactaacccagtaacagggcgctatgctccggtttgatgttctgacagccccaggccgcggcgatttcatagcgcacacggcgatactgtctgtacatggagacttcaaacgacatgttagtgcgcgggtcggtgatcatgatgcggtcatccgccatgtcgccttcttccggcagcgccggggcgcgggtagccaggatgatggctgaacggctgaatgcgaagttggcagtgaactcactgacaatttccagtttggttcctggcttaacatcttccatcagtccgggctcatgaatgtcaatggtgttaaaacttttagcggcaacgatatatttgtgcttcccaataatgacgacgcacccttcctcaacgaacccgggcacgctggatttactgttgtcgccatctgaaggctggatttttacagacagacttccttccgggcaatcctcagcaactgttaaggttctgtccttaagtggcttttcacccgactcacttttcacctgagcgacgccggctgattcacgcaatgtaaaaccatgtaactccagaagtgtgccctgagaacgcagtgctgtggttccggcctcattggctttggtcagctgcgccatggtccgcagtgccgcgcctgcagtggtatcgatgacacactgcaaatcgctgagcggtgcgccattgtccgtcaggattttgcgcacctgtgctgtgtcagtcagggtatctttaaatggtgttttacccgcttcaccggatgcgcgtgaagcgcgacggaacagctcgcccaaatcttcttcgatttcattaaccagcgtgcgcatcgcctgggtaacctggtcgcggcggataccatggtaacccggaccggatttaatgcccttctgctgttcgccttcccagcggaacggcaccatacgcgatttggtaatggccagcggcacattaccaatatcctggtcaccgtcatccgggggcagttgtccgggcttcacatcttcagcgtctgaagccggtgtcacagggatacggatcggctggttgagcgctgcgcgttctgctgtggcgtccagcgtgatggagggaataaacccgcagagctcacgtgagacgatatccagcgactgatacaggtcgggaatgagttgagtcatggtattagacatgcagggttatcctgttaatcggtaatctgtacacccgcacaggccctttcgctctgctcctgagggctgagggattcgaactgttcacgggtaagtgtgttggggctgctgttgccattccccccagcagagccgccgcctgatgcgccggtgcctttgaggatctggtctttatacgggtagtgctcaacgagaatgctcagcgcttcatcaaactccgccgcttcgccgggtctgaccgcactgaagattttgtttccgtcgcgatcaaacgccgtgacggcgtcaccgactacctgaaagttgctgccgaaccgggcttccaccaggtcagccggaatactcattttctcggcaatgaattttgaacgggcgaaactgccgccaattttctccgccgtgagcttctggctcaggtcgtcgcgctcttttacgatgggggcatacttctcttccagcgcccggacggcttcagtgcggaccttttcgacttcaccggcatccaccagcgttttgtcttccaggttcttcacggtgtccagtgctgccagcgccgctgacggatcatcaatcccttcaaaggtcttaagcagcgtttctgcactttccgcacgctcacggtgcgactttgcttcaccgttaagacgcgagatggtctgcagcgtgccgggggcatcaaacgccagctctttgccgtcatcctgtacgtacacaggtttgccatcgtttacgaccacatggccgttctcatcgagtttcagtttcatcagggtcatccaaccgtgtaagagccatccggcccgtgacgccgcgctgcatccgcagcgagcggcaataaaagaaggcccatgcatctgcacgggcccggagaaggttaagccggcgttgttgtggccggtttatctgataccggggctggcattgcgcggatacgggcctgctcttccgcccagcggagttcgctgttaataaggccacggcgctgtatctcgttaaacagcgtctcgtcggacagtgcccgcgttttatacatgtcaaccaggaagtcagccgaggcttcagccagcgtggtagcaccaaagtcactgaagatagtgacgtgtccgccttcggactcaccaatccactccgccagatactgcagcgccagccgggccgcatcggtgaggtcacacaccatgcgctgcagggcgctggtgctcgcttcattatcggtcagcgtctgcaccacggtacggtggccgggttttaccaccagcagctcggctcctatctggcgcattttctcttcaaggtcgatgatgtctgtgcgcccggcctcgatggccctgccgctgtgctccacatatcgcaggtctgcttcatcctcttctgacaggatggccgatgccgcacccaccgaaatcgggccgtcgccgagttttttgccgaacagcaccggtacgcgggcgacatgaagaatggtctgctggtcgctgcgggactgccagtgttcgacgttgagccaggccagttcgaccagtggcggccggccgttcataaagccgcgtttgtcgccgtagaccgggacaaaggtgatttttttcaggctggtggtgccttcgtcatgcaactgccactccagcaccccgctcgtttcattcagcttttcgcgataaatccgccagcggccgggattaagcaccctgacctgctcaatgtttttcacgacaaattcattctgcgggtcacgctcactgaccgtctcgacgaagcgcagcagcgtgaatgtctcctgtccgttgacccgttctgagtcgtaatccagcaggctggtggcattcaccctggcgaaataaggccgcaatccgcgctggcgttcttcagccagagagagctgtttatccgcaggtggatgctcgacaaggatgccgcacagtccgtaggccatcgcttcctcaaaagtgtcagccagaaaggagtgcaggttagtgccctgcaggtccacatccccgaacatttcacgtatgcgtgcaggcaccgcttcttcattccaggtgaccgggcgggaaaagggtttgccactcagcacctcgaccgtacgcgaaaacgccggaaacagcgtcgccaccgatagccggttctgataaaacgcctcttcttcactgggccatttaggcagatacgttttgcccgcagcacgcatggcggccgtgccgcccagcagcttgctgatcatgggccagcatccggccatcgactcgattttgggcgatcgcttccggacgtcgttgctcatattgatgttctgtcaggcagagaatggacggactgttgtgcctttcggctggaacagttctgtaatagcccagaccagcgcatccaggcggtccggtgatttcttcgcggtagcgggcacgtattccagaagctggttttcgagctggtagaggttgccacggtgcgccacccgcccctgctcatacagcgctgaaatgggctcagcccgggcaaacttgcccttgctggcatggacgcggacgatgcgcccgcggtagcctgcattgcgcagcgtgtcttcagccatgtcaccgccctggttggtttcaatgacgattgcctcagcgtggtgctcttcataagcccggatggcgcgcttcgcccagccgttcggagagtacttaccggagtaatccgcgtcagcagagaacagcctgtcattaccgcgcccgtaactccttgctaccacaatcccggtttcatcactctcttcgctgtttgtcgcctgcgggtcgatggcaacgaccgtccgggacggctgcagggtgatatccagcgcacgcgcaccggacaccatcccttcagtccagagtgcaccgtcggcattaaaccgtcggggccgctgcatgtactgcgcttccgcggtgcgccggtgtgaaaacagagagacgcgatgtgattcattgtgcttgtacggccatagccagccgtcaggcagaccatgttcaatgggtatcgcgtgcgagttttccgggtacagtactgaatactgttcgctgttatcaatcagcaccggcaggttcaggtggtgccactgttcgccactcccaccgcgcagcagatagccactcaggtcgtggtagtgaattcgctgcatgatgaccacgatgggtgtggtctcaatagccagacgggaacggatggtttcattgaagcgggtgttcaccccgacgcgtatggtttcgctataggcgtcgtcaggtttgaccgggtcatcaataatcagactcccctgccagcccgactccatatgcccggcacgaaaaccggtaacctgacccgcagcggacgaggcatacaccccgccgccgtattcggtccaccacatggctttactgtcggcgtcatcgcgtagcgccatcggccacatggcctgaaaggcagcagacttcacgatgctgcgcgtggtagatgagttcagtaatgccaggttgtgggaataggacaggtgcatgaagcgggcgcggcggttcagcgccagcccgcggcccatcatattgatggtggccagttccgttttggtgtaacccgggggcacattgatgatgagtcgcctgatgtcgccatcaatcacccggtcgagcgtccgctgtatcacctggtgatgttgcgcgacgatcattcggctgccggtgcgctgcttaaagaagtagcgggtaaagtagagtccgtcctcttcacactctatacggcgtgcagcggtcttgaagtcagcagtcgtcatcctccagcatttcccggcgtgcctgccggtattcctcgcgtgaaagcagggcaacctcaagcgggccgccgtctttgcctgtcagtgatgtcgccgcctgttcgcggaatgcctgcacggaaatgtgtttgccgagcaattccagattcctgactttatccggccacttaatctttttcaggatgccgaccatctcgcgctcttcgccccggccttcaaacatctcggccagatcgaatccgctcaggtatcggcgccatgaagctggccattgcgacacaggcttaatgctcatgtcatctgtcatgatgtcgagcacgtccatctggtcaatctcaaacaagcgtctcagcacataatcagcatcaacatcgattcgatcattgcgctgtgctttcagttcagagattcttatctgaacgctaacatttgctaatagacgggcaccctgttcattcgcagtttttgcactgtaccccgcccgaatggccgcttgcgtggcgttcaaatcgatgaggtactcgcgacagaacatttgttgcttgtcggtgagtgccataacttcctcaatcagttaaatgcatgggaataattatgtttattttaaactggctgttagcccatcacataccgtctatagcgactggtatcgtatctgcattattttgggtgatatcagcgaccgttaaatcaaagctgaacccaggaaaggtaatgataactttcaatggggaacaagacgatgtcgatttacataatttttacgataccgcgcgattgcaatccaaatacaactccatagctgcattagccgcggcagctactgttttatctcaggctttaggctggtaattttttacaaaccacaacatgcgcagaagtgcatcggtttaaagccaaatttttagcagagatcatttgcataacttttacttaaagcatttcgtttcataaaaaagaacgaatgctctcctaactggcactgctacagaatctcttatatatttacttgagcgtatttcagctgattcgattaccccctgaggccaaaaaatgaatgataagaagcaatctgataagcgcccgccttctcctcccccttcgcgtgagcctacgccaaaccatcgacgcgatggctcaaatggaaacgatagcagaaagaaatggcatactgacggtgtcaggccacccaagccatcaaatcgatagtattgaggtcataaatggaacgctgggaaactggagtactcaatttgtctttctcattacaaagagaagatgtacgccactctcactggccgcatagataaggctatcaatttcactctccttctcaccggctctgcagtattcgctaattttggcagcaacatgttttttggtgccatggttgctagtttgtctgcactatcttttgtcggtgagtttggacgaaaatcatctgaagcattacgaatatccaaggaatatcatcaacttttaatttcaaaggataagctgacagatgaagctctcgctattgcttttggagaattaaataaaaatgattctacagtctggaactgtctatcagtagccgcacgaaacagaacaaaacttgctctctatggaacagaaaaaagcaagcttgaggattacggaatgtttgacggcataatgtcttggctagcgggcgataagccataaaagtatgtgtttatatttattcaagataaaagtgatttaatttaagcactgctctttgatgtactgctgcaattcggctatctgctttccggcgacttcgattcgatctctgagggtgaaataatccctttgagcggcgtcagtaagtcgcgcggtggctggatcatatatgctggaggtgccggtggcagattgcttctgacatgtagcgttgagctgcagtcggcgctagtctgggaaaatccctttttgctaaattcaacactatctgtcgtgcagtccagcatgccaaagtattccccgatagctgactggccgttacgctgagtaaaagggactaaccagatatcgttcccgaatgtcaaatgcccatagtcaatcagaatcccgttcttttcagcggcgtcctgagcgtcagagaaagttttccattcagcctggtctccggtcttggcccggatcaccttagccataatggtctgattatcataatgccggcaggcttcaatctgggcagcatcaacttttgaaggtctgatcgatactatcaacagaatcattacagcaaatgcgagcactgccagaaaactgtgatggcgatgactaaaattttgactacccttttcatatgatcctcatcctgagctatttagatgcgaatcatacctgaagcttcttgtaatgatcacgctgccttgcacgacaggtgcactgcattgctcacagatatttaatcgccagcgcttttacatcgtcctttgctgcgtcacccagcagagcaaccccactttcaacaaacgccagcgcagcttcaaaatcatgaacgcccactttgacttcagctgatgggggcatctgcgctgcttcggcagagaattctgactgttcaacgtgttcgtcattcattgattctgacatttcattactcgcttcttcagggtggataaactggcctttcagccactggaggaaattcatttctgccgttcccgttcgatttgccggatggcggtcttgtcgtggttgcactgctccagagcgttaagcagacgctcattcagctccaggctgtctccccaggtcaacgggtcaggaatcaaaggcacagcgcagtcagccagcagactcaccggtatcggtactggcggaaccggtacgtactttgtcccggtgcgcacgcagctggtcagcagcaggacgaggcacaggttcagtggcacagctgttacccctgaccagcttttgaataaccaccaccctgcgctcactctcttcatcgcctgcctgatttgcatcctgagttgcccgggcaatgtcgctgaagagggctgttgccctgaggacattagtcgcgagcatctctgctgcagctttttgctgcgccagctgcctgttctgctgagtaatcacgactttcgataaggactgaagcttcagggcgacgcttagcgcgatgaccagcagtagcaggcctgtgatggtaacggcaccccacttaacgcggcttaaggtcatcgctgctctccgacaggcaaagtgcacgctcagtttcgcgacgcttcattagccctttccacctcctgccaccggcaaagatccagcgccgcagttcattgcaggcacccgtcgtgtcgcctgagttgagttttctcagaagggaagtgcgggaaaaagcgtcagtaccggtgttataggcaaagctgtagagtgcagcgcgctggtaatcgctgagggggacagtgaccagactgtcaacagctgcctgaacgggtttcaggtctgcgcgtagcaggctgtcgcactccctgtcggaataggttttgttactgacaatatcggggccggtgtgaccatcacaggcggtgagcacaccagcgacatcccgatagggaacataacgacgcccttccagaccatccggaccacccagcagcgtcattgccagagtcagggcacccgcaccggctgcagccagaagtctgttacgcagcgcagcggaaatagccatgatttattgcggcttattctggcaggtacagcgcagcgccctgatttctgccagtgtcgccttgcgccggtaatacccgttgatgacgcaggttacggttgcaagactgataccggccagaaacgccgacggcgctccactcttccggactgaaataggtcaggatgccgtggacgatttcgcccgcggatacgccataagcgacaccagttgtgagtttgctcatcaggatttgccgcgcagaacaggagaaaagtagccggagccggtggatgagcaggatacagtgacggcatccggtcataaaaaaagccctgacaaaaatgccagggctgaatagaaatctctcgagggtcatttacccatcgttggagccaatctaacacaaaaaatggaaatgtaaatagcgagctataacatcgctacgtgaattatcgctcgctatttagtaatgcgcgataacgtcttctctgcccaggcttcctcccggtgcagctcggcgaccagaaactccagcagctgcttcacgcttttgttccacgtatccagcgtaacagcctgcgtgacctgacacaccgccctgaacacaacagcggaaggaatacgttcaaagccgcgcccggaacaccgcttacagggctgataaaccggcacaccctgaaatcgcgtcatcacacggttaacagcttcccctcgccctttgcagtccttgcaggctgcccgcacgacaccttttccgttacatttactgcaatactttccgttacgcaggcccgtgccgtgacaggcatgacatggcgattcggaatccgggctgcgcgcataatcaagaaaggcatagcccgcgatgaccgtaaccaccgccattcgctcatcttcgggcaatctagagagggccggataatgcactgatgccttcattccggtcttagtgagcaaccctacagcgcggtctctgtcatggtgactgagctgcattttgccaaagaatgcagaataaccgaggggtgcacgcttctgtgtcatacccagtgcagccatcacatcgctgccgagcatgtcaccaggtgaacgggaggactggcgggtgaaaggcgaaacggagcgcgggctgtgatacttaacaacactttcaagtttcatggtaaagactctgtgccggtaagaatgtcaccggcactatgagtcgtgtcagattcatttttctgaatgcctgcaggcacgtttctgacgaatgaaaaatgaatttctgcacaaatttttctctgggcagctgatgcctgcccttctccgtcacccggcaccacagttcaatgagcgcttcgccagaatggtgacgggggctggcccctttcttccacccgattagtgtggaggcaaccacatccagttcatctgcgatgtcctgaagggagtaaccggaacggctcaggtctgtgaggatccggaaccagtcgattttatgaatattgatgacgggcacgcgacttcccctgctgttacagcctgagtaaatctttgagatttctgacgcccagcttattagcacagtttttccggtgctggtaaagcgttctggtttgtatacccagtgctgagcaatgatgactgacatctgtgccgttaagaaagccatcaatgacggcatgctcacgcagcgttattctgcagttttctctgtctgaaggtttcctgtccagatagcgtttgagaacgaatgagatgcaggaaacaggcatggacacatccagaacatattccatatcgcttaccctgttcagaaggtttcttttccggctgtccagaagagcctgactgtctgaaaaaaccagcacgttaccgtttgttttacgcaccagcgtgagaaataagctaaaccagtcaggaaagaagtcatcgtaccccaggcagataacggcgagatgatagcgacccggatatctgttcgctgcatgactgctgaatttcaggccgtttccgcacgataatactgtcagatttctttttctgcatgcggtgtgtataagactaaatagtccataatgtaaaacattgttgtctccgatgacgacaatacagcattctttgcttttcatatcctgccttccgtattaagcatttcatcccaaaagaattaacatctaccctcctaatgacgcgtattattactactcatatcctgcaggacattcaatgcaatcgtttgcccgacagaaatgccaaacaaaattacccccttaacctgttgattaaaataagttaaagtcacaccaggaaaagtattaggattaactttcagactcctgttagcacccattcctacccaaaatgaattctgacgagcctgaataatagaaggcggatttgtactttcatacagacactcacatatcggttaaattcacattgtgaaaatcacctttcagtcatgaaaaaatagggaagataatgagaggagtgctgtttttccactcacagaaaggaagtattacatgatgctacggggtatctctaaaaccatcctgagacaaattgaaaaagaaagcgcatattacttcagatgaaatggctggcatgaccgaggatgccgacgcggaacaatactgaaacagctgacaccattacgcgtgcaattcagtgactgcgtgatagcactattgacagtatagcctgctccaattgtcttaaattcattgaacagcagatgaaatgaagtctggcgaccgccggaagccgatcaggatgatcccgttgcgtctttgaggccatcagaattaccctacagcagcgcatcacaacaggactgagaaggtcaatacacatctccctttaagtcatcagagagaacatgccccctgtcgggatacctctgcagacaccgcacgcagggcactgtactgtcatcagcaaaaagggatatgaaaagacgatcaatgccaggtcaggtcatcgtaactgtcggttgagttcatggtgaattctaccatggcacttctctgtagtgcatcgcgccttttgatttcgtcgctgacatcattgattgccagtttcagggcatcaatcctgtgtatatcactctctgttttgagaaaactgttcagcttgttcagtatgcccggccatgagacacgtgtgttgtcattgagtatggcgagagtcgcttccccgatgagcacatcacgcagcaattgcatatcctgtttctgtcatgactgcagctggtctcctgtctcacgacaccgaaaaggtgggcagtaaaatcacactcatttgctgaacaaaagctcaatcagcgcatgcaactgctgttcttctgcatcagatgaagccttatcaagacgtacaatcagccttaagcagatagctttgcgattcagtgtctgacctgaacggaggatctcagcaacaactgaaccaagcgtttcctgctgcgagagcagatttgcacggctgaaatagtcagcgatatcgctgttggaacctgtgctgctcagattcagttgcatgactgactccactgtatgattcgaaaatgacgtgttttgcgtaaattatacaaaatatgtaaatctgtacaggtatatccgcttcgcttacaataattactggccaggacagatgccggagagtatccatccggatggtgtactgctacagcctgatttgagccctatctggcccatggcaaatcagacacacgggttgtgtaggcaggcgacagcatatcccgcttcattgaccaggttttctggataccctgccccgcaaaaaacagactggctttaccgctctgattaagcccgtcaactacccgcatgagagcctcactgttcgcctgcggccggtattcgtcaaacaagctgagctgagccacaccctggctgaagaaatcgcccagcatgacgcctgctttcatgtaccggtgtccgtctacccatatcctgtcgagcgcatccatggcgacgcgaataatatcgcgggtatcgttagatggggtcagcagcttgccggttgcctggttaccgtaaaacacctccccgtcggcatgcgggctggtccggataaaaaccgctatctgcctgcagtactgcctttcttttctcagtttctcagcggcacgctcggcaaacgcgcacaccgcctgacgcatatccgtgtactcagtgatacgtgaaccgaacgagcgtgagcagacaatctgctgtttggtgggggcaaattcctcaagcgccagacatgactcgccgcgaagttctctgacggtgcgctcaagcacgacgttgaaatgtttgcggatgatccaggtgctctgttctgcgaggtctttggccgtggtgatgcccattgcattgagttttttactgatacgacgccctactccccatatatcctcaacaggcacaagcgccatcagctttcgctgccggtcgatattcgacaggtcgacgactccgccagtctgcttccacttcttggcggcgtggtttgccagcttagccagcgttttggtctgggcgatgccaacccccacggtcaggtgcgtgttgcgtttgatcgtctcacgcacttcgcgcccgaagttttccagcaccatgcagttgcgtacaccggtcaggtccaggaacgcttcatcaattgaatagacttctacgctgggtgccatctgctcgagcgtcgtcattacccggttactcatgtcagcataaagcgcatagttgctgctgaagacgtgaatcttatgccgtctgatttcgtctctgagtttgaaatacggtgcgcccatagggatattcagtgcctttacttcagcacttcgggcgatgacacagccgtcattgttgctcagaactaacactggtttgccgcgcaggtcaggccggaatactgtctcgcaactggcatagaacgagttcacatctaccagcgcaaacatcacatagcgccattcgggttgaagacctggaagatgcgatcctcaccttcggatgctgagatatcccggaaatctgacttgtgcgcttctatccacctgttcgcttccctggcggtaaactgccagttcagctgctggagttcgtgaacaaagtcgagtgtgctcacggtgtaacgtccgcgcgcgtcccgcttaatggccagccggaaagcgtctttgatttcataatcgcgtggcatgatcactgccctttcagaaatactgtatacataaacagtaactgcagttagaggttttaagcaaatttctggggtgcgaaattttgtaaaggcagcgtgaaatgtctcattgcgattaagttagatttttatcccgcaagaaatacgatggtaaattattctgctatccagtgttaatacatcaaccacaaaatccatcacagaaggatagcggcacttatctcagtcgtatgagcggtgtacctgccacatgtcatagaatgcgggaaaagtccgctttcgaaacaaagcggacaatccatcccatgaccttatcggtcagcataagtcatacatgacgtgaagatacaatgaaatagccaatttgctcagcgctttgcataaagataatcgccattggcctcatctaaaaatttgatttttgagagtaattaaaaaatttaaatgatggttaccagcacaccggaagattccatttcagtaattttctcagcatccgctgccaattgctccctgtcagagttaaccaacacaacccttccataagaagtgaccaggtcgacagttttattgatgtaatcgccaggtttatatttacaaacagtaaatccatagctctttagcaggctgcacttcgattcaatattaacctccttaagatagcctgcatcaggtgaattgaggaaaaactccagtgcgtatcttttcaataaagggctcacagaggtcttatcagtaaattctcttggtgagatacgggccataagactcagatcgatgagtgaatgagtattacagtcttcaacaaggcgcggtccaagtccgccatgcatacgcgcaccagattcgaccagtacgggaccggtggcagacataataatctcattatgggacgtaccattacgaatgccgagtgaagtaagtaccgacttgatataactgataagaactggatgttcctccagcggtttctgtgatcatctgacgatagatcggcacaccattaatttcctgttttacatatctgaaaatgttcactacgaagtgctgaccaaaactactgacagcatcgacaacatactctgtaccaataattttctgttcgataagcagttcggcgtttttactacccgaataatcaaatgtattgatcaatttaccaaaggcactttcaacttctgatacatctttgcagaaaaaaacaccttctgtaccaaatgaactgaccggcttaatcacatattcatcaaactggttttttgtgcaccattgcaggatatcatcaagatttccggatttataatgcggtatgtatttaatgtcatccttcttcaactgatgctgcataagatatttgtcacgccgcgcatggcttagttcaaacacattaggtaatagctgccagtgctcacataactgatcaaaaaccagtacgccgggttctgagccacaaacaataaaatcaggttgttttccaagagcagattcaatctgttgaactgtttcaagatgagaatgatagttgaaaaccattgagtaatcttcctcaacaaatgtggcaaggatcgcctgaggaagattaggattagttattaaagcaacaacatcataaccgtaaagcgatttaattctgcttgcaaaaacagaaccgcttgaaaagggatctacaattaaaacacattttttttccattttttccatcctatggttctaaatcagattatgtcaatcacagcgttttcagaaggaaacgaacaacaagcgaggtatattttttcggctttatctttggcagaaaggcagaagtctggttcactttttacatctccgctatgaagcctgaacttgcagctcccgcaaatacctgaccgacacatatttcttattgaaacgttgtggctgatgagattatccaaaacagttaaaccaggatctacagagatgactctattcaaagttttcaaagtaatctctgttttatgagtttctgatttcatgatgtaatcaaatgatctgcctgaactaaacgcctctacagcaacagaagtttgtgggaattttgtatttatagcagtaaccattgactgtgcaaaatcagcaccgccacatactattgccgattcaggcaccgctttaatatagtcaaaagctaaatcaatccttcctgctctgacaatgtcactgaattttgcgagtttgacccgagttacgtgaatgcgcatcgaaaaccagtcacatcgtgtgtgcaaatccattaattcattcaggcaaggcacagaccccagatcgtgacaacttagtaccaattgcacaacgaccccgggagcactgtacccataagatttaaaacattctcttatcaaagccataggaagtgttattccaacgccgcctgctatcagaagcacattctttctactccggactgaattaaaggttatttcgccccctcgccccaagatatttacttcttttctttcttgtaatagccgactgatgacatttgatgcacttccttcgcctctgtcttcaattataaattcataaaactttccatgctcagcagataccagtgtatagcaacgctggagagaattattaccctcatcatcgaagctaaaaacaaaatactcacccggcatggtatcagcagctaataaatctgtatcactcacaggcatcagacggaatgatctcatccttgatgtaagcagggatgtttcttcgcagacaagtttcatttactggattaccctataggcctattctggaaattactgtctcagctgaatcgagataaatatttatctcattacatctttctgtttcagaaataatttctctggcatagggcatccccgacagtctgaaaactgtctcccatgcacccaactcgttatcagcaaagagatccgctgttttaagcattgtgtcccgaagatatttccgttcactagtgcccagatcacgaacaatatcataagccacataactaaagacgcttgaatgactccattcatcctcagcatgaactcgtgtaacttcatggcatattctctgaatactgtgatcttcagccatcactttgagatagtctgttattagcgtctcgctggcacatgccacagcaaaacgtgtcagtcttcgctgccactctgcactacatccggccagcatttcccgtcgccagtttatgagattaaaatctgtatagttaagcggctcaagttttcggcggtcatagatataattacatgccatcactgacattcttgtatgcagggcttcatccagaagagcttctgacattacatcctgaagatctgccctgttaggtgagttcaccggcggacactttattatgtcttcacaagccggcgtaacaatgtcgcattcaatatagatggtttttaaattgtatataccccacgcataagaaagacacttgtccttaacatcttcaggcgcttccttccaggcatcgtgctgtctgaatggcagcaaagactcactaaaatcttttttagtttggtcaaattcaagatctgaatactcaggctgagatttattaactgcagctctgtttttccaaagtgcagacaatcttttcaacataagggcgacattttcactgtcgggcactgcaaattcagcggacataaattactcctttaacttttgactgccagattaatgttcgttttttactctaatcaaactcataaaaatagcgcctgatagggctaatacagcggaaatgatcaaagcattttcccagtgcccgccatcaagcaggtcgccgtatgcaattgctgacagagcactgccaagataaaaggcgagctgcctgatgctggttgacaggagagtttctgtctttcgaaaagcctgttatagccagagtatccagtagcggcatgagacagtaattcagtaaaagtcttaaaaaatataatgtaataaagattgccacaggaacatgtagtgtttgaaagaacaaacacgcggccgtcatgatgcccgcgataattacggccggtttcagagaaaaacgctttacaagcataggagcaaacagtgctccaacaatactgacaactttatcacctcccataatcaatgatatttcactaatattcattgaataagcaagattaaagacaatattaacaaaccggaaaataagtgttattgacgcacccagaagtgaagcagcaataaagagaataataaaattgctccactccatattcttagcgctcttaaatcggcgctcatcgcttcccggctcatttattcccagaatggactttattcgaaagtaaatcatcagcaaagcggaaataaacgaggcggccaggatagcttgatagttccgtaatgcagcaaactgtgagaagtgtgtaatagcactgactgcgacagaacctgtcatagcagcacccagatacgatacgaagaaacagctaaagagtgtcgttctgtttccggcatcaatgtttgatcccatgagtgaattgcccagcgacagctgtgcaatcataccggaaagaatcaatccaagtgtaaaagcgctagcccatactgttgttagcacaggaagcagaataaaaggtaatgcatacaggaatgaaaaaacaagcagtagcttcttctgtgatacccgtcgactggctaagattaatgggattaccgctgctgccatcatcgccatagctattgcataaatgtgtccagtatttgttttatcgatgccacgttcttcaagataaaaattataaacagcatcgaacataccgttactcagacccatcaggaaagtcgccactaaaaaactttgtgcagctgatccgaattttcttacttccctaaacatattcaatctcgtccttcagctttaattaaattaatacctgtaaagctctcgaaaagagattcgccctcaggccattcaccatatcctgctgcagtatgaatatgacccgccccgctaaactctcgggtttcgcatccccattgttccgcaaggatgcgcgcgcgagtaaggctgagatgctcatcattatcactgtgaatgagcaagctgctgtatcctaagcgggatgtgggcaatgagcgttgctgcctgatcggctcaatcgccgtttcggcgtcaacatccgccggggcaacaagaatcagggatttaacacgctggcaagaatgagcagctgcccattgggccactgtaacagccccgcagctatgacctagtaaaactatgtcacccctggtcacggcaatgacctgatttagtcttttaacccataaagatgatggcgagttccagtcatcctgaagaaacgcgtagtacattactgtatttcttctcaatgaatgactgccagtgatccggacctgaatttgtatatccggggacaatgagataggtagtagtcatcagtttctcgtataagttacgttgtcagcggaaatgttaattccaaaccttgaggacagaagcaataaaagctcttctttgtcagctatttcatatgaagtagaggtaagaccgccgacctcagtgaatgtattgtttctgatacttatccggccgttgtcggttggaaggctcgcaactctataatttttaagaaggctttcaggtgaaaaaagagtatagaaatgcgccattttgatatccggcggataaatttctacatcctgaaatgaatagatgtcttcccaaaccgcatcaatcctgctcttttctttaacagaaacaatccacccaagctcatgatcgcatctgactcgggatgataaaaaatcatcttcatgagtgaatccgttcttaagcaataaaagcccccgggggcctttggctccaaatccgacgtcaaaaatccatcgctcattatctttgttcaccagaaaaagctgatgcgttgcaggcgacaaatgagggatgaggactctggccattcggctttgaaaatcaacggcaaagtgactaaaaacttgctgtagtaagacagagaattcgaagcaaatccctcctctactgttaagtattattttattggcgacatcttctggacgtaggctgacatctgagccgttgtgcatggcaaagttttcgaacggcacagtaaaaaagtgagcgttgtgcagcgttgagagattaaaaccatccttttcaattttttcattaattttcagcctcttaaggtaggccagcatgtccatcacaatcttctccttagatattgattatcctgctgtgtgagcctcctcacattcccggatgagatattaagagcaaaactttacaaaacaacataattatcacagtgaattattaaaaaatcataaatatttcttaatgactccagtaagcgcgtgaaaccctctaccagcttcatgtaaatctatgtaaagcatgcttatttctttcaattgaatttatattcatttaatgaataaagtgtctccttaacatttatgcgcgtaacctgagatgccgcctcaggttgttgaatatttgttaaccaaactttattttagttgtgaaaaaacatggggttttgttaaaagtcgcacaccaaatatttataatgtgatgggacttagagaggtgcaaggtgatgaactgtaagtatggattcggcgcggtaagttagttaaggctgttgtcgttcaatcttagaaagaaattagttcgaattataagatgtcaatgccaacccccaccttccgggctgtttccttaagcgcagatttcgcgctcagcggctcactgctttttgccgtttaaacagcaccctgcatttaccataaagccatatctggatcgcttaaagtgacaggaaggcgcttacgcgttgtacctggaagccacttcagccagtcggttgaaaagtgttttgagtccgggctagtcgtcagcctgacggatcatggaaaggtcacagctatgatgcagatcgttaagagaatgcctgtcattccagctcataacatcccgttcaagcgcacccatcctatgagaataaagctgctgaattactggaacaaaccttgcaaaaaaacattccggtttaagtggaaatagtggcttataggtagcgttttgatctgtattttgagaaacgtgtttctttgtgattactatgtctgagagccttgtaacatgaattcaggccagccaggattgcccgccgacctcaacctttccagaccctatgagtttaaggaaacatcagattgttgatgcttatgtccgctttgtgccagaagcggacattttctttgagcctgaactggcaaaattctgtcagaatcaaaaccgttaaactgtgtgtgccgcaaagcgattttcaggtaagccggggctgacatcagattcagctttcagcaatgcaccgtcatattcagacagcgcagtgagtcccactgtagccgtggtgcaatagagacgggtaaaaccctcaccgccgagtgtcggacaggtgctctggattccaggtgacgtcagaatagcgtctgtggtcccaaccgggcggtaacggacaacacggtttcctccccattcagcattccatagatagcccatgtcatccacgcaggagccgtcaggcgcgccgctgccttcgatttcggcgaacacgcgctggttctgcagcaaggggtaatcacagcacattatccgaccctgcatcgagtcacagtaatagagcgtaccaccatcggggctgaaacagatgctgttcggtatagcgacatcgggcagtgcaagcgtctcaacagtcagcgttgccgcgttgagtcgatgaaacttaccgatgactttaacgggataaccgtcatccatcgtcccgaagacaaaattaccggcacggtcacatcgtccatcacctatgcgggtcccgatgtctcccggtgaagcggccactggggtaattaaactgctgttgagatcatagaaagccagccctgacgcgaatcccatcagcagaatgtgactttgttcagtcagtgcaaaggagccaaggcgttcaggcagcgaccagcgcatcactgcatcattgccttcttctatggcgagcagttcactggcttcaatgtcagtccagtagagtctgcggtttctttcacaccaaagcgggcactctccaagcgtattcctgacttcagctgcaattgaaaacatgttaatcctccggatataaaaggtcgaactgcacgatggcaaaagtggataacgcagttactgcagaaaacgtgcagagatccgatcgccgaaaagcatgacggcaagtccgatcagcatgacaaccatcccccccagcctgagtaacgaaaccggtcgccgcatagcacccagcaacccatagtggtcaatcatctgcgaggaaagtaactgtccgacaatcgccagcccgagcagagctgaaaacccgattttcggcgcaagcacgacatagctgaacagggcacatgcgcctatcattccacccgtcagactccagaggggttgcgacgggatcgccgccagcgatgtcatcaatcctcccctcagcagcgcgtaaacccccagacttaacgcgcccgccgtaaaggaaaacagcgccgcagtgaccgggtcgccgcccagtccctttgccagctggctgttcagggtcgtctgcagagtgatccccagacctgcggcaaaagcgattacgtaatagatcatgcttctcattcctttcagtctgcctgctccagcggcaggaaggtgtcagcaaaattgtcgggctggtagccagaggcggcaaacaggtgctcacgtgactcatcaatcgccgcccgcagtcgcgtgctgtccacgcccagcaccttaccgttctgcttaacgatgcgtccgccgatcatgacggtgtcgatattgctgcgctcggcggcatgaaccaccgtaccaaaggcattgccggacgggtaaagattgatatcactggtattaatcagcaccaggtcagcctgtttgcctggcgtcaggctgcccactttgtcctgcatccctgcacaggccgcgccatcaagagtcgcggctttaaggagctgcgccgccggaagcgttttcagcgcatgttcagaatcgcagcactgctgctgatgcttgcccatcacgcgctgcaggtaaaaggcgacgcgcatctccataaacatgtcggtgctgtacgacgtttcattgtctacgctcaggccaggattgatgccatgacgctgcgcggcctcaatggcgaacattccgctttcgatgccatagtgcgaatctgagcgcgggcagacgttcacccggacaccggcttcgcgcagaattttccatccctcgtcaggcagcgccgtacagtgattaaaaatattgtccggacccagcagcccctgctgatgcagtgatttaagttcagctcccatctccgcaccaaagaactcagtgacaatcgacaatcccagtctgcgggcctcggcccacaactccggctccagctgcgccatgacggcgagagagaccaggctttcagggttgtcgttgaaatacttgtcctgcagacgctgccagtttcccggccagtgcgctttatcccattcgccagctaccggtgcgccggaagcatgaatggcacgaatgccggtatcaagcagggcctcgacggcggcatcggaatgcgctgcggttcggctgttgtgcgagttatcgatcatcgtggtgatgcccgcgtcaatagcgccaagcgccgtcagcaggttgccaacatagatatcggcaggacggtaatatttagcgaacgagaagtgtgtggcattgctgtagtcgtccaggcaggtagcgtttgggttaatgcggcggagctgtccttcccatgcgtgacgatgagaatcgaccattcccggcatggcgatcatgttagtggcatcaatgacatgcgcacccggtacatcaaggttctggccaacggcggtaatcgttgagccgttgatgagaatatcgccacgctcaatgttaccgacgttctcgtccatgctcagtatcgtcgcgccacgaatcaacgtagcctgtaaagtgacattctgattgttaacaatatttctgatgtagtcggtcattaaacctgcctctttcctgattaatggggaaacgatacgtcacgtaattaccctgaaaaagatgcttaaagcgttttcataattcataattaacgaataatcagactcacttttacccaggagcaggacgatggatcggattcaggctatgcaggttttcacgcgggttgctgaagccgggagttttgtacgcgcggcagaaaccctgtcgctgccttcttccaccgtcaccagcacgattaaaaacctggagaaatacctgcaggtgcgtctgctgaaccgcacgacaaggcgggtcagccttactcctgaaggcctgcagtatctggcgcaatgccgggagatcctgtcgctaattgaacatagtgaatccagcctgactgaatccatcagacgccctcaggggcggctgcgggttgatatgcctggtggaattgcccatttcatcgtcatgcccaatctgaaagacttttaccggcattatccggatatttacctgatgattggtgtcagcgaccggcaggtcgatcttgttcaggaaggagtggattgcgtcatccgaaccggggaattaactgactccacactggttgcccgtccgcttggccggtttcgctgggtaacctgcgcctctccggactatctcagggagtatggtgtccctgagacgccggaagcgttgtcgcagcatcgggcgattcattacttttccggttcggtaaggcgcactaatgaactgcgtttcacacgaggcactgagcccttctctgttcaggttgagggggatgcagccgttaacgaaacgggactctacatcagactgtgtcttgaaggttttgggctggcacagcttgctgagaatgtgatttcggagaatctgcaacaaggcaaactgatcgaagtttctggcggactggcagccaccctccatgccggtgacgatgctctatccgcatcagcgttttctctctcctgccgtgcgtgcttttgctgactgggttgccggacttttcaacgaaggagcaggtgagaaacggtcttcccggtaaggacggctccggtaacaggtaaacgcttcagaacgacaattaatagcatcctcagcagaggaaccgatcgtttcccctgctgtgtcagctaattcaccccggctgctgtacaggttccaggtgagcgtttcgtccggcagccattccggtgcaggcacctgcgactgcgattgctgcggttatcagtaatggcaccgtccagcctccggaaaactcctgtactttgcccagcaacagcggacccatcgccgccatcagataaccgacactctgcgccatgcctgacaacgcggcagcatcaccggcgtttttagtacgcagcccgatgaaggtcagacccagcatcatgctggcacctgagccaaagccgagaagcgcagcccaaagcatcgccagattcggcaaatacaggatgccgataaatgacaccccggttaacaggctgacgccagcagcagctaatttctgatcgttaagacgacgcagcgtggctgccagaatcaggccgggaatggcggtggtaagctgaaggatgccatgtacctcaccagcctgagctgaggagagtccactgtccgtaagaatggctggcagccagccgacagcaacataaaacggcatcgcattcaggcccataaacaaggtgacctgccatgccagaggcgagcgccacaccgcgacggtcgccgcttttttctcacccgctactggcagctgatgcttcttctttaactggggcaaccataaaagcaacgcaagcagcggtgctataaccagcatggctaacgcgatgttccagccccagctctgcgtcagaggaatgacaatggcagagccaatggcgccagcggcgcccatggtgatggaatatgcccctgttacggaagccacgttgccagaaaagtcacgctttataaggccaggcagcaggacattgcccagagcaatcccgatacctatcaatatggttccgccataaagcgcccagacactgcctgtggagcgaagcaggataccccccgaaatcacggccagggcaccaaaaagggtgcgctccagaccgtacttccgggaaattgatgcactcaggggagaaaatgcggcaaatgccagtaaaggcagtgagttaagcaacccaacggcagtgatacttagcccaaaatcatggcgaacggactctaaaacgggtgcgatagcggtaaatggaactcgcaggttaatggcaataaaaaggatgccggtcacaagtatgattgaagaccacctgttcgtagtgtgggacataaattttgcgttctctggtaaaaagaaagactttaaaggacgcatgagttacacaatatagataacctgacaacatataactaaatcatgccagttaataaaaaaccggtgacctcaccggatgagtttaatgccgatgctttcagtcaggctgctatcgcgctgcatgtatcatcgtcaggcgagtatgcaggtcagagtccgcacgctcaccgtaagggacaacttattctctctttgcgcggtgcagtgagctgtaaggttcaggatgcgctgtggcttgttccaccgggacatgctgtctgggttccgggaaaaatcccccacagttgtcgggtcacgaagaatgcagacacctgctttttatttattgagcccggcgcggcagcgatgccggaaacctgctgtacccttgctattactcctctggtccgcgagctggttctttttctggcagagcaggaacatgcttattcgcctgacagtaaaaccgcgaggctggcagcggtgctgctggaacatataccggatgtgccggttaaagcgctccacctgcctgtatccgaccatcctaaaatccggaatatggctgaggcactttttaatgatcctgatgaccgaagaacgctaaagcagtgggctgcgcatctggctaccagcgaacgatctctggccaggctgataaaagatgcgacaggaatgagctttggtcgctggcgtcagcaactgcatttaatggttgcgctgagccatctggcagaaggccaatccgtgcagcacgtagccggaacgctgggatatgattcggtcagcgcgtttattacaatgttcaggaaagcgctgggtaaatcgccgacacaatatttttcgtccctaaactaatgcaacccaacacaaaccggatttttacaaagaacgccagcgtccgcttttcgctcatagcggaccttcaggagcgcaggtctgctgcgtgccagtagcggacatctcacatatccacattcgcatatgatccgctgcggcctacttcaaggaaattaagctaagtaacattcatatggatgacactttagatactcaaaatgatttattcggaatattggatacattttgaatggagccttaagtgcgtctttttcatttcagcgatagtcctgatatcagcacattcaaacctcgcccaataaaggttcatgtcgacaggcctgctggacaagagtggttaaatgggtcactgatatgggctactgatgaagctcacgaattactttatcttttccctcgggagtgcccgcgcatcgtattttggccactacctgatacaaacagagtggaccttgaacaatggatgggaaacaactcacatgctactgccattgcctgcatcgagcatgcatggctatcacgctttcaaaatggaaaagtttatagatatgaattgcctgtagatcactttgagccaacgggagaggtcggtatgtgggtatcccggacaaacgttatcccaactggcttgaaggtaatttcaaacctggatgctgaacttgtatcaaggaatatcacgcttcgtgtaatggagagactcacgccactcaaaagtatatggctgacatcgcttcacgctagcggcattagattgagaaacgcacagaactggggaaaaccagggtggacgcattcgaaaccgggccgccaggttatcgtataaatctataattgataagttaggcctttgagcaaacgtcagtgatgtccgcctctcgctcatagcggacatcgatattttcttgcgtccgctatgtgccagaagcggaagttgaccatgcggcttgaacgcaaaccataaatgacaagactcttgtgcctgtatcaaggagctgtatatttaaacaccactttaatttttaaggacatttcaaatgaatggcatttttgaagggttcaatttagaggtctgcgaaaatcctaacgctaagcaattgattccgattgaagaaggtcttaacgatttcaatgatttaatgacgggaatgagtgatcgtctgccattatctgtattaataaaatcaaagacaaacggtgaggtactcggagggatgcaggggcgtttcttcgttgggtctactttttatagatctgttctatcttccaccggaattgcggagtaaagggattggtacagaaatccttttacacttcgaggaggaaggaagaagaaggggctgtaccgcagcatttttatacacaattagctttcaggcccctgacttctacaaaaagcatggttgggaagaattcggacgtattgactgcaaacccgaaggaacaagccgtatctttatgaaaaagtctttataaaaagtgtgctattcgcacatagcggacatcagccggccgttagtccgctttgtgccagaagcggacattcaagaagcaatgtcatcgttgcgtaatgaaacagatgacgaatagtgttttttttaattaaggtaaatgctgatttccaaacccaaataaagggagtaagcatgggcaggtttcagggtaaacgtatattgatcactggtggtacgagtggaatggggctggcaggcgctcagcgtattgtcacggaaggtggtcatgtagctattacggggctaaatgaagaaaggctggaacgtgcgcgcagcatgcttcctgcgacatcgcttgttatgaaaagcgatgctgcaggcgaaactgacataaatgcgctgcaggaagagattagtggctggggtacccttgatggattatggcttaatgctggcttcgcagaggtaagctctcccgaatctgtaacggcagattcttttaatcgaatgatgaacgctaatgtgcgcggcccgatgctacagctggcagccctctccaaatcacttaattcaggcgcatccgttctggttacttcatcctcatctgtatatgaaggtgcggcgatgacaagcctttatgcagcaacgaaaggcgccgttatcgctatggtcaaaagctgggcatcagcgctggctgaacgcggtatccgcgccaacactttggtgccaggtccgattgaaaccaacttcaggcactttatgccagaggagtcgcgtcagcagtttgaagattttgtggtaagccaggttcctttgggtcgcgcaggaaacagcagaagaggccgcggcagttgcactatttctcctgtccgatgatgcatcctatgttaccggcagccagtatgcggtagatggcggtctggtacattactgaccgttgaccaaggatgcatgaaaatactgtaattgagccagtaacgtccgctttgtgccagaagcggacgtttccaacataagcatgcactaaccgatggagaacagatcttacggcatagccatgcaggctcgccggaatcattaagggcattttcaggttttgagccggggtaaaagtaccagtaacgcccctctggtctcataaacgttctgaaggcccctgcgggggtgcggccagggatgttatgtttaaaacgatgaaaatatttttaccggcgggttaagactagccttacgcccaatgcaatgaatgtagcacctacaattctatccagtaaattttgtagctttcgattacctgcaacagctcctgccgtgctgccagctaatatggcaaatgtcatatcggtcaaaaaagctataaacgcatatgttagtcccagtagcagaaaggatgccgcatgttgttcgccttccggtgtaacaaactgagggaaaaatgaaataaagaaaaggagcactttgggattagttaatgtagtgataaaccccctggacagtagcctgtaggcacttaccttcctggtgttttggggggcagcatctccgcggtcctttttgcttatgaatgttcctaacaacatttttccaccaagaaacatcagatagctcgctccaatgtatttaatcgcggtgaacataacaggagaggcggtgataagggcagtcagccctaaagtgcttgcaatcgcatgtgtgcaacttcctaacgccactccagatgctgagacaataccagcgcgacggccgttagcaacgctttgcccaatcacataagccatatcaggtccgggagttacagaaagcaaaaaaactgaaaaggcaaagagtccaaaattggtaatatccagcatggcgacctcagatgtccttgaaatttaatttaaatccaaccgtataacacttcatttttcagctcaagaaatttgtcagcctctcctcactggcataattaatattctattttctgcatctacgaaccaactctcagttgaaatgctgcgtaacactgaacgtccgcttttcgctcatagcggaccctggcctgccgtcagtccactttgtgccagaagcggacattagtgatcattggtcggccacttgctgagcagcaacataacatgccatatatgtctgttagtatccgcacattactaatgtttctgggtaagactgacatgtctcaaataaccatccatattctgaatgctcaggaaaaactcactgttcacagtgaatggctgcgaaactaaactgaccgatacctacgtacaagtcacaaggttgatgccgactccttcagtagatgtcgtagttaaggccgggaagtttgttatccctgaaaaagggcatgctggtttttgtcctgaagctggtgttatctatataaccgtcgatcctgaaaaccctgcattctgcaaaaacgttgcgcactctattgagcgtatgtttgctcatgaacttcaccatgctgcaaggtgggcaggaccgggatacggctcaacgctgggagaagcactagtctctgaaggactagcagggcatttttctcttgagcttttgggtggtgaatttgagccttgggaaagcctcaagtccgatattgttaagccctactatccactcatgcttgaaaactggcatcgcgctgattacgaccataatgcctggtttttcggaacaggagatttaccaaggtggctgggttatacggcaggtttcaacttgatatccaagtatctcgcatcatctccaaacttgaaagcatcaatgctggcgaacataaatgttgaggagttaaaggcttttatatgaaatacatattttttatttctcttaagcttttattcaacttataagcgaaagtcgcatggtccgcttttcgctcatagcgtacatatctgaattccttaattgtgagtgttaacatctgaaaagcgcaggattgaccaagttgtacgctataagacacgattgaaacgacgcttctggtgtgtcggcagatttaatccaagaatcgggctgaattgttaatggctgcaatgatactaaatcctacctcagctgtagcgttttgttagctaaaaggagtaaacatggaagtaagggtagaactgtgtccgccagatgaatgggaatccatggtgaaaatttttaccgaaatggaagaacactattatggtaagggcatcattcaggaaccactgttgaagaattacctccgcaatcgactgttcagtcagctctccggtactctggtgctcagggctcgctacgacgctcatatcgttgggctggcgtgttgcagtattctctacccttctccccggtacagtggccagctgcatatcaaagagctttatgtctcccagagtgagagaggtaaaggcataggggaatccataatgcgttttatggcgaaactcgctcttgaacatgagtgtcgtagcctcagctggaatgccgagaaatcaaacgccggagcaaaccgtttttatcagtctttagggggcacaataaatgacggtattgtgaattattatcttcatggtgaactcctgcgtaaactagcttccgacagtttcggcagagcctagcggctgtactggttaagctatcgcactgatttggcttgccagggaggcagaggaaatctgcagaatgttgaagccgtgtccgctttgtgccagaagcggacgttcgcaggaatgcctttctgattacttacctgacgatgatatgcacagtgaaactttgatctctttcttctttcgtttatagtttagcgcctgttctgacaagatcaggcttcccggtcagctttcatccccctgatgaactggcttaattcagtcctgaaggcatcgtttgccgtaaaggagaactctaaaaatcatgcgtcttacgccaccctgagtcgtaacccttctctgtcgcactgagttgtctcagtcgcgcactcaatagcatcccgtctgcggatgtgcttttcgcacctgaaatttttgccctcacgggctgactgtatcaaaatctgagaaattactatgctgctgtcctcgacgcgtaaggactggctgggtaacgtccgtggtgacgtgctcgccggtattgtcgtcgcgctcgcgctcattcctgaagcgatcgcgttttccatcattgccggagttgacccgcaggtcggcctctattcggcgttctgtatacccgttgttatggccatctttggcggacgtcccgccatgatttcatcggccaccggcgccatggcgctgctgatgataaccctggtgaaagaccacggcctgcagtatctgctggcggcatcagtgttaaccggcctgctgcagctggctgccggctacctgaagcttggcagcctgatgcgctacgtgtcgcgctctgttgtgacaggcttcgtcaacgcgctggctattctgatattcatggcgcagctgccggagctgacaaacgtgacctggcacgtttatgcgctcaccgccgctggcctggcaatcatctacctctttccgtacctcaataaaaccattccctccccgctgatctgcatcgtggtgctgaccgccatttccatgtggttgcacctggacgttcgcaccgtgggcgacatgggcaaactgcctgacagcctgccggtattcctcattccggacattccgctgaacctggatacgctgctgattatcctgccttattctgccggccttgccgtggtgggactgctggaatccatgatgactgccactatcgtggacgacatgaccgataccccgagcgataaaaaccgcgagtgcaaggcgcagggcatcgccaacgtctgcacggcgtttatcggcggcatggcgggctgcgccatgatcggtcagtcggtgattaacgtgaagtcaggcgggcgcgggcgcctctctaccctgacggccggactggtgctgctctgcctgattatcttccttcgcgatcaggtgtcgcagatcccgatggcggcgctggtcgcggtcatgatcatggtttccatcggcaccttctcctggcgatccatcaccgacctgcgccgccatccgctgtcaaccagcgtggtcatgctggcaaccgtggtcgtggtggtggcaaccgacaatctggccttcggcgtgctgaccggggtgctgattgcctcgctgaattttgccaccaaggtagctcgctttatgacggtcaaatcgtcactggagggcgatacccggacctataccgtgaccggccaggtcttttttgcctccgccgatcgctttatgagccactttgacttcagggaagcggcagagtgcgtggtcattgacgtcacacacgctcacttctgggacattacctccgtgagcgcgcttgataaggcggtgattaagttccgccgggaaggcgctgagttggaaatactgggcatgaacgacgccacccgtaccctcgttgaccgcttcggcgtgcatgacaagccggaagaagcggaaaaactgatgggcggtcactaaccgacaggagattcagctatgaacaataccgttgtggcctgcgtggacggttcgccgtcaaccgggccggtctgtgactacgcggcgtgggccgccgccggcctcccggcgccactgtccctgctgcacgtgctggaaaaagatggtcatccggccgtctctgacctgagcggcagcattggcatcgacagcaaagagctgctgaccgaagagcttgtgcgcgtggagggtgagcgcagccgcctgctcatggcagagggtaaagccattctgagcggttgcgcggagcggctgtcccgtgcgggggttccggaagtgcgtcagctgcagatgcacggcgcgctggatgaaatacttgccggactggatgacgtcaggctgatggttctcggacgacggggcgcggaacatacggtgggcagccagctggaaagcgtcatccgcctgcagaaagcgcccgtgctggttgtgccggaaacctttattgcgccatcccaggtactttttgcctgggacggcagcgaggccagccgccgaaacctgacccggctgaccgtgagcccgctgcttcgcggcctggcttgccatgttgtgatggtgaacggcgacgatgcttcactgcatgacgcgcagcaaatcctgcaggcagccggcattgatgcagagtcccggctgattcaggatgaatccgtctcgcgcgggctgtgccgttacgcggaggagaacggaacggaccagatcgtgatgggaacctggggacactcccggctgcgccggttctttaccggcagtcacgccacggcgatgctggcagaaagccgtcatccgctgctgatgctgcgataaactttacgggcctgcaatcgcgggccctttccataacgcgcctgcggaacatcagtcccggagcagttcatttgtgcggcacctttgtcagccgcgctcagggaataccctgcgtcagctgtttcactttatgtatcagcacggcagccatctggcttttggcgcgatactgatggcaatgtcgagtttcggacagacttatttcgtatcgctttacgggcaggacctgcgtcaggccttcgggctcaccgacggcgggctgggcggcatttatgccgccggcaccgtgatgagtgccgtcacgctgacctgggcaggcaggatgattgattacaccaccacccgtcgcttcaccctggccgataccctgctgctgatagcggcgtgcctgctggtttccggtgcgcaggcggcatgaatgctttgtgcaggcttttacctgcttcgcctcggcgggcaggggctgctggtgcataccgccctgacggcgactgcgcgccagtgtccgcttgatgccggcaaggcgctgggtaccatcgcgctgagcctggcgctggcgctggtgctgtttccgttggctgctgtgcagattaattatccgacgggatggcgcattgcctggctgataaacgctgcagtttctggttgccggcgttgcgctggttgtcatctgccttccgtgcgctgccgaaaaaccgctgcggacgttcagaaagcgggacgcagagaaggttcgcgaagcatcagtatggaagaaccggaatctgcttcttgctctgcccgcagagctggcgtcacctttcatcactacgggcttctttttccatcaggcgcgcctggcagaggagaaaggatgggcgctgtcgtgggttgcagggtggtttattgcctatgcgataacgcaggcggtttccctgctgtcatttgttccgctgatagaccggctgacgccacgccggctgctaccgtggtttctgctgccgcagggagccggcatgctggcgctgtggcttagcagcagtcaatgggtcacgccgttttatctcatcgtgaccggcgtatcgtcagccattgcgtccatgctggcgaccgcgctgtgggtgcagctgtttggctccgcgcagctggcaaaagtgcgatcggccgttgaggcaggtactgtgcttgccagcggcgcttccccggtcatcatgggtgtgctgattgatcaacacgtcactctcagaatacaggcactgatttgcctggtcttcattctcgctgccagcctggtcgcaacccgggttcaggtagccagccccgaggacataaacagttaaatacaggacttatctgacaggcccaaagtgcagtaagtaaattcaactctgtaccaaagcggacaacgtccgcttttcgctcatagcgggtattatccgatgtcagaccactctatgccaggagcggacgttgttgagttcacacagcatgaattcatgaaaacaggaacgtcatattttgtcttgattaacgcgggatgaaagctcctcatggctctcttttcgttcactgtagcgatcggcaaggtaaccggtctgtcccttgagtataagggtgattttaaacaactcttcggcgacatcgacgatacgatcataccaggacgagggtttcattctcccgtttctcatcaaattcctgccatgctttggccactgaagactggttggggatcgtaaacatccgcatccagcgtcccagaattcgcatctggttcacggcattgaaagattgcaaaccgccgcatacctgcatgaccgccagagtttttccctgggatgggcgaacggacccttcgcttaagggaatccagtcgatttgtgccttcatcacggcactcattgccccatgccgctccggggaactccacaccatcccgtcacaccacctgaccaacccgcgcaactcggtgacttttgggtgcgtatccggggcgtcgtccggcaggggtaaacctgaagggttaaacagtctgacctccgctcccatcgcctccagcaggcgacctgcttcctctgctgtaaaacgactgtaagaacgctctcttaccgagccatacagaatcagaatgcgtggcggctcatggagctgcagacgttcagcaatatgctgatcgaagcaatcagcgttcagggcaggaaagtgctccattttttctccttcgggtggctctggtgatttcaaaataaacacatatgatttaacatatgtgtgttctaaagggaatggagtaataaatgctacagcctgttcagctttttaagatcctgtcggatgaaacccggctcgcaattgtcatgcttctccgggaatcgggcgaactgtgcgtattcgatatatgtgcggctaccactgaatcacagcctaaaatttcccgtcacatggctatcctgcgtgaggctgaactggtactggaccgtcgggaagggaaatggattcactaccgtctctcaccccacatgcccgcatgggccggcgagacgataacgacggcatggcactgcctgcgcgatgatgtgcgtgaacgactggaaaaatccgcatgtacttcctgctgacaagcttaatcacatacacataagcatatataaaggagtctgagcatgtttctggcaggaagtatctttatactcacgcttgtcctggtcatctggcagcccagaggcctcagcattggctggagcgcaagtatcggagccgtgctggcgctgggaaacgggagtcatccactttgaagatatccctgtcgtctggaatatcgtctggaatgcaacagcggcgttcattgcggtaatcgtcatcagcctgctgctcgatgagtctggtttctttgaatgggccgcactgcatgtttcccgctggggtaacgggcgcggtcgcctgttgtttacgtggatagtactgcttggcgctgctgttgctgcgctgtttgctaacgacggtgcagcactgatactgacaccgattgtgattgcgatgctgctcgctctggggttcagccagggaacgacactggcatttgtcatggctgcaggattcatcgctgataccgccagcctgccgctgattgtctctaacctggtaaatattgtctcggcggatttctttagcctgggctttacgcagtacgcctccgtgatggttcctgtgaatctggcagccattgctgccacgctggtcatgctgcatctcttcttccgccgcgatatccctgtcagatatgacgtctcactgctgaagattcctggcagtgcgattaaggatcctgcgacgttcagggctggctggattgttctgctgttcctcctggtcggtttctttgttcttgagccgctggggatccctgtcagcgctatagcagcagttggcgcagcggtgctgttcgtggtggcaaagaggggccaggccattaataccgggaaagtgcttcgtggtgcgccctggcagatcgtgattttctcgctgggtatgtatctggtcgtctatggcctgcgtaatgccggactcactgagtatctttctgccgtactcaatatgctggcagacaacggtttatgggctgccacgttcggcaccggcttcctgactgccttcatgtcgtcggtgatgaacaatatgccgacggtgctgattggtgcgctgtccattgacgggagtactgcgactggcgtcgtcagagaagcaatgatttacgccaatgtgattggctgcgatttaggtcccaaaattaccccaatcgggagtctggcaaccctgctgtggctgcatgtactggcacagaaaaacatgagcattacctggggatattacttccggacaggcataattatgaccctgcccgtgctgtttcgttactctggccgcgctggtatggcggctctctgtcactttgtaatgagatactgatatgagcaatattaccatctatcataacccggcctgtggcacctcacgtaacacgctggagatgatccgtaacagcggcaacgaaccaacaattatttattatctcgatacgccaccgacacgagaagagcttaccaggctgatttcagaaatggggatttctgtacgtgcattgctgcgtaagaatgttgagccttatgagcgattgggtctggatgaagataaattttctgatgcgcagttgatcgattttatgcttcagcacccgatcctgattaacaggccggtagtagtgtcaccgttagggacacgactttgccgtccctcagaaattgtgctggatattctccctgaaggtcagaaaggttctttcaccaaagaggatggagaaaaggtgactgatgaggcagggagacggtttaagtaacctggcgagttcacattagcggacaccgggcgtccgcttctcgctcttagcagacatctgactgttacaagtccccttgtatgtcataaacggacattactagtttctggtttatgaaatattggaaatagcctatggcaatccctctcgcaatgaacagcgtaaatcagctttgacagaagctgagccggttgccaaacggatcgtaaacttccaggacattcgcccagtcctggcttactatttccgggcgaccataaccatattgttttcaatgtagctcgtttctgaacaactcaatattcttcatagggataaatattgttgctccagggggggcgtcaccgtgatgttgagataagtgcaactgcaaaccatctcgatctatgccaggatacaaaggtaaattgggttcgaaccggtgttcaaattcaacgctgaatggcacaaactcgagataaaactcccgcgctttcagctcaccgaacattagtaatgtacaattcatctgcagctcgctggcttgaattctctttttctacctgatcaccagtatcggatcgttgaaattaatatccgagccctttctgctcctgccgtttgccagtttatagagctggtattggatgagaggctgaatcaggattttttcatcggcgctgcggaggcctgtgtggcagtctggctggaggttagccctgtacacgctaaagttgttcgcaaacggtgatattccagggacgtcctgctcatcatgaacagggcgacataaatcgatccctgcccccacttatgcttcagtatttatttcttttttccgatacctgactatttaaaatcgacctgcataagttcggcaattgttgagtcacgcgtcgtcagcacgcagcgatccagataatcggtgaacctggaaggcttattcataccaagctgtagcagtttagaattatcaaacaccacattcagacttgagaaatggccgtacaggttcattgcacgcagcatgatccgttcgttgcacgggccaaacagatccttaaatgttcttctgctgtcagaaagctgtttataggaaaccttttgataatcaacacccagagccgttctccctgatgctttggccatcgcctcatcaatttctgcgaacgttacactgctctgtgttccggcagaaatgtgaatcacttcattgatgactttttctgcgtcgagcagcataaccagcgcttccgcgcagtaatcaaccggaaccacgtcaatacgatcgtccaggtcgcaggtaaatttgcctaatgccagcgccatccggaatacccagaaaatactggctgatggcagacacccctgatcggagtgacctactactatcgacggccgggctatgaccagtggcagacccggcagcttttcgatcatcagtttttcaatcgaggccttgctccaggtgtattcgacaatatgctgatcccggctggagtccagtccgccctctgtgaccagtgaaacccggttcaggtgcacatgacattgcggtacccacgtggataaatttctgtaacccttcaacgcggctcatccgttctgcgaactggaatgtgccctcaacgttcactttccagatagtgggattgttaccaaaagaggcgacagcagcacagttaataacgtgggtaacgtcgctaagccgtgagtcattaataaatttctcagttaacgcgaggtcacccagaataatattctcaggggctatcgtgttgattgctgactcatttaagccaaagtttttcaggtttgctttaagcctgtttaacccttcctcaacggtttcgcctctgaccagcagcagcagtcgatccttaaccctgttctgcaataaatttgctacgacagccccgcctaaaaaacctgttgaaccggtaataaggatatttttcatgatagtgccattgaatctggttgattaaaggaaagcattaacagaacgccttccgaacacaaaaaaaccaaaaaataaatgaattattttgatttcattatttatggtgagttaaagataaattaaggattgacgttaaatcccatactgacgatttaattacttatcatgttataaaccataccagtataaagataaaaactatcgccaggctcaacaacaatgtagatatttcattaaacttgttcatttagattttgtttatattccatgtgcaggtagtgattcttaaatatacgtatccccttgctgaattcacgatctgatttgaacaatttttgccatttagaatcaagctttatttaaattttttttcgtgaacttattattactttggtgaatgaagtgtttcctgggcttatttatggagagtcagttcagactgtgtgtagatcatgtgtagaagctaaacaaagaaggtttatagtagaaatccctacttttgtttaccccttgtttagtattcatcaattacacccttgcctgtcattaaatatttccgcacaaatcatccagggactcttgtgcttcacttcaggtaataggcatgtttacaacacacttaaaacttaaaaataccggctgggaagaatgcacgctttctgcgtatgcccaaatttacactacatttggggggagcgtgtgcacccatccccgcgtttctcgcttacctttctgaacgtgaaggcgtccgtattcagtactatatgaaaaggcgacacgggcaacccattgctggcgtgttttctgtcaatggctctctggcatataaaaattcaacgcttccctttgtttttgatgatcttatcctcccgattaaagcgggtgaaaaagtcattcttccctttaaaaccaagcggttatcgccccattctcagggcataatctttaacagcatctctcacaacctgtttaagaagaaaatggctcatatcaagtctgatttttccgtgaaaaccgctaagaagcgtaccggagaggtccgacgattcagaaaagcggggggaacagtcgaagatgttacgtctttttctcctgctgaactttcggctatctatcagcacctgttcgatttgcggtggcaaaacagccttaagtgcactgaccccgggatcctgactgagacgttcaccacgttcagagacatgatttttggcaaagttttattcattaatgactcaccctgtgcttttgatctcaattataaagttgagtgcccatcatggtattacttcgaggactttaatggcgggattgatccccagttcaaatcgatgggggttggctctgttttactctgggagaacatccagcacgccagagcgttagccacgtcatcagataaaaaatttattttttccctaggcgcctacaacccaggctggcattacaaaaaacagtggtgcgatattatgccctcaggtcgtactctgttctgagctgaatatattaagggttttgcattgccacccgaacttctggccggcaatacaattacctttaatcagtaaaaaaattcgcttctacacacaatctcaacacaccctcaacggcgaataaacacgtgttcgataacatggggcatcactctttgatacgagaaacccacattgtccctcaaactgttttcgctgcctttatttctggttgccttgattgccgcgctgactggctgcgatgataaaaccattacggcagctgatgcccctgctcctcaggttgccattgaggtgatccagccacagtttttatcagttaacgagacgcttccgggtcgcgttaatgctctgcacacagcagaaataaggccgcaggtgagcggtattattcagcgccgtttgtttgaacagggcgcagaaattaaaaaaggaacgccacttttccagatcaatgcggctccctttgaagcggaagtggcaagtgcgcaggccggtttactgcgtgcccgggccgccaatgataaagctcagcagcaggctgctcgcctgcggcccctgatgaaaacgggcgcagtgagccgtcaaagtttcgatgaggccatagcgaatgcccgccaggcggcggcagatgtcgcgcaggccagcgctacgctcaggcgcaaagagcttgacctgagttttgccacagttgaggcacccatatccggacgcattgatcaggctctggtttccgaaggggcttatgtgacagccagcgatagcaccccgctggctcgcatttaccagacagaccccatttatgtggacgtccaccagcaagcggaggtttaccaccagttgcgccagcaagcatcaagtcatcaggatgccgacgcaggcttgccggtaaaggttttgttacccggtggcgctgtttatcaacagacgggcaggattcttttttccggcatcagcgttgataccgctacgggcgacgttatggtgcgcatccaggtgagtaatccggatcgcgaactcctgcccggcatgtttgtgagggttgagatcccccgtcagcattatgaagacgcgctactggttccccagcaggctgtctcgcatcgggaaggtaacgctgtgctctgggtggttgacgagcagcaacaggcccgccagatcaacgtccatgttggggagttaacccacggtgcataccgcattgccgaaggcttacctgccggcagccgtgttgtcgtccagggcatggataagctgagcaatggaatgaaagtcgcggcagtgatttcaactgccttccctgcaaatctgaccatgaaggccggagagtaatatggctcagtttttcatcaagcgcccggttttcgcctgggtcgtcgccttgtttatcattctgttcgggagcattgcgatccccaaactgccggtggcccgttatccctctgtagcaccgccgaatgtcaccattaccgcgacctgggcaggcgcttcgccgcagacgatgaacgacacggtcgtcagcctgattgagcgcgaactctccagcgttaaaaatctgctctattttgagtcatccacagatacctcgggacaggcaaccatcacggtcacatttaaaccgggcacaaatgccgaactggctcaggttgatgtacagaaccgcattaagacggtggagtcccgcctgcctcagacggtgcggcagaacggacttcaggttgaatctgcagacactggcttcctgatgattatcagtctgacctctaaagccggtaaaacagacagtgaagcgttaagtgactacatggccagaaacgtggttgaagagctgcgcaggctgccgggcgtaggacgtgttcagctgttcggcgcggaaagtgccctgcgtgtatgggtcgatccggccagcctgctttcactcaatctgacaatgaatgacatttctgccgcaatcacccagcagaatgcacaaatcgccccgggacgggtcggtgacgaacccgcgctgcccgggcagatggtcaccatccccttaacggtggagggtcagttaaccacgccggaacagttcggccgcattgtgctgcgcgctaatcaggatgggtccagcgtcaaactctctgatgtggcaaaagtcgaggccggctcccagagttacagcatgatgatgcgtgaaaatggtcagaactcaaccggtgcggcgattatgctggcgcccggtgccaatgcggtaaagactgcagaggcggtgtcgacccgaatgcaggaactgagtctgtcgatgccggaggacatccggtacgcactccctttcaataccgcacccttcgtaaagctctcaatcgggaaggtgatccacacgcttctcgaagctatggtgctggtgttcatggtgatgtatctgttcttacagaacatccgctataccttcatacctgccatcgtcgcgccgattgccttattgggcacgctatccgtaatgctgctcgctggcttctccgtcaatgttctcacgatgtttggaatggtgctcgccatcggcatcatcgttgatgatgcgattgtcgtcgttgaaaacgttgagcgcatcatgcgtgaggaaaacctcggcccccgcgaggcaacgtcaaaagctatgcacgagataaccggagccattaccggcattacgctggtgctaacggcggtcttcatccccatgggattcgccagtggttcagtcggcatcatctaccggcagtttgccctctcaatggcgaccgcgattctgttttccgctttgctggcgctgacactgacgcccgcactctgcgcgacgctgcttaaaacgccttccgatcacgcccggcgcggatttttcggcatgttcaaccgcagctttaatcgactgacaaaccgttatttacgctggaccgctattatcctgaaacgctctggccgaatgatgctgttatttgtcgcgctgtgcgcaggaaccggtctggcattcagtcagctctcttctgcttttctgccagaagaagatcagggctacttcatgacggcttttcagctaccggcggaggcaacgcagcagcgcaccatggcggtggttaaaaaatatgaagaggcagtgagttcgcgttctgccatcgcaaccaatcaatccatcattggctttggtttctccggtgccggggcgaacaccgcactggctttcaccgtcctgaaagagggcaaagaacgcggcgataacacgacacgaggtgaagttgaatttgtcgggcacgcgatgcgcgactcgccggaaggcaccatcatgacgatgatgcccccggcgattgaggagctgggtacctcttcaggctttacactgagactcgaagatcgtgcgaatcagggctacccagcgctggaagccgcccagagtaaacttctgcaacttgccgctaaaagccataaagtcacgcaggtttacccggacggtctgccgccgggaagtactgtccgactggatattgatcgtgaaaaagccaataccatgggcgtctcgttcgccagcatcagtgacaccctctctgccgcgatgggttcactctatgtcaacgactaccccaacaacggccgtatgcagcaggtgattatccaggcggatgcaaaagatcgtatgcaaattgatgacatcctcaatttatatgtccgaagcagtgaaaaccggatggtcgcgctgaagaccttcgttacaccggtgtggtcatcagcacctctccagcaggtccgctatcagggatatcccgcgatgaggctctccggcagtgctgcgccgggtgtgtcaagtggtgatgctatgaaggagatggaaatgctggccagacagctgccgccggggttcgcggttgaatggaccggtcaatcgttgcaggagcagcaatctgccgcgcaggctccgatgctgatggcactttcaatactggtaattttcctggtgttagccgcgctctatgaaagctgggccatcccgatttctgtattaatggtgatcccgctgggtatcgccggtgctgtaacagccgtgctgctgcgcggattggctgatgatgttttctttaaagtcggattgattaccgttattggcctgtcagccaagaacgccgttctgatcgttgagtttgccagacagttacatcaggagggaaagagcctgcgggaagcggcaataacggctgccagaatgcgtctgcgcccgatcatcatgacctcactggctttcggactgggcgtcgttcctttgattattgcttccgggccagccagtgaaacccagcatgccatcggcaccggcgtttttggcggaatcatcagcgctacgattctggccgttatttttgttccgctattttttgtcactgtcatgactctgcgaaataagctgagagcgaatgaaaggtaatactggaaacatgcagccagcgggtatctcgtctgatttattgtttcacaggcctgatatcatgatggcaacggctataaatcaatagcgtttataacgcgcccggcggcggtctttcagaataagatctgagccgccgcctccgggccgactcagatcgattacaggataagaatgaatagcagcatgattttaatcgtcgaagatgatgtagaaatagccgcaatattaaccgcctatctgcaaaatgtcggtttcatggtaagccatgcggaaaacggtgcgttagcattagcgttttgtgcaacatcctcacctgatctgatcatactggatgtccgtatgccggtgatggatggctggcaggttctggccgaagtgcgtcgacggggaaataccccggtcattatgctcacggctaacgacgacgatgtggataaactttccgcgctccgtattggagccgatgactatgtcgttaagccgtttaatcctgctgaggtggtggcacgggtacaggcggtattaagacgcacccaggttgtgacgcgttcagacgatagtttctctacccgatcgctttctatcaacctgcagcagcacagcgttgttgttaaacctgacgggacggatattgccccacgcctgaccacaaccgagttcaggctaatcacccagtttcgtgcgcgaacccaacagggttttcagccgggatgaactgctggaagcgtgcttcccggaaggtgacacgttaccgcgaaccgttgacagccatatcagtaaattgcgcaagaaactcgatgacgcgggtgcgtcaggattgctgcagaatgtgagaggcttcggttatcgcctgggagagagtaaatgaagcaacgtggtcttagcgggcagctgaactggcttatagtcaaagttacgatctactcttttttgacctcctttgccacctattcactttacccaaccgttatcggattattttcaggtcaactgttgccactcgacttagacatggggacgaccggcgactggattaccatgctggtgtcgacgctgttaacgatagccgtctcggtgtttttttctgcccgctttgcgcgccagatgatcgttccgctggagtcgctgactcacagtgcaaaacgcgtggctgaaggggatttaagcgcgcgagccagcgaaggtgctatagaaattggcgagattaatgcgctggtcaaagacttcaaccgcatggcggaaacactggaaaccctgtcaaatgatagccggacctggaacgccgctatcgctcatgaattaagaaccccggtgacgatattgcgtgggagacttcagggcttagcggacggcatatttgcgcccgatcataagctcttcgttaatctgattcatcagactgatggtcttacgcggttaattgaggatctcagaaccctgagtctggcgcagtcgggacatctgcatattcactatgagcgcgtaaatattaaaagtgagattgaatcgttagctgaactggttaaggaggatttcaaagccagtcaccactcactcgtgctgaaagttaatccggctatcattgaatgcgatgccttacgcttcaggcaggtgttgctggcctttctggagaatgcccgccgttattccatcccgggcgttgtcatgatttcctgtgagcaggatgcagcaggcgtcgcagtgcacatagacgatgaagggccgggaatcgatcaggcttttgccagaacgatatgggatgcgtttgtgcgcaccgatgactctcgttcacgcctgagtggcgggacaggcttaggtctggcggttgtcaaagcgattgtactggcgcatggtggaaaggtgtcctgcgaaaaaaacgatcttaacggcacccgattctctttctggcttccttagactaaagtcagtcatcctggcagaaggcgaatgagctctgccgcaaatgttttctgataatgacggctagttgataatgagaaaagttggtctgctatacgttgctggcggaaaacgaattacgtggtgcccgcctcgtgtcaaaagcagaaatttagtggttctaaaagctctcatagcgtggccgaattttatcggccactaaacagattgacgtactgacggcgcaacagccgagtaatcatgacgttattcagcggaaaattaatcggtaaaacgccactgataaaagactcacagtacaaagaagtgtttaatgatgaggctacctacggccaggctgtcagatcaagttcggtttctgtgctctatgaaaacagtcgccacagttcagaaatttgtcggttgatgaaccttctaaaaaccaccttgccgggtttttttcgtctacagccagaacgaaatgctctcgagatgatcataacccgcatttgtcatacccgattagctaatacattcttaaggataaaaatggaagaacgcataacccttatacctgtaaaaatagctgatgttgctgatttcaaatcagagttacagaaagctttctccgtagcgatagtcgataaatttgaagagcgttcagatgagccaatcccatccgataaaacgctagacatgacaatgaatgctaccaatgccgtatcacttcacattctttgtaatgatcgaaaggttggaggtgctgtgctgaatattgataataaaacccatcacaattcgctcgacctctttttcttgatggctggagaggagggacgaggcataggccttaaagcctggcatttgattgaggaagaatatcccgagacagtatcctggcaaacacatacgccctattttgaaaagcgtaatatccatttttacgtaaacaagtgcgggttcaaaatcgttgaattcttcaataaaaaacatcccgatattaaccatcccgaagatgaagttttgcttgaagaagacaatgatgcattccgttttgaaaaggttatgcgcgagagcgacatatagcgacagatgccagccggtatccctgccaggtggtttatcggcgatatcagttaccatgacctgaatagaggcacattgctccttaaattcgcagacaggagctacatcagcgtcggaaacacgagtgctctgattctgatggcaggactggtctcaggccatgctttgagtttctcttcagaagcattttaagtcggctgatatgcgctctcgccctctcaggactcacaggtacataaattttttcaagttgcgcgcgcggtgggggtatcgattccccttcgcgaatacgacgggacatcttttcaagctctttttcgcatgccttacgtaactcaccctcagacagattatgtgatgtcatctggctgtagagggttgtgaccaaccagtaatgggtattggcctgccatgggtacgtttctggtgagttatacagaccacgtcgcgcgctgtagcgaatgaccatgtcatacagtgcatgttcatccggcaaatcagcagcggcatagtcgcccttccggcaccagctaatgaactgcccgggggttggccagaacggtgaaacgctggcacgcgcaagcttcatccctgctgaaatctgatgccccgaggtaatgccgttttcgataaacgcagcgacccactgacgttttgctgttgcttcatcgcgtggatgctttaacaccgtgctgaaggatgcgggaaagataaccttcagactggcgaagagagtgtccaccaggcgctctgcgtttgagtcaactaaacggccttcctgctgctggtcagccccactcgggccaaagtgaccattttgcagctgctcgttaaatccggattctggcttcgtcataagaaattattctcccactcgctgagatcgttccagtgtggcatccctttaccagcaggcgctttctggccccgcaaggctgcctgtttgttctggtagctgagcttctggctggctgtgataaaccagtgtctgggtttctggtatgagaattcgatgtcgagtttttgcagctcgtagacgaggtccagatgtgtgtagagtttttgccacgatgcgaaatctgcgtggttaagcttcacgactttgccctcaaaggcatagcgtgaaggcatccattccccctcacatgtcgccctggcggcgggtgttatatttatagattctatgttgggttctaatgactgattctgtgtcccgtttttgggatcattcaaaatcccaaatttgggatcgttcaaaagcccgtttttgggatcatttgagggcttaactgatacaggcccgattttgggaacgttcccgtttttgggaccattatcttttgatgaatcctcccctctttgggtgcatttgaaatcaaggttgagcttcagaacacgcacccgttttgtgggccctttccgctcaccggtatcggagagcagcccctcctcaatcatctgattaatccatttcccgatagtctttctgtcgagccctgtatcattgacgagcctcatgatgctgggataacagcagtggtattcgtcagcccggtcagccagtgaaaggagaagtagtttttgggaagccttgagattaagactccaggcccagtctgttgctgcgcgactcatttaatatgtccctccaaaataaaaaattttaagaagtttcattgcattctcgctatgtgtgcagaggttaagatctgactctcgttgcaactcttgtcgcttcccttcccccctcacactgaattaagcgcagtcctgaaaccaccagctcatggacaggattgtctgtgctgatgctcatcgccttcctcattacaggttcgttccagttcatactcagcaaacctgatagcgaccttcatcagccagcgatattgttcctggggtattttcatctcccccttcatcacgaaatcctcaataccgctggcagccagcgtttccatgatttccgggtatttttcagtgcgtctcaagatggttgaatcagcgacgttgagacggcgggcaaccaccgattgacgcgtgttaaaaagggcccttagagccagtgaatggagatgtcgtccctgaactgatgatccttgcttgcgtgtttttgcagtttccacaatgtaacttccttagtcggctgtgacgcagtgaccaaacgtcaccttaaactaacgtttcagcaaagatatccggctttcttccagtaacttatctgagcagaactgcccctgagataacttctcaatagtcattgcatattgagttcccccataaaactctgttttaggaagtgaacccttgttgagccacttgtagaccgctcttggactgattccacacgctttcgcaacttcagcaactcccacagacttaattgcaaggttaatgaatgacatgaaaaccccctcaatagtactttcagttcactttaatttgaactgacagttttatcaagtcagttaacattgtacccatggttcaaacagaaacgatccgtcagcagtttgcagcgcggcttactgaagcgctcaacaacgccaaatacccgccacatggtcggggggtaatgcttgctcagcgtatgggggtaacatcgaaggctgtcagtaaatggctgactggtgagtcacttccccgggctgcgatgatgaaaaacatcgctaaagctctgaacgtagacccactgtggctgcaacatggagatgaggctaatgctggtgaagaaaggttagctcatgccctgtttcgcggtagctttccgttaatgggctgggatgaggttattaatgtcacgcagttttttgagaaaggtttggacagattcagttatttctattccggcgctgtactgggagatgccccggcattctggctagtagttaaagacgactcaatgacgagccccgcgggcccatgtgtccccgagaaacagcatgattcttatagacacaggtcgcattccagaaaatggccaattagtcgttgctaaacttgcttctgcaaaagaagtgacttttaaacagtacattgttgatgagggtatcaacagaaagtatctcaagccattgaatactaattataaacctgtggaaattgatgattcctgcaagtttattggtgtggtgatagagtgccgaatgagctttgtttcccccgatcccgcccaaagcctcagtgtgataccgcacacttaaaattaacaaaaacaatgagatgaatcaaaaccccggaaaagtactaattttctgtacttttggtgttgaccaaaatagtacttatagttcattattgagttattagctgaacggcacagcatactgtcgggcgggaggagtgcagaagcgcgagatcccgaagtggcaaaacccaccttcctctcaacaaatgagttggctttgcccagtgtcatttcctttgttgatggaggttagtatgaaaaagcacagcgtttctgtgcccggtctgtggaatcaactttgatcccagagcacctggagttcatataaaaaagcatcatagcgcagcatcacgccatgagttaatcctgatacgcgacgcccggcgtctctgtttcgggaaaagtaagccctacaaaaataaatcaccctgcttactctgactcatcacgacattgacagcttctctgaaacccttttcgcagtttaaacgaggtgtcagtgcgaagggttttcaattcattcagaattatgaaacggaatacctctataacttcactgtcagcgaatgcctgacagcctgaagtaccgaaagtagtggcatcctgattgtataattatgagtgtgatctgtctgaccaagtgcctgaatgactttcccgcctcgtgcgggattttttttgccccggatatgttacgtccggccgggcatcaaagcctctctggctcaatcaccctttccgtaatgcctgaatggcaaatccacttaaggagtaacgatgttatatcgcgaagctgccgtgcgtatcagccagactgtattgttgctgtcccgtgaactgagtgtttctgctgatcagatgtttgagtaccagcaggaaggcaaagtcacggaagagcaggctgcgacacatatgcataaagtccaggttgttctcgacgtgctcttcaccgaaatcctggatcccatcatgactgagcaccctgacttactgcctggatgttgctgtagcgacgtttcagagacagacaggaacggcccgtcgtgatcgctctcttacctgtccacatgaccgccattatggcggtttttttacgtccggaaccggagaacaccatgcataaagaaaaaccttcatgcgtcctgaatccaaaagaaatgcgccgcctcgcccttgctcatgtacaggcgtatgtaaatgcctgtcactgtcagtcccgtcgtgacgtcctgatggcactggctcactggcacgatgtaggcgtgaacatgagcgatttcatcaaaaatacgcgcctcatcattattgatgaagatggcatccatgaacgctgagatgtcattcggaaaccccgcccgcaaaggcattacctgacctggaggtcattatgcaacatcgtgaaactgcagaaaaagtcactgaaacactgctggaagtggcgaacaagctggtggcatcggtaaggatggttgatgccagtgagaaagacggaaaagtcagtatggacgaagcagacgcataccgtaagggtgtgatgggatcactggatgaattgcttcagtcaactctcacaaccattttcgccacgcaccctgatttacgaccagcatgcagctgcgcttcttctgcctcggaagacaacaaacagccgtaactgcctgcctgaatacgtcagagtaaaccgtccgccagggcggtttttttatatctcaacggagacaaagcatgattattcatatccggaaacggcaggttcatcttcaccgccagttctttaaaccgaagccgccgttttgtctgtttcagtgaaggcatcgcctggacgtatgtgcagaagcttgccgctgcctgtgccgctgaaatgaggtaacggtgatgtccaagccacatacccccgtcaggataatgaggcgtgctgagcgcattatgcgcttatggcgtaccgggcaaatccgggcgaggcgaacctatcggggtcagtatcttacgttaagggttacgccgcagtggagactgttatcgaaagacaatggacagaactgggaattactcagtcatgcggattacgacaatcagatttagtcccgatgtttcagccgtaatgaccggcacggggcaaaacagagaaaatcggtcatggacgctcaagagtcacagcatcgccctgctgtccataaacgctggctcgcaaatgcggagacccgaagcttcgctccgatcagagcgggcggcatccgggagaaaccaggtccgggataacagccagatcaggcgggtcaccaaccctgaagttaaacggttattttcacttaaaggagattaaaagatgaaaattcagtacatcgcgacctcaacagagggcacgctccatatcaaatcctgcgttcttcgggcatttatccatgaacgtgttgtcagggcggctctcatggccgcaccggatgcccgggtgacccacactggtacgtttgttattcatacgcgcatagcaggagacccggcacaaatccttgcagccacccgcgaggcccgtcgtgaagaagaagagtaaacgcagggtctgatgacgtcgtgcccggtcttactgacacctgagtaaacacgtcatccctgcccctcatcatactgccgggcttatcagaaccggaacaggttaactgactattcaaaggaccatttcccatgatgcaaccagacatcaggggcgatgctgcttttgctcgcccctttaatgccatccgcgatatcgagtttgcgcctgaaaacattgtcaatggtgccagcttttcatcgcccacatccccgggattgccaccccagccacctttgcccgtgatgcaggtggtgtttgaccgttttgtcggcatccttcttcaggaggggaagccatgatcacaccgtatgctttgctggaacgtcacaaagaccacctggatgcccaggagcaggacgcagtcaggaaagaacagtggatcgatgacgaagcccagcgcctgctgtcctgttttcctgaccaccttcacctgttccgtcactggaacctgcatcctgatgcgatgaagtgctgtgcccatcctgaagccgctgaggaatacatcagctttatcacgaatctggcctacctgcaggcggcccgaaattacgaccttcaggtgctgcttggctgggaggaaccagcatgatgaaaccgggtgtctatgaaggcctcagcaatgaggcctatcacgccggtcccggcgtcagtaaatcgcagctcgatgacattgcggttaacccggccatttacctctggcgcaaacatgcgcctgtggatacggataaaacagccgcactggatatgggaagcgcgctgcactgcatgctgcttgagcctgaacagtttgataagcgctttattgtggctccttcttttaaccggcgcacctctcaaggtaaagcagacgaagcagcatttctgaatgagacacgcatccggaacatgacggtcatggatgcagaacagggccggaaacttcagcttatgagagagagcgtaatggcgcatcacgccgcacgcttttttcttgaagctgacggccactgcgaatcctccctctactggtcagatgcagagacagaagaactctgtcgcatccggccagataaatatctgacgaatcgccctctcatcgtcgacgtgaaaaaggtgagtgatatgtcgcgctttgcccgccacatcgaagcgttccggtaccacgttcaggcagccatgtactgcgagggcttttatcactgcactggcacatatccgcagttcgtttttattgcggtcagtgaagcgatcgactgtggccgttatccggttcgtgtgtttgagctgcacgacaatgacatgagcgcgggatccgccctcttccgtcgggacctgtgcacattccattcctgtcgcctcggcaataactggggcggcatagaaataattaagcgccctgcatgggcacattaacaggagtaggcgttatgcaaaatcaaccgatgatctctgcgcccgacagcactgacacaactgccactattttcagccccgatgccctggataaactggtgcgctttgcagaaatcatggccagcagcagagtcactgtcccggcgcatctcgcgggcaaagccgcagactgtctggctgtgaccatgcaggccctgcagtggcgtatgaatccgtttgccgtcgcccaaaaaaccttcaccgtcaacggtgttctgggatacgaggcacagctggtgaatgcagtgatcaacaccatggcccctgcacgggatcggctccattacgaatggtttgggccatgggaaaatgttatcggcagattcaccgagaaaacctcatccaaaggcaataaatatatcgcaccggactggacactgcaggatgaatccggatgcggtgttcgggtgtgggcaacaatgaagaacgagcaggagccgcgggtgctggaactgctgctctcacaggcacaggtgcggaactcaacactctgggcgagcgatccgcgtcagcagctggcttatctcgctgttaaacgctgggcccgtctgcactgcccggacgtcattctgggggtgtacacaccggatgaactggaaaccttatctcctgcagaaacgcgacgtgacaccgccagctcgtgaagatttgaatgcgttcatcaatcagtcagtcagccgagatcacggtattgcgctgcaaaaccattctgtcccggacctgcgaactgaagagattaaagcagaaacgcccgtgcctgcagcgccaccagccagcccggtcagatcgcctgaccagccggcgagcgcacccccgccctggcctaaacactgtccgggtaaagaacaggaacgcgctgaggacagggaacgttcttcagaagaacttctcgctgatttttgtgaggcagccatgaaaagtcagtcggtcagcgcactcgcccgctgctacgcctacgcatcaaaggtacttaaacctgtgccaccgctgctggataaagccacagatgtgtttctggtcaggaaagccgagattgaagaagccagagaataaatgccatctgaaccccgttaattcaggagttatcgatgaatcagagaaagactgaccgcaaccagcgttattacgccgtcgccgaggcggctgcatttgccgaacgctgcgaaaagtttgatcaggcgggaaaactctggctgcgggcaatgaagctggccttaagaccgatgaatgcccagtgggcagaacaccgcagtcagtgttgtatgagtgcattacgtaatggatggtctcatatcagggattaagccagcagtgattatccagggacaccctcatcattatgaatattatattcacttttctgacttcactgatatgaaagtgagtgttagtttctttacagaaggcgaataaatatatacataaaattaaaactccgcgcgctccctgagtgtaacattaattaagaagacgccacctatgaacacaagactgttaagctatatcgacacctttttataccattcttctaccgagccactgcagcaactggtttatatcatcgcaaaactgtgcctcattactgcacccgcagcctgggtcgtcaaacgcccgactggcaaagacgacagactctttacgtctcaggaagaggcactggagtttctggaaaagcagggccacagcgatgactatgtcgcgccacttttcacaacagtaaaagtggatatgagtgcaggagaaatccggcatctgcttttgacgccattacctgatgaagaagattagtctctaattaaaagcaggcaatggttatcttatatctgcaaatttaacgagtcatgattgtggctcgaaataaaaaacaacaccagggcagtcaggaacaattcaatgaccagaacaacgaatgccattattattgtggcggctatactgtgctcgctccagcttgcaaggggagaaagtatgccgctggaaaatgaactccagtccttttctgtaaaaaccggcgcaacccggattatatattctgcgggttcgaatggtgcatcaatgaccgtgatgaacccgcaggcgtatccgatgctggtgcagtcggaagtcatgatggaagaccggaaaacccgggccccgtttattgtcaccccaccactgttccgtctggacgggcatcagcagagccggataaaggttatcgcaaccagcagtcacaataatgacacgaaagagtcactttactggctttgcgtaacaggcataccccctgaggcggatgcggactggacgggggatgcgtatagaaagaaaaaggccggacagcacgctacccttctgacgcaattgcgtatcaaaagctgcctgaaactgcttgtacgcccatcctccctcagaggcacacccgaagactttgcctccagcctgacctgggcaaaacgcggtaggacgctcacggtcagcaaccccacgccctttttcatgaatctcagaagtgttcagcttggaaaatcgagtgtggccaacgctgaatatgttcctccgatgggtaaacggcaactgcgcatacctgcggatgcgtcaggtcaggtgcactggcgactgattaccgattatggcggagacagcaaagcgttcacgtccgacctgagcactgatcctgtttctcactgagagtactccctgccaggattaaaacgatgactgtttacagaccacttttcgtggccggtctgacgctggctgcggttcaggcagaaggcaaagtctatacctttaacccggctctcattaccggaagcaataaagaaacagacctgatgcttttcagtcagggcagtcagctaccgggcatttatccgactgacatctacctgaacaatacacttatcgactcccggccagtcagttacatattaaggccggataaatatggtcgtcagggactcgtccctcacctcagcagatccatgctgtcaggttacggagtacgcatgaagagcttcaaggttactgagaaggaaaaacgctcaggcttttttgatctgtcgcagataccgggcgctcaggctgatttccactttgatgagcagtcactgcatctgagtattcctcaggtttatctgaagcccggatttaaaggcatcgcaccccggactctttgggacgacggcatacctgccttcatcatgaattatcgtaccgggacgagccagagtgttacccgtggcccctcgggaagaaaatatcagtactcctggctgcaactgacaccaggcgtcaacatcggtgcctggcggcttcgcaacgtcaccagctggcagcaaacacgtggaacgcccggacgctggcaggccattacgacttatctggagcgcggtattaatggcatcaacagccgcctgacgctgggtgagcgttataccgcctctgagatttttgacagcgttcccttcagaggggtcatgcttgcctctgacgatcggatggtgccttccagccagtatatgtttacgccggtcatacgtggcgtggcgagaacccaggcccgcgttgaggtaaagcagaacggctacactatttataaccaggtcgtcgcaccgggtccgttcgccctgactgacttcaatcccaccggcgcaggtggtgattttcaggttacggtatgggaggcggagggcgttcctcaggttttcactgttcctttccagacgccagcaatcgccattaaagagggctacctgcgctacagtctgatggccgggcagtatcgttcgtctgacaggagagtaacaagagcgccggtcatggaagccaccgccatgtacggtcttccctttggattcacgctttatggcggaatccaggcagcccggcactatcagtcttcatccctgggtaccgggctgagcataggcaactggggtgcactctcttcagatgtcacactcagccgcgcacagcactcgggtcatgacccggtacacggttattcctggcgtatgcggtacagcaaagagtttgtcgggacaaatacttcgctgtcactggtcaatttacagttcagccagccggactatctcacactggctgaaacactggagagctggcggattgatggaatggcgccaggcattcgcagaaaaaggagaaaaagtcgtaccggactatccatcagtcagggactgggtaaatggggttacctgaacgcaggtgcttatcaggatacctactggaaccgcggtctgcgagaaagcagccttaacgcgggatactctgttccgttcagggatatgacgctgtcattaatctggtctgccagtcaacgtgcccggcaccatcccagggaacagatgatcagcctctggctctctgttccgctaaaaaaatggatgggtggcaacacgcgagcgtcgtaccggttcacgcattcatcgtccggccctgccactcaatctgcaggcttaagcggtgatgcgtttgatcagcgcctcagctggaatgttgatcagcgttataccgcaggacacgcagtgcgccggagcaatagcgacgtatctctgggatggaccggaacctacgggcacatctcaggtaattacagctgtggccggtattaccagcagcgtaccgttgcaatggacggcggcattattgtccatcgccacgggatgactttcacacaaacgcttggtgatacaaatgcgctggttacagccaaaggcgcttcaggcgtaaaagttctgggcacgcccgggatctttacagattatcgtgggtatacagcgcagcactggctgaatccttaccgtgagaattcactttcattagaccccacaacgttgccggcggaggctgaaataaccatcactgacaggaaaattgtgcctacagctggcgcaattattccggttaatttcaaaaccaatatcggtgctaaggctattattgaaataagacttcctgatggatcaaaggcaccttttggatctgttgtgcaggcactctcagcacaacatcccgaaggtattgttgataacgaaggtaaagtttacctgtcaggtttatctgcaaagggacagcttaatgtaaaaacacgaagtcagacgtataaatgttttttcgttttaagaaaaaatattgactcgtatggtctgtattcagcagtcgcaaaatgccaataaaggagtgcatgatgcacagactgtttgcccaatcatgcatgtcactgcttctgctacttaatgcattttataatcagagcatagctgaaaacttagcaattaaaatcgtacccgatacagaattacactcaggaatatttccggatggtacgacactggccgtgatatatctatctggtatgaatcaaaagtgtgctgtaaatgtctggagcccatcggcgcagaatgagactacccccgggtcctataccctttatgacagaccgggaggaaacaggccactgagagtcaggctggtcggagaaggctggcagcctgacatacaattcgggacaggcgttatgcttaacgacccatcaggtttcgccaccctgaaattaataacaaacggcgaacagtatattgagagccatacatggccaattaacatttcggttcaatgcggaaggaactaaaaaaccatcaaacatgaagtaactcaaaacgtaatttctcaaacgtcctattacaggcatcaaccacagaggattgaaaattgattaaattaaagaccttacccttaacactttctttgttaagcgcatgcaacatcgcaatagctgataacacaccacaacaagtcggcgagattttaactcaatcggcagatttagttttcaaacagaactcgaaactgaatcttaagctgatacctgttcaggatttaaaggcaggaataaatgacgaatacaaaatagtagcaacatttgatatcacttcatcaccaccagtaaggataggagtgcgctggacacctggcgttggagaagtaagagtttcccatagtgaaaatccacggtaagaacaatccaaaaaatatccttgagctgaactttgcttggggtaattatgattacgacaacaaagatgagtggcatataacacgtaacctcgaagaaagatttggtggttcgttagttattcaaggaaaacagcaggtagctgctgacacttataccgtgagtatggatgcatcagcgtttatttcttaacgatagttattcatcagaaatgaaatgaccagaaagaaggctaagcctatgaattaacacccttagccttccgctcgatttcaacatccattgctcgagtgaagattagataattaaaaagcattttattattaactaaagttacttgcagcgggggaaaacacttatgaacaattggtttatgtcgcagccatttcattatgcattaacaaaacctaaagagaggtgactgaatgaaaaacatcaaaattatggcagttctactttctttagttgtaaatccaaccttcggtaatgtttttatttttcatcctggcaagcataaaatcaaaccttcaccaaaacctgatcatcacgcgttcatttctccaacaggctcccctataacacaatctgcagatttagtttttaaagaaaccagtcagattgacttccagcttttggctgaaaacaacctgaaggctggtaagaataatagtaacactatcgtggcgtcttattacatcagagtaaaaaaaccaacacggctgggtattcgctggacacgtcagtctggactgacaaatggcggcaggatcgtactcagtggaaaagaagactctatgcataaaattgtcttgtatctgccaactctggcatcaggtaatttcctggaaatatgggataataaaggctgggcggtatcacaatatcgtgtggcagagttaaatggaacgataaatttttataaggaccagacagttcaggctgatatatatactctgagcatggatgcctctgcgtttatatcttaacaacatatgtagtcatttagatgtgcagatctgtatagaagccagagcatgataaaggcgacaaaaataaataatgaaaatcccgcctatgcggggttttttattgcccgaaactggattcagatgtcagttccttctggcaaatcatccatggcgctgacaacctgtgggccagctcatgagtatggatgatcgggcatgtccgaggcaaacaccatgacagaggtatagacagaaatggtgcataatccaaaaattgatattcaaactctcttacagatgccctatctgaatctgcacgaagctgccatgctgcttcgcgtagcaccgcaaaccattcgcaaatgggtatcagtaaacgggcgaaactcagcgcccccacaatcccgcgtttccggtaccggtacgccgcagccgtctgacgtttcgcacctgcgacctcatgcgctatcacgaagagcgcgccaacactgatactgtcccatcaccactaatccactctgtaacacgcgcccaccataacgaataggcgcgacgctgttcctcgatatactcataacggtcgtacacctgccagacacctggcaatttatgccccagcattatttccgcaatgtgtggttcagtgagatccgaaaaattagtgcgggccgtccggcgcagatcatgcaatgtccagtgttccatttcagtgctcaaatggcggcgcgctgattgcctgatcctgggtggaatatcaatcagggatgagcgggcctggggagcgtcacgctgaatgttcgccattacaaagcggctatgcggtgactggtcgaacagctcctttagcattttttctgcctctggtatgactggcctcaacagcggcttacgtgtgcgtttgcccgttttgtgatgtgatggcgggatggaccatattttcttttcaaaatcgaaatgcgacttttctgcgttggatagttcccccacccggcaaccaaacaacagacacaacttaaccagcaactgaaactttctcgccagcctgctggcctccattgcgcggaaaattgtcacaatttcgtcagcagacagaacacgttcgcgcggtgtcagcgtgatccctaaatctgccagacgcagatcggttagcggtgtgatttttatcagccgcctgcgcatcgcccagttatgggcctgcctggcattggttaaaagacgaatggttatagagggttttttacgtgccagcggttccagaacgttcagccacatgtggatgggtgcatcctcatggggaacattacctaaccagggaaaaaggtgtatttcgaatgaacgcagcacatcatgatgttcaggtttattttcaacggcatatttttccagccacgtcctgattaccccttcaacagtcagtgcagaaaaagcatcatcacgggctttgcgcttcagtatgcgaggattgcggttttgttcaagctggccacgcaacctggtaacctcgtcacgcgcttcttttaaactggtagccgggtatgtaccgatatcaacgcgttcgcccttcccgttccagcggtaacggtactgaaacgtgatcttacccaggcaggatacgcgggcagaaagcccgtcacgatcggtcttaacctgaactttttcatattctttgcccagcatcgcacgcagggcagcgtctgatagcgccataaatcttctgaagtggaaaattatgtacaccagtatgtacacaaaaaagggggtaataaagggaaaaattatgaatgcagaggaacattataaacagctcataaccgatttttttctattattccctgctgatacagggattcaggtaaacagtcgggaatgagcagacactgtaaggaatagttgctggcatatctcaggaatatgaccatgaaaaacgtaaaagcactttcaatcgccgcactcgcaactctttctctgatctcttttggcagctttgccgagagcgtttctgtcacctcatccacactggatggcgcagaatcaaaaattgctgctcaggctcaggaacagggtgcgcagtataaaattacggaagcgaacaccaacaaccgtgttcacatgaccgcagaactgtataaataacggatggtcgcaaacggatttgccagaagaggctgcccaatgggcagccttttttgtgtccgatcaggccagacgggcggctggggcgctaccggtgcgccaccatagaatcagcgctgccagcgcaattgcgccgagtaccgcaaacgcggtgctgtaagaataacgtgcggcgatcatgcccgtcatggcgggactcagcgcggcacctgcgccctgcatcagcataataacgctttgcccggcgttaacatgacccgtaccccgcagcagggagacaatatagcctggcaccgccacaccgagaatcccggccgcaataccatccagaaacctgaaccggaatgacaaaaatcggcccggcaaagccggcggcgagaaccgcgcgcagcggtaatatcatcagggcgatcatgataaacaggcgatagccgtgcgtatcaacgcgtttagatacccacagcgcgaccgggatcatcaccagttgggaaatcaccaccgttgccgccgcgtaaaggcccggactgatcgccgcctggccgcctgccgaggcgacgcgcatgctcagcatcggcagcagcgcggcattggcaagatgaaacagcagcagcgtcaaaccggcgatcatcagcgccgggtttcgcaacaacattgataagtgcagcgctggctgacgctcttcatgcggttcataaccgcgcgccacatcgttatcgatctcatttccgcgaattgccagcgtagcgaaagcagcgaaaaccgccattaccgtcataagaatgaaaacggcacccatgccccagtaccaggctgaaaaaccggccagcaatgcagcaatcgtattcccgccatgattaaacgcctcgttgcgtcccatctgctggttaaagccgcgctgacccgtgagccctaaggtgatccccgccacagtcgggccgataaacgccgcagccaggcctgctacaacctgagagaccatcgccgtccaggtctgattgctgtaccacagcagcagtgtggcaacggtaatcaccagacagcccagcagcacaatgatttttttatgacgggtcgcatcggcggcgatccctgccggtagcgtagcaagtaatccggcgataccgccacaggtcattaccagaccgatttcgtcgggttgccagtgtcgctccgtaagaaagatgcccagaaatggccccaggccgtcgcggacatcggccagaaaaaagctcattaaacagagcgcgtagagtgaacgctgagacatgttatttccctggaaggtaagtgttagaggcagttgcgcttcggttaaaagggaaattatgtgttacgacgtggaaagtcacctttcgttatagtaacaaaatgaaaaaggccacccgtaaacgctacggatggcctttttctattcactcaataacgagagcgaactatttatctgtgccaaaaccctgcttcagcagtgctggcagtacattcgggaagtagatgtttttatagtaaccgctgacgctttcgctccagctctcaccgtcattacgaccaatcgtcttccagtgctgaaccatctcatcgttgtaggttgcaatctgctgctccagaccctgcgtctggtaagtctcatcatggcggaaacgtcgccagaggcagacgtggtttctgatgagccggttcgtctacgtgaccgattaccacacccgccaccgggaaggtcagcggcggcagctccagcagtgaaatcatcgcctgtgggtcgcgacggataccgccaattggcacaattcccagaccttcggcacgcgcagccgccattaccgaccccagcgcgataccgatatcggtagaacccgacacgatactctcaattctctgatgggcgatctgctgctgatcgacagcggccattcccacggctgatttatgcatatccagcacaaaggtgataaacaccggtgctttggcaatccacggctgaccgcctgcaatggcggcgatttgtgcgcgacggccggcatcacgcgtgatcaccaaagaaacctgctgcgagtttactgatgtcggtgcgcgataagcggtactgataatccgatccagcacagcttcatcgacaggttgctcagtgaaactgcgttcacttttgtgacttgtaaaaatatcaatcagttcgctcatggttcctcccatataaagcgcaagaatagcagcaagtcacaaggaaaaacttaaccgcactggtcatgctgtcgcggcgtttctcagcctccccagcggcttttaagatagctgactgcttgctgagtctgcggctgattcagatagttctctctgaacagaatcgtgccatcaatattggggttcgattcattaaggtcgagctgctttttcagctccggtacgccgccctgctgtgtccagtcaggctcaacttttgacggctcgcccactttatagagagcaaggccgatgtagagccgggttttggtcggtttcacgacctctgcccaccagtttgccagcacgtcgtatcgggccgcctgacgggaaaaaggccagtagagctgaggtgcaatgtaatccagcaagccctgctgcacccagcggcgggtatcggcaaaagcttcatcatacgccgccgctccgcgggtatcggaaccggcaggatcatgcgacagattacgccagacgcccgccgggctgacaccaaactccacgtccggcttcagttgtttgatggtacgtgacacctgctcaatcagctgctgagtattgtgacgccgccagtccgctttgctggcaaacccctgaccgtagcggctgaaggtctgattatcgttgagcagtgaaccggcagattccgcatagaagtagtcatcgaactgcacaccgtcgatgggataacgcgccaccacctcggccacaatactggtgatccagtcacgcgcctcagggatacccggatcgagcacatagcgatcgcctgcagtgcggatccagtcgcgatgcagcacaaaaacgctggccggatgcagtgacagcgtgcggttgagttcgctgacggtagacgatttagtgtttaccgacacccggtaagggttgaaccaggcatggactttgataccgcgcttatgcgcctcatcaagcataaactgcagcggatcatagcccggatcttcaccaatttttcctgtcagcatatctgaccaggggaggatttttgagggccagagcgcagtggcatcaggcttaacctggaaaaacaccgtgttgatgccgaggcttttcagcttatccagcttgtcgatcagcgattgctgctgctggcggatacgctgcgccggattggtgccattcaccgaggcaaccggcggccagtcaagacgtgaaaccgtggctaaccagacgccccgcatcggttcctgcgcatgaggttgtgctggcttgccgggcgtcggtagcggctgtttcgtcacgggcggaaaaggtgtgaccagcgatttcggcggctcagatgcgcaactgaccagcaacagcgcggcagccagcgcggcgcctcgcttaatagccgcacgggccggtgcagtaaagggtttaaaggcgatgatagactccagtattgtctggtcggggcgcaaagaggagtattctcggtgactctgattaaatgtcaatgcgttagcacagaggcagcagtaaaaccgccctccttcaaaaaaagcgcccctgaacccgctagcgctgcggagtgaataccattccggcggacgcaagacaggctttgagggtgccaaacgcatcctgacactgccgctcattgacgcaggcgtaacccagcagcaatccgcgcgcctcctgagggtgcatataatattgcgaaagtggccgtactttgacgccgcgctttagcgcctccgcggctatcgccacgtcatccgcgcctgctggcagcgggatcaccagatgcagccccgcttcatgattgaatgccggtaaaaaggctggccccagatagcgctcgatcagcctgcagagaaactgccgccgctggcggtaaagcaggcgcatccggcggatatgctccatgtaatggcccagccggataaactccgccagcgcacgctgaatcagcagatgtccgccgcgatagagctctgccgcggcgatgcgcaacggctgtgccagcggtttcggcaccaccatgtagccaatgcgcagcgcgggatagagcgttttgctgaacgttcccatgtaaatgaccggcgcatccgcttccagcccctgcagtgagggatgaggctggccggaaaaacgaaattcgctgtcgtagtcatcttccacaatccagctctgatggcgacgtgcaaaggtgagcaatgcctgacgacgggccaggcttagatgcacacccagcggatattgatgagagggcgtcacaaacaccatcctgggtggcgggccgctgtccggcaccagtccctgctcatccacgggcatcgcccgaatcttcaggccattcatgcgcagcagattgcgcgtttccccagtagcctggctcctccatccagacccgatcgccaggatcgcacaacacccgcgttaccagatcaaccgcctgatgaaccccttcggtgatcaggatctggtcagcatcagcccttactgaacgtgccacccgcagataatccaccagcgcatggcgcagatcgggacagccaccgccgctgctgtagaccaggcggtgaacgtcaggttcgcgattcagacgcgcctgaatctgactgaacagcttgtgggggaattcggtcacatccggcgcaccggggacaaacgcgccccactggtaaggcgatgctgtcgcgtgccccagcagactggcgccacgcttcgacagcgttgccggtcgttgcgccttcaccgcctgaaggtcggctatcgcatcactctgcagagagttttccggcagcgtttctgcaatccaggtgccgctgccggtccgcgcggtgacatagccttgcgccatcaggctctcataaacatgcataaccgtgtttcgcgacacgcccagttcgcgcgacagatcgcgggttggcggcaaacggcttccgcgcggaaacacctcttcagcgatcgcggcctgcatgcagttcagcagccgctgatgtaatgagccagttcttaaaaactgtaaccgcgctaatagatgatctgcgtataagagtcgcaattggctccacctttcctctgacaattggctctggcaactcaccacgcctcaggcataaataaacgtgtttgtcgggaattgtaaacacgcatattaacgaggtggaataaatgagcgaaaaaaataacctgttgcagcagcgcaaagcacaggctctccccaaaggtatcggtacgctgtgcgactggtacgttgcccgggcagagaacgccaccttatgggatcaggagggtaatagctggattgacttcgcgggcggcatcgcggtactgaacaccggccaccgccatccacgcattgaacaggcgattgccgatcaattaacaaagtttacccatacggctttccagatcaccccttacgaaagctacatcgcactggccgagcgcattaatcagcgggttcccatcgccggtgcggcgaaaacggccttcttcaccaccggggctgaagctgtagaaaatgccgtaaaagtggcgcgtgcctatacccgccgccacggcatcatcacctttggtaacgcattccatggccgcacctttatgaccatggcgatgaccggaaaagtggcgccttacaagcgagatttcggcccgatgccgccgtcagtcttccatgcacgctatcccagcgcggttcaggggatcagcatcgaggcggcactgaccagccttgaagaaatttttacgcaggacattgcgcctcatgacgtcgccgcgatcgtgctggagccggtgcagggcgaaggtggattccatgcggcacccgtagagtttatggtgcagttgcgggagctggctgaccgtcacgacattctgctgattgcggatgaagtccagagtggatttgcccgtaccggcaagctgtttgccatggaacactacccggtgaaggccgatatcatcaccatggcgaaaagcctggcaggcgggatgccgctctccgcggtcgccggtcgtgcagaggtgatggatgcacctgcaccaggtgggctgggcggaacctatgccggaaacccgctggctatcgcctcggcccatgcggtgctggatgtaatagaagaggagcagctctgccagcgcgccgttgaactcggtgcccggcttgaagcagaactccaggaacatcaacgcaaacatccggacattgctgaagtgcgtgcgctgggttcgatggtggcgatggagttctatcaggccagcaccgcgcaggcggttcagaagatggcgatggaacagggcttgctgctgctgacctgcggagccaaaggcaacgtcatccgcttcctctaccctctcaccattccggatacgcagttcagccaggcgctgaccattctctccacggtgatcgctcactgtgtcgcacccgccggacatcccgtcgtcccggcctgatttcgctgacgcgttaacgcaagttcatccccgttcgtccggccatccaggccggacgtcgacaggagacgtttacatgacgatgactcagagtgcgaatgcagattcgctggctcaaaaccttaaaccgcgccacgtgcgtatgctctcaattgcgggcgtgattggcgccgggctgtttgttggctccggccatgctatttctgaagcgggccccgcggtgttgatctcttatgccgctgccggtgcgctggtggtcctgattatgcggatgctggccgagatggccgtcgcctcacccgattcaggctcgttctcaacctacgccgataaagcgctgggacgctgggccggatttaccatcggctggctctactggtggttctgggtgctggtgatcccactggaagccaacgcagcgggaaccattcttcatgcctggttccccgatgtcgccatctggcagttcacgtttgctatcaccctgttgctgaccattactaatctgctcagcgtgaaaaattatggtgagtttgagttctggtttgcattgatcaaggtcgttgccatcatcctgtttcctgggcgtggcaggtgcggcagtgtttggtctgctgcctgacagcaataccagcggcctgtcgcatctctatgacactcacggatttatgccaaatggtatcggcgcggtcgtggctgccatcctgaccaccatgttctcttttatgggcacagaaattgtcacgattgccgccgcagagtcgaagaatcccggtaagcagattactcaggcgactaactccgtcatctggcgtattgcactgttctatctgctgtcgattttctttgtagtggcgctggtgccgtggaatgcaccagggctggttgaacagggttcatggcagacagtgttacaggcgatgaacatcccgcacgcccgactgattgtcgatctggtggtgctgatggcggtgtgcagttgtcttaactctgcactttatacctcttcgcgcatgctctactctctgtcacgccgcaaagatgcaccggcggctgcctcacgcaccaatcgcagcggcacgccgtggattgctgtgctgctctctaccgcggctgcatttctggcggtgatcgccaattatctggcgcccagcgtggtgtttgaatttttactggccacgtcgggagcgattgcactgctggtctatctggtgatcgctgcgtcccacctggtgctgcgtaaaaagcgcgagaaagcgggtgaagtcctgagttaccggatgtggttatttcctggcctgacgtgggtcactatcctgtttatcgtcacggtgctgataatcatgttgtttgatgcgaaacatcaggctgaattactggcaaccggcggtttgacgctactgattattaccaccagcctggtgctgcgtcgtaaaaaggagaagcgtcagagcacgaaatattttactcagcgctcttctgactcttactgatcttcacgcaagctttttataaattaaacccacctttgacagcaaaggtgggttttttctgcatatcaacagatgcaacgcgtgttaaccctcaattatgcaggggtttaataagatgcgcacactatctgatgatcaatccggtaaatgaattccccgatgctgacttaaaaatttcaaaaaagatacttcactgactcttggtgacttaatgataaaccctgtattggctatgggtttatatctttaggttccatgtcaccgttgctgctaaggcattgcactgtcgttcagaataaaacctcaagagaagcattaaagataggtaacgtaaagtatccctttgctcttttcaggattaaaccagtgcatttttacttccagaggtaatttggtcagcgattcaggattcatcaggtcagcagtagtggccacagccttaccactggcgggatcaaaacagtcaaacacgacaggattttgtccgacattcatattacatgaaccattagtaatggctccgctgaaggtgagcatgcctgaatttgaatccgcaataaccggtccggccagggcaatcagcaacgtgctaatgcagacagataaaaaagatttcattgtgcgtcctcctgagtatgtatcacctgttatcggctcacattcccaaagattaagtgctgattgaacgaataaatgtaaatgtacgaacgcttagcccaatgaaatcccttaaaaaacttttgttaagaataatcctaatccagccagctaacgagagtgtagaccatcgctggataaattttctttcttacattcattttttattatggccttgtagcagcaaatcacggctgcctgtgacttaatgacgctttgcaatagttaacacgctattcatagcgccttccgttagtggaaaaggtcatgattaatgtgacggtggtaaacagcaggtaactcttcgcgctttagatgacttcactacgctgctattaaaggcttccattgatcatgattgaacagtcaatataaaaatatccgaagagaatgtctattttactcaagccattctcctgctgattaatattgccaaaaacattcagcttattccagatactggctgaaacgcagcagataaccatcggggtcctgcaccagaaactcccgctgacaggcggtggtctcgccgatgtcatagtggttgtcccgaagcggccgatagagcggaacagcatgctgctgcaaacgcgtcagcacagcatgaacatcgtcgacttcaatctggaaattaataccctgccccagcggccagcgcagatcggctatgttccagccctgcggatggaactgctcaatcatcaattgcacctctccatagcagaggtaagcaaaatcaggctgctggcgctgaattctcacactgaaacccagcaccacggtgtaaaaatgcagcgaagcggtaaagtcagtgacggtcagttctggcaccatagggttccagtaatgggtttgattatcactcatagtaaggttccattttgatcggttactcgcccctctgatcaccggtttctggattctgctttgcagctcatccagcatcagccgcagtgcggcagactggtgctcacgcgacaggtaaagcccccatatgccgatacgttgcggctcataatcgggcagtaattttaccagcttccctgcttccagtgcgtggcgagcctcctgctcaggcaccatcgctatcccgcaatgcgctatcgccgcgtcacacaacagtgaagagatacccgcactgaaatttcctctgacggcaaccgcgattttctccccgccagccgccgtaaaatgccagctctgtccggcaaagcgactgtagtagaggcagttatgctgagccagatcgtccggggtttccgggttaccccgcgccttaagatactcaggtgaggcgcagaggaccgagtggcattcgccgagacggcgtgcgatcgcccccggctctggcgagtcggtgatgcgaatagcgagatcgatacgctcaccaatcaggcttactggctgattgttaatttcgagctcaatgcgcagtgccggataacgcgccagaaaatcggggatcaccgggccgacaagatgaagagcggtaaagtgggcgcaggcgatgcgaagcgttccggccgggacgccctgggtggtttcctgctggatcgcctctgagagcagggccagctgacgggttttttgcaggatcgcctctccggcaggcgtaagggtcagctggcgcgaagagcgatgcagcagacgcgttcccgcccacttttccatttcctccagataacggctgaccatcgggcgagagatccccagcgatcgtgaggcggcactcaggctgcccagttcacatatccggttgaaaacggctgccgccgtgactctgtccatccactccacctgttcggattatgaaactcagcatctctgattgcgggaattctaacagatagccagatgcgtagaatagcaccactgatactgaacattgcccgttacgcctgcctgaatcgggcatttatctctgaggatcctcaatgaaaattaagtttttacctgtgatgctggtactggcctcggcctccgccagcgcagccaccctgcaactgcaaacctataatccgcaggaaaagggcatctttgccgtctcctcaacgctggttaccgggccaaccgaagcgattttgtttgatgcccagttcagcacccaggacggtgagaaactggcagagatgattaaaaagagcggaaaaacgttaaaggaaattgtgatcacttctggcgatcccgatttctactttggtctggagccaattgttaaagcctggccggacgtgaaggtggttgccgcgccggcggtggtgaagcatatccagcagacgcatgacgccaagctgaaatactggggtccacagatgaagcagggcgcgccggataaggtgtttgtgcctgaagtgacccatcagacccgctttagcgtcgacggcgaggtgctggagctgcgtcatccggagcaatacgccgcttatatctggatcccgtctgcaagcaccattctgggcggtaccgccctctcctcgggcattcatgtctggacggctgacactcagaccgttcagagccgcgctgaatggcgtcatatcctgaccgaaatgcagacgctgaacgcgaagaacgtgattccgggtcactatctcggtgcccgtccggccggttcacaggcggtggatttcaccctgaattatctgaagagttttgaggcggcgctggcgcaacataaaacctcagcccaggtgattaccgccatgaaagccgcctggccgaaactggcagaaccggcttcactggaactcagcgccaaagtcaataccggcgagatgaagtggtaaaccccgctgagaggtcagctgactaccgggtttgcaacgtttaagcagacccggctgaacccattgacctgatctaaagatgcccgggcgctatcttttcgccagatagcgcctgtcatcgcgcgcctgcaaccgcgcctccgctggtgaggggaagatatagtgaaacagatcgcggtaaaaactcagatgcttcagcaatccttcctgtatggatttactgatgtctttgatcagaaattcctgggtcgtgctgaagttagtcacgctaaaaaaggttttgtcatagacgttgaccacaccttcccatttcatcacctgctcttccggggaagccccttcagaggcgacaaatatccctttatgggatttcacaccctgcttgctgacataggtagttaacgcatcatagccgcgcttgttacgccagcggcagaattcgtagggcacatcgtaatggggcagcacaaagtccggactacgaaaatgttcatcaccaattaacccatccagcgtaaccgtgaaatgcagaaagtcctgcaggaagtcgaactggcgggttttagtcagtgtgacattaatggtgtagtgacctgcatgcacataccagtaattggtaaagccggtgaccagaatacagaacgcctgccagtcactgagtcttcgatcccccgccagccccctgaaacggctgatcatcatccgtgatttgggatgctgatacgctttcagcagcggatcgttcatacctttcagtaacatcaggcacactccttgatagattgcgcttatcctgccacgccctgatcagggtgaaaagtgtcgttggtctgaatgtgacccccattaaaatctggccggcggcgtgaaacggactatcggattggggagaggggttagcgttttaaattcgtcagcgaggggaaaccggaggcatcgataatgaaacaggatgccagccttacgggctggcctgtcagagcttcgcgagcgtcttcagcgtttctgggttctgctgcaccatgcggatcagtaaaacagcctgggcgttaggtctcgccctgccctgtttccctgcaaccccaccagcacctcacttaagtgcgtgaccagcttccgcgctttatccgggataaagcgggcatcggggaaaacagcataaagatagcgatcgggaagccgccagtccggtaaaacccgcaccagtcggccggatgccagcgcgtctgcgccgataagtgtttgtaacccaccgatccccagccccgcttcaagggcctgcatcaatgcatcactgttgttagagcgaaaagcactttccaccggcacagacaccctcgtggtcgcggacaccagctgcagcggcgcatcgggcgatacgccgctaaaacgtatgtggggatggtgctgcaggtcactgggagtttgcggcgtgccgtttcgcgctatccactcaggggaagccaccagcacggtttcaaccgtggtgagtgaacgggcagccagtgtagcgggcggcgattcgctgaggcggattgccacatcaacgccttcaccaatgagatccgacaggcgatcctccagcgcaatattcagacgcagtgcggaatgcgcctgctggaatgcaatcagatacggcataagccgctgcccgatgccgctcggtagttgcatatagagtttgccgtgaagaggctgcgactcaggccgtagttgctgctccagctcttccatcgcgctgagcagctgcctgacctgctgcagataatgctgaccctgctccgtcagcgccatttttcgtgtggtgcggtgcagcaacacgacccccagcgcctcttcaagcgcggcgatctgctggcttactgccgactgcttcatgccgttttgccgggccgcagccgaaaaagatcccgcttctgccacccggatgaaggtctgaatcgcattcagtttgttctgcatttattgattttcctgataagtgacatccgtttcaggggatttaatcagaaataaacgcaggtgagaatgcagcttctctcttaacagggcaatgatcatgaaaacgacgcaggataagaaggttgcgctggtggcgggtgcaagcgggattgtcggtcagcaactgagtcaggcgctggtagcagatcactggcaggtcaaagcactgacgcatcggtcagactatgcagtcagcggcacagaggtgattgcggttgatctgcgcgatagccagcagtgccagcaacggctggcatcactcaccgacgtcacgcatatcttttacagcgcctggctgaacgcttctgactgggtaaccatggtcgggccgaatcttgccatgctgcaaaatctggttcagaccatggaaaatgtcgccccacttgagcatgtcagtctgatgcagggatacaaagtgtatggcgcccatctcggacgctttaaaacgccggcgcgggaaagcgatcctggtgtaccgggtgctgagtttaacgtcgcgcagctgaactggctgagcgcacaacagcaaggtaaagcctggcactggagtgcgctgcggcccggtgtggtcggcagtgacaggccgggcaacagcatgaacctggcgctgagcctggcgctgtacgcctcaatctgtcgcgcggcgcggctgcccttacgctttcccggttcgccggaaacctggcacagtatggtcgattttaccgatgccactctgctggccgacgcgacgatctgggccgcgcgtactccagacgcacgcaatcaggcctttaatatcaataatggcgatctctggcgctggagtgagctatggccggtcattgcagcgtggtttgaactggagatcgcgccgccggtttcgctgtcgtttccggcaactatttcaggattatcgtgcgctgtggcgggaaatcgccgctgcaaacgcgctgatccagcccgatattctggcgctcagtgatggtgtcttcgctgattttgtttttggctgggattacgacatgtttggcgacggcagcaagctgcggcgggcgggattccacggttatcgcgcaacggataagatgttctgcgatctgtttgcccgcttccgggcggcccggatcattccgtgatgatccgctgattaccgatgcagagagcaggaaagtcgctctctgcatcgggccattattagcgccctttcttcttacgtcccggctggacaaagcgcttgcgtgaggcaccgttagcatccgctttttcagcgggtttcgacgcactcttctgcggttttttagcggcggccggtttcgccggagctttagctttcttcgctggtttatcttctgaagaggagttctccagcagtttaaacagctcaacgagttcgtcgtcagtgagatcgcgccactcccccagcggcaatcccttgagattgacgttcatgatgcgggtgcgctcaagcttcgtcacttcaaagccaaaatgcttacacatacggcggatctggcgattcagcccctggaccagcgtgatgcggaagacaaacggcgcttctttcttcactttgcactttttagtcaccgtgcccagcatcggcacacctgcgctcattccggcaataaactcatcagtgatcggcttgtcgaccgtaacgacatactctttttcgtggttgttaccggcccgcaggatcttgttgaccagatcaccgtggttggtaaggaaaatcagcccctgagaatctttgtcgagtcggccaatcgggaagacgcgcttgctgtgattgacgaaatcgctgatgttatcgcgctcgccctcttccatggtggtgataatccccaccggcttattcagggcaatcagcaccagatcgtcttcatcgcgcggctcgataagctgaccattgaccttcaccacatcgcctgcaaatacctgcgcgcccacagtggcgcgtttgccgttaatgaaaacgttgccctgctcgatgtaacgatcggcgtcacgacgggagcagatgccgctctcgctgatgtatttattaagacgagttgatgagtcagtcagcatgattcctccaaaaaacgcggactataccttaccggcgggggcttgcgaagtctttgcaacggaaacttttgctcagctttgccagcctgacggcagcgggcattcacagatcaatcgccatctcagtacagcgtaaatcgctgcccgccagctttgacggatagaaactttcgcccagcggccggaagccatgctgctggtaaaagcccacggcgttcggcgtcgaagcgagcgtcaaccggtggtagccacgctgcagcgcctccgctttgatggtgtcgatgatcagcccagccattccctgtccggtgaacccaggcagggtaaaaatggcttccacgctggcggcggcaaggtccagcgatcccatagcaacctgtacgtcgtccggaccatcaatcacgaagaagggattcatgcggatcattgcgggaaagctggcgggcatgcggtctggcgtccaggcggcgagcacgtcgggtggataagcatgctggcagccatgacggatggccagatttctgatgttccataaatggtgcgcctcttcgggcgatgcctgtctgacaatcatagtgccctccggctctgcaacagaacctctacgttatcacatcgctttgcggctatctgcgaataccgccgggttcagatgcccctggcctcgccgcagttacgcgcggtcatgaagcgctgctgcattggcaaccgtgctgtttctgtgttgctgcatttgcaacagctcgcttatgcaaaactggattttaatcctttaacttcaattatttaatctctggcatggttactgcttggtcttttcttttatatctgaaagtttggaagatttaactgttccattaatccagctatatgccaggagaaaaccatgtcactgaaccaacctttacagttcgcctactgggtgccgaatgtctcgggcggactggtgatcagtcagatagagcagcgtacccgctgggatgccgaatacaaccgcaaactggcgcagatcgctgaacaggcgggttttgattacgcgctgacgcagattcgctttactgcaggatatggcgcagataatcagcatgaatcggtcacattctcgcaggatttacttagtcacacctcgaaattaaaagtgattgccgctctgcttcccggcccgtggaatccggtattggcggcaaagcagattgccactatcagccatctttatggtccacgcatcgccgttaatattgtcagcggctggttccggggcgagttcaaggcaattggtgaaccctggctcgatcatgaagagcgctatctgcgttcagaagagtttattcgctgcctgcgcggcatctggcgtgaagagagttttagctttgccggcgatttttatcgcttccgcgattacgtgatgaaacccaagccgttgtcaccgctcccggaaattttccagggtggcagttcacgcgcggcgcgcgacatggccgccagggtgtcagactggtattttaccaacggtaataccccggacggtgtccgtctgcaggtcgcggatatccgtgaaaaagccggacgtaatcagcatcaggtcagaatcgggctgaacggttttgtgattgcccgcgagagcgaacagcaggcgcaggcggtgcttcatgagatcatcagcaaagccaacccggatgcggtaaaaggctttcagcatgaggtcaaaaatgctggcagtgcctcacccgaaggagaggggaactgggcgaaatcgtcgtttgaggatctggtgcagtacaacgacggctttaaaaccaatctgattggcacaccgcagcagattgctgaacgcattatcgaactgaagcaggccggtgtggatctgctgctgctggcatttctgcactttcatgaagaggtcgaattctttggccgcgaagtgataccgcgggtccgcgaaactggaggcgcaggctttgatcgaagcgtgaaaaaggtacgccacagaagagagttatacccgactgcatccggggtgtgatgaacgctcagatctgctgcaacgtcgcccgccgctatcattatgagagcgacggacaacgtctgcagggcttttcactccgcaaagcagatccgttaaaagcgggcgttaagcccgacgttccatgtcacctgatgcatgtcgctgttgcctgttaccgccgagacgcccgcaaaggcattcaccgaggtgccaagcggcacgctcgcacccaccgccatatcgatccagttatcatcactggaatcgctgctgcgggtaaaggcggtgcgggtcgatttcagtccggcggtcaccgccgaatcgctgtcaccaaactggtgattgtagctgacctgcgcccagggattgatcagcaaatctttgctgtcgatacgccagcccactgcgccgatttgagagtgcagcgtctggtcgccaaagcgcattgaggtgctgctgttgccttcctctttatagccatcgacctgggtgtagtcgagcgcatagctggccaccgggccagtagaaacatagctacccagcggcaaatcccagccggtctgcagccgcattcccagcaccttaccattgctgttgcccttttccgtgcgggtcgccggtcccagcctgatctgacgctcaatatcatcaaagtcgagatcggcataatgggcgtccgcattaatccatccccgatcgagataattcaactgactccagagtgccaccagattgccgcgtaaacggtaatcaaagcgcgacgagggatcctgacgttgcgaggtcgtagagagcatggcaccggcctgccagtgatcggtcagctgatagcccacacccacggtgccgctggcgctggtcgcatcgccatcctgcaggctgtcgccgcggaaatcacgctgctgcccggcataaccgccgaaaacagtaaactcgccagcactggcgggctgctgacgctgctgctgcagatgtccatccagcgtattatgcgcatcgcccaccagcatcgacggcgcctgactcagtgcagctacctgcagcggcgcattcagcaccgactgaatgtaatcggcgatcagcgcatggaccgccgggctgggatgcagtctgtctgcaaacagatactgctgtgactgcgaaaatcctgtcgtcgaggaggtgcagtccatcgccgagacacctggcggacaggccattccggccgtattcgtgagtccatacaggcccggattatcgatcacctcattaaacaggccattgatatccactcgtgcgatgttcccgcgtgcggtcaccagcccctgctcttcagcctggttgtaacggtcggtgagggccgccgcctcctgactcagtaactgccaggcggcaatcagctgctgtgcaatggcatcccggatcagcggaattgaagagatttgtccggccgcctcgccaagcgcggtttcaatcgcctgctctcttgcggcacggtcaggcgtagtggtggtgctcagcgactgaaacagcgccgccgtggcaggttgtgccgctgggccaagcacctgcagaatcgcctgcagcagggcgggcgttgcccctacattaggtaccgtcggtacaatcaccgttccggctccggcatccagcaaccggctgacctgtgaggccgctgcactggcgctgttatccactatctgccgggcagcgagaggggcaagagccgccgccgctaaatcattgccgccaatccagtgaatatagagaccgtccgaatcagcccgtccgcctcgcgccgcaaggtagttatcaagctgatcctgagtgttaaacaggggattaattgcaggtaccgcaactgcgccaccttcggcatagttgcttccgccctgcgatgaagggcgcaggttatcacccagcgactgcgctacgatctcgtcatagagcggatgggtcgcgccatcataggtaaagcgcccgacgtttcccgccatcactcaggctatcgccaaagacggtgaggtcgctccaggccatcgcaggcagcggcgacagcaggctcagggtggcacagcagaaaaggtattgcgcgtgaaggggtttcatcagcagctccgcacaaatcaaatgaaagtcagtatgagtaagaaccgcaccggctggcgcagcaagctgtaagcgtagacggctgaggaaaggggtggcagaaaatacgggatcgcgctcgcaaagcggagaaatttgacttaaagatcagccgtgctggttcaggtgaaataccgtgaacccaccacggcgtcgttacacgggctactttttgctggcgggcttcagcccgcgattaagatcctgtaaacgtttcatcgtcttaacagtgcgctgtggcagcgttgaggcaaccgacaggatcagcatctccagacagaccataatcgtgccgtgcaggggaatgcgtcccttctcgccgccgcgcggcacattgattacgacatccgcctcgcgggcgaaaaaggagtcggtggcgttggtcagcagaataatcggaatatccagccgcttcgcttcacgcaccacggttgtcccttcccggtgcgccgactgttgcgccatcatgatcaacacgtcgccacgctgtagcgccagcatctgctctgccagcgcaattccggcacggttaagggaaaaggcgggcagaccgatacggttcagcagccgcacgctgtagtccgccagaataccagaggcgttgatgccgaaaatagcgacctgccgcgcttcgcccagcagcgccacgctatccgctaccgccacccgattctgcggctgcgacagcacctcacaggcgtgacggtggccctccagcacaaagtcgatggcgctgttcacatcactggtcacctcactgacggtggtgatcatcttatcttcagaggtcagcgagggaccaaaccaggtcttaagtgtctgtttgaggtcacgcagtccgctaaagcccagcgcctgaatcgcgcggattacagtggcatcagaggtgtgattcgccacagcgatctccatcgcggtgctctccagcaccgtttcccgctgttgatcgatatagcgcgccaccgccagcaggcggggtgaaagctgcttttcacgggcgcgaagacgtttctgccaccacatccactctgtttttaacggtcctgctctgtttcatgctgcacctgcaactggggttaaatgtgtgaaagactcattgctagtctggctaaatagatagtttcagggccgggagatgtagtaaaagcgtcacactgttttatatttcacctgcagaagatgtggatttaaccaaacccctcacctccatataaaaatatattcattattttcaataagttaaaaatgccagccaatctatttgcagcgataaacgacacggcaataatgtagtcatttctattcaaattatgtttactactacaatagcggatgtttgaatgattctcaattacagatgagaaaggttgtcgtccggccggcataatgaccttgaaggcctgatactgatctcctctgtttaaacgctgcatattgcagaacacctccagggtagacctgcaagacagacagattgtcagtcgtcaggtcctttgcttcagatacgaaaagaaaaatgaaaaacaaagactcacgatatccggcccggcaccccgctctggtcgtggcgatctgcagcagcatcatgctgccacaggtcaatgcagcaaccgacagcgccccggatatgaccgtgaccgcggatgccagttcagagggaaattacagcgccagccagagtagcgttgccagtaaaatgccgaccgcgcggatcgatgaggcgcagtcggtcagcgtggtgacgcagcagcaactggacgattaccaggcaagctcactggcggatgcgatgcgctttgtcagtggtgtgaccgaagcgaacacgctggctggcaccgaagatggctttgtacgacgcggatttggcagcaacgctgatggctcaatctaccgggatggcattcgcagcagtcagggattgaatttcgatgccacgaccgagcgggttgaggtgctgaaaggctcctcctcgctgctgtatggcattcagaatccgggcggcattatcaatgtggtcagcaaaaaaccgcaatacagctggcactccagcgtcagcggacgttacgccagtgaaggtggcggtgcaggcaccctggatgtcaccggcccgctgggcaacggcttcgccttccgcctgatcgccgaaaagcaaaatcaggattactggcgcaactttggcagtgaagagcacacactgctggcaccctctctgcaatggtatggcgagcaggcaagttttctgatcagctatgccgactaccgctatgacattccctacgatcgcggcacggccttcattgacggcaagccaatcgacatcggttataaagatcggctggatgacaaagccaatcacgcctggggccataacaaaaccctgaatgctcattatgactggcagtttaatgatgagtggcgcacccggttaaccctgggctggaaccagcggcgttatgacaacaatgaagtgcgcgtgacggcggtgaaacgccagcagcggcgtggtcacacgtcgcgccgatgccaatcgcgggtttaaccacaaaaccaaatatctgagctgggatctgctgggtaatcccgaaattctgggtatgcagcacgcgctggtggtgggcaccgactatgagatgaaccagacttatcgcgcccatcagtatcagggcaaggtcaaccgccagttcaactattacacgcctgaatatgacctgctgtcaccggtcacggacgccagcacggaaaatagcgcagcagccaataacctgaaccgcattcatagccgatcgctctacgccaaagacagcatttctctgtcacccgactggattgtggtgctgggcggtcgttatcagcattatgaacagcgcgcctcgcgcggatttaatccgcaggtggaaaccctgaatgatgaggggaataagtttctgccgcaggcgggggtgatctacaaactcacacctgacctctctttctacaccagcgtcagtaagtcgttcaccccgtcaaccgacgtggatgatgatggcaatgtcggcaaaccggaacagggcaccagctgggaggttggcagtaaatggcaactctcgccgaaactgttcgccaccgtcgcgctctatcggatagacgaaaaagcgatgtcgctgaatattaatggcagcacgcgggccattgataaagcccgatcgaccggcgctgaatttgagctgaacggcgaaattgcacccggctgggatttaagtgcgaactacagctatgatcaggcagagatcgttaatgaccgggttaatccggataacaacggcaatcggctgcagaatgcgccgcgtcatgccggtgcgctctatctcagtcatgagatgcagatcagcagcctgcccggctcgttccggctcggcggaggcgcacgctatgtcggcagccgtgcgggcgatcccgataacagtttcaccctgcccgactatgtggtggcagacagttttgtggcatggaacaaccgcctgttcggtgaaaaaacgcagctgcgtctgaacatcaataacctgtttaaccagcactattacagttcaagcggcggcaacctgcgcgtccgtgaaggtgaaacccgcaacctgatggtacaggcccgtgttgaattttaaatcgctgcgctgtgcgttattaatgctgagcgtgatactggtcagcgctggcgcacacgcccgcacgctgaccgacatcaccggccgtaaggtagagatacccgaccatccgcagcgtattgtgctgggtgaaagccggatgctctacagcgtcgcgctgctgacacccggcaatccgctgcagcatatcgctggctggccacaggatctgaaaaagtatgatccccagacctggcagatttttgccagtaagtttccgcagatggaggaaattccggtactgggtctggatggcgtcaatgacatgaatcccgaacaggtgatcgcactgaaaccggacctggtgatcctgccgcagctggcgcgcggcagtgaaagcggagcagtgctggagaagatgcttagcgcggcgcatatcccggtggtgaagatcgatctgcgggttgagctgctgaaaaataccgagcgcagcatgaccctgctgggcgaggtgctgaatcagccccagcgggctgctgacttcaatcgcttttaccgcagccacatgcagcgcattgagagacgactggcggactatcacggagctaaacctaaagttcttttgcagctgcatctcgggcggcgcagtgaatgctgcgtgacgtcggtgaatggcaatctgggtgagctgctgcgctttgccgggggcgacaacatcgccagtcagcagatcaaaggcgtgttcggacggctgagtgaggaaagtgtgattgcggcacagccagacttttacttcgccaccggcaccggcagcgccgatgaagcgggagccttaaaactcggccccgccgtcacaacagcgcagacccggcagagcctgctggcgctgaccggtcagcagaatgcgctgaagcagctgacggcattgcgggacggtcacgccggggcaatctggcacaacttttacctcagtccgtggcacgtggtagcgacagaattcttggccaccacgctctatccgcaactgttccgcgatgtcgatcctgaacagacattgcggcagctgttccatgatttcctgccgatcccctattcgggcagctacctctaccggctcgcaccggaggcgacgtcggactcaggcggctgacagcccgcgatttttcacccggacgatatcggccatcaccgacagcgcaatctccgccggggttttgctgccgataggcaggccgatgggcgcatggatgcggtccagtttcggcacgatccatgccggcgatctgttgtagtcgcgcccgtcgtttctcgctatttttcgccgagcccatgatgccgatatagaacgcgggtgtcgcgatcgcctccatcatcgtcaggtcatcaatgcggggatcgtgggtcagtgccacaatcgccaccgctgcatgcgcgccgttcagctccagccagcgcgccggatgctgtgacaccagcgtcacgttgtccgcagcgctgaagtggctctccagctccgtcagcatctccggtcggtgctcacagacccgcacgtgaaatcccagcatctgcccgagccggatgcactcatatgccacagtcgagtagcccgcgatcagcagttccggtatcgcaccaaccggcagtaacatctgctgttcactggcatccagcgcaggcaacaccctgtcaggggcgagcacttcccactgcgcacgttcgccgggtcgtatcattttcaccatcggctgctgtccgctcagcgcgcgctgcatggccgtcagcagcgccagcgtggcatcatcgggcggcagaaactcaatgacgatctccaggctgccgccgcacggcaggctgacgtcaggacgcattccgccttcaccgtaccgcacccgctgactgctggcgcgataggctcctgccgccagttgcgccagaaagtcctcttcaatgcagccgcccgacagcgatccgcagtaagcacccgtttcgttgaccgtcatcagggtgccaggcgcgcgcggcgaagatccataggtgcgcagcaccgtgcagagccagacctgctgacccgcctggcagctgctcagtgccgcattaatcacacgttgatccagcgcaatcatgaaaattcctttattaactgcagatcagcagggagatcgatatcacacaaacagccgcgatcattaagcggcaaccggacggcgagtgacttcaccgccgcctgcggcccggcatcgccctgtagcgtgctcagcatcgggtagtagtggtgctgaaagcccaccggatggcccggcctgccgtcaatccacggcctgacgatcggcgcgtccgccagcgcagcgctgacggcgcggtaactttcaggcgtgacaaacggcatatcgcccagcgcaatcagccagccgtcatagtcacggctggcattgacacctgcggcgatcgattcgcccagcccgccgctgtcgcacagcaccagggtagcctgcgagcagagcgccttaagcgcagaggcgtccgggcgcgtgaccacaaacaggtcaagatcactggcagcggcctgctccagcgtgcgttgcagcaccggtttgccatccaggtcagccagcagcttatgcccgcccgcctgctggcgaaaacggcgactcagcccggcggccagcacaatcaacgctatcttcactctttctctccgctaagcgtgaaaaacgggcgcaggtttcatcccgcgcccgcatatcctcacatcaacctgctggcagcaggtcatgaacaggctcagataatcttatcgagagtaataggtaagtcgcgcacccgcttgccggtggcatggaacaccgcattactgatggctgccgccacgcccacgatacctagctcacccacggctttaccgcccatggtggtcgcctcaaaatcgggctcgccaacgttgatggtggtaatgctcgggatgtcaccgttaaccggcaccagatagtcggccaggttgttgttgatcacccgaccattgcgtggatcgacgatgccctcttccatcagcgcctgaccgacgcccatgatcatgccgccaatccactggctgcgcgccagtttagggttgtagagacgaccgctgtcgagcgccgccaccatccgtttgacccggatagtgccgaaatcttcatcgacccgcacttccacaaactgcgcgctccagctgtgggccgagaatttttcaggacggctcatgtcattaaggttgcgcaccatcttgtcgcgctcgctctgtgacagatcgtccgggaaagtgccgcctttcaccgtcagactctccgccggtgccaggcttgccagccgggcaaatgagaccgccagaccgctgcgcagattatgctgaacactgtcgcctttcagcgtgagctgagatgccggagtgccattcagtggcgactgtggcagctcgctggcgagtttcagcagctggtcgcgcattcgtttggcggtatcgttcaccgccgcggtcacgttgcccgccagctgcgatccacctgcgacaccggcacgcggcagctcggtatcacccagctgaacctcgatggtggtagaggcgacgccaagaatgtcggcagcggtctgagccaggatggtataggtcccggtgccgatatccgcaccggcgcactgcaccacaaatttaccctgtggcgtcaggatgatttttgcctcagcaggcagtttgttgaccggataggtgccagaggccatgccccagccaatcagttcacgcccttcgcgcatcgaccgcggcgtcataatgcgcttatcccagccaaaggcttcagcccctttctgataggcttctttcaggcgacgcgaactccacggcagatcgagctgataatctttgtccgcccagttgcgcagacgcagttccagcggatcgatattcagggcataggccatctcatccatcgctacttcgagaccaaaggcgctggggttttcgcctggcgcacgcatccagcctggcgtcacggtattgatcggtctgacctgatgctgggcggagacgttgcccaccgcatacatgcgggcggtgactttgctgcagtttctcagcaaatacatcgattaatgaggtttcactgaagctgcgctggataattgcctggatcttgccgtcacgcgaggcacccagttccagctgctgcgaggtggcaggacgtccgcccagaccggtaaaggtctgcggtcgggtaagcgacactttgatcggacgcttcagcgcccgcgacgccacactggccagcgcgacgtgggtgtaaggcaccggcttggatccaaatcccccgccgacatagggagaaataatccgcacatcttcaacgtcaatgcccatccactcggcgatttccacctgcgcgcctgccacccactgacttggctcccagacggtaatgcgtccatcctgccactcagcgacacaggcgtgcggttccatcggcatgttgtattcgcgcggggtggtatagcgctggctcagacgcacctcggcctgctgcatcgccacctgtgcatcgcccatatcgatatcctgtttcgataccggtttcggttcgacaccctcatcggtggcaaaaatcagtgcaggcgaggtttcatagtcgatctccaccagcgaggcggcatacgtcgcctgctcaaacgtctctgccaccaccagaccgatgttctgtccgttgtgaataatcacatcgtcctgaatcggggtataggttgactgcgccgcgccgccgtctgcaatcgcggtaggtttattgattttcagggtgttcagatgggtataaaccgccaccacacccgaggcctgctgcgccttttccgtcgacatccggctgatacggccgctggcaacagtagactggatcaccacgccatagagcggattttccggctgatgttctaccgcatatcgcgcctcaccggtgacttttactttgccgtcgccccgcgagcgcccggcgcccagtccctcaatcggatcggtggtttctggttccgccgtggcagtatcactggcactggcgctttgcatactcagacccaggctgcccgccgctgagatcgccgccgtcgccttcagtaactcccgacgtgatttgtcatttatgtcactcatgcggtttctcctgctgccatcagcgcacgtgcaatcacacgcggcgccagttttactttataggcgttgtgggtcagcgcctgcgtctcctgagtaatccgtttctgccgcctggaagaccgtctcttcattaaacggctggccctccagcgcctgctccaccgatctgacccgccagggtttggtggcgacgccgcccagcgcaatatgcacctgacgcatcacgccgttctccagggtaaagcctgcggccgcgctggctgcagcaaactcataagagctgcggtcacggactttaaggtagtgtgagtgtcgcagtgactcagtttgcggcacttcgatagccacaataatttcgtcatcgcgcagatcgtgctcacgatcaggtgtctcacccggcagcaggaagaaatcatcaatcgcgatgcggcgggtttcgccctgctgattctgcaggaccacgatggcgtcaaacgccaccagcgccaccgccagatcgcctggatagaccgcgatgcagctgtcgctggcgcccaggatggcatgattgctgttaacgccatccagtgcggcgcagccggaacccggattgcgtttgttgcaggcggaaaaggtcgccggatcgcggtaataggcgcaacgggtacgctggcgtaaattaccgcccagcgtggccatgttacgaatctgcggtgacgcagcctgccacaggctgccgtagatggctggcgcgttctgctggcaggcgggatgatccgccaggccgctcatggtgaccagcgcgccggctgtgatcttatcgtcgtcaaactgcaggtttttaagcccggtcaatccagtgatgccgatgagctgcggcggcgtgaagaccccacacttcatcagatcgagctgtgtggtgccacctgccagaaactggctgccagattgctgtttcagggctgcggcttcctcaggcgactgcgcgactttccagctgaattcattcatgcggactccttcgccatctctgctgcggcctgtttaatcgcatccacaatgtgcggatatgctccacagcggcaaaggttgccgctcatatactcacggatctcatcttctgaacccgcatggccctctttgatgcaggcgacggcggacataatctgacccggtgtacagtagccacactggaaggcgtcattctccataaagcagcgctgcaccgggtgcagttcaccttcggtggaggctagcccttcaatgctggtcacttcggcgccatccgcctgagccgccagcgtcaggcaactcagcacccgctggccattactcagtaccgtgcaggcaccgcactgcccctgatcgcacccttttttggttccggtcaggttaagatgctcacgcagcgcatcaagcagggtgacacggggatcgacctgcatctgctgcgactgaccattaacctgcattgttagcgatattttttccgacattgtctgcttcccattgttgggggccaaaagatgtaattttttataggtttatttctgacggggttcgaatcgggggaaaatcgtgataaccctaatctttacgcgcgtatctctgctttaaggtttagcagctttttggcaattttgcggggaagccgggaaaagtaagtgttatatgaatggcatagcgaggtggaatcaggataaatacgtgttcatacaacgctcatctaaatgattttattaattttattgaaaaaagcttttatagccgtcgttcatagggtttatctgtgcacctcattaatcctgccgcgaaatgtgcaaccctgaaagactatttcgggtctgatagcaggtcgggtagcgaagccgtagttaacgtcgataaatcggcctgtcccgaccaggataaccgatcaaacaggtcagagggcctatgctgaaagaaaattttaacgatctgatctatctggtggtggtagcagaagagcgcagcttcacccgggcagcggcgaagctgggtgtgtcgcagtcggcactgagccacgcgattcgcgctctggaagagcgtcttagcgtccggttgctgacgcgcactacacgcagcgttgccccgacagaagcgggtgaacggctgatcactaccctcgccccgctgttcagcgagattgagtctgaactggtcaatgtcactgacagtcagggtaaaatctccggcaacattcgtatcaccgcaggcgaacatgcgctcacctctacactctggccgctgctcaggccctttcttcagcaataccccgatgtacatgttgaagtgtcggtggataacagtctgaccgatattgtcagcggccgtttcgatgcaggcgtgcgactgggtgagcaggtcgaaaaggatatggtggcggtacgcatcgggccggactggaatatgtgcgtggtggcagccagcagctattttgatcagcacggcagacctgagactccctatgatttacagcatcataactgcatcaacctgcggctgccgacgctgggtggcctctataactgggagtttatgcgtgatggcaaggagatcagggtcaaaacgcagggtcagttaatttttaatcatctcgcgtcgcgcattgatgccgcactgagcgggatggggatctgctatgtgccgcaggatagcgttgcggaacaccttaaaagtggccgtctggttcaggttttggctgactggtgtgagccttttccgggttattatctttactatcccagccgcagacagcacaccagcgcctttacacgtttgattgatgcggtgcgctatcgcggttgagagacagccgcgatagccagtcagctggcattaagccgctgtcgttcaagctgtcgcgttttgcggcctgaaatcaccatcgccacaataaataccagtgcaaacagcaacacgatcgtgggtgctggcgcgctgtcgataaagaacgagagatagaccccgctcagtgacaccagcaccgacaccagcagcgcatgtgaaaagcgtcgggtcagcagaactgcgatagcacatgccaaagatgacttttggttacgtaaaagcagatgtactggcagacaaggatgcccagttcaaactgattaacttctgcagcattgtctgccagtcgcagtggcagagctgataccagacggtgtaaaaaggaagaatacatgaaagcgccacatttagcagaagccctgccattttctgtggcgcttttcagggtgagcttaaataatttttgttttatacgcctttgctgaacagtttggtcaacggtgagatccccttcggctgattgctcatagtttctttaacgtgaagaacttacaggtatactcgcggatgtgaagaaagtaatgaacgtgcatcatccttttcggcttactaaaaatttagattttgagattattttcaccagatgacgatctctatcctttacagtgtgtaggacagggacttcaggataaaaaatggcaatagtttgccgccgggattacacctcaagttaaaagctcctcgattaacggccaaaaccatatttgagacaactcccgtcttttttgctaaaatccatcaccagtcgtgggattcagataagttaactataggtgcattcagcctgaactctatatttgttcattaaaatcaagaaattaaggaggatttcatgagtgataatgaagggagtcaaaggctcctgacacctggcgaaataacgttagcaaaatcagtattcggaaattcaatcgtctatcctcgcgtgtggattcatcatgcaagttactttcccttcaaacttcagggtagaaataccgcaatgagccccaatggagaattatatttccgggactggtattgcgagaacttttcaattcaatcttttcagtttcaacatcttttcatccatgaaatgtcgcatgtctggcagtatcaaaggggcatatgggtacgtatgagaggccttgttagtggctttgttagctacgaatactcttttgaagaaaataaaaagctgtttgattatagattagaacaacaagcacaaattattgctgattactttttgctttctaaatttgggcttaatatgtggctggcaagacgtggtaaagatggcgaagtttcttatgttggatcagtagacaataagattcattcaaaatatcaaaaagttcttgaggggttcccgtttctaatgaatattttaactaagaccttaatccctgtaatttttctcttgagtggttgcacgctgggcgaaaacctggataatcgatatactaaagaaacacctgttccggcccatgtccagaatagtgatgtatgtgtttctataccaatacaaagtgatgaaaaggttgtatccgcgttaacttataatatgaaaaacccctcagaacaggttattttccctgctgacaaacaacccaaagctggccttttttgcattcagccagaagaaataaaacttgaaaatggacaaacatacctcatttatattgaagtgaataaaaaagcaggcggtgagaataaaaaggcgacaagaaaggcctatgtctctaccttccaggctgtacaacaaggcaacaacctgacaatcactccagcaatgaaaaaataaattaaaagcccgcatactttgtatgcgggttaatttaccagattgcagccaatcaatttccaccccaaatcagtcaacgcaaccaaaattattattatatttttccaaatggtgataaaaatatctttcatattcttcagctgattcaattaaaatcgtcacttctgtgagcttttcatcaatttgctcggagctatccacaatagttataaacttcgtatgaatatgcagactcccatctcgcttaaaaagtgcaagttcagtcattgaatcatttctttgataaaaagtggtaggcttaaattctccataaacaaaccccatcggaggatcaccgaactccagttcagtgagaccaatcacattacttccttttctgatctcaaatgtcattaccatttcctttgagtcatgttcatagttttagaatactctgaacatccgcttgcacataaagtcccaacttaccgcattcatgctggtcatcactctactcatacctgccgctctcgcgaagtttcagacgctccagctgtcgcgttttgcgacctgaaatcaccatcgccacgataaacaccagtgcaaacagcaccacgatcgtgggtgctggcgcgctgtcgataaagaacgatagatagacaccgctcagcgacaccagcaccgacaccacgaccgccaccagcagcgcatgtgaaaagcggcgggtaagcagaattgcgatagcaccgggtgcgatcagcagggaaatcgacaggatgatccctactgctttcagcgtcgccacaatggtcagcgagaccatgcagagcagcccgtaatgcagccagcgtgcgggtaagccagagacctgcgcctgctgtggatcaaaactgaacagcataaaatcacgccatttcaccgcaatgaccccaacgatcaccgctgcgataagcgaggtctgaattatgtcagcgcccgtaatgccgagcatgtcaccaaacagaatgtgatcaagatgcacctccggtttcacggcgatatagaggatcaatcccaccgcgaacatgccggagaagacgattcccagcaccgtatcctgcttgatgcgactgttgtcctgcagaaatccactggcaacggcacagaaacagaccggctacaaacgcgcccaccgccagcggcagcccggccatccaggcgaggacgatgccagggaataccgcatggctcatggcatcgcccatcagcgcccagcctttcagtaccagaaagaccgacagcagcgcacaggggatcgccaccaccagcgcaatcagcaacgcgctgttcataaaagcgaactggaaaggttcaaagatccacatcagccaggctccttttcgggacgatggcggccacgacgccggttagccagcaagccatgtttgggcgcaaagataaacgccagcaggaacaacaacgtctgcgccaccacgatgatgccgcccgttgcgccatccaggtagtaactcgcccacgcaccgagaaaactggtgatactgccaatcgctacggcaatcatcagcagacgcgggaagcggtcggtgagcatccaggccgtcgcgcctggcgtcaccaccagacagatcaccagaaatgcaccgacggtttgcagcgccgccacggttgagactgccagcagggtaaagaagaggaccttcagtcgttcagggcgcagtccgatagcgcgcgcgtgattctcatcaaagaaggtaaccatcagatccttccacttaaacagcagaatgatgatcgacagcccgccaatcatcgccagctggagtatatccgcgggcgcaatcgccagaatattgccgagcacaatggtctgaatgtttaccgcggtcggattgagcgacaccataaacagacccagaccaaagaaggaggagaagatcaggccgatgattgcatcttcttttaagcgggtgcgctgattgagtaacagcatactgcccgccgccagcccaccagagagaaacgcgcccagcgcaaagggcagtcccagcatgtaagcacccgctacgcccggcacgatggagtgcgacagcgcatcgccaatcagcgaccagcctttgagcatcaggtagcaggagagaaacgcacacaggccgccgaccatggcggagacccacatcgcgttgagcatgtagtgataaccaaaaggctccagtaacagttccatggtcagtttccgtcttcaggtgccgtacgtggcgcaataaaaggtcgttcatcgtcggtgataatctgatcgtccagccctttcaccattacatgacgcagcaccccactgaatgcacgctcaaggttggcggcggtaaaggtggtgcgggtcgggccgctggccagaatggtgcctttgaccatcacggtgtaatcgcagaactccgtgaccgatcccagattatgcgttgagaccagcatggtcttgccttcatcgcgcagctcacccagcaggctgatgattctggcctcagtctgaacgtccacgccggtaaacggctcatccagcaggataacgctgccctgctgggcaatggcgcgcgccagaaataccctttttttctgtccgccggagagttcaccgatttgacgatggcggtaatccagcatatcgacccgcgccagcgcattactgacaatctgctggtcgtgtggtttgggtcgacgcagcaggcccatatgaccgtagcgacccatcattaccacatcctccaccagcaccggaaaagaccagtctacctcttccgactgcggcacatacgccaccagactctgacgcagtgcttcacgggttggcatgccgagcaccgagatgctgccgctggcgagccggacaaagcccatcagcgctttgaacagggttgacttgccggagccattcacacccaccagcgccgcaatcgatccacccggcacgctgaagctggcatcaagcaacgcggtgtgaccgttgcgataggtcacggtgacatccgaaacaacgatggtgtctgtcattgcgctttctctcccgctttaatgccctgtgccagcgtctccgtggtgactctgagcaaatccaaataggtcggcaccggtccctgagcgttgcttaatgagtcgacgtaaagcaccccaccgtaatgcgcacccgtttcccgcgcgacctggcgggctggcttatccgacacggtgctttcactgaacaccgccggaatcgcatttttcttcacctggtcgatcacttttctcacctgttgcggcgtgccttgctgatcagcatttacaggccacaggtagagttctttcatacccaggtcgcgagccagataggagaatgcgccttcgctggtcaccatccagcgtttatcctccgggatgttggcaatctgctggcgaagcggatccagcgctgcggtgattttttgtttgtaggcagctgcgtttctgacgataggtttccgcatgcgccgggtcatatttcaccagcgcatcacggatattatcgacatagataagcgcattgtccggagacatccaggcgtgcggattcggtttaccgttataaggcccctcgccaataccgatcggttttaccccggcagagacaatcacttccggcaccccatccagatgctgataaaaacgctcaaaccagcgttcgagattaagaccgttcgccatgattaactgcgcaccctgcgcccgtttgatatcgccgggcgtcggctgatattcgtgtatttcagcacccggtttggtaatggaagtgacttcggccgcatcgcccgccacgttctttaccatgtcagcgattactgtaaacgtcgtcactaccttaaatttttctgctgcatagctgctggtcgccatcagggttgtcagtagcgcactcagtagcatgatggttatttttcttttcgggaccatagggcgatctccagaggtgattaaaaacaaaacataattagcataggctattttttatagcacaggctatacctttgtaacagcgaagggttgtgaagtttcttcagcgtccgggcccgaatgtgaagttttgtaagcgaatcgctttacttgttgatatatagaaatttaatttcaatgatgggaagtttatggaaagcgtgatgtatagctataaccgggttttacgcctttctcatctgtggttgagtaaaccgcaggaacgataacaggattacaaaaagcccatcctgacggcgcaatttaccgaaaagcgttctgacacctggcggcactcacatgacatgcatagcagaccgacaattaaaataatcttattgataggctgaattgattaagcttcgtaaatttttttgctacagttaatgttacttaccgcaatcacccaggaggataatttgtatttttccagcgacgaaaaagcgaatgtcatcattggcgaagccgcaatgaacctgtttaatgccggtcaggaagtgaatgttgaactgctgattaaagaactaagggtcatggctgactctgaagttaatgagactcgccttgagcagatgcagcatgcgcttcaatggctgatggggttcaaaaccatcggtttcccgcaccaccgccccggcgacctggcttgccaaaaccactggcaaagagcccgctgctcccgtctctgccgatgacatcttctttaaacactaatccatgtatgcctttcctctccggccttaatattcaggtcggagcgtcggtggggtgtgaatgatacaagaatctggtacaatttttacctcgccacaaactcctcgtaacaccctgttttaaaagccttagcactttttgcacaaaaaaattaatcccaaaaatccaaaattctgtacaagttttgcaaagatgtataacttgcgcatcaagagtgcatacatttaaaccacctgaggacaacaacatgcgtcagaacggacaagccccggaaacgatcagcgatattgcccgttacttcaatcaggccagctcaccgtcgcaacaggagacgctgggttcggttgtggtggaaattctgcgcgcaggtcatagccttagtcggaaaacgatttgcagtaaactgctgagtcgccttgaactggctgccacgccagaagaagagagtcatctgcatgaactcattgcgatgctgtttcgtcgcgaagattaatgccctctcacggtcgtgcatgttaatcaggacgcctgtttcagccatcacccaggaagatctatcctagcaacaaagcccagttctgcttcccgtatcgggtgcactaagtcgcacccgctgacgcatacggacccgcagcatggccattgattcgcaatcagagaagccagtatgtacagaagtgaagatgagaaactgacagatgttatgatcggcgaagccgttctgacattactcaagtcagacaaaccggtatccagcaatgccttaatcgcacagctcgaactgatggctgctgatgctgacgacgacgtgaaagtgtcagtcattcgaaaagccatcaccgaagtccgtaatggtatggttgccgcgcgcaaacgcgtgcagggcgacggtgccgaacgtgataacacggctcatcgtatgaacagtgatggcccgcctgaaggttcgaaaaagcactgattgagcgtactgcgtacctgatacatgcggctaattttaagcgaagcggcagacctgaacagaatttttaaggcgggctgggcaaaacgaaaactgcgcctacactcgtttttgacttcaaccattgcatctgactcattttcctcagagaaagaataatcatgcagcattcatcatcagattcttcaattattgactacttccgtagcgcaggcgatcagcttgctccggaaactgaactgctgggcgcagtgattcgtgacattgttgctgatcagggacgtgtaaccaataaagcgatcatcctctatttgatcgctgaactggaatgcacttcagatgttgtcaggctggatgtgttacgcaaaacgctggaaatcgtggttggccgcacgccagacgataccggcatctgatacgccattctgcgttacctctggtaacgcaggatactcttccccctcgcccgcttttgtttccttccctcactttcgctgtatacccgatatgccacacagaaattatccgatataaaaattcttttgcaggttaatgatgtagcagggatttgatcccgacgataacgcttttttgcaatcatgccagatgatgatcattcaggcttaataagacctgccaatgaaaaggcgaacttctttatcaaaaatttgccacccctaatgaataatcaacagaaagatctgactgacattttttaatgcggtcatcaaccgtctcgctgaataaaaaagaaacgaccgactcacagtaaaatcccttttaaaggctgcgagcaatatgcaaagcctcttatgctcgccgatgtcaaaggtagcagggacgctatcatgacacaggccgggacaacgcccggcatcaggcctggcaaccttaatgcatcttccgggtgaaaaagcttatcgcttcctgacacaatgctttcatcctgctgtcacgcgtctcttcgctcaggcgaaacagcgcgtccgtaatgtcgtggaaatgaaccggctctcccgccttgatcaaatcactgactaccgcaccaaccagcgcacggatttcgttatcgttgtcgtacttcacacgacctcccgatggtgtatgcatatacagtctatcattagcgggagccaaaaaacaaaaaagccgtcaagcgggaaatataagcgaagcggcaaaaaggttattatctatacaacctcagaatattatcttgctttattttcaccccatgcagccctgaagctataaatagccaaaacgtggtagcaaccgctgtaatctatttatgcccatgtatattgagagttggatagttatatatcgcggaaacagacttttggctgaatgtgttataaacacttttacgactcactgtttgttgcgataacctgcggggcagctttcccggcctgatatgtgctgaccagcctttcacaaatgatcatctgacaatggccagcagtatgataaaactatcgtcatcctctggtgtcacgagcagcacatggctaaatttaccctgaaacagattgctgcccagtcgggactcagtctggcgaccatcgaccgggccctgcatcagcgcggcaacgtgcatgccacgacccagcaccgaatccagcaggcgatagcggacctggaactgatgcaaaaagcgggactcgccaggggaagaacgatctatttcgacgtcatcatgcatacacctgaccgctttcagccactgatacgtgaggcgttcagcagtcagattgccagttttactgcctttaaacttcagctgcgtttccacttcggcgcgaatttgactgcggaggcgattaacacgctgctgaataaaaaagcgttgcatagtcacggcgtcattcttaaggcagcctgttctggtgaacttcatcccacccttgaatcactgctgaaacaacgcgtttccggtggtcaccatgatgagcgacctgcccggcagcgcgcgcctgcgctatatcggcatggataattttgatgccggtaaagtggcggcttttctgatgtcaaaatggctgcgggtgagtcgttcgcatattgtggctgtgaccggcagtcacgatttcattggcgaacaggagagaattcaggggtttcagcgagcaatgcaggagtttgcgccccagcatcaggtgagcgtggtggcaggcggttatggcattgacgcccggatgcagcagtcggtgacacagtttttgcagagacatccggatgcagatgcggtctacacagtcggtggcggtaatcccggcatactgcgcgcttttgccgaacaaaagcggacggttaacgcttttattggtcacgatctcgatcgtgagaatcgtgcactgctgcaggccggtaaaattgatgcattaatcgagcataatttacagcttgatgcgctgcacgctttcagaacgctgctggcgtttcatggatttttgcccgcctcagaaccgcccgcgccctactctaaaattaacatcatcacccgttacaacatgacagcctgaaaactgtcaggcaattaatgagcccggctcataaccgtttgccgactgagcgggctaatcacgctccggcttgccggttacactgtgcatgacacgttaacaacaggagtgagtaatgaaaattatcgccaacggatcgctgccttcgcgtaagggacctgctgaatattttaccggcacggttcggattgatgcgccattccaggcaaccgaacccgcccgcgtgggtggcgcaacggtgacttttgaaccgggtgcccgcaccgcatggcatacccatccactcgggcaaaccctgatcgtcacgcatggccagggctggattcagtgtgagggtgaagccattcaggtgatgaacaccggtgatatcgtctggatcccggaaaacgtgaagcactggcacggtgcaacgccggataacgccatgacgcatattgctatcgctgagtcactgaacggcacgccggttgactggctggagcaggtcagcgatcagcaatatcagcgctaaatcagacgtgcattctgtcgctaaagtctgacgtgatcgatcagcgccctcagcttgggggccagatttttgcggctgggaaaatagagatagaagccggcaaaggcgggcaaccatgcgtcgagcagggtcaccagttcgccacgtgcgatgtaaggctggaaggtttcttccatgccaaagctgatgccgcccccggcgcaggcggtgcggataatcacccccatgtcgttggtggtgagttgcggattgacggcaacatcaaactcgcgtccctgctctgcgaaactcccagcgataaggggccagaccaggccctcttcgccagccgatgcagcgatgattgaccagatcctgaggatgttgcggcgtgcctgcacgagccagataggcgggtgacgccaccgccacctgacgctgcgcggtggataccggcaccgcaatcatatcctgagcaatcacctcccccagccgcacgcctgcgtcatagccctgcccgacaatatcaaactcctcatcggtgacggtgatatccagctcaacctgcgggtaagcggtaataaagctcgccagcagctctccccccaacatccgctcagcaatcgaggagatcgccagccgcagcaggccccgaggttccgcagccagttcggcaatatcggtcacggcgcgattgagctggttgatcgccggtgccgcttcggcatagagccgctgtccggcttctgtcagctgaaccgatcgtgtggtgcgctgcatcagcgtgatgttaagccggtcttccagacgccgcagactctggctgatcgccggacgcgtaacacctaattgttctgcggccagccggaaatttcgcgtctgcgccacaatcacaaaaacttcgagagcatttttatcagcattcattggtcagattgagttaccagtgcgtaaagcgttcggtggattatctttataatccagtcgccgtatgatcgccagtgacaacctgactggagaaacaaaatgactcagaaagtgattttaattaccggcgcctcaagcggcatcggtgcaggcattgcacgtgaactggcgaaaacagatgccattctgctgctgggtgcgcggcgggaaagccgcctggccgcgctggctgaagagctgcagttcaatggtgcagaggtggcgatcaaagcgcttgatgtaacgcgccgcgaagaggtgacgcagttcgttgagtatgctctggagagatggggccgggtggatctaatgatcaataacgccggtattatgcccttgtcaccgatggcgtcgctgcgggtggaagagtgggaacagatgatcgatgtaaacatcaaaggggtgctgtatggcattgcgtcagtgttgccgaccatgctggcccaccagcgcggtcatatcatcaacatcgcgtcgataggtgcgctggccgtgtcgcccaccgcggccgtctactgcgccaccaagtttgcggtgcgggcgatttcagacggattacggcaggagaacagccagctgcgggtaacctgtgttcatcccggtgtggtggagagcgagctggcatcaaccattaccgatccggcagccgccgaggcgatgcagcactatcgcgctatcgcgttgcagccggacgccattggtcgcgccgtaggttatgccattgaacagcctgaagaggtggatgtgaacgaaatcgtggtgcggccaacccgaaacgcagcagtaagcaacccgcccgatgcgctgtgtgcatcgggcgggcggctttactgtcagtagaggcttctgcgtgtacgctgcacggtgatggcgatggccgtcagtgccaccagcatcagaaatatccccagtccaaccatggcgttgaagccatagactttaaacagcagcagaccggcaatgcagccgctcaggaatgaaaacacggtagtcagatgggtgtgcagaaccttctggaaaaagcgacgatcgtcggtttcaagatgcacggcgtgagaagtatgggcaaagatccacgaccccagcgcaatacccgcatcggtcagcgtgccggtaatgtgggtcgatctgacgcggccattggagagctgcgttgaggtcgcattatgaatccccattaaaaagcccagcattaacagcacttccccgttaaagcttggccggtagaacacgatctcaaagattgatgccgccgtcagtgccgccccttccgccagaatgatcagacagaatatggtgcgtaacttatgtttgatccccactaccactgccagccgggcaacggtgcagcccagcacaaaggcaataatcagtgccatcaaaaacagcatggtatggaggtcgctggtggtcacttcctgggagatttgcgacgtgttacccgtcatatgcgatggaaaaaatccaaacgcgcccagcgccatggcattaaggatgccggcggtggtggcaagcaccagcgccagcagtcgatcttcggtatgcgaacgaactttcttcttttttatcagcacaggcttccccacctcaggtgaatgcaaaacgttcttataaggcttctagcatacaacctgatggaaattattcctgtcagaaccagataactctgatgaaataagccattaattttgctgatttttataaagctgattcagtttacttttaaaagtgtcaacgacgcgatgattcaccagcaggtgatcaccagagaggctgatggtgaactcagtcaacgatgaagagttgcgcgcctgtggacgtaaaggagcgatgtggttcagcatcgtccgccacctgatagctgacgcccggtgtcagcacgaaacggcgaccatctgccagttcagtgtgcaactcacccgccatgcacagcaaaatatggccctttgtgcaccagtgatcggcgacatagcctggtgaatagtcgaccatccgcacccggatatcgttaaacttcacggttcgccaggtcgcctgcccctggtcgccgggatgaatcgtctcttcaatctgatcccactgggtcaggccaaacggcagattttcaattttcatgcgattccctcaaggctaagtgcaggataaacgtcaggccagagcctgggtaacggcctcttccgcgtggataagcgtggtatcaaacagtggcacgctggcatccgtggcatccaccagcagtgtgatttcggtgcagccgagaataatggcctccgcgccctgcgcgaccagctgctgcatgatctccccataacggcgacgcgacgcgggattgatctcgcccagacagagttcgtggtaaatcacctcatgcacaaaaatccgatcctctctatccggcgtgatcacctcaagaccaaactgctgctgaagtcgcccgcgatagaaatcctgttccatggtgaatcgcgtcgccagtaatccgaccttacgcaccccggcctgctgaatgcgtcttccggtggcgtcggcgatatgcagcagcgggatgcccgttgcggcgctgatttgtgctgccactttatgcatggtgttggtacagagtacgatgaactgcgcgccagcccgttccagattgcgtgccgcttcagccagtatctctcccgcctgctgccactcgcccgcggcctgtagctgctcaatgcgctgaaaatccacgctatagagcaccagctccgccgagtgcaggccgcccagccgctgtttaacctgctgattcagaatgcgataatagagcgcggtagactcccacgacataccgcctaacagaccaatcactttcacaatgcactccgggttcaggggttttattccagcatgccagatcgacattgatcggcaacggctttgttcagttgatactgttctgaggtctgaagcgtcgggcaatcaccattaacagcaccacgccagcgctcatgatcagccaggcctgagtcattgacgttccgctatcacgcacccagcctgccagcagcggcatcagagccgcaatcatatatccgcctccctgcacgcgtgatagcagaatgcccgcctctctggcactgcgcgcatgatccagcgtgacgatcagcgacagcggaaagagcgcaccgatgcccgtacccagtaacagtgaagagagtatcggcatcgtgcccgggtaaaagaccagactcagcagccccagcagcaacagggccagcacgccgagcagcagcggacggcgatcgggaaagcgatgtaacgtcgccgagacgatgaatcctgccaccacttcggttaacgtcagcgcggcgagcagatagccactgtggcgagcactccagcccagttgaatatagaatggcggcagccaggccagcactaacgtataagcacccgtgccaatgccgaaaaagagcatcagcaacagggtacgccgcacaggcagcgtcgttgcatcagaggccacgctcacctgcggcgaacgcctgactaaagtcagccagatcagcagtgtgaccagcgttaacccgccggaaagcgccagcgcgggttgcaggcccagccatgaaaacagcgggtcagcactggcagcagtcagtgccgcgcccgccatgatgcccgtgctgaacagcgccatcagcgtcgccgcggcctcagcaaagcgttgccggatcagagcgggcatcagcgcctgtatcacgccaatccctgcgccccccgccagcgcggtgagcagcagctgagagggagtaagcgtaaccccgcgccacaggcaggcgaccgtcagacagagcaaaccggcggcgattccctttaccagcccgatgcgggcgatcagccacgggccagagagtgcggccaggcccatcatcgccaccggcaacgtggtcagcagactgaacgtcgtcgccgacagcccggcctgcagttgcaacaccgggaacagcgggccgataatcgccagcattgggcgcaggttcagcccgataagaaaagcgatcacggcaaacagaatgggtaacaacaccttatttttcatcatcgacgcctttacagaggattgacgatgacagcaccgggctgccaccatttatcttaacgttaagataaatttcccccggtgttaagaggctgcgcacaacccgacaacataaccacaatatttaaaggtgatttatgcatgaccatattgatttcgttgtcagtcagtgggacgacgcgatgcccgatctcgacgcctcttcaatggggatcttcggcagagtgctgcgtctgatgaaacatctggcgaaagcgcgcagtcaggcactggagccttttggttttcaggagggagaatttgatgtgctggcgacattgcgacgggcgggatcgccttttcgcctgtcgcccacccagctctaccaggcgctgctggtgacttccggtgcgatgacaaatcgtctgaaccggctggagcagcagcatctgatcgagcgtattgccgcgccagaggataagcgcagcatgctggtcgggctgacgccccacgggcagcagcagattgagcatgcactccgcgtccataccgctacgcaggaggcgctgctggccccgcttggcgcttcagagcgtgccgaactggaaaggttgctgaaaacgctgctgctggcgtgtccaggcgaagcgacagccgcagaatagcaccgtcagcgctgcagtttcggccactgtcatggtgaagataaccggcaggtgatcggcgctggcataggcatgcggcatatcggttcgtgctacggctgcacagccctgctgcaccaccagggtctgctcacccaccgttaaggcgagcgtgccctgctcgacatgcaacagttcgagtgtgcctgaggagtgaccggcagaacggaaagcttcgcccgcaaacatctgccagcgccagagctcgatcatatccggcccacgggttcccgccagcagctgcgcataaccgccctgctcaccctgccacagccggggcatttcgctgttctcaatcagccaggcgtcaggcgcatgcgcaacgttgacgatatctgccaccgagacgcccaacgcggcagccactttacagagaatggcgatgctgggattggcggcacccttttcgatctccaccagcatgcctttactgacgccagcccggcgtgataactcatccagcgagagtttctgacttttacgccagcttttgatgctgtccgaaacagcctgattgacactggcgacatcggcacccgcatcggtcgttatattgactttcttggtcatcggtcattactatgaaataaattagtcactgagagagtatccgatgttatctgttcacccgtcaatcgatcccgctgttttctcgctcgctcccggctttcgtgccatgagtatggtggtggaagccacaccgattacccgaccagaagttgccagcgatgcactgaagagcgcatgccagcaggtgttaaatgatgatgcggcgtgggcagacgcgcatctcgccgcctgggctgaggtgtttaaagcctttggtgccaaagcgaaacgtacaccctgttcggcagaagcattgcgtaagcgtgtgctgcgggatggcgcattgcctgccatcgatccggttgtggatctctataacgccatcagcattcgttatgcgctgccggtcgggggtgaaaatattgcggcctatgctggcgagcctcgtctggtgattgctgacggcagtgaacgtttcgataccgttaaagagggcgaggtggtttatgagtcgccagaaccaggcgaagtgatctggcgcgacgatcagggcgtaacctgtcgccgctggaactggcgtcagggtgtaagaaacccgactggatgccagtgcgcagcagatgtggttcattctggaaagtctgcccgctatgccgctttccgcgctgcaacaggccagcgacgatctggtttcgggattagagcagatgatgccgggtgcgcaaatcagtacgacgctgattgaagcgccagcaaactgaacattgcctcaacagcggctgaacgaggttaacggtgagcagaaattgtggcaggatacgcgccctgcgtctggccatacccggctgacttaacggcactcaaccggtgactagcatggctaaagtaaaatatatcctgcccctgctgctgatccttgccctggccgcctggtggtttatcccacacgacagtgaggaagataaggcgtattacgtcgcggtgttgtgcgcgattgatcatgatagtaagcagcccctcgaccggcagatgcagaacgtcattgaaggcggcaactctgattatgcgctgcaaaaaatggcttataaaccgggactgggccgcagcgtgattgctcgctggcagcaactgacgcccgatgagcagcagcgcgccgggcaggataatcttctctgtcagcagctgctgaaacgctgatttctgacgggcgtgttgcattgacaatgctgataattttccaggagaacagatcaaccaccacggccacataaagtcagccttcatgcggccggatgtacgttatgctcgtcacccagcgctcatcaggtgcctccagattgaactgacgctggagtctgttgggtgacactatgctggcttcacctttgcgtgctcgtaggttccggtactcgatctgagcttttattccggcacgcttcatcagtcgccagacccggttcacttctttctgaagtcgccgactctcagaccaggtatcagaatgcgctttagtggctgatgaatcagggccctacttttttactcaggcatagaggctgtgcgtgatgataccaggacgggtggcgacacttgcaagggaatggctacgatcaacgacctgtttaaccgcttcgatttttgactcttcgggataacgtttaccgctcatgagcacctctcttttgatagccggttgcaactgttgtcctcagccgtcaggcacgaactcgcctgcaagtttgacggagtgaagctcgacgactgcctgccagggcaggagccggagggttatgcagtgaagagtttgacgtaaattcacgcatactcctgaccggttgcaagctgaaacgctctcacagcaccactattttgtttgctgcacgcacgataatgagtcggttttttagctgttgaggtcccgcctgccgcagttctgataatgcttcatgaaatttctgaatttcacaggttcggtaaaacgaattcagagtggttaaacagttttccccatgaccatgcctcataaaagtcagattaattatataaaaatgatatttgcttctgtttttttgaatttaatttttttatttttctgttctttgacaagcgcgctacattaataaaaatgtaatgtgtatattttcatgaaaacagtaaactgttagcaggataattattagtctttaatatcatttaaatttaaaggcttaacatttaaataacacctccgacaacttcgatttaattcaaataaaacattataaaacatcgataaacctttcattacaatccttagtttttaattttcagttaatttacttttaattaaacggctcattagctacgggatgggccaaagattatctcatgtatttcttacactttaaggatggattatgagacataaaaaattagctcttgctttgggtatttttgttctctctgcggcgcgactttctgttgccgcacccttacataacgaaccgttgactgatcactcctcacataccttcttacttatcgacgatgctaatggtggcaacggcgggaaacggaggtgctggtgccaattctcctggtggccccggaggcgatggcggtaataacagcggcagcggtaacgggaacgacagcggtaatggtaacggtactggcaacggctcagctaacggcaatggttccggagacggtgacggtggtggtgatggtggtgacggcggtggcgatggtggtggtgcgtaatcaggctgctgaatctaactaaaaatggtcgcctcctgaaggcggccattaattaaaggatgaaacttctatgtcaaagctgcacaacactctgattcttttcccgctttctgcagggctgctcttttccctgccggtattcagtcaaacattcccgcaaggcattatccagctttctgcctgtgaaaatcagaacggacaggatgggaacgccgcttcgcctaacggagaaaatggtaaagacggcgtgcccggcaccggctgtctgaacgggggtaacggcggtaacggttctgcttcaggtggtaacggcggaaatggtggtaacggcgcaaacgccgggactgaatcgcatcacaaacaccacaaacatcataacaatgcacacggtagcgctaatggtggaaacggtggtgatggcgggtcaacagacaatgcccccggaggtgctggcggtgatggaggtaacaatgaccagtcacaacatctgtaaacgatgcagaaccttattaagatgctccgctctgatactggcggttttaacacattacggttatgcctctccggcatacccgatcccttctcctgattctttgtcactgatttctgatggcggaaacggcggagacggtggtccgggtgaaaacggagggaatggcggtaacggcggtaatgctggcacaggttccgactccaatggcggtaatggcggtgatggcggcacaaacggagccaatggagggaatggtggcaacggaggaagcgggaataattcacccggtggtgatggcggtgatggcggtgatggcggtagcgatggtggtgatggcggcggtatatagttcataacgcaggggatgatatgaaaaaccttctcatgaaagttgcatacctcattattctgacctcagcattactgagacctttcattgtcgtattcactgtaacgtcctctctggcggccggaatattcagcactgcggcatgggcagacggtgatggtggcgacggtggtgacggtggcggtgacggaaacgggggagacggagggaatgctggatctggcagcaacggagatggcggcgacggcggtaatgggggtgaaaacgggggaaatggaggaaacggcggtaatggtgacggatcaggtaatggcggaaacggaggcgatgcggggcctggcggcgtcggcggtcagggtggcagcggcgggagtcagggaggacatgatggttctcccgggatgagtggagctaaatagctatccgtatgccgttaacgcggtctgccggaggttgattgctccggcgacctcattcctgcagactaaacggacagcatagcaatgctgagaggtcgtgctgcagggcctgaacggcgaaagttcgtgaagtcatatcagtcctttttaccagccctgcaaaccccgagcatcctaaaaaaaaccgcatagtttcagcctgagaaatggcagcttattaggcaccacccaacaatccagctcccgcccgacctctgcctacagtttccacactggcaggccttctatttcccagtgttcaaaaggcatcatggaagagaatccctcactccagcgataaaacatgatctccggttcgatatgatgcagcagcgaatctaaccagcgggatatccatctgatgacagttgccggcgtatggaaagccagatcaatctcagcctgcccttttgccatatgataaatccgttttcactcctctttctcacgacggaaactggcgggaatacttctcatcgctaagctccgtgtcctgacacggccatccggaaacagatcgtgagcatcataactgttcagtggatgcgggcagtcctcacccgctataacaatcagcctgtaagtgctgccagccatgcctgcctgttacctctgaattcggcgtcagtcattgaaggccgcaaaaagcgaatttctttctgtctccccacttgctgtcccctgagaatccgaaaaaggcttgtgcatacggatagtctgcacaatgcgcatttcgttcatgcctgttttgacgacagcaagggcctgcatcgcttcacggcgtgcaggagagagcggaacctgtaaacggctggcttcccgaacatcctcgttattcaaaacatccttcaatccgctatcaactttcggcctgctttaatgccagtagcctgtatggtatgaaatccatttaaaagagaaaaatatgacgatgccagaacgcaaaaattatccgcaactgggcgaagtaaaagcgccttatgtccacgcagtgaaacatggcgcgacgctgtatgtctctgggctgaccgctttcggtacggcggctcagcagggagatatggctgaacaggcagaagccatttttgatcaactcagagcggttgccgcagctgagcatacgtcgcttgcagcgctactgaaggtcacgatattcatcacctctttcacagagatcaccgcgctgcgggaagtgctttatcgcaactacggcgagcatctgcccgccagctcgctggtacaggtcagcggacttttctccactgacctgcgcatagagattgaagccatttttgccctctgagtagaaaacagcgacattcccgatgctagagctgcagatctgctgcggctgcaccccgcgccagataaccgatgcgatagacttcctgctcgccagcggggcgctggagtgacgcgttaacgtcgactccctgccagcggctcacatcccaggcgctgatccctgttgttaccggcagtgtcgtgaggtctgaatgcggtggaatcgtccagcggttcagcgttataaagcgggcgtcggccagatcagggatgtgggtctgcccctcaagcgccagccagctttcgatgatcggccagccaaaatccctgaccagtgtcgcaaagccaggactttgcaggaaacgctgcatgccactcgcctcccgccagaaatagagcggcgcataacggttttcattctgtccgtcatcatcacggcaggcgtagagatacgccttggccaccagccctggaaagccatcaagccgggctccgttcagactgatgcgctgctcgatgatgcccatgtcgtagtcagcgggcagggtaaaacggtagtgcatgataatcataacgcctcctgcgccagcatccggccgccgctaaagctccactcttcggtgctgttaaactgaataatgatcatcacgtcgtcaggatcgatcgccatctctgcctgaagcgtcgtacagagtgaatgataaaaccgctgcttctgttgccgggtttcgcggtcggcctgccgtcacctgaaacagcacgaaattatcgctgcgcccgccgctgagatagtgacgatcaaatacccgctgtccggcgggcagcatctcaatcacctgaaagcaatcatgctcaggaacgtcaaattccgcgaccagcgcctgctgaagcagcgtggaaatctgatgcagagccgcctcgctgtagccctgacgcagggtaattcgggtaaagggcatcagtgattatcctccagataacccagcgcggtgacggcggcgggccagcctgcgtaaaacgccagatgcgtgaagctctccaccagctcatcctgcgtcagtccattttgccgggcgaaatcgatgtgccacggcagctgctggacccgccccagcgcggttaacgttgccagcgtcagcaggctgcgttcacgcggtgacagcagttcgcgctgccagatatcgccaaacagcacctgctgtgtcagttcggccagttttggcgcgcgctgcgccagtgtttcccgatcaagcgattttttcattgcacactcctcagtggtgagacagagtgtcactcaggccttcaatcctgaaaatcaaattaatcagctcttaccatccataattacaggacaataatgaacaaggtaccggagtccctcgatatggatgcgctgcgcagtttcgtcgcgggcattgatgccggcagctttgccctggcggcacagcatctgtgtcggtctgcctcggccgtgagtgcgcagcttaagaaacttgagcagcaatgcggcacggcgctggtgatgaaaaaagggcgtcatgtgcagctgacccgcagcggtgaacagctgatgagttacgccagacgcctgctgtcgctgaacgatgagacattgcgggcagtgaaaggcgaagcgttacagggcgaaatacgcatcgggatgcaggaggattttggcgaggcgttgatgccggacattctcggcgcgttcaaccggcagcatccggaggtgatgctgaccgcacgcgtcgacagaaatctgccgctgcttacggcgctggcccgtcatgagctggacctggcgctgctgtggcaggcagagcagcaggctggcacgcagttaattggtcagtgtccgttagcctggatacagcatccggcgtttgatctggcgggatatctgcagcgcggcgagccgctgccgctggtggcattcgatgcgccgtgtgtcatgcgatcgcgcgccatcgaggcgctggataaggcaggtattccgtggcgggtggtgttcaccagccacagtcttagcgggatctgggcggcattacaggccgggctgggcatcaccctgcgcacccgcgcagggttgccggagacgctggtgattgaatcacaccggctgccaatgcccggctatctgggtatcgcgctcgcccgctcagatcagggtgacgatccggcgcgagcactcttgcagcatctgatcacgcaagccgccctgccctttattcagcgctgactcctgtctgaaatgcccgctgaaccagagacgaacagtattctgctgagatgtcgcggtcgccgaacagaatatgaaacatcaccggcgccacgaccacatcgatgatgcgatcaacgtcaaagcctgattcgccgcgtgcctcggcccgacttttcagtgtttcaagatgctgataggtaaacccacagcatttctggctcgccacttcagcctgacttcctatcacatcagccagaagctcacgaccgactttggacgacatctcttcagcatactgctggatgaacgcggtaagatcgccggccgtcgatccggtatcttccggttctgcaatgggccgcatccgtgccacggccacatccgccagcaactgggacagatcgccccagcgccgatagatcgtggaaggtgtcacacctgcctgttcggcgatcatcggcactgtaatagctgaacgatcaagcgtttcaagcaagcggttaacggtgttatgcacttccgcctgaatacgtgcgctgcgcccaccctgccgaatcatctccctcgccatcactttctcccgcttttatcagcctcaacgtcatggttaaagcaacgaagttgcattaacagatagcggcagtgtaccccatctcaggctgagcaggcgctaatgtgtgctatcgggcgattgagaatcaaggctgcagtttactcaggacagatttaaccggctcggcggtgagatgtgacgaacggttatctgatgcgcctatccataaaagactgactgccatgactgctgaaataaaaattgtacgaatatccataaagcctccccctgattaaggtggctaaagtaatccacacagcggagtattaatcgcgggataagagagggtttaaagggactttgcgcgaaaaggtggcgcagatttcgccacgcctgaatcacaaacgggaaagatcaaacttattcggtaacgatgttgccagccgcaagccagtcacgtcgtgtcagggtgtacatcaggctgggaggcaacccctcaggatcgtcgacctttttcaaaaaggtcaggcccgctttttccagtacccgccgcgaagccagatggttttcgcgcgtcacacccgtaatgatgctcagcccggcctcttcgaatccgtagcgaatggctctgcgggaaagctcggtggcatacccttttccccaggcagctggctcaaaccggtaaccgagattattcgtctgacgaccgtcaaactggcttctgaaaacaccgccaaaaccaataattttatccggatgggctttctcaaatatcgtccagtcgccaaaaccctgttcctgatagctctgtaatatgcgctctatggcctgaatggcatacgtttctgtcgggccatggacctcgcgggttaaatttatgcgtttcggggtcgccatagattctgaagaggtcgtcaagatcctcgcgaagagtatatctgtagagcagccgctctgattcccaaaccatcctgcgctccttttgggtgctgaataagcaatctttactctttatatcagcaacttctcctgtcaccaactctgttaatactcttaacgaacggtggctaatttcagtgcacaagccgcggttttcgtgctcatctgattgcagaaaatggacctctcatcagaggctgtcactacgttgtgttgtgcttctgatattggtaaagggtggaaagaggttgccgcccaggtaataagctgtttaagcggcgggaagacagattcacccggggcgattgccataaagggtggcgcacgggttctgaatacgctgcatgggtgttaaagtgctgcttaaactggcgcgtcgggtctgtgtagtctcaccttcagcgtcatgaggatctgaatagtgaaaggaaagtgcaaaaatggctgaacagagcagcattatcactgaacttaccgaacttgaaggtctttacggtacggtcgcccggccctctgtcgctaaagaaaccgatcatattcatcccgcctatcgtccgtttatcgccgcctcgccttttgtggcgctggcaacgtcggggcctgagggactggatgtttcaccgcgcggcgatccggccggatttatcgaaatcgaagatgacaagaccctgttattacccgacagacgcggcaataaccgcatcgacagcctgcgcaacattctgcatgacaatcgggtagcgctgctttttctcatccctggcattggcgagacgttgcgcgtgaacggcacggcagcaatcagcaccgacccggcgctgcttgagcgctttgccatcaacaatcagctgccaaaaaccgtattgcgcatcactgtggagagcgttttctttcagtgcagccgggcgattattcgctccggattatgggatgccgaaacgcagatctcacggcagtcgctgcccagcaccggttccatcctcaaacagattgcagagattgatggcgatgcctacgacaaagcgctgcctgagagattaaagaactcactttattaatcgccgttaagggcctggaggcttaacttcctccagcgtgctgatgagtgaagtacttatactttcggaacggagatcacagtgcgcctgcagtcacgcctctaagcgcaaactgcgatagcgttacgcaaagctctccagtatctgctttgcatgcaggtagtcgtaagaggtcacttcaattttattattactgagatcgctgaaatagacggacatcgacacgtcgtggtcactgacgctgaaagggattttattcttacggagtacaggcataagttcgttgaaagataatgctgccaccccgaaagccaccgtatggcctggtggctgagattttcgcaggaaaagagagagtgatgccctgttatttcttatgaccagcggcccaccctgttcaaaccagaagtacagggaagggtcgcgttcaaagcccaggatctcgttgtaccacttttctgcctgttcaatattttcaacgtagagatggatatgatcgatctcagctatcttcatcatctggctccctgattgttattaacagtgagactcgccgaaatattattgataaacaacccgcaaagcacataacaacacgtatcaggaaacggacagagaagagcgcaggaaagcggcccggagagacaaagcgcaggcgaagggagagcggatgtgagttagcataaacgagccccatttggggttgtaacgcttgcatcaggtcacacgatcacaatatggaccagacctttatgctttccaggaatttataattattaagttttaactttcagccagtgttgatttaccgcgggtcgataaggtctacgaccaaagacaatatttcatccataacatgtggctcaactgtggcggcatagcttgccctgcgcgcagtcaggtcaagcgagcgcacctgatagcacagcgccacgccggtcactttgccggtatctgtgctgttaccgtccagataaacggtcacgccctgtgagcgtgatgcgccgccgccacttgttaccggcacgcaaactgccgtttcccaaagccgcaaccaactcccgttgcgagataacaaggtaataatgcggccctttaaactctcgcccttcaaccggatcgccattaacgtgccagatttcgcctttctgcggcactctccttgaaaccatcagatatgctccctgccctgcgtcgcgtcgttcagcccgtccgcggcctcttcgttatactgttggatttcctgctgatcgataccggccagcaactgagcaactgtgcggcgaccgcgtggtacacgcgttaccggcacaatattcacggattcgccttctgcggtgacgtccagctcaatgccaacagtccagcccgctctggcagcaatctcgctggggatagtcagcacgaccgccccgccctgctgacgaagtcttgttgaagccatatctcctcccatgtgtgacttagtaacacaaaccttaccacagggtgacactaagtcacacagcaaaataggttaaagcaaagatattgcattaaggcacagatagccgtataccttattaaaagctaatactttgcattaaggtgatttcatgaaccccacattgacgcctcaggctgctgcccgcaccacgcttttcagttttaccggtgcggcgctgatctccgccaccagcagtgcgccaacgccgctctacccactttatcgcagcctgttccatttgacgccgaccatgctgacgctgatctttggtgcctatgctttcgcgttgctggccgcgctgctgacggtgggtaaagtgtccgactataccggccgccgtcccctgatgctgctggcgctggcgatcaatgcgatcgcgctggtgatctttatgactgccaactctgccaccaccttaatcgccgcccggctggtgcagggctttgctaccggtattgccttgccgacctttggtgccagcctgattgatgccagtaaaacccgtgggccactgctgaactcgttcaccgcctttctggggatgacgctgggcacgctggcgggcggcatactggtcacctttgcgccctttcccacggtgacgctctatgcgctgctgctgctcctgatgctggttgccatggcgctgttgccgctgataccagaaaccattgcgcctcagccgggtgttctggccgcactgcgacctcaggtcagcataccgcgacgcgcgctgggcccgctgttaatggtgacgccggttaacatcgcaacctggatgctgggcggattttacctttcactgatgccctcaatggtggcgaacgcaaccggcctgacatcgccttttatcggcggctcgattgtggcgacgctgatgctgagcgcaacggcagcagtatttctctttcgcccgttaccgcctgcgcgggcattagttatcggtacgctgatgctgatagtgggcgtcagcgtcactcttgcgggcctttctctgcacagcgtggcctggctctatctcggcactgccattgcgggtcagggatttggatcgattttctccagcgtgctgaagatcattatgcagttagctgaaagtcatgaacgcgccggactgttctccgcctttttgatcaaaagctatctcgcctttgccctgcctgcgattgccgccggaatggcagcgccccatatcgggctgaaccagaccgcctggttctatggcatgactattatcgtgctggcactggtgtcgctgctggcgatcagaggtcgcgctttagccggagcggccagttaataatcccgcccgacgcggccagatatctgccgcgtcatccacaaacggcaattttcacttacactcaacggattaatttcaggcgcagttgctgcgtaataccgtgagtatgatgtcgaaatcccaatctgatgcggttttagcccggttttcatccgccacacgacgctggttttctgccacctttgcagcacccacgccggtgcagcaggcggcatggcaggcgatagccagcggagaacatgcgctggtgatcgccccgaccggttcagggaagacgctggcggccttcctcaccgccatcgacacgctgtttcagttccgaaccacccagccctcacctgcacgtgaaacgaccactcgcattctctatatttcaccggttaaagcgctggccgcggacgtacagcgcaacctgaatctgccgctggcaggcgtttacgctgagcggcaggcgctgaatgagccagagatcacactgaatatcggaatgcgatccggcgatacgcccggtgcagagcgcgccaggctggtgcgccgccctcccgatatcctgatcaccacacccgaatcactgtttctgatgctgacctcaaaagcgcgaacgacgctgcagggcgtgaccacggtcatcgtcgatgaggtgcatgcggtggcgggatcgaagcggggttcccagctggcgctgagcctggagaggctggatgcgctgctgccacagcccgcccagcgtatcgggctttccgctacggtacgaccggttgagcgggtcgccgccttccttggcggctgtcagcccgttcaggtcgttaatccggccgccgatcggacgctgcacctgaccatcgaggttccggtcgaagatatgaccgatatcgccagccccgttgacctgaccggtgaagccacctctgccagcggttcgatctggccgcacattgaagcgcgcattctgcagcaggtcatgtcccatcgcgccacgctggtgtttgtgaattcgcgtggcctggcggaaaagctgactgcgcggctcaatgcgcgttatctggcgcagcagacaaccgctggcgaacgggatgcagaacgcgacgacagtgacgatcttattgcccgctcgcaccacgggtccgtctcgaaggagcagcgaggcgagattgaagccgaattgaagctgggcagactgcgctgcgtagtggcgacttccagtctggaacttggcattgatatggggccggtggatctggtgatccaggtgggcgcaccgctttcagtcgccagtgcactgcagcgcgtgggacgcgccgggcatcaggttggcggtgtatcaaccggcatcctgtttccgcgcacccgacgcgatctgctggattcggccgtcatattgcagtcaatgcgtgcgggccagctcgatgcgctggttccgccgcgtaacccgctcgatattctggcgcagcaaaccctggcggccgtcgcaatggatcccttacaggtcgatgattggtacgcgcaggtctgtcgggccgatccgtttcgcactctgtcgcgtcggctgtttgatgccacgctcgatatgctggcgggtaagtttccctcagacgcttttgctcagctgcggccgcagctggtgtgggatcgtcagagcggactgctgacgccgcgacccggcgctcagcatctggccgtgaccagcggaggcaccattcccgatcgcggcatgttcagcgtcattctgccggaaggcgaagagcaggctggctcacgtcgtgtcggcgaaactggatgaagagatggtctatgagtcgcggatcaatgacattattaccctgggcgcaacgtcgtggcggattcagcagattacccacgaccaggtactggtggtgcctgcgccaggccgtccggctcgtctgcctttctggcgcggagaaggtgtgggccgctcggccgattcgggtgccagcctcgggctgtttctgcgtcatctgagtgcggcttcaccggcggatgcgcaggagcagttgcgcacgctggggctggatgcccgcgcagtcacgaatctgctggctttgctggctgaacaacgcgccgcgaccggcgtactgccggacgatcgtacattgctgatcgaacgctgtcgtgacgaaatcggcgactggcgggtgatcctgcattcgccctggggaaagcgggtcaatgcgccctgggcgctggcgattgccgcccgaatccagcaacgcctgggcattgatgcttctgttgcggccagcgatgacggcattgtggcccgctttcccgccagcgagggagtgttacctggcgctgacctgtttatgttcgacgccgaccagttgacccgggaggtcactgagagtgtcggtcagtcggcgctgtttgccgcccgcttccgtgaatgtgcctcacgcgctctgctgctgccgaggcgtaatccgggcaaacgttcgccactctggcagcagcggctgcgcgccggtcagttgctggaagttgcacgacagtatgacgatttccccatccttatcgaagccgcacgcgaatgtctgcaggatgtctacgatctgcctgccctgcaccagctgatggaacagatggcacagggaaaggtaaagctggtcgaggtgacgaccgaacagccctccccttttgccgcgccgctgctgtttggctatgttgcagagtttatttacgccagcgacgccccccaggcagaacggcgcgcctcactgctggcgctcgacagtaatctgctgggtgagctgctcggccagaccagcaagcgtgatttactggcacctgacgtcgttgagcaggttgaacaggaactgcagcgcattgattcccgctatcaggcgcagcacaccgaaggcattatcgatctgctgcgcgatcttggcccgctcgcggttgccggtattgcggcacgtttcagtggcaacgcccagcagatcgcggaagccataacgcagttcgatgccgcgcagcgaatgatcccgatcacccttgccggtgaagagcgctgggcgatcattgaagatgcagcccgcctgcgcgatgcactggccgttgtactgcctgacgatctgcccgaaacatttctggagccgcaggccgatccgctacacgatctcattaatcgctacgcccgaacccataccctgttcactgcccgacagctggccacgtattttggtctgggtatcgccattgtgaatgaggtgctgctctccctgcatcagcagggcaacctgctcaatatgggttcgccagagggcgcatcggaaacggagtgggtttccacagagatcttcaaacggttacgcttacgttcactgcaatcagcacgtgaagcaacccggcctgttccacctgccgcctggatcaacctgctgctggagcgtcacggtgtgcttaacacgcagcgtgaagagcatcacggggttaacgggctgttgcgggtagttgagcaacttgcgggcgtgcagctaccggcctcgctgtgggagtcacaaatcctgcgcgccaggatagccgactatcagcccgcgatgctcgatgaactgttagccagtggcgaggttacctggtgcggacacaaagcgctgggtcagaatgatgggttgatctcgctgcacctcacggaatatgccgctgaaacactgccggtgattgacactacgcagcctctgacgccgattcagcaggcgactctcgacgcattgagccggggtggctcgtggtttgttcatgagatcatggcacagatggacgaggcagaaacgcaaaccaccgatatttatgctgccctgtggcaactggtgtggcagggctatgtcactgccgatagctggattgcggtgcgtgggctgctgaccacgccaggcgcgacccgttcacgtcccgcgcgtttccctgcgcacccgttttggtcagcgcttaaccccgggcgcactttctgcacgccgaccggcggtcaacacgctggctggtcgctggtcgcgggttaaccgacaggaggttgctcctgcccggctggccctgtcgctggtggaaaatcttctcgaccgttatggggtgatcagccggggtagcgcgatatcggagcagatcccgggaggattcccggcgttacagccggtattacgcagcatggaagatgccggacggctgctgcgtggccggtttgtcgctggtgcgggcggcgcgcagtttgccgaccataacaccattgagcggctgcgggagctggcagaaaagccgctgaccgcgacagaggctgtggcgctggccgcaccggacccggcaaatccgtttggcgcgttactgagctggccgctccacgccagcggcatccgcccgacacgccgtcaggggggccgcgtggtgattgcaggcggcgcgctggtgctttatctgacgcccggaggcaaagagttgctgacattcatcgacgatcccgcgctgcagcaggtcgcggtggcggcgctgggcctggcactgaagcgtgaaaagcccgcgagtttcacgcttgagaaggtagatggtgaaccggtttcgcggtccccgctgcttaacgcgttgcgacatgccggattttcacgggtgccacaggggtttagctggtatagctgagttgttttcgcgcccgtttttttcgcgcacaaagtcgataaatacctgaagcggggcggggatcaggcggcgatcgttgtaatagagccacggaccggagaaagtcagccaccagggttgcagcagcggttccagcctgccgctgtcaagggctggcctgagccactcgtcaaacagatatatcacgccgcttccggcgatggccgcctccaccgccagatccattgcgccaccgaccgaaaccaccagcggcccgctggtttcaacgctgatctcttcgccctcgtggctgaaggtccagtcagccatgatgccgctggcataacggccacgcagacagcgatgatggatcagatcgcgcggatgttccggtcggccatgttctgccagataagccggagaagccgccagcgcgaaccgttgctgtctggggccaatgggcatcgccaccatatcctgctccagccgctcatcataacgaatcccggcgtcacaaccgtcacgaaagacatcctgcacgctgctctccgccacaatttccagccggatgtcgggataacgcttcaaaaattccggcaccagcgcgggcagcaccagccgggttgcactgaccggcacattcagccgcagcgtgccaccaggggtgttacggtagcgattcaccgcatccagcgcggcgttaacttcattgatcgcgggcagcagacgttccatcagcgccctgcccgcttcggttaataccacggtgcgggtggtacggtgaaacagacgaatacccagctgttgttccgcccgtcgtaccgcatcgctcaggcgtgacgcattgctgccggtgacgcgtgccgcttcccgaaatcctcccgcttttgccaccgccaccacggcatccagcagcgccatatcgatcgccattgtgcatcaccccgtacagtctgtcctgatttcaccggatagttgcacagctgaatcaccgttacaattgatctacattcatgcaggaggttttcatgtcaaacaccaccatgacttttacgttaggcgatcgtgaagttaaccgtattggctacggcgcaatgcaactggccgggccgggcgtgttcggcccggtaaaagatgaagcccgggcaatccaggttttgcgcgccgctgccgcggcaggcgttaatcatatcgacaccagcgacttttatggcccgcacgaaaccaaccagctgattaaaaaggcgctacatccctatccgcaggatctctgcattgtaaccaaagtgggtgcccgacgcgacgccaaaggcggctggctggcggcgatggagccagaggcgctgacgcaggcagttgaagataacctgcgcaacctggggctggatgtgattgaggtggtgaacctgcgcagtatgttgcatccggccaggcccaaagaaggctctctgaagccacaactggaggcgctgctggcgttacaggcacgcggactgattcgccatattggactgagtaacgttaccgccacgcagatcgcagaagctcaggcgatgacgccgattgtctgcgtgcagaatatgtataacctggcgcatcgacaggatgatgagctggtggatcagctggcgcagcagggaattgcgtatgtgccgttcttcccgctgggcggcttctctccgttgcagtcggatcagcttaatgaagtggctgcatccctgaatgccacgccgatgcaggtcgcgctcgcgtggctgctgcggcgatcgccaaatattctgctgattccgggcacctcttccccggaacatcttaaagagaatcttaccagcggcagcctggaaactgtcggatgaggtgatggaaaagctgaacattatttaacatcaggcccgcacgatgcgggcctgatgctgtactgattcagaaactgctgaggcaggccgcaagttgcggcttgtcgctacaactgatgtggtgatcgattcggttaatcatataaggataaaacgggttagaggtggcgcgcataattgagtccagcccgacaatcagcactgcactctcgccgcgcagtgacaacgtcccaaaactgataccaaactcattcttctgcgcgggcgcactgccatataacccatcctcggccgggaacggaatcgcaacgtgcgacagcgagtagagacccgcaggataggcaattgccagcggctgaatccgttcctgcatctctcccacgggaacgctttttgtcaccatttccagcgaggtagcggaggcattggtgatcaccgtggatgagtaattccgacgcgccgcaggcaacagctgattaaccgcggtatatgaggagtggcggaataacggactgacgctgaccgcctgattgatatcgaacagcaccagttcgctgccgttcactggcagataattatagagcgagcggatgaccgaaggcgtactgacggtggaatccatgaccgactgaaaggttagcacgggcgggaaaccggagagctgctgattacgcgcatattgcaggatctctttctgcagcgcctgcgttagcaaataggtctgccgggcagcgtgaaccggaaaagagttgtatttaaacggattaaactccggcacgatattcagccaggccgttttcgaaaaggcagggaaaacagagggcaacccggcaacacctgcgaaccgggcaaaacgagtcacaccgatcatcggcgataacagaatcaattgctgcggacgacgcagcgtgtgatcgcccaggctgtcgagcgcatattttatcgccagcgccccgccgttcgagaaacccaccagatgcagcggcgtctgcgtgcccgccagccgggtcgcttcccgcaccgccaggcgtgtggcggccatccagtcctgcctgtcaacatcggtcagacccgcaggcaccgtaccgtgacccggtaaccgtatcgccactgccacataaccctgctgacggtaagcctctgccacatgccgcagactgtaaggactgtcggtcagtccatgtaacagcaccaccgcaccgcgcggcctgcccgtcggttgcagactataggaacggttccagtcctgcgcgaaatgccccggatagatcatgctgccagcatagtatcggttgagtggcgttttatcttccgcatccagccggttgctgacctgctgcttcatctcgtcgaacagatgattttcggccttgaggtagtcggcataggtcgcattatcaagctgttccactgtcagttcatgcgggacccaggtgtgccagcgatgtaactccggcccgcgctccgcttcatagattcgaataatcagtagcagcagtaacaatactccagacacaatcgcaagacgccagagcctgcgggtgacggttttccacctccgggtcataaatcctttcctgaaaaattaaaatgcatagcgaaaccacgcgaacagcacgttgccattattgtacgtgcccggaatataggtgaactgtacattcagcgccttataaccggcagagaacagcggcagaataatcggtagcggaatatagttaccaaaatcttcgcgtgcagtgataccggcggttaatcccgcgccaagacgaaagtcctgattcgaaccaggataccagcccttctcccagccataaccgacaatcggctgccactcattgtgtgagtctttgaaagccattgcataaagcgcgctccagttgccgctgtcgctgtagcgggaaatgcccagaccgcctccccagggattctcgttatagttatcggttttttctttgtcgtacataaagcgggcgtgccagctgataaatggcaggtagagatcggtatgctgaggcgcgttccaggtctgcgcaacatcgtcagtgaatccattccaccaggaggagattggtgtgttttcagcatgcaatggcgcagcagtcagcaatgcggcaaaaactgccgtggtggttgaaattttcatagtgcgtaccggtcagcgtgcggagcagatgaaaaatgagtatagcgcagagcctgaggcaatctttgtcagcggtcatgcttcgcttaaccggggatttctgaagacaataacgacagttcattaagtcagtttctggcgatttcagcctgaaatcgccagaactgtatggaaattaatcgagggaaaattgctgattacagtgaatgttgtctgatggtacttagtgaggataaggacggggaaatgcggtgcaacggttagtaagaagataaggaggtaacaagataaggcgataaggaggtaaaaccggattcagccggtgggctgaatccggtgggagactcaggaggcttcagcctcttttggcttttcaccaaacttctctttcatgtgtgactcaatctcttccaggcttttgccccgcgtctctggcaccatcgccatcacgaagatcagcgacccgacgttaatcgcggcaaagataaagaaggtggtgctgccggcatattccattatcggtggaaaaccaaaggcgactatcgcgttaaagatccactgtagtgagacagcgccgccggttaacacgccacgcaactgcatcgggaacagttccgacatcatcagccagtagaccggcgagatgcacatctgcatgcagaaacaggaacagcagaatacaggccagggcgaggtagctctgcatcaggctgggagcgataaaggtcatcacgctgcccagcataatctgcgaagctaccaccagacacaggccggtaatcagcatcgtccggcgcgggaagcgactaaccgcccagataccgacaatcgccgccaccactgagaccacgccgttaccgatggtcgcggcaatcgaggcgctggtgccaagtccggtctgtttaaggatgatcggggtgtaatacataaaaccattaaccccggtgaactgggcaacaaagcccagaccgacgccgataaccatcaggcgaatcacccacttctcacggatcagggttttcgcatccggtccacgttccgccgctctcgcctgcttcttcatctgcgccatctcatggcgcacttcacgcggcgtttcacgcagatacttcaggatctttttagcctctttcagacgcccttccgccaccagccagtgaggtgaggcgggaacgaagaacgtgccgataaacagcaaaagacccggcaccatggcaattgccagcatgtagcgccacaggtgctcatcatgtagcagatagctcagcagcgtactggcaacataagcaatgagctgtccggtaacgatcatcagctcattgcggctgaccagcggcgcacgcaggcgcggtccggcaatttcggcgataaacaccggcacggtagaggaaccgccaccgacagcaatccccagcaggaagcgcattgccaccatgacattgacagaaggcgccagcgctgttcccagtgaacccagcacaaaaataaccgccaggctgcgtagtgtaatacgccggccaaaccggtcagagaagaaaccactcaggaaagagcctatcgcggcaccgaacaccagcgaagaggctaccagcccttcagtgaatgaattcagtccaagtccaccctgatcgggtggtgaggtcatgtagggtaacgcacccgagattatcccggtgtcataaccaaaagccagcgcgcccatagtggcaaccagtaccactaaaaaaatacgctggcgtaccgtatccgcaggcgcgtgatcgcccgcttcaccagagtctggtgtattcgtactcataatatccctgccattaattagttaaacatccgtttgattaaatttcatacggaatagaaatggaacatatttaccgagtgggtaaagaagtgtagacggtatttaaaagttagctttagcaatgcgatttttataacagggatagttaaccggataaataaaccagcgcaataatgacgtcgtgaaagttattttaacattaggttaacactttcagttcctgctggatccagctcaggaaatgcgcgacgcggggaaactgggcaaatccacgcgggaagaccagatgatgggcgctgacgggcagactctcctgtttcggacaagactctgaccagttttccactgcgcagataatcctccgccagcaattcactttcaaatataagaccgtggcctaacatcgccgcctcaagactcatataagagcgatcaaagcgaaataaccactctttatctggctgaggtaattgctgagaagcaaaccactgcggccactgaataagcggcgactccgataatatcagcgcatgatgaattaaatcagcggcctgatgaacaggatgttttttcagatactcaggcgaggccagcaccgacattctttcgtggcggatcgttttaatctcgaatgagttccagtccgggaatccatggcgtatcgcaatatcaatattgtcgcggctgaaagataaattctcgtaagagcaggagagcgtgagctggaactcgggatagctgtcgcgaaatttatggatgcgcggcaacagccacagcagaccgaaactgggcgcgcagtggatcctgaggttgctgcgggctttctcgttactgatgcgtgcagtcgcctgcgtcagactcagcagtatcggaccaatctccctgaggtaatgctcacccgacagcgtcagcactacgccctttgccgaacgattaaacagaatacagcccaattcacgctccagttttgccagctgatgactggccgccgaaggcgtaatacttaattcctcggccgcacgcgcgacattaccaaaatgggccacctgctcaaaaacccgcagtgatttaatcgaaggtaagtgatcagactgcttttccatccgcctctccacactggaattttgtgatgtgtgcccatttttaaatcgcagaattgttaactgcatcaaaccaacaaattcattcagcatcaaatgaatttttttgcattgccaatattagccgctttatcaattctgatcgtgaccctgccggtagcgataccgaaccactaataattatttttctggagtggacaatgttactcgaaaacaaagttgcgattattacaggtgccgcctctcagcgcggcattggccgggctacagccgcctgttttgctcaacatggtgcgcgcgtggtggtgctcgatttagatctgcaggccgcccaggccagcgcacagtcttgtggtgaggggcatctcggcctggccaccgatgtgaccgatcccctctctgttcgtcgtgccatcgaccaggttcttgagcacttcggccgtattgatgtgctggtcaacaatgcaggtattactcagccggttaaaacactggaaatcggcatcgaggattacaaccgtattcttgatgtcaatctgcgcggcacgctgctgatgtctcaggcggtgatccccaccatgcagcagcagaaaggcggcagcatcatctgcctgtcctcggtctcagcacagcgcggcggcgggattttcggcggcccgcactacagtgccgctaaagcgggcgtttctgggcctgactaaagcgatggcgcgcgaatttggccctgaccagatacgcattaatgccctgacgcccggtctgatccagacggacatcactggtggcctgttacaggatgaacgccgccacgccattctcgacggaattccgctcggccgccttgggtccgccagtgacgtcgccaacgctgcgctgtttctcgccagcgatctctccggttatctcaccggcatcacgctggatgtgaacggcggcatgctgatccattaaatagcgcccttccctgcccgcacgcctggcgggctaacctcgggagtgaacaccatgaccacgcttaatctgagcgcagcctctgctgcgcgcgatatcacctatcgcaaaattgcctggcgcctgatgccctggctgatgctctgttatctctgcgcctatcttgatcgcgtcaatgtgggcttcgctaaattacagatgatggatgatttgtcactcagcgaaaccgtgtatggactgggtgccgggatcttttttatcggctacttcttctttgaggtgccgagtaacctgatcctgcaccgtgtcggcgcacgccgctggattgcccgcattatgatcacatggggaatcatctcggccctgttcgcctttgtagaaaccgcatggcagttctacctgctgcgctttctgctcggcgtcgccgaggccggtcttgcgccaggtttactgctctacctgacctactggtttccatcacaccgtcgcgcgcgtatgaccgtgctctggtttgtcgccattccactttcagggatgattggcggcccgctctcaggctggattatggcgacctttgcaggctttcacggatgggcaggctggcagtggatgtttatgctggaagctatccccactcttattatgggattagtggtactgctggttctgaaggatcgcgttgaacaggcagagtggctggatgaagatgagaaacgccgcgtgcgtgccgatctggacgaggataatcagcagaaagcctgtcatggcacggtaaaagcctttgtcgccgaccgtcgtctgtggctgctggcgctgatctacttctgtgtggtgatgggtcagtacgccctgacgttctggttaccgacgctggtgagaaactcaggcgtcagtgagccgctgcatattgggctgctgaccagtctgccttacctctgcgccattatctttatgctgctggccgggcgcagtggcgaccgctatcgtgaacgccgctggcatctgattgttccgatgctgatcggactcaccggactgacgctggcaactctgctgagccatagcgtctccctgtcactgctctccctttgtattgccgctgcgggcattctttccgcctcatcgctgtttctggatgttgccgaccaatctgttaggtggcgtctctgccgccgcaggcatcgccgccgtgaactgcattgctaatctggccggttttttctcaccgtggctgataggcaccatcaccaccgcaaccggtacgcccgcttccggaatgtattttattgctgccgtcctgctgggtggcgcgctatgcgtgctgcgcatccgggcagcggacgttaatcgttaatcaggaggtaatatgactgactctcgtcacgcttcacacgtgctctcattgcagcaacgagccaccaatattcgccgccatgccttattaatggggcagattcaggggcagggatatatcggtcaggcgctgggtgccgccgatttgcttgctgtcagctatttccacgccatgaattatcggccggatcaacctgagtgggaagagcgcgatcgcttctatctgtcgattggccattacgctatcgccctttacgccgccttgctggaagcaggcgtgatacctgaagaagaaagggaaacttatgggactgatgagagccgcttgccgatgtccggcatggctgcctataccccaggcatggaaattaccggcggttcactgggtcatggattaggtattgccgtgggtgcctgtcttgggctgaagcagaaaggctcgcaggcacgagtctataacctgctttcagatggtgaactgaatgaaggctctacctgggaagcggcaatgtccgcctcacactggcaacttgataacctgatcgcccttatcgacgtcaacaatcagcaggctgacggccatagcagtgagattctcgcttttgaacccattgtggatcgctggcaggcttttggctggtacacccagcgggttgatggcaacgatatctctgctttgcaggccgcctttgatgcggctcgcagctggcccgaaccccagccgcgcgtcatcatttgcgatacccgaatgggcaaaggggtgccgtttctggaaagtcgtgagaaaacccactttattcgggtcgatgccgatgagtgggacaaagccctgacagcacttgagcaaggagtctgagatgagttcacaaccgcaaaaaaaacgtctgaccacatccgccatgatcgcctcgatcgccgctgaaggccagcccacggtttcagctccttttggacatgccctggtctctctggcagagcagcgctcagatgtggtggggctgacggctgatttaagtaaatacaccgatctgcacctgtttcgcagaggcttttccgaaacgcttttatcagatgggcatggcggaacagttactgatgagcgccgcagcaggtatggcgcgtgaaggctttatgccttttgtcaccacttatgccgtctttgcttcccgccgcgcttatgattttatctgcatggccatcgccgaagagaatctgaacgttaaaatcgcctgcgcactgccgggcctgaccaccggttatggaccgagtcatcaggcgactgatgacctggcaatcttccgtggcatgccgaacctgactatcatcgatccctgcgatgcactggagattagccaggtgataccggctatcgctgaacatcagggtccggtctatttgcgcctgctgcgcggtaaggttccgctggtgctggataaatatgactatcgctatcagcacggtaaggctcagcgcctgcgcggcggtaagcatgccgttattatcagcagcggattgatgaccatgcgggcgcttgaggccgctgaagcgctggagaagcaggggattgaggtcggtgtggttcattcacccatgattaagcctctggatgaagagaccatcctgcgtgaggcgggggtagcactgcatcataaccagctggttatcaccgctgaaaatcattcgataaccggtggattaggcgaagctattgccggcctgttaatgcgaaaccatgtgacaccgcgctttaaacagattgcgctgccggatgctttccttgcagcaggcgcactaccgacgctgcatgaccgttatggcatctcaactgatgccatggttaagcaaatcaccgcctggcttgaagcctgattcatatcaaaaccgggcctggcccggttttcttctgcataggttcggttctgccgtggaagatcatcattgcattacgtcacttcacatcggtctgattactgattgcagtggtcagcactctttgcgcatcagcaattacgctctatgctgataacagccactgataacccggttcaatgccatacagacgttatttctcgcaattcactgtaaacagcagtgcagtgagccatcgtcttttatcaggtaggccgataggggctcttcgtccataagctgccgatttcacctgctttacccaatacagtgaatctgatgccatgcaactacctttccgctatgaacagactatgacaatctttttccgctgatcaggttttaatggagttccctgccaaagctgcatcttgtatcgcacctcttcaaaaaaaatcttatcacgcagaaaaagttatccactttttctgtggataagtgagggatagtttctgagtatcttttttcactctctgttcaggactttactgctctcaagatacgcctcttttctgatcttatccgttcgccctcaggcctgaaacgagggagcttttagctgcaagcatggcgatttcaggctgaaattcttgcatcttttataataaaaacaaacagttaatcacgaaatatcgctggcgggctaatgattggagaaaggccaggcagagggtttagcggagtgtgtgaagccggtacgctgttaatgaggttcagtgggggttgattggtcactaatgaaccagccccggaaaatcattacttgcaatattctgaccgtcggatgcgcgctggcggcgatgagatttatcaacgaaagcatcagacgaaaaacgttatctctgtttatagtggcctgtgcggtttggtggcggcttcggtatctggcgaaagagttcagcgaagtggcgatttcatgcagtttttcagcaagaaacaatagattaatttattatatttcaatagcttaaccatgaattcacacttaaaaatctggcgatttcagcctgaaatttgggtgtcagccatctctattaacgccgattacctaaaaaatcaaaaaaaaagccagcgtctatcgctggctgatttgagtgcagatacgttaacggttgagatattttttcagggtctccgtaataactttatccagctcttcctgcaactctttcgactgccggttaaattcataactgaacatccgcccgcgtacctttttacgggcgaagcgatctttatccgcaaaagaccagagcgcagtcgcctgggttttatctttctccggttctttgatcagagtctggctgccctgtcgaatcagacgcaggatatgatttttaagctcgtcctcggccagaccttcacgggcacagaccacatcaatttcccttgaaatggatttgatcagagcttcaacgctttgcccggactcactcaacttgtcagctgcctgtaacaacgctttatagtcgggataggtcagctcggcgtgattaggaaaaagtgaaatcaaatctgacggaacgctggcggcttgcagggcacgcgtcactttagcctgggacaaaccctgattttcagcaatctccttctgtgacaaaccgccatctttaagtgttaacagacgcatccccacttcgcgcagattgtgttcccgtgccgtctgaatatcctgcgccagtcggcgggcttcatcagcggtgatggccgcgtcagtgatcagcacgtccaggccggttttgcagtagagcgcggctgcccgacgacgtgagccatccaggatttcgatgcggtcatcgcgcatcacgccgatagcgggaaagaactgctgcagcttaatggtccggataatgtcgcgcagcgaatcaggtgtcaggcctgcctgatcgcgaccgttggtttccattgtgacaaacgttttgctttcaacgtcgctggcggcaatgcgttcaaaacgaaacaacgcgcgcttgcccgttgccagaacgaatgtctggttgtgctggctgtctggcgtgtcattttccagtggagtctggctgaaggttctgccaatcgtaattctttttgcgctcatacaaacctcagttcaggcgaataaattcgatacggtcgaagacggctttagcaaagtcttctgcggcggatcgtgcattcttcaacgcttcgctgctgccgacgtaggtcgaaggattggcggagataaccgtatcaaaggattcgccacaacgttcgaaaccatcaaggcggggaagggcagcatcaagcatgtcgccaccaaaaatctcttttgccaggctgtgacagagtttgtggtctgctttattggagagcttcgacatgaagccaatattgccctgcagccgacaggtcgcgccggagtcttcgataatcgcaatcagttccggaagacgtgtcaggtattttaatgtcgagtgaaagtctacctgagccggtggcaccggagtcatcagaagatctgacgcagcaatcgcattcttcaggaaggcatcaagatgcgggccgctgtcgataaagataaagtcataatcttttttcagtttggcaataacgttgtcatacaacacggcgtgaacgttctgttgcggaagatgctcagcacaaagctgatcccagcttgaggcgataaaggcgtcatcaatcgatgctggcagcacatccacacccggaatgatcgacggaacgataaactcgttgaccagctcatctcgtgagacattctgcagcattgcctgcgccgcagtcgcttccaccagcccgacggagcgctcgtggttcagaaacatggttgctgaggactgcggatcaaggtcgataaccaggatgcgcaaatcttcaaaaagcagatggggatgtgcgcgcaacgcatgtgccagcgagacggttgaaaccgttttagagacaccgcccttcagattaccgacaaacagggtgtaagcgtcactatggcgatcgcgatacttcggcacgccacgatgatgatagatatcgataatattctgaatcgacatagcatatttaacggaagaaccggccgcacgtttatcaaattgataaccgctttcttccatctcattgactgcgtaatccacactggctcgggtcagtttgggcaactttgccagcgccgctttggcatagacctgatagtaagtattttcatgcagttcctgcttttgcgcctgaatttgctcggtgaggcttagcagcatgcgttctgaacgctgcgcaaccttcatcacctgcttgtcatcattagccatagttgctccaaacatgtaggatttatgactttatacagaaatcctgcacgtgaggcaataaattatcttctcaacataatctccgtttttatgtaaccacacaggttttggtgagcttcatcacattatttcatctggccgaatatacttttgcaggttaattgcggttagcattcactgtaatcagtagaacattcactgtagtgagcaaacaggtttaaaaaatcatcagacaaaccgggtacagtgagcgtgaaaggggaaaacacagaagacgaaccttgagatcaaacgttcactgtagtcagtaaagcttgtgtctctttcggtgacgttatggagcaggcgaaagagcgatggatacattgataaatggatttcaggcagtgactgcagcttgcagtgctgatctttgccactgcatcacttcaacattcactatagtcagtagcgttttacgtgttcagctctgtgaagagcaacgttcactgtaatcagtaaacttgccgatcaggagccagaagagggagcagggcagagtaaacgttcactgtagtcagtaaggatgggttgaaaaatcctcagcggatgataaaagcatcggaatctggagagggaatatacaccggcaacgtcacaaccgactctggtctgcgatacagaagcgtaaagcccataaacgttcactgtaatcagtaaatccagaaagcagtaaacattcactatagtcagtaacatcacaaacagaagaggcattagaaggagaacaaccgcgcaaacattcactgtagtcagtagtcagcagtaagtagacagaagcgattctgttctgaatcagggcgtgccgacggggtcgtaatatgagtcagtagatagcagtaagtagacagaggcgattctgtttctgcatcagtgtgtgccgacttggtcgtgagtcatgaagtgaccagaccttgcgagcaacggcttcttctgtcgcccttcagccagtcatgcaccagccccgtatcgtatacatcagcaatgccgtcagcaggttcactttaacgttcactgtaatcagtagaatgcacgatgccttcaggtacaccgcagcaaacattcactgtaatcagcagaacgtttactgtaatcagtacaagattagcatctcgccatggcagttatgactcgcttcagaccggacatctggcaacaacgttcactgtaatcagtagcgattcggaaagccgtttaagagattcaatggtgaggcgagggtagtgcccatcggcaaacattcactgtaatcagtaatagtgtcacgctgctctctctggttacgtgtgtcattcaggtcatacgtatcatgtgaatcacgctgagcagacccctcatggtaaaccgcatccaaccctgatttgctggccagtcggtaatgctctttgaaaacagggcagagcaaaggcattcactgtagtcagtaaaaaggattcactgtaatcagcagagaaaggcttagccaaccgaagtcagggcattcactgtaatcagtaaacacagtataagtgagtgctaaccaatatgagagtaagtactaacttacttataagctcttgttatcacgcacaatgaaggggaacggggtctgaacacacttttgcccggcggcccgtatactgattacagtgaacgttactgatcacagtgaatccctggggagtactgattacagtgaatgaagagtggatggcgcaatgtcaccggtaacgcagaaagtgacactgccacgcaggaatactgattacagtgaacatgaggagttaatcatcaaactcgatctcatccagcgaatcgatgctctccagattactgatgccatcaagcttaggcgtacggctgtggataataaaaaagactgagcggccacgcttcacttctgagtaatccagataaccgatctctttcagctgctccatcgcgcgccgcacgacatggttctgcgtggtggtcttagagccgaggtttcaggcgcatacgcaggcgtgcaagcgagataggcgctggattggttggcaggctttccaggaaagtgtaaagcgcctgcgcagactctttacgcttcagacgggatatcgcacggagctgaagcaggaccttgtggtcgaagttatagagttcgaacagcttggggtcggcctggatgcgcacaatatctttttcgcgatcgtaataagcagactgaacaaggtgggtgtgataggccttgccgttgccttcaaaagagagcgtattggtcgcgatacggcgcagagaggcatcaagacgcttgcgcagggcagctgaagagttggcagagggaatgccacacatcttcacaaaatcgataaacggcagcgtgacggtatcgcctttggtcggatagcgggaaaaagattgaataatacccgcccaggttttgaaatcgttatccatatccagccgcgcgccggtaatggtaatcttttcgtagccttccgctttcaccagcgtcagattcttcagctctttcgtcgcatccgttgatgccatagcaccggatttaccgcgtgcagtagatttcagcgtcggtacgaacagcccaagacgcattaaagcgacaggctgaacggtattattcttgttgggatgaagctgaataacttcaccgctgttttttgtcactgacagaaaaggttcaagtaacgctttgttttcgttgtctttatctgccatggcgtaagatcttcattctgtggatgaaagggatcgttttctgactacagtgaacattagcactgtttacagtgaacattctacctggtacagtgaataaagtactgattacagtgaacactttactgattatagtgaacgcgatcaccctttcagcccttgtggggtgcgacctgcgacgatcggggatctcttaggatctctatatgatctattaaggatcgtttattaggatctggtcactgtataagtggaaaacttaaggcgtaacatcattttcagacgtgttgaccaccagcaaaaactggcccgcaatctgcccactgcctgaccgactaataggtcatagccgcattcattctcaatcgataaacaacttcctcactattattcatttttcatcatcaactacagcgcgtatcgtctctccatcactgacagaatgaggaaaacggcaccatgactgaacatgccttatcacgtaaccctacaactggtgaaattctggcacgctatcctttgcagaacagtgcagagctggaacagacactgactgaaagcgcatctgcttttgcagcatggaaacagagcaccatgacggaccgcattcgcgtattgcgtcagcttggcgaacagatccgtctgcgtgagcaggatctttcccgcatgatcaccctggagatgggtaaacccattgcacaggcacgcgctgaagttctgaaatgcgctaacttatgcgactggtatgcggaacatggccctgcaatgctggccgatcagcctacgcagattgccgatgcgtggcagcgattccgtcctatcggggtgatcctggctgtaatgccatggaatttccccttgtggcaggttctgcggggcgcagtgagtatgttgctggcaggcaacacctatctgctcaaacacgcgcctaacgtcatgggaagcgccacactgatggctgagctgttcaggtcaaccgatctgcctgctggcggctttaacctgatcaacgttgacaacgatggtgtctccgtagccatcaaagatgaccgcattgccgccgttgccgttaccggaagtgtccgggctggcgccgcgatcgctgcacaggcgggcgcagcacttaagaaaaccgtgctggaactgggtggatccgatccctttatcgtgctggcggatgccgatcttgatgaagcggttaaatcagccgttattggacgtttccagaataccgggcaggtgtgtatggctgccaaacgctttattgtggaagctccgatcgctgaagaatttgaaaaacgcttcactgccgcggtccaggcactcaccatgggcgatccgctggatgaaaataccttcctgggcccgatggcacgcgccgatctgcgtgacgaaactggatggacaggtaaaggccacgctgcgtgaaggtgcacgtctggtactgggcggcgagaaagtggccgggcagggtaactactacgcgccgaccattctcgctgatgtcaccagcgacatgaccgcgttcaagcaggagctgtttggcccggtagccgctattgcggtcgccagggatccacaacatgcgctggagatcgccaacgacagcgaatttggcctcagcgccaccgtctggagcggtaatgaagagattgccgatcgtctggcgctccagctggaagtcggtgctgtgtttattaatggcaacggcgcgtccgatccgcgcgttaccatcggtggtgtgaagaaaagcggctacggccgtgagctgtcgcactttggtgtgcacgaattctgtaacgtgcagaccgtgtggaagaatcgtcgctagtgtttactgtgccgacggaagataagcgggcgctgttttagcgactgcactgagcggacgcagcaaccgatgcggtgcaaacgcactcagcattggtgacgctgtgccgctcagcatctcctcagccaccagcctgcccagcaatggggcaagtgtcatgccgctatggctgaccatcagataaacgcgtgctgactcgctgatgtagcctaatgccggcaagccatctgacggacgcgaccgctgtcctgtttcaatccgctcaattctcgcgccttccgtatttctaaacagccgccgcaatcgacgcagcatctctttgccaatcagtccatccggcgagaccggccgcgccgaatcggcatgctgatccagatccagcgcctgcagcatcaggcggccgccaccatccggccgcacattcagttccggggtaatcagattgcatttaagtgggatcggcagaggctgggtctgcgccagaaaactgcaggcaacaggatcggcgcggttcgcatcggtcatcgccagttcaagcccgcactggcttatcagttccggtgcccagcggccggtcgccagcaccagctgatcgccgcgccattcatccccactggccagcgtaagatggacatcctgcgccgattcagtgagcgtcgtcacttcattgttgcagaccagctgcccgccactggtacgcaggtctgccagcagagaggcgataaacaggctcggataaagcagacactccgacgggaaagaccaggcgtgctgaacgcggggatcgagccgcaactcaggcattgcacccagaagtgcggcgcggctacgtttctctacggggtaatcgagcgtcgtaagctttgctgcgcgctgcgccagctggcgcatggatgattcatcggctgcccactccagcgtgccggtttccagcagccatcggggcgatgcaggatggctggcctgccagcgcttatgctcgtctatcgcatgggcattaagatcatggtagctggtgggttctttgccgttggcattgacccaggcatagctgatctgactggttccgctgccaggatagtttttatcgaagacggtgacctgtgcgccccgtcgcgacaatgactgcgcgacggctaaacccagcacgcctgcaccgattacggcaatacgttgtggcatatctggtctctcctgaacagggattagtggaaaactgctacccgccggttcgtttactattgcgaagtcaaagaagtacgtcaaccgcggcgtcaggcggtggtttcatcgaaccacgcgggcaccggatcggccagagtgatccagtgttcaggccccgcagccatctcctgtggtgtcagcagcgcatgatccagcgcggcacggacgctcttctcgtccatctcaatgccgataaagaccagctcctggcgcgcatcgccggtaccttcctgccactgttcagcgataaaattgagcgaatccgcatcctgtggccattcagttcgcggcacgctgacccaccagcgccccgcataaccctgacgtgccaccgcgcccgcctgtgaccacatcgcggcatattccggccgactggccagccagaagtagcctttagagcggataacgccgtcaagctggtggtttactgcatgccaaaaacgctgcggatggaacggacgacgggcgcgatagacaaagttacgaatgccatactcctccgattccggctgatgctcaccgcgcagggtctgcagccagccgggtgcctgcgctgcccggtcaaaatcaaaccggccggtattcagcaggcagtccagcggaaacctgcccaaactcactgttcacaataagcgcgtgcggattaagcgcctgcagtatgcccttcaactggtgcagctgcgccgggctgagcaggtccgttttgttcagcaccagcaaatcacaaaactcaatctgatccaccagcagatcaaccactgagcgctcatcctgcgcgcccagcgattcgccacgtgactgcagatcatcggctgaacgataatcgcgcaggaagttaaagccatcgaccacggtgatcatactgtccagccgggcataggctgacagactttcacccgcttcatcttcaaacgtaaaggtttcggcaaccggcagcggttcagaaatgccggtagactcaatcaccagttgatcaaaacgcccggcctgagccagacgttttacctccagcagcagatcttcacgcaacgtgcagcagatgcagccgttactcatttcgaccagcttttcatcggtgcgggagagctgcgcgccgccatcgcgcaccagcgcagcgtcaatattaatttcagacatatcattgacgatcaccgcgatccgccgtccttcgcggttgttcagaatatgattaagcagggtagttttaccggcaccgagaaagccggagagaacggcaaccggcagacggggatcgtcggatgtcagagcagagagtgtcatgatgttacctgtaagaacgggattatagatacgttataacataacattggtgagtttgttttcaacccggatttgtgtttttgtttcgggtatcaatgagcgtttaaaagggagtggaaatgcaacaactcacgcttgtcccgcgtctgatgccagccgtcaggtccggagagaaaacctcgacgattcgctggcaggagggcgatatcactatgggtccgctgagactggtgaatcagcacgatgaaacggacgcggtaatcgtgtgggtgaagcaggtcgacacgctgcgcttaagcgaagtcgccgcgacacaggggaaacaggaggaatggcctgatgaggtgctgctggaagggatgcgcgagcactatccggagatcaggctgagcagtgaggtgcagctaatcactcaccttacgcccgcagaaaccctgcagaagctcactaaacagtgatcagctgtgctcaatcaccagcagcgccatcgtatcggcttccagcgcccgaaagatatgcagctcatcgcccggataggtaatgtaatcccccacatccagctccaccgcactgtcgaccgggcccaccagcgcacgccctttagcgataataatatgctcaatggtattggggatatggggctgggaaatgcgttcgctgccgggctgaacttccagcagatagatatcacgccgaacgccgggcgggcaggaggccagcaaaacggcctgataatcggcaagatcggcggtaaccgtcaggccctgtccacgccgaatcacctgcagacgacgcgcatccggctccagcagacgtgaaaatggaatgttcagtgttacgcaaagcgaccacagggtttcaatgcccggattgccattacccgcttccagctgtgatagcgtagatttggcgatccctgcgcggcgcgccacttcagccagtgaaagaccggctcgctgacgtttcacgtactaaggcattggcaataatgctgataggggtattcaaacgcactcctgataacctgaatgttttttatatcgaacataacgttcatcttgtaaaacgctttcgcagtgttcattatatcggattatatgttcattatgagacagagtgatgctttttccgcaaatgcagttgctggacaaaggggtgatcaaagcgatttttctggtctgcctggctgatggaattgttggtttatcctatggctcgctggcgtcggccgacgggtttccgctctgggtgccgctggcgctctcaacgctggtgctggcgggggcgtcggagttcctgtttatcggcattgtggccggtggcggcagtccatttaccgccgccgcagcgggcctgctggtaaacgcacgtcatttgccgtttggcatcgcggtcaaggatctggtggggcagggtccgtcaggctggctgggctgtcacatcatgaacgatgaaagtgtggtgtttgggatctctcagccgcaactggcgcagcgccgcagtgcttactggctgtgcggtatcggtatcggcttgatatggccggtcagcgtcatgatcggggcagcaatcgggcagtttattcctgatgtctcggtgatcggactggatgcggtgtttccggcgatcctgattgctctgatcttcccggcgctgcgccagcgacgcacccggatccccgcgaccgtcggcgcgctgctctccttgctggcgacgccactggttccggcgggcatgccggtgctgttttcactgctgggcctgctgacatggagatcgcgcaaatgacacatcagggaatgattatcgccgggattgccctgctggctgccggaacctatctgatgcggtttgcaggcgtcaggctgggaaaccgtctgccaatcagcgagtgcacccagcagatgctctccgacgccgccacgatattgttgctggcggtagcggccaccaccacgctgtttgaaggccagcattttgccggtgtggcacgggtggcgggcgtgggctttgccctgttgctggcgtggcgtcgggcgccgctgattatgattattctgggggcggcggcgatgacggcactattgcgtcttctcggcgtgccctgaggatgtcattaaccccggcaaaagcggggatgttatcgcagtgaaaatttgtcaggatggcacactctcaggcgtgattagcccgataaccttgcagggattgctgaatgaacactatccgtacctgtttcctcctgatgctgctgaccgtgatgacagccggtttaaccgccgtttccggccattgcccgacccgatatgcgtccgctgggtaagaacatcgccgaaacaggctccgcctggtatcgcttccagagtaaaaagtttgtctcacaggatggggaacggcactatcgggtgtggcttgctatccccaaaagcgatgcgccgccaggcggctatccggtgctctggctactggatggcaatgcggcgatggcacatttgacagaacctctgcttaaaaagctgagcagcggcacgccgccagtgctggtcgcggtgggttacgacacccatttgccctttgatgtggtggcgcgtaattacgactacaccccacccaatgatgcgcctgatactctggtcactcagcctcatggccgcaaaggcggaggcagccatcagtttcgtcagctgctgctgaacacaattgtcccgtgggcagaacgccttgcgcccagtaatccgcagcggcgtgcgctctgggggcactcctacggcggactgttcgtgctggataccttcttgcatgccgcctggttcagccattacttttcggctgctccctcgctgagctggaatcatcagcgcattcttaccctggcccgacgcgccgacgccggaccgcttaaacatttgtcgctctatctgatggagggcgatggcatcaccgaacgccgaaccggccactctgacgatcttcagcaggaagagcgtgcgcttaccgacatcctgcgcccgagcggtgccagactgattcttacgcgttatcccggtcagagtcacggccagatattaccctcatcgctggtggatacgctggaaatagtttccggtagccgggattgatatctgaccgggcatcgcggcatgatggcgtttcatcacctgcccggagttcacgcatgaatcgtccgctacagattggtcttttactgttccctgatgtcactcagctcgacttaaccggcccgtgggaggtgtttgcgcgcacgcctggtgtcgaatgccatctcatctggaaagatcttcatccggtgcgttccgatcgcggcctgtcgatattgccgactacttcgtttgcagattgcccgccactggatgtgatctgtgtgcctggcgggccgggacagatcgccctgatgtcggatgacgtcacgctgaatttccttcgccaggaggccgatcaggcgaagtgggttacgtcggtctgtaccggttcgctggtgctgggggccgccggactgctaaagggatattgtgctacctcgcactggagttccatcgatcagctggcactgctgggcgcggagccggtcagtcaacgggtggtgcgcgaccgcaatcgtatcagtggcgcaggcgtgacctctggcatcgattttgccctgacgctggtggccgaaattgcgggtgacgcggtggcgaaagcggttcagctgcagatggaatatgatcccgaaccgccgtttaccagcggttcaccgcataccgcaccgccacaggaagtggagcaggcacgggctaaaatggctgagtttcttgccactcgtcgcgcggcaaccgaacgagccgctctgcgactacaggctgattagcttactgacgccggggatgcgcaacagcagcagtgatagcgccattgagaagattaacgtcagggcgatgatcagcagtttatcgcccagcgtctggatgcggattgccgccgccagcaggccaaaaatcagatagtgcaggatatagacgccggtcatggtcttccccagggtcgtcagaaacggcgtcagccactggactttttccggcaggcgaatggcgttaatgctgatcacaatcagcaccaccagcagataaacctgcgagcccgtcagcaccacatcgttatgggtcgccagaaagcgcgcaagaaagtaatgacgctcatacagccaggtaaagagataaaccgcgggcagcagcagcaggctgatctttatcactctgggtgatgtcagcaactgcatcacgcgcggcgcggccatcagccgacctgtgaggtagtagagcacccaggtccagattcggtattgcggcagcagcgaaaaggcccgctggcccgggtagaggctggcgagcaggtcataggcaaaagctaacaccagcagcagtaaaatccccgatgccatcagcccaggccgctgaatgagtcggtcaatcagcggatgcgacacataaatcacaatcagcgcaattacaaaccacggctgaatcagatagcccttatgatgcatcccggcaaaccagaaaaagctgaaccagaagataaaaatcagcagaatgcggcgaattttgccgagctgccacgcgggtgtatgcagctcaccggcgtcgatatagccgctgagcagaaaatagagcggcgtggcgatcgtcgaaacaaaactcagcacgttcagcgtcagattaatgtcgtaatggtagctgtcgtagctctggtaaagcgtgaaaaacgagacggcggtgatacaggccagcgtcttcagcattgccagtccgctcttattcaccgtgcgcctcccgaccatggaagcaacgatagatgaccggcagcaccagcagggtcaatactgtcgcgaacccgaggccaaaaataatgaccaccgccatgctctggaaaaagacgtcgcgcagcagcggcagcaggcccagcaccgtggtgaaggcggtcagcagaataggacgcagacgtgaggtcgccgcatcaataatcgccagctgcagcaatttctcctgccggaacagcctgatctcctcaatcagcacgatcccgttacggatcagcatgcccgacaggctcagcagcccaatcagcgccataaagccaaacggaataccggtgaacaaaaagccacaggtgacgccaatcagcgccagcggcacggtgatccagatagcgactgcgtcgcgcagcgagttaaacatcagcacggtaatgatgaacatcgccaggaatcccaccggcagcgaactcagcagcccgctctgtgcttcacgtgaactctccagctcacctccccattcaagccggtagcccgccgggagtttaagctggtcgatctgtggctgaacccgcgccaccacttgtgcggaggttaaccctgaagcgggatcgggatcggtctgcaccgtcagcacgcgcgtacgatcgcggcgcataatcagcggattctcccactccagccggaagtcggaaatcacattgctcagtggcacaaagtgctgcagggccgcactccacagctgaatattctcgatgtgatcgacactctgccgctcttcatcagccggatagagcatcaccggcatcagccgcgaaaccgtcacggaaaatgcccaccgcgtcaccgctgaaattcattctcagcgcctgatcgatgtcacgtttatcgatacccagttcctgaccacgcagcgccgaatagaccgggcggatcactttgctgcgctcctgccagtcattgcgcaccggaaacgttgagccatccgccaggaaaatggcatccagctggctgccgatgtggcgcagcacttcgggatcggggccgatcacccgcagggcaatggcgctgtcactggcgctgccaaactggatacgtttgatgcgctgattcacctgtgggaagttctgctcaatataggcctcggttttcagcgccagcgcatcaagctgtcggccatccttaacccgcaccataatctgggcgaagttgctgtactgccgtgccgcgtcataggtcagggtaaagcgcagagcgccctggcccaccgtcgtgaccgtggctgcgacctcaggatcctgattaatgaacctggcaatatccgccgccgtattcgcggtgtaatgaatatcggtgccatagggcagccagagatcggtgaaaaagaccggcgtgctggaggaggggaaaaagttctgcttcaccagggtaaagccatacagcgacagagccagcagtgccaccattaccgtcagcgtggtcaggcggaaacgcagcaggccgcccagcgcctgacgatagagccggaatacgatgccctgataaggtgccgagggttcggtttgctcaggctgagccgtgctgcggcgcttctcactccagttgataaataccggcgttaaggtcagcgccgtgacccagctcagcatcagtgaaatcagcagcacctggaacagcgatttacaatattcgccggtcgaatcctgcgacaggccaatgggcgcaaaggcaagaattgcaatcaccgtggcacccagcagcggcagggcagtgcgccgtaccatgcgggcaatggcctgctgtaaagggtgcccgcgctggtgatcgattttgaccccttcgaccaccacaatggcattatccaccagcatgctgagcgaaataatcagcgcgcccagcgacacccgctgcagctcaagtttaaacaggtacatgatcaggagtgtgccaagcacgttaagcgccagcgaggcggcaatcaccatgccgctgcgcaggcccataaacagcagcagcgttcccaccacaatcgccagcgccatcaggaaattgaggataaagccatcaaccgactgtttcacctcatgggcctggttatagaacaccttcagactgataccggcgggcgtatcctgctgatagtgcgccattcgggcggaaagcgcgtcgccaacatcaatcacattgacgccgggcgcgaacgaaatgccgatagccagagccgcttcaccgtctgcaaagtagatattggcgggattgtcggtaacgccacgcgtcagggtggcgatatcgcgcagatgcacgttctgtgggttgccagcgggcagaatcggcagattagccagatcgtcaagcgtctgcagttcgccggtgggatgaaaacggatcgattcgctgtcgacccgcagcgttccggcactggcaacgctgttattccggctcagcagatcggcgacgcgctgcggcgtcataccataggcggtcattttgctggcggagagagcgatgcggatctcctcctgctcgacgcccgctactgcaactttagccacacccggcaccagcaccagatcgcgccgcagctgatcggcgtagttgcgcagttcgctgttggtaaagtctttaccgtgaatgacgaagaagtagccgtaaacatcgccgaaatcatcgttaaccagcggggcctgaacgccaggcgggaactgccgggccgcatcgccgacccgacgacgtaactcatcccagatttgcggcagctgatcggccagatagcgggtatgaatattaacggtaatctgcgacaggccattgccagaaatggacgtgacattgtccagcgacggcaggcgctgcagcgcattctccagcggcagcgttacctcctcttcaacctgctgtgcggacgcgccgggatagtgggtgacaataaccgccgacttaatggtaaacagcggatcttcgaggcggccaatgttgagcagcgcatagatgccgcccacgcccagcagcagaatgaccatccagatgcgaatgggtttatcaagaaaatgctcctgaatacgcattataaaccccgctcgcgctgccagatgcgcaccgcttcaccgtcacgcaactcacccacaccggcggcaacgatacggtcgcccggcttcagcccgctgatgatttctatgccctgggcggtgagacggcccacttcgacaggtcgatctttgatgcgcagcgcctcaccatcctgctcaaccagccagacgtgcggttgattggtggggctgcgatcgggattgaacaccgccgccgcaggcacgaccagacgcggctgggcaggggcattcggcaggttatgcagcctgacgcgcaccgatccgctgaggccggcaacgccagggagatcagccggacgcggcatggtcagcaccacctgataggtcagcgtggcggcatccgtctggctggtgtgctctttgtattgtgcggtgaaaaagcggcctggcagggcgttaaactgcacctcaggctgatagtcaatattctggatatcgaggctggtgaagagggtttcgggcagcgtaaagatgacgtcgagcagatcggcacgggtcagcagcgcaatgggctgtccggcggccacgacctgatgattacgcgcctgtacccttgcaatcacgccatcaaacggcgcgcgaaggctaagaaactgtaactcctcctgtgcgattttcagcgcagtcgcggcggcatcgcgattagcacgctgcacatccatttcagactttgaaacggcgctgcgctgggccagcgtattgaagcgctgaaattgtcgctccgccagttgcagtgcagtctggcggtcgcgtacccgtagtttcgcatctgcatcattcagggtagcgagaagctgtcccgctttcacgggcgttccgtcacgaatatcaagctgtaccagctggcctgcccgtttaaacgcaagatcggtattatcacccgcctgaatacgcgcaggaaatatccggatattttgagcgatgtccgactcaagggtgaaaactttaattacgcggggcgggggagcatccggttcttttttttcatcgcacgctgtcataaaaaaacaacagagcaaaatgaggataaccttgcgtttaatcattttcttcgccttaacatcagcttttaaactgcggtttgataagcattaaggcgtaataaaccctgatgcttatcgcgaccgggataaacttatttttaatcttcgtcatataagtttaacgaagcggcagggccgcttcgcctgaatcggcttacgccgccatctgagagaccaccagccaggtcagtaagcccaccagagtcgttgcggcgaccgcgagaataacgaaaccgcaaagcatgataatgctctgttttttcatcagagtttccttttgcgagccagagtataaaccgatgcacactgcatcagcatacttaaaccttagctaaacaaaaacaacgttgtcattctcataatataggttagatttaatttagccattttatgttattcgtcagacgtttcttacgtaaatatgatatcggtcattacctgcaggaggggctgcctgcaaaatgcatgtcttttaattgcgcctttatttcatcgctaaatggcacgaggtttatatatgctaaataatgataagcaggataaagcgttagctttatctgagcgcccctggtatcagcgtagtgtggcagagatattctccgaactgcagagctcatcagcaggattatccaccgccactgcgcaggaaacgcctgcagaaacacggtcccaatgcccttccgcaaaaagctgagaaatcggctctgctcaaattcatcgcgcattttaaagatgtgctgatctatattctgctggccgcggcggtgatcaccgcgatcatgggtcactgggtcgatacctttgtcattatcggcgtggccgtcattaacgccctaatcggctttattcaggagaataatgccgagaagtcactgaaaagtattcagaacatgcttgccagtgaagcgatgttggtgcgggatggcaaacaggtcacggtcgcgacgcgcgatattgtggtcggtgatgtggtgatgttacgccccggcgataaaatcccggctgatctgcgactgtttgaggtcaataatcttcgggttgaagaggcgattctcaccggggagtcgacggtggtgtcgaagaacaccgatacgctgagcggtgaaaaatcgctgggcgaccgtctgaacctggctttttcaggcactaccgtcagttccggcaccgccgcaggcgtggtgatcgccagcggcggtgatactgagctgggccatatcaacgaaatgatcagcggcataaaagaggttaaaaccccgctgctggtgcagatcgacaaactcggtaaagcgatctttttcatcatcctgctgatgatggtcgccctgtttatcttcggctatctgctgcgtgacattccactgggcgagttgtcgctgtccgtcatcagcctggcggttgctgcggttccggaaggtctgcctgccattatctctatcatcctgtcgctgggcgtgcagtcgatggcacgcacccaggcgattatccgtaagctgccgattgttgaaacactgggcgcgatgtcggtgatctgctccgataaaaccggcacgctcaccatgaatgagatgacggtgaaagcggtggtgctggcgaagagccgctggcgtgtcagcggaaacagctatgaacccaaaggggagattgttgctgagcagggcgacgcaagtggactctctgcggcacaggatccgctgtttcagcagttcctgcatgcggtagacacctgtaatgaaagccagctgcgtcaggaaagtcagggtcactggacgattgttggcggcccgactgaaggcgcgctgaaggtgctggcggcgaagggccagacgacacctcagccggttgaggtggtgagcaagctgccgtttcgattccctctataaatatatgtcggtcagctgtgttgccaacggcgaatcttatgtgctgctgaccggtgcgccagacgtgctgctgacgctgtgtcaacagcagcaaacgccggagggtgcagagccgatagaccgtgcgtactgggatgccgccatcaccacctacgccagcgaagggctgcgcaccgttgccgccgcatggaagagaacctctgcacccgttaccgcgctggatcatgccgatctgaaaagtgacatggtgctgctgggtctggcctgcatgatggatcccccccgtcccgaggcgattgccgccattgacgagtgccagaaagcgggcattcgcgtcaaaatgatcaccggcgaccatcaggaaaccgcgatggcgattggtcagatgctgggaatcggcaacagccaggctgctatcactggctaccagcttgaacacatgagcgacgccgaactggcggacgcggcaaaaacctatgatatttttgcccgcaccagcccggaacataaactgcgtctggtgaaagcgctggaagcgagcggcgagatcgttggcatgaccggcgacggcgtcaatgatgctccggcgctgaaacaggccaacgtcggtattgcaatgggtattaaaggcaccgaggtgacaaaagaggcggccgatatgattctggccgacgataactttgccaccatcgctgcagcagtcaaagagggacgtcgggtctacgacaatctcaagaaaaccatcctgtttattatgcccaccaacctggcgcagggtctgctgattattatcgcgattctgatgggcaatctgctgccgttaaccccggtacagattctgtggatgaacatggcaacatccgccacgctgtcgtttggtctggcgtttgagcctgctgaagcgaatgcgatgcgccggccaccgcgcaatgtcaaagcacacgtgatggacgcttacgccatctggcgcgtggtgtttgtcggtctgctgatttcaatcagtgcctttgtgctggaagcctggctgcaaccgcgtggctacagtgccgagtttatccgtaccgtgctgctgcagatgctggtgactgcgcagtgggcctacatgcttaactgccgtaactcggatggcttctcactggatcgcggtctgctgaaaaatcgcggtatctggctggtgacgctggtactgattgtccttcaggcgatcattatttatgtgccattaatgaacacgctgtttggtacccgtccactgccgattaactactggctgatttcgctgattgtcagtatcgcgatcttcatcatagttgagattgaaaaacgcctcacccgcgcatggcgggtgaagacgccatcactgagttaattctgcctccgggtcctgctgcggatagctcgccagcaggacctttttaatcaaataggtcagtggaatagccagtatcccgcccgtaatccccagtaacgcctgccagaacagaaacgccagcaactgcgtggtcagcgccagattgagtcgcttcccaatcagcaatggttcgatcaccgaactcaggcagaggttcagcaccacaaagaaacctgctaccgccagcgcgatctgtaaatcaaacatgatgtaactctggatcaccggcggaatcgcggccagaaaggagccaagcaccggcacgtaattaaagatgaacatcagtacgccccagaaaaaggcaaacttcagcccgatcagatgcgcgccgacgcccacgattaacccgcccagaatactggtcagcgttttcactctggcatacacaatcacgctctgaattccctcctgcagcgccagataaaaggcctgatgttttccctttacccgctgttgcagtgcagctttcagcagcggcatctcatagagcataaacagcagcatcaggaacaccatgatccaccatgagatgacgccagggatttgcgtcagaaatgcagtgacaatgcgcactatcgccccagcatccacaaaggtcagcaactggtcgggcgtcataccgatatcaagccgggcaaaggccagcgtcagctgttcaagccgggccgccagcagcacgggcgcctggcggctgagttgcatcaaatcgggcgtcagcacggttaacttgaggatagtgaccaccatgatcaacagcatcagcataatcaccagcagtgacgagacgatgcgcggtatgcgtttgttttccagccgggtaatcaggggatcaagcatgatggccagtaacatcgccagcagaacctgattgatcagcggtgctgccagataaaggccggtcagaataatggtcagacaggcgaggataaacagcacgcgtgccagtggcggccagagggtgaaccagctcagtcccatgattgggctccttcagcaaagataagctgcagtatagatgaggcttaagcttcagtgccttgcgtcaggtcagatggggaaaggcttctcgcagggcttaagagacgatcatcggtggcttccgtcccttgttcaacgcacgaatgcgcgaccaaaagctatccggatagtttatgtacgatccggtttcagccgacgatcaaaccggaacggaatggcctcagcctgttgaactatccggaagaactcgggatgttcaggatttaacagatagttatattctacaggggagagggcactgggaacacgcaacgcaaccgcatcgcaggcaaagcaccaggcgtctccatagtcagccagtttctgccggtgcgtcttcatcggcccagtttgcaggcaactcagtgatatcagcggtctgaatcaacgcatcgggaacatcgatgcgcagaagtgtgaatgcgtccaggatgtgtgctgagtgcagatggaccagtgtttccagcaaagtcagtgatgctgtttcagaaacataaaccatggagatgccgatgctgttccagcggccgcccgcctcttttgcgccaaatcccgtccaggctgtcgaaagatactttgtcttagtcagcctgtagagaatcaagaataaactccgtgctccaggcgcgtgattaatttcatgacctcgtaagccccggtttcagacgccatcagttctgcgggcattttccagctcagcgccctgttaggctcattcaaccattttagcgcttcatccttatcaccttcgaacagttcaactgcgcgatcaatgacacggataatacgtaccagtcgttcactttgttcagcgctgaatttcgctttcacgcttcggctgaacgtcgtggagggaataccggacattttgcgcaggtcgttttgcgtaatcttcgcccagctgacgatcaggtgagctacgttgccatcaaggccttcattaatctggccgagcagggcgacaccatcagcgttgttcaggcctgcggcctgccataagcgtggcggcctggttttgttcgcagaaaagctgaatgttttcatctgtcacctccaattggtcatttaactataaccatttggtgggaggggcgcaaatttcaggctctgataaatcaggaaaaccttcactctgaacctttcaggggcatgtgtcagatcaagtcgcgactcacacatattcatgagtttcattcatatcgcgttattgatctgaataatgtgcagattgtcgatctcatcagccagtttcttaaagagcgaaatctgcaatagcgggcaggcaaagatcaggattaatcatcattgatgaataaaagtaataagccctagctaattaccctacttaatccaataaattattttacgttatgattttcacacacaacggctgaaggataacgccatgccaactgtaaaactcaacaatggtagagagcatcaatatcctcgtttttggactcagttctgaggatatgttgcaaattgcggcgcttgattccgcaaccagcgcattcttctctcatcgcgatccggcgatggtggagtggctgactggccgcaaacctgacgtttaaaacgcaacagaagaggctttcaataatgcaaaaacgctatctcggaaaatcagggcttgaagtgtcagcactcggtttgggctgtatgggcctgagtcatggctatggtccggcgaccgacactcgtcaggctgttgagctgattcgcgccgcggttgaacgtggggtgacatttttcgacacagccgaagtttatggcccgtatcttaatgaagatgtggtgggtgaagcgttacaacccttacgcgaccgggtggttatcgctaccaaatttggttttacctttggtgaggacaataaacagcagattttaaacagccgcccggaacatattcgcaaagcggttgaaggctcgttgcgtcgtctgaaaacagatgtgattgatttgctgtatcagcaccgcgtcgatccggaagtccctatcgaagatgttgcgggaaccgtgaaagacctgatttcagaaggtaaggtcaaacatttcggcctttctgaagcgggtgcacaaaccattcgtcgtgcacataccgtacaacctgttactgcactgcaaagcgaatactcaatgtggtggcgcgagcccgagcaggagatcctgccattgctggaggagttggggattggttttgtgccattcagtccattaggcaaaggatttctgacgggcgcgattaagtcaggaaacgacgtttggcagggacgatttccgtagtaaggttccgcgttttgccgctgaagcaattgaagccaacgaaaagctggtcacattactgggtgaactggctgccggaaaaggggttacgtctgcacaaatagcactggcatggttgctggcacaaaaatcgtggattgttcccatccccggcactactaaactgcaccggctggatgaaaacctgggtgctgccgacatcacgctttcacaggacgacgtgcggcagatagaagaggcgcttgaaacgatagaaatcgtcggcgagcgttactcccctgagcatcaggctcgtgtgggccgttaagattcaggcgggtctgcatcgaattgcagacccgctattccgggtgccgaagcgcatctatcatcagcacaaaagcgggcggatgctgtttacggctcggataacagagataataaccgggaaatgcagggcaccaatcctgcagaatctgaattagctttccggattttacatgctccctgatcgtatcttcaggaacacaggcaataccaaaacccgataatacggcatcgattctttctgacagaaaattaaacgtgacctgtccttcaactctgacacgtaacgattttccttccttcacgaacttccaatgataaaagttttaatttcggccatacgagagtttgagctgcatgctcccctgcggataaacggatattgccagagagcgttccattgagttgaacctgaaattcatgctcctgctcaagatcggcaatacgtggctcagataggcctgattacataacgcgagattaaaacggcgtgcctgacgtgccgaacatgtctgggcctatgcctttcacgcgccgtcgaaacggtgttttatctgagaaggtcatggtgaggggcgagttccatttccaggcgagccccaggcataagaaagcctttatctggcggacaaatcagtctatcttaaaggaaatgatcattctctaatggtgtttgcgatgaacgataaccgttataaagagcggggacgaccgcgggcgtttgataccgatgcggcactggacagcgcaatgctggtattccggcaaaagggctatcacgccacctcgatcggcgatttgggccaggctatgcagctcactaccggcagcatctataaagcttttaccgacaagcgcacgctgtttgcaaacgtcttcgctcgctatctctcaatgcgcaacagcagtttagccgcgcggctggcgcaatgtgaaaatggccgtgagcaactggcggcgctactcaatttttatgtggattcagtgcgcgatgtagaaggtgagcgcggctgtctggtggctgtcagcgccgtggagctgcaaactctggatgaggaacttgccggagccgtcagcgcggcgctgatacgcaaccagcagaatctgcagcagataatcagcctgggtcagcaggatggttcggtcaatcctgcactggacagagacgccaccgcttcgctaatgctttgcattgttctggggatgcgggtcgccggtaaagttgctgctacccggcccgatgccagcatcatccccctggcgctgactttactcgactaaattttttacacattaaggaatcgatcgtttccttattatccggaggttttatgcgcgtatatccactctaccagcaccattttattaacattgactcgcagcggctacactacctcagcgcaggcagtgaacacgctgaggctgtggttttgctcgcgggtttcccgcaaagcagttatgcctggcgggaggttattcccttgcttgccagccgctttcatgtgatcgcacccgacctgccagggcagggtgattctgactttccagccagtggttacgacactgacagcgtggcagagcgcatactggcgctgctgaacaagctgggtatcaaacgctttcatctggccgggcatgatatcggggcgtgggtcgcctggtcactggcggcaggccatagcgaaaaggttagacgtctcgcgctgctggatggcggcattcccggtatcacgctgcctgacttactgccaatggtgggtgatagcgcctggaaaacctggcattttggatttcactgtgtggatgatttaccggaagcgctgatcactggcagagaggcgatctacctcgactggttttttaaccgtaagtcagccaatccacatcgcatagatgcggcggcccgtcatgaatatttgcgcgtttttcagcagcccggggccttgcgggccggactggctttttaccgcgcttttgcacagtcggcagagcagaatcgacagcgcgcgttaaaaggcaaactggctttaccgctgctggctgtcagtgccgaccagggatcgatacccgatatggccaccccgctgcgcaccgtagcgcatcaggtaagcagtgaaactgttctcaactgcggccattttattcccgacgaacaacccgagaaattagcggaaatactggcagacttctttattccctctccggataaaagcgaaatatcacctcagtgacagtagggaaagtaatgtcgtgtggcggattattaatattattgctgatccgctgttatctcatacaggtttccaataaataacactatcttattgatttttaagtatgtagagcaggctgttgcgcgttgctttctgtcgcgtgctgtgaataaataaacggtcatcaacgtccgtcatcaggatgagattaaaatagcggtcggcagcagagtgccgatcgcatattgccggggctgctatgaatcaggaaaaagcacgactggccggggaaataaaagccagagttaatgaacttgaatcgcagttagtggcgattcgacgtgatatccatgcgcatccggaattaggctttgatacgctgcgcaccgccagtctggtcacagagtatctgcaggcgctgggacttaatccccgcaccggcgttggccgcagcggtgttgtggtggacatcgacggtgcagagccgggtaagaccctgctgttgcgcgccgacatggacgcgttgccgatccatgagcagaccggtctgccgtttgccagccgctatcccggaaaaatgcacgcctgtgggcatgatattcacaccgcaacgatgctgggtgtcgcaacgatcctgccgcactatcgtcagcagctcaaaggccgggtccggctgatattccagcccgcggaagagacgccagaaagtggcgctgaggcgatgattgcggacggtgcggcagatggcatcgactgggccgtgaccctgcataacaagcctgaactggctgcgggagaagtcgccctgacgcgcggggccagcactgcctccagcgatgaattcgacgttacggtgcatggcgtatcgacccacgcggcacgtcctcacatgggcaccgatccgatcatcgcgaccgtgcatctcatcagccagctacagaccctcatctcgcgtgaacgcgatcccgctcactccgccgtattgaccatcgggcacatacagggtggtaccacccacaatatcattcccgatagctgcctgtttcagggcaccatccgtactaagtcgccggaagtacgcgctgctatggaaacctcgtttaaacggatgtgcgaaggggtggcgctggcgcaaaacgtgcgggtggaggttaacttccagcgtggcgtgccgcctctgatgaatgacgatcgcctgatcgattcactggaacagattctgtcgcatcagtttgataagcccatcatcgcgcagcccagcgccagctttggtgccgaagatttttcactgttcacggaacgggtaccgggctgccagattcatattggatcggccacgccgggccgtgacgatcacctgcataactccgactatcagccggacgaaacgcagcattaccgccgggacgcaggcgctgacccgccttgcaattgatttactctcttaataataaataaatgaggtttatatgatgatgcttaaccgcctgttcacggcttctctgaccgtggcactgctcgccacttccgcgttcagccaggcgaaagatttcggcaccctgaagtttgcgactgaagcggcttatcctccgttcaaccagaccaccccgagcggcaaaatcgtcggctatgagccggatatggtggcggagctggctaaacgtgctggctttaaatatgaaatcatcgcccagaaatggtcgggcatgatcccaggtcttatcgacggtaaatatgatgcggtgatcgatgcggtgaccgtaacgccaaaacgtgctgaagcgatcgattttacccatcagtacaccgtcagtgtctccagctttgtgactgcgaaaaaaagcccgctggccacgctgccaggcagcggcacgattgtgacggcggatgatgacgccggcatgaaaaaagcgatcgacgatctgaaaaccaccttcaaagggaaaaccatcgcggtgcaggtcgcaaccattcaggcggatttcctgcagaaatacctgggcgatgttgccactatccgcacctatcaggcgggtcctgaaacctttgccgacctgatgaatggccgggtggatgccgtcatggcttctcgtactaacctcaacgcctttgtgaaaaaacatgctgaggcaatcagcagcagcggctatggcttctccggtggcgtgctcggcgcaggctcggcgattggtctgcgtaaaggcaacagtgagctacagcaggtgctgaatcaggcgctggactccatgatcaaagatgggacgctgagcaaactgtcgatcaaatggtttggcgaagatgtcgcgccgaaagcgtaaccgctgatgctgatgaatattgactggcagatactgggcttcggggatgagggctggggtggcgtcctgcttaacgccgccgccgtcaccgtcagcgtgtcactctgcgcctggctactgggtgcgttgctgggcagcgtgctctgctggatgcagattgccggttcacgctggcagcagcgactggcggcaggctatatcacactgtttcgcggcgtgccggaactgctggtgatctacctcttctatttcggtggaagacaggtggtctccaccgtgggcaccgcgctgggcttccagggaccgttcgatgtgaacggttttgtggcgggcgcgattgccatcgggctgatctccggtgcctatcaaagcggggtattccgtggcgccttctacgctattcccggcggaacgctggaagcggcgaccgtgaccggcatgggacggctgatgatgtttcgccgcattatcgtgccgcaggcgttacgcactgcgctgcccggcatgggcaaccagtggcaatcggtgatcaaagagtcggcgctggtctcggtaaccggactggtggaaacgatgaaccaggtctccaccgcagccaactccacccagatgtcctttttcttctacagcgtgggggcggtgatctacctgattatcaccacctgttccgatatggttttccgctacgtggaaaagtttgcgatgcgcggtcaacagcgcgtgaaggggtaaggagtccacgtggatatgatgtttttacagcagacgctgctggcgctgctgaaaggattgccgctgaccatcaacctggcgctgctctcactctttggcggcggcgtgctggcgctgctgcttaacctgctgcgcatgacgcgtgtcggcagcgttttctgtcgcttctacgtctggctgtttcgcggtacgccactgctgatccagatctttatggtctattacggccttggcagtttaccggcggtgcgggaaagcctgttctggccgctgctgcgcgatccctactggtgcggcttgctggcgctgattctgaatgatgccgcctacacctcggagatcctgcgcggcggcctgcgcgcggtgagtcagcagtcgctggaggccgctaaagtctcgggcatgtcgtcgtataaaatctttacccgcatcaccttaccgattgcgattcgacaggcattgccggcctacagcaatgagatcatctcgatgatcaaagcaacgtcgctggtcagcactatcagcctgatggagatgaccggcattgccgactcgatagtctcttccactttccgggcgctggaggtgttcctgagcgcggcggtgatctacctgatactcaccatgctggtcagcaaaggcgtatcgatgctggaacgacgcttatcaccttactattttggagcacgctcatgaccgcacctaccatcatgctgagtcatctcagaaagagttatgcgggacacgaagtgctgcacgacatcagcctgaccgcgcaggatggcgatgtgatatcgctgattggtgccagtgggtcgggcaaaagtacgctgttacgctgcatcccgtttcttgaagtaccacaggcgggtgaaattgcggtaggcgaggtgaacgttacgctggataacgccgacgaaaaactgagccgcgagcagcgccgtcgcatcaagttgatgcgaatgcagctcggctttgtatttcagagcttcaacctgtggccgcataaaacggtgatgcagaacatcattgaagcgccggttcatgtgcagaagcgcagccataaagaagcgattgaagaagcagaagcgctgctccataaagtgggactctatgcaaaacgcgatgcctggccgtcgcagctttccggcggacagcagcagcgtgtggcgattgcacgggcgctggcgcagcagccgaaagcgatactgttcgatgagccaacttccgcgctggatccggagctggtgggtgaagtattgcgggtgatccgcagtctggcggaagagggacgtaccatgattatcgtcacccatgaaatgggctttgcgcgtgacgtgtcgaacaaagcggtgtttctgcaccagggcatgattgaggagtcaggttcaccggagcaggtgtttctcgatccgatctcgccacgctgccgcgcctttgtgaacagccactttgagcgtaatgcaggctgaagcggcgttctgataaggctgacgcactgagatttcgtgttttgagatcagaaaaccccggaagattttccggggttttttacagcagccagaacacgttatccagaacgatcagcgcgatcttacgcccggtcctgagacgaagcagcagcagggcggcccgcttcaaccattgcctgccattgctgatagctggggcggctctggatttttgcataccacgctttcagggcgcgacactcgtcaggaacagtaagattcaccaaagccgcgaaaatcattccgccggttacggcgatatccgccatcgaaaatgtattgcccgcgacataaggttgtgagcgtaaaacgccgtcaaagtagtgcatccctctgatggccttttcacgcatcttcgcaccccattccggattctgatagagctccacctccggccccagtcctgctgtggcatgatggaaatagacgctgaccgcatcaagaaattcgatctcagcccgtttggtcatcatatggataacgcctttttctgccggcgtgacgccagtcagaaccggattgtcatccagcacatcgagatattgcgtaatggcggtgcattcagcgatcagcgatccgtcattcagcgctaaaaccggcagggttcctgaataattgatcgctaaaaattcaggttttttatgctcacctttccacaggttgaccggaataaattcgacctcagaaagtaatcccttttccgccagcgcaatcctgacccgtgcaggataagggccatcataccagtcataaatcttcatcgcggggagtgacggaactgcagatgcattgtggatatcagtcatgattaagttacctacctgtcaattggtaggtggattgtgatgccgaacttttctcctgtcaacccctgtctaccagttggcaggtaaatattttccccttataatgcgtctccacctcctgaaggaaaactgagttatgagcctgaacgcgcgtgaagccattctggccgcagcaaaaagtgctgcccagaatcatggctataacgggattaattttcgcagtatcgctgacgaggtaggcatcaagaatgccagtatctattatcacttcgccagtaaggccaatctgggtgccgcggttgccaaccgatactggcaggatacggctgaggatttaaagactatacgcgagcaaagtgcctcaccggatgaagcgttgcagcgctatccgcagattttccgcaagtcgcttgaagatgccaaccggctctgtctctccagctttatggcggcggaatatgaagatctgcccgaggaagtgaagcgtgaggttcagtgttttgtcgatgcgaacgtcgagtggctgacagaggtcctttgcgaaaagtcgcccgataacgcggagaaaaatgcgcagcgtgcgctggcaatttacaccgcagttgctggcgcgcagttaatagcccgcacgcgccaggatataaccatttttgataacctgattgcgacctatcaggagagcggcctgattccgctgtcacactgaattaaaacgacaccgcgcctgaaagagatgcaggcgtcagcactcagagcttcagggctatcagtgaaagcagcagtgaacattcagggttaaatcgcactatggcgcaagccgcctgccagttgtgtgaacacatcgatcatctttggcagcgccttttccggctcgctgctggaagcgacccacagtgcggcattcagcgccgcgctgttcagcagatgagcggcggcatcggcgtcgaccggcttcattatcccgctgtcaatcagacgggtaatcgtttcacgcgtggcttccaggcagctgtttctggctgggccattgggaaggatctcccagaaaagccgggccatcgcgcagcacaatgcgttgcacttcggcatccattgccatgcggatgtaggcgatgccttccgccaccagcttttcccacgcatcgctcaccccagacgctgccgctttagcctgctgcgccatttcgccatcaacctgtgcgacgaccgccgcaagcagcccctttttgtcaccaaaattgtggtagagcgccccgcgtgtcagacctacgctggccgtcagttcatccattgacgcggcggcaaagcctttttcggcaaaggctgcgcgtgctgctgcaatcagttttgcccggttctcttccattgtttcagcgcgacgtttagcggccatacactctcctttcacatacgcgaggtatattaattgacatacgctgcgtatgtgtgattaatgtgacatacgccgcgtatattaaatcaaactcgtgtgcgctgcatcctgcaatcccctaaaggctattgaggaaattctatgatcgcccgcgaacccatttttcctgccaatcgtcacgctctctatgagcagcatggttattcagcggctatccgctcaggcgatctgctgtttgtctcaggtcaggtgggcagccgtgccgacggcacgccggagcccgattttactgctcaggtagaacgggcatttgagaatctggcggccacgctcgctgcggcagggtgtacctttgacgatctgatcgatgtcaccacatttcacaccgatccggagcatcagttcgaaaccatcatgcagataaagcagcgcgtttttccgcagcctccctatcctaactggacagcggtgggtgtgacgtggctggcgggatttgattttgaaattaaggtgattacacgcattcccgatcagcgggaccaacggagcctgtcacagagtgtataaagcatgagtggcaatcagtctgtcaggtactttacaccggagacgggcgctgcgatgacatgccggacgttaaataagctggcatcacatacagggatgtcccgcgctgcatttgcaaaacactttggtcagacggttggaattacgcccatagaatctctgacgcaatggaggatgctgctcgccagcgatcgtctgcaaaattcaggcgaaacgatttcaggcgtttctgccgcgctgggatatgagtcggagagcgccttcagaaaagcatttaagcgtgttactggcgctccaccaggaaagttaacccattcgaaaaagttttgaaggttaatcgaaaaccccattaattacggcggtcacgacagcggtgctcagggctatcagcacaagattatctccgacagctcgccattcgtaaccagggtaatagggcagctcatttagcattgatgctggcaaactttttttggcgatacccggtggcaaaggtttaccacgcgcaacttttttagctattcctggcggcaaagactgatagccgacaaggccataattgacagcaaggttacgtgcaagcgagtagttgatatctgactcgacgtgatcgggccgtcctgcgtttcttacgatttccatgtttttctttcggacccgcattaccatgccccttgtttccgtgctctccgcttttgccgttattacccgggtttccgctattaccattaccctgaccgccaccaccgttgccgttgcccggatttgcgaaaacgggcgcagcaagcacggtaaaagatatcaccaccgcaaatgcggcttttaaagcgcgagatttgagcatgttatttttccttaatattattcagtaatctgaaccagaaaatttatagcgatgtaaggaggtaacatgagctcaacctcttcacattattatgtcacctgttagttattacccagcattaaacggccgacaaccacctagcaaccttaagaattatctcaaagtaatcaaagaaaagctgtacgatgttttgatatttcgtataaattttatgctgaaacccttgctaacaatagataaattttcggctttaagcgaggcggaatacattttcgttatttttatgctgctgcaatgcattgtttatacttgcgattacctgacattactacaacgcttaatcactctgctacgtaaggtaccttaagcgagacagaaaccatgtcgactcatgagacggagcaggtaattttgagcagaacttttctgatatcggtcttcccataatattcaggagtacaaaatgaaaaataataaaagctataaaggatggctggctatatcagccgtcgtcgctctcttcagcactgccagcgtacaggctgagacgcagacaagcgccccgcagggtgggaatacaccgcagaccgtaaagaatgacaagctcagtcctggtgatgaaaaagcactgaaggatatggcgcaggccaatatcaatgaaattgccgccgccaaaattgcgctgaacaaaacacaaagcgcagaagttaaaacctttgcacagaagatggtcgaagatcatggcagtgccctgacaaaagttcaggcggttgctaagcaaaaagaggtggcattaccgactgcgccagacgctaaacataaggtcatggccgacaagctggaaaagcagagcggcggtgcctttgacaaaatgtatatggaaaacgccggaataatggatcataagatggtgctgtcgacgctgaagagcgacgcgacgaagataaaggatccggatgtgaaggcgctggccgacgcgcatacccctgttgtagaacagcatctgaaatccgcccagcatatggcgatgtaaccgggctggccggttccgaattatccgcaagcgctgttaccggatcatcgggaccagccagaaacgacataatctaccatcggctggagtttctctctcgttacgccagcctttgcctgaacagccatgccctgcgttcagacacatcggtataactggcttgaattgcgagcttcaggcgccatcaagacccagcgtttcacgacgcaggaaggcccagtcaatcagagcagtcattgatggcccaagcgcttttcccagatcggtaagtgagtattcaacacgcggtggaacttcgggataaaccgtgcgtgtcacgatgccatcctgttccagttgcttaagctgctggatcagcattttttgatttacgccctcaatccggcgctccagctctgaaaagcgcagcgggcttttagcggcgaaaagctgacagataataattgtcttccatttaccttcaataatcttcagcgcttcggtggtagcctgagcccacaccagtcgctgctccggaatatcacaacgccagtctctttccatacttaccttcaggttagtaacccactattttgtcggttcttgttgtttattcagtgaatatgtagggtatctcacttaccacagaatcaggagcgaaatatgaaaatcggcgtaattggcacaggtaatatcggtggtaccctggcacgtaagctcagtgaagcggggcacaaggtaaaaatcgctaattcacgtggagttgatggcgtgcgtgtttttgcgggtgaaattaatgcagaacccacagacatcaggggagcggttacagacgtcgaagccgtgattctctccattccgctgccggcacttagcagcctgcctgatgggcttttcgatcaccttccaccccatgttccggtgatcgacaccagcaactactatcctggcctgcgcgacgcaccgattactgcactggataatgggcagaccgaaagcgaatgggttcaggagcagatcgggcaccctgtggttaaagcttttaataatatccttgccgactcgctcgccgatctgggccagccgcagggaagtcggggtcgtctggcggttgccgtagcgggagatcagcctgaacctgtgcagacggccatgtcactggttaacgacaccggttttgatcctgtgttctctgggactatcgctgaatcatggcgtcagcagccctgcacgccttgttactgctgtgactgggaagcgcccgtgatgctgcgagctctggcgttggccagaaagggagaaggccaggctcggttgccacagctttatgccagtttcgcgacgctgggtgatgcaccttctcatcaggatattatcgaaaacaatcgtgccataaactggccggtttaaatcgcccggcaaggataatctgtctgcattgaagttctggataaagattgttctgagaatatttttgcatagtggctctggctcaggcatctggtccacggtattgctctgcaggcttgtccttaagcctgagagatccagattactctccggcgagtgcggtaataaagtcacgataggtatgcagtgggcgaccaggcagggtgaccagacgttcccggtcgccctcttgtggaatcatcccatcactgacgtaacgttcagccatcagccgcatttcatacgccatccagcgcggcataaactccgccatattggcttcgaatgcatccggattatctcctccataaattaccggacggcccagaagctgttgccaggctgctgctgcctcttctccgttgagcgtatccggccccacgagattgagcgtttcgaccggtaattcttcgctggcctggtcgcgccttatcagttcaattgccgctacttcagcaatattccgtgtttcgatgattacagttacggattatcagatctctttacggcccagataacactctttcatcagtgacagttttatgccgatatccagcgccggcgatggcggcataaaactggccttacccagcgacagcatatccgcaatatatgggttgtcctgtttcatcatgaaatccgccagcagactgcccgctacggtctgttttgaaacacctgcaccgttacagccacccgccgtacagataaatttgttcagcatcccccattcaggcgcgctgtttcgcgtaacgctgatggtgccggaccaggtatgcgttatcttcacactgcccagggtcggatagactttatgaaataagcgctgatgcagctgggttgcctgccaggtctgcgcgacattcacctgaccgttgagtgcgggtatcacgtgctggcgaatcaggaaacggcggtctgtggtaaaacggaaggttgcaccggcaatcgcattaaccggcgtaagcccccagctctgcataggaggcagggtggccagttgttcatccgtcagcggagcggtaatgctggcgaaggtcgccattgcagcctgccgcgaaagcccgggtcgcaactcgggcgataatgcgttggtggccagcatcacttttggcgttttaatgatgccaaacggtgtcagcacttcagccatgctgccgtagcgaatccccagcactggcgtgttatcgaagcgttgaacattttcaggtaaatagtggtttagcccggcgataagctgcgcaggattaaccagcacacagccaggtgtatatatccctttgctgtaaaagcgcgtgccgagttttaagtaaagctcctcgctgtctgacatctgccacggctcatccattaaatcgaggtggctggcgtactcttttaaaatacgatcactgccacgttcagcctggcagtgatatttaccgacctgttcccagtcgcactgaagatgatgctgagaaataacctgctccagctgacgaatgccttcctgaagcaggttacggtaagcgttggccttttttaattcagcggtcgaactgccaatattatgaggcagaccgataacaaacccggaattacgtgccgatgcgctttcccgtgtgctgtgcgcgtcgacgatgataattttcaggccaggattgatttcagccaggcggcgcgtaaaggcaacacctgcaaatcccgcgccgacgataacccagtcggcagtgatatcctctcgcagcatgggctgcggcgtaaaacaatgctcacccgcaggccagcccagttgattgtgattaaatggtatcgatgcgtagcgcaattccctgtgccttatctaaaaaatagaacaattttataagtcaaagcgggatatctgtgccagcgataatctgactattgttgatttcagacaagtaaaattcaggtggatgattcttgatttaacaaccaaaggtggcgcgaatattcgaagaagagattataacgcgactgttatgtgttttatttgctggtgtcaaagaccgaaaccagtgatatgcaaagcggtattcataaagcgcgagcaggggagagcgaaacggaacaggtcacgctgttaactggcaatttcgagtgagaatcagccccttaaaccaatgcatgcacggcatcaaagcgttttatagatttcagcattcacctgcatcgttgcctcttctacggttccttcattgcgacataaaaaccagccgtggttggtcatctcctgctcgaaacgctctggtgcaagcgacatgctcttccagccggtgaatcactgtactccccagcccacgcgatcgtgccgcggctcgtttccatgaaatctcgggtgccgtgatcaccccgacatgcaggtctggtactcgcacattgagttcaatatttcgctgcaaaatctctgcaaagggcatcatccgccgaaatgcggcatcggacggataccagcgatccatcaggataatgcagttcccgggctgtttagtgagtacattctgtgaaatccaggcacggctaacggcaaaacgttcacaaatttcccgttcaagatccactgagggatttctggcgagcctgttaaccagcgccattgtttccgctctgaagggatcgcttttttgctcgctaagtcggatcactttcctgttatctgctcttagcacttgcgtaatggactccagcagggtggttttaccggttcccttgggcccatccagagaaacaaacagctgcctactcatgccagaaatgagaagtgaggaaagatttttgtgaatcgtgcatccggtaaaaacatcttattttcctggtttgaacagctgaacttacatcgttctctgtagcagtaaggcacttcagcgtgaacatgatttttaaacataccctggtgaacacgctggtaacggttctgacgtatgagtttatagaacaggatgttagtcaggtaagtttaatagttaaggcctgtgcggtgaagtttaagggaagcgtctggaaaacggaaaagatcgtgcctgttctgccatttacccattcaaacgcatgtccttaatcgtaataacgagccctcaaaggcagtcccccggtacgtgcaggaatctggcgagtagaaattatctatattatgctcataaacccttgttaaattgatcctaatccaatcctgcctaaggtggttaaatgtctgacgaaaaggcaatcaaactggagactgctttaaaactggcggccgatcatccagcagaacgacctgagttttaccgggttctgttagattcatcgctttacgtcctgggtagttccggaggggcaacgggtgatggtgaggtcgaactaaaggcgggtgagaatatctcgattcagcactgggaaaaaccggatggaacgcctgtcattccggtattcagctcgcttgccaccctgcagcgcgccatcagccaggaaagtaaatatatgaagttgcctgccagagccttttttgaaatgacgcggggagagggtgtgtttcttaatccagggtcggattacggaaaggagtttgtgccggaagaaatagaagccatgctggcggaaggaacgggtcgcctgccgcagacaagggtggttgaggaagaaacacaggtattagtgggagtacctgccgttgttccggacaggcttctgaaagagttatctgcctggtttgcaaaatgtcccggggtcagccgtgcattcctggttttaatgcacgacccgtcagtcgatgataaaccgcattatctggtgggggtggaaatgagcggtgatgtgcaagaggtgatgcgtggtgcgggtcttgtcgcagcggacacctctccggatgggcaggcggtggatctgatgcgccttggccagaacgacaaaggtctggactcacatatcaggtcgcagtttacgccattctatgttcggagcatgaagcaaaaactaaagggcgtgtttggacgctgagcgctgaacggcttctgaatgttgtcttgtaaccagcgtagtaaatcgggggtgactttgatctccggtttcaacagtgccagtgatagtgactgaaataggtgatccagggcggatttatctatgtccgctatgagcgagaaggggactttatgcttcgggcttaatcaggcgtaacagagcggccctgcatatgcgcctcgtctatctgagtacgtgcgtgaaagctcacgcatcaaaggctcaggcctcgttaaacccctcaattcgtaaaaattcttatcagcagttaccgatcaccgggtaaatgaaaatcaaaaagacccacattaattgacgattagtgcgcttaagcacaggataatccctttataactatacgttgattaaacaacattaatctttcttaatacattcaagtatctttactatttgcgtgaaaactgcactctttccacagtgttacaaagttgtttttccctccgcattcagcccgcttataactttatggcggtaacaaaaataataccgtttataaaaagattattaagagggatgaatatgaaaacactgacaagaagacattttatggcttttgcggcaggaggaacggtcgcgcttgcggcgggtcaggccatggcacatgacaacggcgtaaagacgtttccggcagggagcggaggacgagatcccggaccacatgaccctattcgtgaggctgaaagtccggacatcgtaaattcgcccgttaccgacagcggaacgctgccaaaccttcgcttttctttcagtgatgcgcacgtacgcaaaggaagcggtggctggacgcgtcaggtgacgcagcgggagctgggcatatctacgacgattgcgggtgtggacatgcgcctcaatgccggaggtattcgcgaaactgcactggcataaagagggggagtgggcttacatgacttatggcaacgcgcggattaccgcttttgacgccagcggaggatggtttgttgatgatatcgctgcaggtgacctatggtattttccgcccggtattccccattcgattcagggtctcggtcccgacggctgtgaatttttactggcttttgacgacggaaattttgatgaggatagcacttttctgctgtcagactggttcaggcatattcccccggaaattctcgccaaaaacttcagggttccggtatcttcattttctcacctgccttcacctgatgatgagtacatttttgccggcaacgttccgggcagcctggaatcagacagtataaaaggcggggtgaagtcgaaaatccgctttacccacaagatgctggctcaggatccggtccgcgcgccgggaggaaccgtcaggattacggattcatccaattttccggtttcaaaaacgattgctgccgcactggtggaaattgagccaggcggactgcgcgagctgcactggcatcctaacaatgatgaatggcagtattaccttgaaggagagggacggatgggggtctttgcatcatccggtcaggcaaggacttttgactaccgcgccggcgatgtgggatatgttccttttgctatgggacactacatcgaaaacaccggtaagggaccactgcgttttcttgagctttttaaaagtgattactatgccgatatttcgcttaaccagtggctcgccagtacaccacctgaacttgtccggcaacacctgcatctggatgaagagtttatgaacatgctttcacttaaaaagaacccggtggtgaagtaactggctcagtcgttacctgattaataaggattgacgctgacttattcctatttaaattaaagtgtccgcttttagcataaagcggacacttatatcggtaatgcaatatctcacctgccacttaaaatggtgcaatagcatcagcattgctcttacagggatggggaagtcgttactaaactgagacagcagggcagttaaatcatcaggaagcatctgctattaacaggggacatttccagattttacctggtagccagacatgaaaacgaagtttagcttatgtctatccagcatcaactattcacttttcctgacgatacgtcgttgaagtcagtaaaggttaattgagccgatgcccggactcttgcaaagaatggtactttttattttgccagcagaaataatctgttttcaaaaacgaatatttaatctggctctggttatgccctttattgttgctacgaattgcgtttaatgcgttgagtgccggctctgcctcagcacctttattggcgctggccgttgcgtgcctgaaataagtaaagcgtcgctttatttccaacggcattgcctacttaataactggtatataaggagatttccatggcattttcaggaacgggccgcgccacggtcatatcgctgaaaagcggtcacccattgtctcagtccactgaaggaaaatcacaatctattctgagcgaacccgctcttatcacgctgcaaagctcaccttctcagatttcttcttttcagaaacagggtgacgatctcattcttaacctgcacgagagcgatacgcttcgctatcagaatttctttactgaggttgcaggccagcagagtaaaatgcttttccagcagggaagtttatttcaggaggcacagttcagcacagacgtttccggcgatgctcagactgtcaccacgctgacacctgtctggcaatctccagcttctgcaacatctccaatgccataccctgccagtttcagagtcagatcccgcgttatcagtggtagagtcttcccaaagccagattctgatcccgtcaggcacgccgttaaacggagcagctgtcgccctgagggcgacgaccagcgaagctgattcaaccttaacgcttacgccccaggttgagtcagcaacagcttcagatgcccccgccacctccgacgctatgaaggccagccccattccattaccggcgctgactcttgatccggttaccggcgacaatgcggtcagttaccaggaggggatatacgggattatcttcaccggctccgccgcccatctcccctccggcacgccggttgaactgacccttgacggcagaacctggcagggcagcgtctaccaggatcagtggcaggttcagctctctgacagcgacgtgaaaactatcaaggatggcaactataccattcaggtcagtgcaacggatctgaatggaaacagtaccagcctcagccagaatctgctgctgattacccactacaacagcagcaacccaaaagtcaccgttaacgacatcacactggcggatgcggtccagcatgacggtcagacctggtacgttatcagcggcacgcttgaagcgccgctgccgcttaagacttttgcggtgcaggtttctgataccttccactggaattatgccgtggtagaggcagatggcagctggcgcgcggaaatcagcgcgtcggagctttcccagggcggcaacttcctgtcgtttggcgtgctggatggtgccggaaactggtttgagcagagtggcaatgtcacagccgaccttattacgcccgttgaaggcggcaatggggttccgccggttatcgatgacaatccaacggatggtggcacgccgattccgcctgtcagcacgcccccttctttaaccattaacagttttactggtgacggcgtgttaagcgctgaggagaagctctccccacagacgttcagcggcaccacagcgaaacctcgccgcagagagcacgctgaccataatgctgaacggtcagacctataccacaacgctggccgctgacggcagctggagtgttaccctgccgtctgccgatctgcaggtgctgccggtagggtctaaccacatcagcgtaacctttgaaaacagcgttggcggtacgaccaccgcaaacaaagtcattaccgtagaggcgtcagcaccgccatcagacgctatcccgccacagccgactatagacacgccgtttgtcgacgggtttatgaacgcacatgaacgcttcgagcctgttacgctgagcggctccactggtgtgaccggggcgggccagaagatcgatctgaccgtagatggtgttcactatgcgggcgctgtggacagtctgggcaactggcttgtctcactctccaccgggcagctgatggaagcagatttagccgaggggagtcattccgttacgctaaccgccaccgatcgctggggccagtccggtatcacggagacgacgtttattaccgatacgcaggatcctcttgtcacgattaataccctggcaggggacggggtgatcgacagtcatgaaatcagcagcccgctggtgatctccggcagaggcgaagccggcagcacgattgaggttagttttggggcctcccactggagcggcatcgtcgatcaaaatggccagtggcagttctcagttcccgcggaaacgctgcagggaatggaggaagggagctaccgtgccattgctgaaacaaccgacgaagcgggcaacaaaggttatgcctcagcaggtgtgcaaatcttcgctactgaggcgttgccgcagctgacccttgatccgatcaccggcgacaatgcggtcagttaccaggaggggatatacggcattatcttcaccggtaccgccgctcatcttccctccggcacgccggttgaactgacccttgacggcagaacctggcagggcagtgtctatcagaatcagtggcaggttcagctctctgacagcgacgtgaaaactatcaaggacggcaaccacaccattcaggtcagcgcaacggatctgaatggaaacagtaccagcctcagccagaatctgctgctgattacccactacaacagcagcaacccgaaagtcaccgttaacgacattacgctggcggatgcggtccagcatgacggtcagacctggtacgttatcagcggcacgcttgaagcgccgctgccgcttaagacttttgcggtgcaggtttctgataccttccactggaattatgccgtggtagaggcagatggcagctggcgcgcggaaatcagcgcgtcggagctttcccagggcggcaacttcctgtcgtttggcgtgctggatggcgccggaaactggtttgaacagagtggttacgtcacagcggatctgacttctccggtcagtgataacagcggcgatccgttgccaccggtcacccccgataatcccaccgatggaagcaatactacgccagtggtcgatattccaggtcagcctgcacctgaaattgatacgccatttggtgacggctggctgaaccgtgcggagaaaaaagagggctcgatgctgaccggcacaacgggcgtcactggcagcggtcagacggtatcggtgattattggtggtaaacatcacaatgcggcagtaagcgacgacggtcactggagcctgccactggcgccggggacgatgaaaacaggtttcggcaaggggcagcatgacattgtcgtgactgctagcgacgcggctggccatacggctacgataacgaccagctatcaggtggatgtctgcgcacccaaaatcgcttttactcacctcacagaggggcagcaaatcaaccttgcctccagccatgatcagcatgtatcaggtacgggtgaagccggtgatattgttactgtcaggcctggcgaccaccagtggcaaaccagtgtgaccagcaaaggcacgtgggccgtgcagcttgaaacgctggacgcactcacgcctgaaccgggcgagcacaggataaccgcaactattcttgatgctgccggaaacgttaaccacgtttcgcaaaacgtcgagctttatatggccgagccgcagccgaagctgagtattgcaaccgcagcgcaggacaacctgatcaatgccacaactgtgatcagcagcaacacagaagatggcagcaattcggaaagccatagtgctatcacactggagcacgcgtctcttcatcctgatatggctgacaatctccatctctctggaacagtaaacagtgaaacgctctcgcttttatattcatatctgcacaccagcctgaaacggtgctgccgatgacgattcgtttcagctgaatggtgctcatgaggcgtttgattttgccacgcttgggctgagatcaggcaacgctgaggtcattaatctgggcgctttcagcagtaatagcgtcaatctggggcaaaaagagccgttgccaatgaacgacaatgcgagtgagtcgccgacgataaaagacgcggacggcaatgtggttacgctaagtaacattgaaggcggcgtctggagcgaggatgggcagcgtattagtaacggtcagcagtacgacctgtatcacaatgcctctgccagccatgaaggttcgctggctgatatcctgatgcaacataatcttcacttacaactggcttaaatcagatggccggggcggattttcttccctggccattttccgcaattaagattgccagtgaagcgcatacgagtgcccagcgtagctattctctaatggcgtgcgaacctacgctgccggtatagggaagactaacgtcaggctaatttccgctatgagcgaaaagcggacattataggcagataaaattctgctttcccaatacattgataactatcagatatattgaacgatgcagttcagatctttaggtaaataatcaaaagcataacctgttgagaatcgatactatatctcggtatcactttcttaagatgttgatagatgggcgcgtgtaaacaggagaaggatgatgatttcaaaggaaaatgcagagcattatttctggggcgacaattgcgatggttggtatctggtaaaccgtcaggatatgctggttattcatgagaaaatgcctgccggcacttctgaaaagcgacactttcactccgtttccagacaatttttctttgttctcgatggtgttctttcaatggaactggagggtaagatgcataatattaaagccctgcaggggctagaaattccaccggggtcaaagcatcaagccagaaacgacactgagtttcctgtagaatttattgtaatttcgcacccaacgacgcgaggagatcgttctgaccttccttcatcctgctgacgaattatgaacaccgctatggcttgtcttaaggtaaggactgcgcgccaggtgttaacttaactgagtatttgcaacgcctgcttcaggcacaaacctgacctgcattccggtaggtccactatgagcgaaaagcggaacattaaaaataatgacattgctcagaccccatgtccgcagctgactaaagtgaaaataaaatgaacaaaagcagtcttaaagcgttttccctgttacgtgttctgacattgacgtgtgtgcccatgtttttactgggttgcgccagtgcactttgcccttttggcaccactgaaggcacgattccggacttgaaaaatagttactggagatctactgaaaaaaatccggctaagactaatgaacaagtcctggaggaatgcacccatgctgccgatgctgaggagcaacgcctttcgcagatctatctgcagatgtgtaaatccggacgtttaactgcagaaaatcaacgctttgcacagagattactgggcaacccactctattctggcctggaaccagtaaaagccgtcccccagcatcaatcagatgattcagttgaagctcagctgaaatggtcgatgtcttatagcgataatcctcaggagttcaaagaaaattgtggctcttacattgaaaataacgcagcggaaacggtccagcaccatgctgggtttacaggcgggccgttacaaagagcaggtttttaaacagtgcatggcagaaaaccatatggcgctcattgtaccaaggactgaattcagtcaatgcaagttgatagggtggtaagcaaccacaggcctgacctctataccaggtaaaatataatgtgtccgctaaaactcatcatctatttatatctgtaaaccgggttcattagccgtgcccagcacaccggggtttttaaacctgcgccaccagacaagtaagcatgggaagatgagaaaatgattacactgaagatttacgctccgtaccccagagaaacagtgttatgtgggcagatataaaattaaatgcgggctatgctgcagaatgcatgatcccagaaaaacattaattatgttgaatagcgttcatgccaggcggcgcgcttgccgtttaccttcggtctgcactatctgatgtgataccaggatagcggttaaagggaataacacatgaagtcaaaccatagtatctttgtcaggatagggttaattactggagtgtttctgatttttattttcttaaaatatattttcgatgcaagtcggccaatgcaaagcgatgtgcgtggcaggcctgtccttaatgtctgtagcgaatctgttcatggtaaatttaaccagaatggtgagagagataacttatttcaggtaagtcagcaatgttcaaatgatatacggcctgttttcagtaactatgtatccattaagaacaatatttactgggtgagtaaaattaattacgaacactctccctgcattactgggacgggcgatacttcaggtttaatttataacatcacttcctggggttgcttaacagcaaagcccatgcaggtcaataaaatagaaaagcgcgatctttatttagtggctaaatactcctctacgtttcgaccggttaattacgttaagactacccggccatactggcaatcggaacaattagcgagctacgcgaaagatgaatcgtctgtatatttccggagcgagaagataaaagaggttaacccggaagatttccaggttatttttccatttggaaaggatgataaatggcgtatttacaatgtcttcaaaagtaatggctcaacctatgtcggtggctataatgttggtgatttagatctgagtaaatttcatcttctttctgttgtctcctgtccggagcatgggctcaccagatgcacgggatatagcaatccagataccttttttcgtgcgggaaactgggggcgcggagtgattggtgacatcgggaatgatgtcatctttttacagcctgaagtgatcagtcgcttctcaaatatggcttcaccagacatgtttatgtttgcgtcatccgagcgtatttatctttatactcacagtaaattttacgaagtggttgaaggggaggcaggattacaaaagaaacttgtcgagatggataaacagtatttcgagcagaatccatgattatctggcaggcaaaatgtgatcacgtgctgtctcgtaaacattatctaattaacatccaggtgagtctgtaattaaaactgctctcagggggggggaacatccgaattccgacactctggactcacctgtttctatatgtctggctgaaaaatgataccattagctcttttcattaacggtcctactgccccgatcctgattgatataatactcatcaatcccagtaaaccagataagcaagtgcggcagctgaacagaaggcataggggcttaaaagcaaaatatccgaataaggcgtttcacatatcctgataacaggccatgccagtacaaccagccacatgaagagcgcagagcacacgataaaaaagctccccttcagggcatcgtcaggataaaatcgctttgaaatcatcgctaatggcatgccgattatcattgagcccatcgtggtgccaataatactcaccataacgatgaaaaaataagtaaaaattaaacccactacgggtgtactgctttttcccaaggaaagataggttaaaaccagtaatgaacccacgacactactaaatattgctgatatcacagatatcctaatccagttgtcgtcaataatgttcggcataattttctctatgtctgagcagctatattgatgcagcttactcgcttaaattttcggcacgaggcttgatcgcaaaacagttagtctccctggcaaagcagaagtcaggatcactaaccggcgccactgcaatactgcccttatcaaccgttgcttcatcactttctggctggacaacaaaggcagttcaggtatggcatgtcttaggaacgcccgtatcacgtgggcggcctgaaaggagcaatacctgcaggtaacctctatctggcagtctgtgacatgatgagccagcccagcaatgtccataacgcttcaccgggctattgcttgtctgaaaatatccgcttccggaaagaagggagactgacgtcatgctaatgtccgctatgagcgccaggcggatgttatgcgctagtgacgatttgcattccactcatcacgtgtaatctcccacaattgtgagtccagaagcccactgacaaagtgttttttttcagttcttattaatcgcataccgctactgattgaaattttctgagaacgtatattttcagctgctttaggaacacgtaatactgacctttttaaggtattgaaccagtaatctgtcacggcaatacttgcttctcgcgctaatccccgtccctgatgttcaggcacaagccagaaaccgcgattgttgtcctctgcatcgtccaggctaataactcctatcagctcgtccggtttaccccgataacgtatgctccagacccatgagaacccttgtgccatagctggcagtgctacattacttacataatgctctgcgccattgtcaggatagggccacggaactgatgacaccatataacgaacgatctcccagtgcggaaagagcttctggattgatggtgcatcttcgataactaatggctttaacagtaaacgttctgtttttaatgagggtatttgcattcactctctcccttaggaattacaggttgggcgccattttttttatgcaatagttaccgtaattcatatggttgtacagacaatatgagaacagtggcctggtcttctgcttttattcttcaggagcgtggacaaagcacagcttattcccttccggatcccgacaataagccgcgtagaagtctgaagcgtattctctgaaaccaggtttaccctcgtcggcacctcccattttcatggcgaggtgccaaatctcctgaacttcttcctgagaagcgaccataaaactgacttgcataccgttgccccaggttgaaggaaggccattttcaggcacctgcacgtaaaactgaggccatcgtttatcaggatatttccagccaacccctttagcctgaccgccattaccctctggcatctgttcaaagcctaacttcgcaagcagaggttcatagaaagccactaatgtgttgagatctcttgcgccaacgtgaacatgactaaacatcaccagttctcctgaatgaaatgagaaatcttaatgtagtccgtacgtgttgtagttcaagtcagaaagagagtcagacattactcttgaggttaaagcagcatgaggtaagccatgtccgcttctggcaaaacgcggacttcagttcgcccgctatcagcagcatgtttatgctgctgccatccgttcaggcgatctgctgtttgtcctgggtcagaaatgcatccgagccaatggcaccccgtaacccgattttgctgctcaggtaaaactggcctttggaaatctgacaacaacgcttgcggcggcaggttgtacgtttgacgatctgactggagcatccgaacattaaggccgcctgtcaggtttttggggcagtgcagtgtacgtctcgcttagttaaggctgaatcaccttaccctgctcatcaagcagatccgtcaggagtgctgtgccatcgcttcccacccgaaatgccccgtaacgtgcctgcgcgaatctgtcggcatgaccttcctgaaagaaataagcgttggtgccgatggtcagcgagccataatgttgatggtattttacccgcagctgatttggctgcagaggttcaccctgatcaaaacgtgcctgagtcgcgtgacgctgcgcatcgaggtcaataatcagggttccgctggtgggcaggcatggcgctgacagggtcgcgccgcaggactcagcctgttgatacaacgccagttccagcgggcgggtgagggcatagttcagcgccatgtaatcaccctgcatcagggatcgcgggtcaaccggggcaagaggtaaaatcatgaccgcaccttgcttcagcaactgctctttttgccagatgctgacattgacggctatcagcgccagcgctatcacagcgccagccagccatcggctctgtttatgcattttcactggcacctccgatttgtgcaggtaatacttttttgactccccatgccagcccaagtaaaaccagaccactgaccagcagcagcagggatttctgcagcagaattacctccaggaagtaataccagccaatgacatacagcaccatgaaaccgccactgaccaccagcaaccccaaacttccctgataacgtgccatcagaattaaccacaatcccagccctatacctggtgcatagagggcggcagccccgcagataagtgcagcgggcagagtgataatcgaaaacagcggcttgctgtgtcttttctgactgagcgcactcagcactaagccagccgcgatccctgtgcctgtccaagactgcagcgtggaaaattgcgatgctgaccagaggaaatccgttagatacgccgcgtttataccgaggaaactcagcaacatcagaccacacgggatgccatacagcagaggatgtatcgcgtcagcatacggccctgcctgtaacctcaactgatgactgacagtccacatccacaaaaatataaccgccgccaccagtacggacacagcaagtcgtgcagccatcggagacaggcagatccgggtcagagagtagcccgccagcaccaggaaaaaggtcagggcagtgatggccataaaccgaaaagtgcggtcgggcatcgccatcgccattgcggccaggatcggcaaggcagtcagtgaactcagcataataaagctgacgttattgctctgaatttgcagcagaacaccggttatcagcccgcacgttgccgcaatcgcccatgccagcccgaggtgatgtttaccgtcacgctgactgcttaacaggccacgtgcaatggcggcaagcagcagcgaaggaataataagggtggcagcattcgggtcttccagcagatcagtggcatagagcatcagtatcatcagtaacagaatgatgatcgctgccacccagcccccgacgcttagcgccagcctcagataccagggcaggtcggatgcgtgaccgcgctgcttaatttcctcaacctgcgaggcgctcagcaaaccctgctgacgtaaagtgtctgtcagtaaggtcagcctggccggagccagatcgattggccccttttcaaccagtttgcgttgccatttcagcagaattgaaccatttaccgccacccagaatgccatcaggatgccggttaaaaacagatcaccggtatcgtaggctaaaagaaataactgcatgattagcgcacagccaaccacggtcaggctggcgatgcccagcgtcagcatgcagagatccggatagcggtcacggtacaggtaataacctgccagcagggtgatcacccaaccgcccgtgatataaggaaggtggtcaccgccgccccagtcagagaggtttccggccacaatggcggttagctgaagcagtaaaaatcccgccatgactcgcgagaaccagcggcttgccagccagctctcgggctgatgcgttatcgcgcgccacgccagcgcttccctgacaatcaggcaggctgccagcaacgccagatatccgtagagcacagcagtcgggagcctggttaaactgtcagacgcggcgagatccagcagtgacgacggcagggtgttgtaatagagctggaacgccaggttagcgaccagccagctgcaaaaccacaggctgttttgccgggcaatcagcgctagcggcagaagaacgtataaccaggcccggaatagctcccagctgtcagcaccggtctgataaatctgtccatacagcgcaaaaagggcaccgaagcttaaccctgtcgccagtaatgcgttgcgtgccagcgtgctgtaccagcgccaccagacaatcaccgccagcgcgacgatcaacagctcggccagggcaaatttcgccattttcggcagccaggcccagttccaggcaataaagaacaccgctccggcaaccagtgatagtaatcccagacaggaaagtaccgggataagaaactgacgccactgagcatctgacggtctgattccacagaaagcaaagatacgctggcaggtctccggggtcaggattcctcctttcagcaggcgtgcgatctggcgacaaagatactctgccgtccgtgacggcatcccggtgatgccatcgggtgcaagctccctcattctttccctgcctctgttagctgtatgactttgatgatgaagttaacggctgttcttccctgcgatcaatccgcgtgtcggtcagtgacgctctgctaagcggccgataattttgctgaacaaatgtaaacatcttttccaggatataacagcgtaaatcaaaggcgaggggggaactctgcgcaatctgccgcattcttatgatcaaatagtatcaaggccgtatttgggctgcgtgaacatgacatccgcccccgacgaaacgcgatccccgcaggcaggctttactgctgtactctcaggggtaccgcatcacccgcattgctgaaaggtaagaagcttaaagattatcgggtgaccgagcaggggacgcttacggttgatgataagctgattgccacgactattggccagaagccgctaaagaaaccgcagtcggacatcaaattgtggattgttagctgcctgaaccgctgaaataaacgctttcctgaaccgaggtttcacccctttatcgcaggtgatgatgagacacggcgtaatacttttaccctggcccgtcgcgcattgattcaaaggggtgggttcctgagtggaaaagcacatacgctaccggacgccgcgccgcattgggcgcgcgtgcagaaaaccgcccattcactgaatcggattgcgggcagttgctatgctggcagaggtccaaaggcgcggtatgaatccaccagtgaatcaaaaagcgagatatctgagcgacttctggcgataagctgggcaccggcaatggccgtgaaaattgcacgtgctctggattcactctcacttgaatcgcacaccttcgcagccaccagcagtttgttcagccatgcaatgtttacatcagcaaacttctgtatttctgcattcatttcaggaggtaaagtctctttttcagcgcccatgaaactgcccaggcagagacgattttcggcctcaagtgatcttcggaagatttcaggaaagcgacccagcgcatcaatgggtgaggggctttctgattcgatcatctcgagcgcgagcgcaccgtcctcccagtatcgtctggcaacggcaatacccaactcggctttgcctggaaaatagtagtaaatactcgccgctttgatacccacatcctgcgcgaggtcgcggaaattcaaaccgttatagccctgagattgggcaattttcctggccgcctgcaaaatggcttccctggtgttgacgctcatcttgatgcctttggtattgggatgatctcttaaatagagaacgctaatttacagcaaacgcttaccgggtgacagggtgattgccatgaaaaacagtaagttcaatgcatccagggtgctcaggcagacgtcattccatcatggtttagcaagtaacatcgacagccgacgctatcataagcactctggtcaccgggaaagtcagtagataacgaacccggcgtaccggagtttacattgagtggcgctattaccgggctggcgaatccagctcaggaatgccgctgttgcgatcggcgtaggccgcctggaaggcaggacgttttgtccagcgctgccagtaggcatctaagaactcaaaacgctcgtccagtggagtggcattgaccgggaatttcgagaaggcgatcgcggttgccagagtaatatccgagaaggtcggcgcatcgccgccgagcagccattcgcggccgtctgacagatggcgattaaccagcgcggcgtgagccaaagcttctttacggcagtgttcaccccaggcctcatttttggtcaattccagcttgaagccgaggccggtgtgcaacacgtggaacgctgtaacgatgcggtacaggatatgcacccacacccggttatcccacatattatccagcccctgttccagtgctgtttctcccataatcttgcggcccggatactcctgatcaagatagcgaaacgatggcagccgtttcagaaatataactcccgtcagccagttcaagggtaggcgtttcgccccacggattcatattcaaatgtcgccagccacgctgctctcctccaggggacatgtcatagatggtctcggcaaactggtcagcgatgcccttttcgtgcatgaaaagccgcatgcgctgtggattaggaaaggccgaaggtgatgtaaaaagctgaagtttagcagtcatggtcgatcctacaggttgatggttggggtatctaactaacgttaggtaggcaaacattagcgggcaaatcaacacacgtcaacaccggtctaacacttgttaggttaattttttggcgatcttcgtgcttgatacgatatttcagcggaggcatagctgaaggtgggggagaatgacgccggagggttgaaaaatgcaaatgagtggagaggctcgattcaaacgggttttcaggtgagttacatattgtcaattgctgccgactggttgctggccaacaggaagatagtccggaagcgcaagggccacggggtgaggtagtagcggttagatcagcccatgaagcagactggtatcggcatcattactggtcacaaaaatgagcggccgctgtgagcgaggagcggacgtggggatttcaaataccttaaaactgcatgtaaaaagtaacaggatcggaaaaagactgtttcatacagcaagcattctgtattgactcatttaactctgatttctttcatgtttgtcgggtatgactattttcacctgtgacaatcctggcgttaagtaaacgctggatatcgtgaaattccgtctctgacattcggtgatcggtaaactccagcaggcacactctctcctgctctttggcacagacaaacataggcccagtgtagtggtaaaccggtgaatgactataatctgagagggagctgcgccagtgagccgcttgtagatgtaaccaaacccactcagggattcgtagccattgtccagtgctacgtcagtcgccgcacgtccgcttttcagctcctgcagggcaatatttacccgctgcattcgctggaaggcctgaaaagtgatgccgtgctgttgcaggaaccagcgccgcatccgctccgggctgattccatgctgacgaagatccgcgtcggatatacgggatttgatatcgcgcctgacaagcgcaagcgcctgtttcgacaaacaatggcgcgctgtgccgtggtttttcacattattgattatcaaaccccttacgatatcagaactcttcgactgccccgcgtaatgtctcatcttctttagatgaaattaagcattgctttctcataaatctactaatgataatttgctataagccagattgtttcgttgttagacagggtgcggtgcggcttttatctttcgtcatgatttgtaaattccatacaaacatttgatgagggagccattttgtccatcctactgaaaagcataaaaacaaaacccacgcgttttactctggcgcttaaaatcgcgttactcagcagtatggtggctttctcttcagcctctttcgccgatgtacccttaaaagagggcattacaccagccaccgatgccagccagattccggcagtggctaagctgcgtaaagacacggtggtggctggtatctctgaaccgcagggtatttttaacccttatttctttgttaacggctgggacgaaaacgtcaccaacgtgattttctcacgtctgattgactgggatagccacggcaagctggtgccaggcctggccgaaagctggagcgttagtcaggataacaatgtctacaccattaagctgcgcccacacctgactttcagcgacggctcgcccctcaccgccgaagatgtggcgtttaccctgaccgtgctgcatgacccgaaatatgatggcgatactgacatcacactcgccaacattgtgggcggcgcggagtataaagccggaaaagctgatagcgtcagtggcctgaaagtgatcgacccgctgacattacaggtcaccaccgggcagcctggcgcgacaacgctggcgaaaattggcggcccggtgttgtcgaaagcgtattatgggaaagggtatcagcgcggcaatctcgactatctgcgcatgttgcacggtaaaccgctgggcaacggaccgtatgtctatgacaaatatattccgggccaggagattcgtttccacgccaatacccatttttaccgtggcacaccaccgacgccgcgctttatctaccgcgtaaccaacccgtccactaacttccagttgttccagaccggcgaaaccgattacgactcgtttacttctcgccctgatgatatcgaacaactgaaaatgctgggcttcgccaatatcaacctgtttggctccagtgactacagcaaagtggaattcaacgtacgtcgcccggcgttgcaggacgtgaaagtgcgacaggcgctgatttatggtctcgaccgccagaagttgattgatgtggtttatcagggctatggaaaagtggcaattgaacctattgccccgatttcatgggcgtataacacagatggcgtgaatccatacaaatttgacccgacacaggcgaagaaacttcttgatgaagcgggctggaaaccggggcctgatggcatccgcgtgaaggacggtaaacgtctggagttgacgctgctggtgagcaagaaagtgctgaatgatgcgctgatccccatcgccaaagagaactggcagcagattggcgtgctgttgaagccgcaggtggtggatttcaacgccctcatggcacagcgtaaagccggtaactatgacctggcctctttcagcaccagcacactcaacgatccacatgatggcgtgtgggattactacagcacggaagcgaaagagtccggctataacaatccgcaggttgataagctgatcaacgaaggtaatgctgtgctggatgtggaaaaacgcaaaccaatttatcaccagctgtataaagtgctggcggacgatccgccggtgattctgctgggtaaccgcgagattttatcggccagtagtgcccgcgtcaccggctttaaaccagatatctacaacgggctgaccggtagcctgccggatgtgaaaatcattaaataacagtaacaactgccgggtctcccggcagttgtcatgagaaagctatgcgaaattttatcctcaggcgactgttgcaaaccctgccaatgctgctgctcgcatcactgattatttttatgcttttcgcgaaaacgccaggcgactttatcgacggtaacattaccctcaccgctgcgcgcgccgccgaactgaaagctatttatggactcgatcaaccgatccttacccgctatctgcattggctcggccagttgctacgcggcgatttggggttctcgctgcaataccaaattccggtgagtcagctacttaaccagtacatctggaactctttcctgctggcaagcgttgcgctggtgttttactggagcatcgggcttgcggtgggcattgcctcggcgctgaaacccaattcgctgttcgatcatctggtgagcgtgtcggtgttcgccgccatgtctttcccaaccttctttctctgcctgttgcttattaagtggttcgcagtcgatctgcactggttgccagtgggcggcatgaccaacaccggcagcgacgataacggctgggtgtgggtgatgcaggttgcggcgcatctggtgttaccggtcatggcgctggtgatgttgcaggcgggcagcctgacgcgctatttccgtgccagcatgcttgacgtagtcaagatggattttatccgcaccgcgcgtgctaaagggttgcgcgaacgtacagtgatccttaaacacgcgctgcgcaatgcgttgctgccaatcatcaccctgttaggttttgagctgccggggttgttttccggcgcgatcatcaccgaaaaggtgtttaactggccgggcgcagggcatattcatattgattctctggccgcccgcgattatccggtgctgatggggttcaccctgtttcttgcggtattgaccattgtgggcaacctgattgccgatatattgtacgcgtgggccgacccgcgcattcgcgtgaggtcgtgatgttcggttcccttttctctacgaatcgccgcttacgcaaggcggaaattccggcgatggcgcaggccacaccttctccgtggcaccaggcgtggaaagcgctgcgccacaatcatctgtcgatgctgtgcctggttctgctggtaatcatgaccatctggtgcgtgctgggcccggtgtggtcgccgtggaaagatgacgccaccgatgcgctgatgatcaacaaaccgcctggcgcagaacactggctgggcaccgattttcttggccgcgatatttatacccgcctgctgcttgccggtcgtatctcgctgattattggcctgatgaccatgctactttcggtggctctgggctacctgctgggtgcggtatccggctatgccggcggctggacggacaaactgattatgcgcatggcggatctggtgatgacgatccccagcctgccgctgctgattgttgccggagcgatgttgtctgagctggatttttcgtctgattcgcgcatctacatggtagtagtgatgcttagcttgctggagtggccgaagctggcgcggctggtgcgcgggcaaatcctgtcactgcgcgaacgcgattttatgctggcgacgcaggtcctgggcctctcttcgcgccgccgcctgttcggtcatctgttgccgaacaccatacccattctggtggtgatggcgaccatggcggtggccaacgccatcctgatggagtccgcgcttagctacctcggccttggcgtcgtaccgccaacgccctcatggggcaatatgatggacgcggccaacagcctgatcgactttcagcgtcgcccatggctgtggatgccgccgggcattgccatttttctgaccgtcatcgccattaatgtgctgggcgatggcctgcgcgatgcgctggatccgaagatgaaacggagcctgaaatgagcgagccgctaattacctttaataacttatccatctccttcgccagcgagcaggggcgtgtgcgcgctgtacaggatgtctcctttaccattcaggcagggcaaaccattggtgttgttggtgaatctggctgcggcaaaagcgttaccgccatgtcgctgatgggactgttaccgccgcaggttgcgcgtatcgacggcggagaaatccgctttcagggcaccgatctgcttgccctgaagccgtcgaaaatggccgatctgcgtggtaatcagttagcgatgatctttcaggagccgatgacagcgctcaatccggtgctgaccattggcgagcagctttgtgaaccgctgatacgccatcgcggcgaaacaccaaaagcggcctggacgcacgccacgcaactgatcaccgatgtcggactcgggcgtgcggagagtctgatgggttgctatccgcatcagctttccggcggcatgttgcagcgcatcatgattgccatggcgttaagctgccagccgaagctgctgattgccgacgagccaaccacggcgctggatgtcaccgtgcaggcgcaaatcctgcgcttactgcgcgaccaggcgcgggcgcagcagatggcgctgatgctgatcactcacgatttgggggttatcgcgcagatggcggaacatgtcgtggtgatgtacgccgggcgcatcgttgagcaaggcccgactgccgatgtgctacacaacccactgcacccttataccaaagggcttatcgcatcgcgccctgttccgggcgagcgccgacgccgcctctactccattcccggacaggtgcctgacctggccgaaactgccgccgtactgcgcgttctatgatcgctgcgaacgcagaaccgcgcagtgccacgcggtcattccgccgctgatcgggcatacgcggcaagccgcatgtattcacagtgagttagcggagccgatcgcatgagccagcaatatgttattgaagtggacgagttgaaaaagcatttctcgctacgcgacgggctttttggtcaggaaacaggacagctacgcgctgtggacggcgtcagttttaacattcgacctggcactatttttggcctggtgggcgaatccggtagcggtaaaaccaccgtaggacgcacgctgctggggctttatgacaaaacggcaggtagcgtgaagtatcgtggtcaggagttgcaggatctgacgccgaaacagatgcgcgcgctgcgcccgaaaatccagttggtatttcaggatccttacagctcgctgaatccacgcattcgaataggtgatgcaattggggaagcaatgctggaacacacgctgtgcagcaaagaagaactgcgcgacaaagtgctggaggtaatgaaaatctgtggactggcgccgcagcattacaatcgctttccccatgagttttccggcggccagcgccagcgtatcggcatcgccagagcgctgattctcaacccggattttattattgccgacgaacccatctcggcgctggatgtctctattcaggcgcaaatcattaacctgttttccgatttgcgtgatgaccatggcgtcaccttcctgttcatctctcacgatctcggtgtcgtggagcatttgtgtgatgacgtggcagttatgtatctggggaaactggtggaaactgccagccgcgatgcgctgttcagccagccgcttcacccctacacccaggcgctgctggcggcggtgccgacgcttgcccctggaagcttatccgtgccggtggtgcagggggaaattccggatccttcgcgcccgccctctggctgtcgcttctcttcccgctgcccgcaggcaacagtacgctgccgcacagaaattccagaactgcgcgaaatgcgccccggccatcaggtggcgtgccactgggtgcagctgacgtaataaaaaagagaggattcatcctccctggttgatggagtctgacgttcaatgatgtaaaaaaccacgcctgtcagtatcagaaattaatcctgatacgaccctgtctgaaaaggtcataaaaacctatctgacctgctcccagcaaactgacatagcaatgtaagcaagttccgcttctggtacaaaacttcctgctgaaaagggcggatgaccgctatgagcgagaagcggaccttttgtggcaaagatttatatattccaattgctttaaatatcactttctggcgaagcgccttaatggaaatcaagtagagcatcaattaatatccaaacctatggaaataaacctttatggctttatgccagcactactccctgttgcactgtcccccggagcaagcttcactcttgttatgaatggagctctggctggcggttacaaaggactattcagaacgcttgccggaacagccttgggtatatacacacatgcggttctcatagggctaggtataaccgctgtgatcatctcgtctccagcaacttttgcggtgttgaaagttttcggaaccgcctatctgctctggttaggagcaatgctcatccgcagcgggataaggtcaaatgccagcgggcttgctgttacgaaacattcggtgactttaagagaggcctggatagctaatattttgaatcctaaagccatcattttttatctgacagtcgtttcgcagtttcgcagggatacagggaggcgtctacaactatctgacattggcaacagtacatgtcgtggtcatgagcgtttggcttttcgctgtcagtcaaacacttatattttcagtaaaaaaaacaaatccattaatgctcaaaaaatacgtcaacattgccggcggggtgttgctcattgcttttactctgcacagcctgacccagtaactcatcacctttagcaaaaatgtccgcttctggctgtgagttcaactgatagatgcaacacattggttaaaacgctctgcgggtgattcatagtctagcgtttttcttggcctctcgttgagctgcctggcaacactgtctagtctttgctggctgtgaaccgataagtcagttccttttggaaaatactgcctaagcaatctgtttgtattttcattggagccgcgttgccagggggattgaggatcgcagaagtaaacctggatatctgtggctacagtaaaccgggtgtggctggtcatttcagcgccccggtcccatgttaatgttttataaagctcagcaggtaattcccgggcttgtttgataagtgcagatataaccgttatggtcttgttgtccctgatcctggccagcataacaaaacgggaatgacgttctacgagggtgacgatataggagtttttagagccctggatcaggtcaccttcccagtgaccgggtatggctctgtcagcggcttcaggtggtctttcgctgatagagatcgtatcccggattgaccctaatcctttccctttaagcgatgatgttctggatctacgcacgactcttccgcttctgaggcattgctgcagttctttttttaatgcaccccgggtttgtataaaaagcgtttatatatcgtttcgtgtgacacatgcatttcctgattatccggataacagcgtttcagccaaccggcgatttgttccggcgaccagtcctgatgcatcttctctgcgatgattttacacagtgtgggtctttcaattagcttgcaaggttttggtctcagagcattttcccacgcagcagtatccgcttttgatgcacggtattgatttgcaccaccgtgcctctttatctcccggctaatcgttgagggggctctcgatagtttgtttgcgatcgccctgatgctgattttgctaccagcgctctggatatttcctctctttcatcaagtgaaagcgctaacggatgccgctttcggacaggggggcggtatccatcagtctggtggatagtgggcataatagaagaatgatatctgtcgaacattctggcgatatcatgcagggaatcaccttgcttatatctgtcccagataatcgccttctgctctggcgtgtagttaatccgagttcttcgtttcatggaaacgccccccttgattaaggatagcgttgcatcgacccgttgaactcacagcgaacagcagacgttgactgatgactactcagtgaattcatcgttattgaacataccctcccggcaacgaactcaatctcaatcgttctcagacagctagcgctagttgttgatgacgctctataaatttcgctttgagggcgctatagcgatgagcatcgttcctgctgactaatacagctgcgtgttttatctcagcatactcttctgcaatgtctttgtttctccgaagataatcacggaaagcaagatgtctcaatacctgcatatctccgactgcaaacgcatggacttgatgactacgctgatcaccacctttaatgaaatatctgcgccccgcaatcccgttctcaccgcgagcaacatacccggcgtgggccattgctgaatggtacttatccagttcattgatgtcggaaacttcaagtagcatatcaattacaggctttgctgagagaccaggaactgacgtgcttccaatatgatggacatccttagccattccaccgagcaatgtttttatcagtaaactttcagcttcaaacatctcaggccatctatcaacgtatggcacaacaataatcttccgcataaacacattctctctgtcctaagtgtgcaactcaaccctgaaccccggcattgcctgcagccggcgtttccctggtgaaaaaacagagtccactggccctcatccgaacaaatccagcaagaggaacgtagtgcatgatggctaccatcagcgtaaaacgtccgatagtgaagcagagcgtaaccgcagcccatctccgtaagacggaaatcgctgctgagaatataaggtgcagccttttcacttagcagcgacgcaatggtctctgaccggtcgaccgtcacacctgaccgggtgatttcacggaattcaggatgaagaatcagttccagccactccggatcattgcgcctgtcgccgtgaaggctgcactcaagcaatctgagcttctccagaagcactctgcttatcctcaagtgattaagccggacgttcaaatttaccataacagttcatgcgctacttccgcttctgggacgaagcggacttaaacgttggcccatgtccgctatgagcgagaagcggacttttaaaaagtaatatttgatagattgattgcagggaactaaatgattagcatctgctctttcggacaaagaaaatgactgttaacgattccctcttcgcattctctctcgcagcactgttacttaccctgactcccggccttgatacggcacttattctccgcaccgcttgtgctgagggcggcaaaaaggcttttcacgctgcgcttggcattgatgctggctgttttgtatggggcgcgctggtcgcgttaggtcttggtgctcttctggcggtttcagagatggcttacactgtgctcaaagtttgtggcgcggtctacctgagctggctgggcttacaactgctgatacgtcctcgatcttctttcagtaatggtgatgacaacaacgtttctcaggggagctggtttatcagaggaatgctggggaatgtgctcaatcccaaaatgggcattttctatgtctcttttttgccgcagttcataccagccggtcactcacctttaatatggacttttatcctggtcagcatccacgttgctatcgggactatatggtcagtcactctcattttatccacgcattttgcgtcagccgtattgaagaaaagtcgcgttgtccgggtgatggacagagcaacagggggcttatttttatgcttcgcggctaaacttgctattagcacgagatagccctggactggctggcgtcgtacgcttctggcacaagcggattagcgtctggctaacgtacgatatgagcgaaaagcggacgtcatcatatacctgagtttgcatgtaactcgcgtaaaacaatccccagtgttaatttgtaagtgaacctgttaagcaaaaccaatgtttgaatggttagtggatagatcatgggcgtagagttatatataacacgggctgatttttgggctgaaaatgaagaagcaaaaataactcctgaggagtggctttctctcattgatagtgataacgaattaacgatagaccttaaaaatggcgattatcatgctttgtggtcgggtgctttatcgcatgatgagtcatggcttgactggaacgatggcaatatttacaccaaatggccagacacgcagctatatagaaaaatgttagacattgccgggttcctcggcgctcgggtaatggacgacgatggtaatatttacagcgatccatctgcctgggaatatgaccctccttctactccttaacgtccgcttctggcaaaaagcggtctgaaacgcggccccatgccttcagtgcgttttaacctgccacaacctgtcaaaaaagaggtgcgcttgttagccgagctcaatatcgactggcgggcctgctactgcagacaatcgagcggttcaggcattgactggacctctttcaggaaatccacaaaagcgcgcagaggtgctgacataaagcggctgggaaagtagagccagggaccttcaaattcgggccaccacttcggaagcagatgcagcagttcacccgtcgtaaagcagggctgcagccagttttcaaagacggcgacagccggttgctgccggaaggcattaaagtgcggctggctatcattgacgtgaaagaccagaaaagtgttgatgcggccgtcgggcagataaagtcagaagatggaaaactagatgtgctgatcaataatgcgggtattcccggaacctggcccatcgcgcctgagtcgcagagcatcagcgatattatgacggtgtataacaccaacgttttcggcgtcatcagagtaacgcaggcttttctgccgctgctcaaactgggtgaggaaccccggattatcatggtcagcagcgggctgggatcgctggaatgggtatctgacaaagcgcatccctactctcaggtagcggcactgggctataccagttcaaaaacagcattaaatggcgttacggtggcatttgccaattcactgtctgagtatggcatcagcgtaaacgcagttgacccgggatatacggccaccgattttaacggacataccggttatcgaactgtatcccaggcggccagggggatcgtctggctcgctgctgaagtatcccagaaaatcaccgcaagattctttttggatggagagcgtgcaccctggtgaatctcgtctaataaaagcattccacctgcctgaatggggcaggttggttgacgggttgcggcagaaacgccaggcgtgtcgtgcgcagtcggttctcaaatatgtccgaatcatcctgaaggaaaataagcggctcaatgtttcttagcgcatctgaatgtaattaatggccgcctcaggcacggatcgtacagaaaattaggtcataaggtccgctttgaatgaaaagtggacccagacctacaggctggtcatcagccggggtagtttccgaagttaaacggcagttttgcaaaagatgacaacagataacgatgaccgaataaatttatctgaaatgcggtcacgccacgagcgagatacacacacactggatttactgccctgtaaatacacatactgaccaattatggctgttcaggtgaatcagtcgcctgcttcccatatccagacaacattgccgtagcttcatccatccgttgtcgatcaagtttatagaacacccagttcttgatacgtttcgatgtcacaatcccagccttagcaagaatttgcagatggcctgtcacggtgggctgactcagaccaattttttcggtgataaatccgacacacacaccatccttaaccagatcgccgtcctgctgcaccggaaaatgtgactctggatcggacagccattcaacaatcacgagccgatgctcattaccaagggcacgaaaaatatcggccattaatgtctttgagttgtgcatatagtcaatcgcctatatagtcattttcttatataactttaggggcatactatgacaaaccacagacaaaggctaacagacagtgtcacgctgaaagatatttatgcagcttccgggcgaattaaatcaacagtatgcaaaactccgctggagctttcgcacccgctgtctgctcttgtcgggacggaggtcaggcttaagatggaaaatcttcagcatacgggtagctttaagctgagaggtgctgcaaacgttcttgccagtcttaatgcagaccagcgacgtgccggcgtcatcgctccgacggcagggaatcatggtttagggcttgcctgtgcgggacatgcggcaggcatacccgtatccatattcttaccgttttcagcagacccgattaaggtttctgcaatgaagagttatggtgcgcaggttacgttttttgacaatattgaagatgcaaggcaggaagccattgttgcagcgcaacagtccggcgcaacgttcgtctcagcctataataatcagcagatgattgccggaggcggcaccgtcggtctggaaatcatggaagactggccagacgctgacgttattctcgtgaacattggcggcggcgggctggcctccggtatcgcaacagccatcaagggcataaaccctgcagccgaagtgtgggcagtgcagagtgaagcaagcccgacgtttgcgcgctggaaagaagctggtgaggcgatcccagtggaaatatcgtcgtcaatcgccgaaggcataagtggctatatagagcctgaagcgatgacctggccacttatacgtgatcgcgtcgatcgtgttcttctggtttcagaagctgaaattaaagcagcgatgctgttaatgcttaatctgcacagccatgttgtagagccttcaggcgtacccgcagttgcggcagccatccgttatgcaaaagaactgagcgggcgtaaagttgtctgtgtggtgagcggtagaaacatatcgggttcccgctatctcaaattagttaatgaggcgtcactatgaagaaacagagcggagttaaggtcggctgagctcatattgcacaacgttcttatcataacggcttcattcattacgcaggctttgaggtagtgccgcctttgacggcctgccgtttaacagccttttcgcttaaaattctatggttcgtttaagggaatgtcaggcatcatcaaaaaatatttttgtcatacaaggagtaagactaatgaatataaatataagaacagcccgggcttctgatgttgacagtattttcgaagtcagaacctcagtactcgagaattatttgagtcgtgaagaaatgcgtcagatggggatcaccgaaagcgtcgtggcggatatgattgaaaagaatttatgcgcctgggttgcggctgaaagcgaaaaaatagtcggcttttcaatgattttaccggatgaaggctgtctttttgcggcctttgttctcccggaatatgaaggccaggggataggtcgcaggctggtttttctcgccgagcaggaattattcaaacatcatgagattgcctggctggaaaccgataaaaatagtcgcgcggcgaaattttacatgcagctcggctggggcaataaaaaagagattaacgataccgatatcaaactggagaaatatcgcagcgtgtaatctactgtcattttcataaacgtccgcttatggcataaggcggacatctgcatcaggcaaattatcttctgatcaaatatctgacaaactatcgttaggctactcatgtttctggcaaatctatgataaccagtgtgccaaaactgcctttttttacatcatgaggaatcccagccttggctacgtaaagctggccagaagttacagagatttgttttcctttcacgctcagttcaagacgaccgtcaatgaccagtaacccttcatcatactcatgtacctcttcaataacagagcgttcatccattcgtaaaactttgagattcgctgtgccaatgtggcctaatacctgagagtgccaggcctctggtaatgcatgtgattcaattctaaggtcataaagcgacataacgtcactcctttgagtgttcttttaatgctcttatgccatatatatttcctaccgtcatataataaatatgggaaaataaatcgaataagagactataccattcctcattatgctcttatttctgaaatgccagattctgcaatctggcctggtcagaaccttgtttatcaacgggccgatagttaaatcgcgtcagctaatagcgcaaagcggacatttagccgcaatagcgtgtttgctgtcagacgaactgtttgtcctgcgcagacctttaatcattaatcgtcattttaaatcgcgtattttcttcgggtcggcttacattcccagactggccagcaggtcgtccacatcatcctgactggcaggagtctctggtgcggaggaaggtttagacggcgcagtgcgctcggcggtgctgtgtgagccggtattatcgcggatgacctgtatcagctgctgctcagcctgattcagcacggccatcatagcctgcacaatctgtcctgtgaggtcctggaagccctgtgacatcataatcgcgtgtaactgctgttgcgtcagacccgtgacgcgggggacatcattcagcaaggcaacggtatctgccgctaatgcctgggtctgtttctttgtctgacagcgtaccggaagtggcatcccagcgttgcgagagtttctcagctttttctcccagatcggtttgcagaggctgcgtgatttccacgctgttgattacgccctctgctgcttcgcgggtcattgtgacgacataacccagcctttcacgggcgtttgggatgcttcccgccacatcggcgatggttttatcaagccccagctgttgcagactgtcgcgaagctgccgcaggatgaagccagcacgcgccgtaatttcgccaatttcctgatgcttactatgggtgtcggatggtgacatggatgttgtttcctgcgtacagagtttcgatacctgaggttatcggcagctcgcggcgattttttaaatttcctgaggtttttactcgtgtaaaaagtgacatgatgtgaatgagacaccctagagctaacgacatcagggttgtaataggcagaaagtgttgcgcgcaggccctgttttttcagccggagggggttgtcaggtatagagcggaatgtgtgcgggttaatgactgttatgagcgaaaaaaggggcgtattacccacttctgaaacgtttacgcgagggcaggcagtatcttatttatcatgtaatttcttcgtcttaattaatccgccaacgaataacattttgtccagttgtagttaaccctcgccagttttaattctccatctacatccccaaaattaatggtctgacgttcaaaaataaactcacgcacgggtgcaggtaaaaaatcagcgccgtagcgcagaatcgtgctgtgccagaagggtgccggtaatgggctgccggtatgacgcatcagcaactcatttttccagtgcgaatccagaactttttcgcagaatgagtggcgcatggctattgccgaactatcagggatccccgcaagcaataactgactgggcaatgcaactaactgcagatctctgataacaatttttatcgcatcaaattcgctccagatattcgtcaattcatcgattttttcgggcaatggctcgtttttgttatagagcggcagagtcaggggcaggaaggtaaaatggaaaccctgtgtgggcagaatatcggcaaggggatcatcctttgtgagctgctgtaattcacaaataagacgtgagacatcaaaggtcaccggcggctgaatgcccgctgcaagagccagccttacaggatcatagtagttcccctctttaacagccccaactcctgcattttccgaccagatggagagggtgttctcgttggcagagcgatacaagctttccagatttatcgatttcattacagacctttggcattggtatgaacagaggcgattcgtcatccatgcgatttcagcccataactgttcagaagtatccctgtggctaatcgtgaacacattaccatacgctcaacgcctgctctggcataaagcggacatgtgcggtgccgggtttgcctgaaaagcattgcgaccttcccgctctgcccctaaacggacaaccagaggacagatcaggacaacagatgcctgacgtatagaatcgatcaactctctctgatattgatgatgtcgatggcgttaaatcactcctgttgagagagctaaaatgaatttttattgcagtaaggaatttaccggttcgaaggcctgggactcacagcatattgccagcttcgataatgtcagcgtgaaacttcactggaccgatcagccttataagtggcacatcaacgatggtcaggaggtttttgctgtcatggatgggtgtgttgaaatgcaatataaagagcagggcgaagttaaaagccgtgtactcaacgccggtgatattttttatgccagtgaagggacagagcatattgcgcgtccacagggcgtcgcccgcgtgctggtgattgaaaaagagggatcggtttaattaaggtgattcattaactggctgagccaacaagccagtgacaaaacgggcgatctcttctcccagattgagaagaaaggcgtcgcgtgatgggtgggtgtcagtgatatgcggcggcaggatgttcatgaaggtaaaatgcccggcatctttaaccacgcaaagttctgtctcagttcgattatctaattcttctttgatgaatagcgcttgcgatggcggtgtcagggtgtcctgctcgccactccagatcctgaccggcactttcacggaggcgagggccgagggtgctctgaaaaaatccgcaggtggcgctaacagcacaagttgattcaaatcctgtctgcctgcatatgtcaccttctctccggagcgagtccaggccgtcgccccggcgtgcattaacaaaatcacggtgccgagtgagtgtccgatgccggtaatcgaggcataatgttgacaaaacgcatcgcgggcgaggacaagcctttggctgcgttgcagtaagtcagcctttgagggcgtggaagaggttaaccgttcgaaatggggcgctaccactgaaataccattgcggctaaagatctgcagaagctcaagatgacgcaatggacttccgccagcacctgccgcaaaaaggatgcagtggctggcctcattcaccttcaataacgtgacgtcaaaattcctgtcggcatgcctgatgacagaggtttccgccctggtgttgttaatcataaagccgactccccgctaaaaggtcagtctggagatactaacccgttcccggtgaaacgataaatttccgtctgcttctggctccagactaccgttacgcaaggcgccagcagcagatcaaggatcggttattcatactctggcctcaggccaccaatctgtccgcgcttactgcgtcgcctctgcccataatgccgcctgcacagcagggcgcacactgatatttgctctgtatgccaccagcgcaggccagcgatccagttcaatgctgaagaacttacaccagcccagtacggtgaaaaggtaggcgtcagcaatgctgaatgacggccccatcagaaacgctttttcggcgagcgtatcctgcagaaagtcgaacctccggaagagcttttcacgaaacagtgacaggacagcgtcgggcagtgcctggttaaacaacagagcggaacccgcgtggatttcactggtaatgaagttcagccactcctgcagtcgaacacgcgcccagctgcctgctggcggtgccagcccgctttccggcctcaggtcggcgaggtactgcacaatcgccggcccttcagtcagtatctgcccgtcgtccagttccagtgcagcaacatagcccttggggttgataaggcgaaagtcgcgtccgtcagaggtgagcttgctcctgttatccactttaaccagctcaaactccagtgcgagttcacgcagcacgatatggggtgacagcgaacaggtatccggggcgtaataaagtttcatgtcttctccgttaacattgaaagcgatgtgagattctctttgtcgttacggaacagactgtgcttaacgcagagaattctgtaaaattaatgcttcaaaagttaactattagctgagctactgataaccatgatgaatcttctgcactggcgcttgctggtggcggtggccgatgccagcaatatttcgcgtgctgctgaaacgacaggcatgacacagtccggtgccagccaggctatcgcccagttagagtcgtcactcgggttcccggtattcgtgcgtgagcgccggcacatcggtgttaccgcgctgggagagcaggtcattgaacatgccagaattatgctgtcgcagctcagcgcgatccgcgtgctggctgatgagagccggggtttaaagggcggacgcattcggcttgccagctttccctctgtgacgtccacactcctgcctgggctgttgcgtaacttcaggcgtctgcatccgggcatggaggtggtggtgctggaagggacggatgaagaagttgaggagtggcttgcagcggacaccgttgaactgggggtggtaatgaaccccacacccggacgtgctgaggtgatactgggaaaagacgcctgggtcgccgtcatgccagccagcgctccgcacatcggtcagtcaggcgcgaacggtataaccctgcaggaaactggcagaccagccctttgtgcttgcaacaggcggatgcgtcgttaatggcaaaagcctgatggaacagtcaggattccacctctctgacgtgcgcgtaaaggtccgcgactggatcagcgcctgcatgctggtgcgtgaaggcatgggggtcgcgctggtgccggaatcagccctgccagcggaacggcgcggcctgtcagtgatgccggtcatcccgcctctgcaccgggaattcgggctggtttgttcgccttccggaaaagcttctggcgcgacgcaggcactcctgaacggactgcgtaaagggcagggtaatatctccggataaacccactacacagctgactttatctgccgttacccgatcataaacagcagaatggctggccgggaaagagaggtctgcagactctcccgcccgcgatcctttctcaactcacgtcttaacgctttgccacataaggtgatcgcggcgaataacggttttatggcgtggcggaacacgcctgaatcttcgggatggctcagaattcgcgtaactggtcgaagagttgatacaaccgcggctgatccacaagcgtagcgccttgctcgcccagtttctgctccagcgggttcagaacatcgaacagcacactgtagatctcctcacgctcgaccgtctcaatcgcttttgaacgccggtcgatgagattaaaggcttcggtataggcggttacggcggcggttaacaggctcgccacatccatgctgctatcgatgttgttcgtggcagcccgcaggtttttgtaagccagcgctgcttttttggcataagtggccgaaatatgttcgcggccatcccagtcccggaaaggattgtgcagattctcagccagccattccggcttgcgtgctttactcagcgagagatccaacccctgagttgtcgcctttttataagcggttctgacagagctgatcacgtcaagcgggacgctggtcatccacaggcatgagagattgggcaacgcttctggtgagggaaagtcagccgcgctgaagccaaacaggtcgaagaaggtcagcatctgcaactgtggcagtgcggcaatacgatgcatattgctggctacgccgggatttccccagatgcgcagctcagttaagcaggtaaagcgctcaacgactgacgccaggtcaatctctttaacgcctgtcagtgacaatgccctgagccggtcaataccctgcagcacaggcaaagtctgcgaacattgcaggcacagattgcgtccctcctgatcagcctctacctgaaagcctgaagaaggcgttgcggtgagtgacagcagggagagatcaggattcagacgcacgcagctgacgccttcagggtgcagaataaaacgcgacaaacgagtcgccccgacatcgatttcgctgacgacagcggattgccagtgcaactcattaatgaagtcatgctgctgtatataggccatcagttccggggtgccatggcgggtttcgatggtcatcaggcagggcaggcgatccagttcagagagatcggtcagggtttgcaggaggtggtcattgatacgggtggtgtcctggcgaagtgtctggccgccgacaaccacgttgtgcgcgcctgaagcagccttgaaccgcgcacggctggccgggtcgatcttctcccagtttcgctgacgaacaagactgtctcccacgtcccagccgaacttgtaggcgtttacttcctgatctgacagcggcggcaggttggcaattaatacatgtcccggtgggacattggcagaaacataaccgtgatcgaagctgtctttgacaaaatagtagctacagcgcaaaggctgcatacggctggcttccgccctgtcaggcaaatgatcacctgcccagtcgagctggagtatggctgcaaggactttgcctctggcattagcaggctgctggaggtgtgtcacctgacaggcgacatactgctgcaactgcggggaaaacacgctgtagatatcgccgacctttgcttgcactctcgctcctctcagtcaaaaattttacagtcagaaaatctgatatagcgcgcatcctgctcaggggtgcgctttgccacggatctcagatccatccagcacactagcctggcataacgttttaacgaaatgctggcgcgtgaacgtttttattttttttcgcggcaggtgacagcgtcagtcgggttgcacgcagcagcccgactgacgaagcctgcccggaggcatgcggggcaggtattcagcttacaggcggttaccggcctcaaccagttcgttataggattttaaaacacgcatcggtgaacccgataccatccagcctgaattgccgcttcctttcagcagactctgctcacccgtgctgtaaggtgttttatcgcgaatccgacgcatgcgatccttgcagtctttcaggaaggttccggcattatcctggaagatggaccaggttaatggcttgcccgcttcgctggccgttgccttttctgcctcactcagcagcgtactgtaagcatcaatcgcttttgtcatctctgtcacgtcgggagcggaagaggtaaacagggtcgccagcggtttggcctgtgtgactaatgccaggcggtagtagcgactatgacggccctcagacttttcaatctcaacgagttgcgcagcaacgacctcattgttctctttttcaacttcggcaccgaactggtcgctggatttcataaagctgttaaacgccttcatgagtggcggatgcatttgtttggctttcgcgaagccatcatccttgtaatcttcctgactgtagtaaagatgagcctgcgaaaccagcggctgcaatgtcgttaaatccgccagatactgtgttgctgcagcatccagcgccggtaacgtcggtttagctttcgatgcctggttgatggctttagtgcagctctccagttcataaggcgtgacctcgcccagtacgttgacgctgcgctctttgccggttggccccttttcagcattcgccatccagctcacatagcgcagggcactatcgcgaaccgatccatccgtagtgttaaagcaacccacataggcgtttaattttgtggtgagttgcgcagcgctatcctccgcaacagcctggggttgactctgcggggcgggttttgcatccgctttgtcactgttgtcacatgctgccagcggcagcacaagggcagtcaccagcatcccgggtatcatggccctgcttgctcttttaaacacaatcgttcctttatttatgtggtcagaaatagagaatgaaaataaatgttcgcattggctcccttttcagctgcgaggagggagccgatgacaaacgggttatgcgctttgcgtcgctgccgccgtttcttctttcagcaacgccctgactgtctgatgacgatgccagtaatagccgagggtgtttttaaaggcttcaatctcctttttcaggcccggcagagggatctcactgcgtttttttccctgcgagtttggctgcacatgttgcacgtagagcttatcccggccgaagctacgaatgacgttgatgtttttaacgttatcccactccagcacttcgccggttttcggcgacacgatgccctgccaggtgatgacgatctgcgagccatctttcagggtataaggaacattggggaaatgcttcagcaccagcgcggtttccatttcaccgtcaggctgatagcgccaggccaggctctcttcatgcacagaagaaaagtcgcgctcatatttctgccacaactgctgttcaatctcgttggcaaccggcatcagatcgacccagctctgggccgggaaatcggcggcgatcgctgcatagtcagcttcgttaatctcataccctacgttacgcatcctttccgccagaggcgggtgtgaatcaaacgggtgcggcacattctgctcacggatgacgctgataaagtccggagaggcgacatgttctggcagaccggcagcaatagctttactgatccccagttcattttcgtgcagcgtctgattattaaagaagtttcgctcaacttcattccggtagctggcatacgcagatactttgatcagtgattcgataatcgcggcaggggagaccagcgttgatgcattgcgatccgcgacaaactcacgttcacggctgttacgctgccacgccagttcaaacagcatgcgataaagatagagcggatagaagacgatcagcgtggccacattctgacccatcagctgcatatagagatcaaaccgatgcagtttcggtcccagtaatgcgccggaggcggtgtcgccttcatgcaggtgggtcagctcatggaccatcacgccatcagcctgcgcaacggtgagctgacgcaggagcggaatactgacatagagcttacggccggtgagcggattcccattcacgttcagcggagcttcggtcacgtagaagttggtgtcgatacccgcaacaatatgatcgggtggcgtggtgcccactcttgcggcgagcatatcaatctgtgaccagagtgccggtgccgcttcgcgggtcacgacttcgccttcaatactctcttccggtgggagttttttgaagatgcctttaatcatgtaatacatgccggccagcaccagcagtcctactgccatcaccagtttgggatagtaggtttgcgtgaagaaggcggtgccccagaatgagagccataccagcatgccgccctgtaccatgacttccagcgaacaggccagcatcaggaaacttgcgggccagcgccagactgataacctgtccctggcggcttttaaaggccagcgcactgaacagcaacaccatcagcaggacagcgccgctgccgatcagtgtccagaatgccactttatccatcatgtagaactgccacagttcggattgcggttcgcagacggcgtttttgtaatcctgcagattttcatctaccggaccgcagacactggaaggcgggttctgctgcagaaacgcctgtagtttgtccgtatcctgatgttgttcccgcgcatcgtccatgaagaactgcgtgtattgctgatcaagttgtttgttgccatattcagcaaaaaacagggtaatgacagggacgagaaacagtgtgaacagcagccagaaaaatacctttagataaccctttttcaattccgttaatgtattcaaaatagtaacttcctgcatgtctatgaaagggagaagctgctgctatcaggaaattccgaaaagaatatcctggccccggttaaacggtgcggaaacatttatgcgagcttcacgatattataattattgcagagcgattataagccagcctgaacccgttttgaaaaggtatagacggatattttcggcgattttttccttttccgtcaggttatttttctggcggctcccggtggttctgccacgacagcactaatttgagttagtgctcataacttattctgtccgatctcctggccgagggctaatccccgccatctgtctgcatccgatacaccataatcctatattttaccatcagagcggtgcgaaaaaattaccagcgcatccctttgaagggattccagccgttatcgccttttttctctttcaggtaataactgtaattggtgctcatgccgtacagggcattaaagccatagcccaggccaacctgaagataccgtggaaattccatgcccgctatcgctaaggcgatgatcaaaatagtataaacaactaccataattaaaatcagcatgatgttcttcttccacaggccgagtacgaacagataaatcgggccgaaaaggaaggcaattaaattcatgttcacttttaatttttgcctgaaaggcagttgtttcaatgcctgtctgaagcctggtgtactgggagcaccatgaaggtcgaaaaaatcaaatcgggtctgccatttcgcactgtactctttagttgcgtttactttattataattttcaataggttgattcatgattacctcaatatcctgcgcagaaaactacagagaccgacactgtttcagacggatgacagccgcatgaatggtgcttatcgaccgccagaaacagcgcataagaattttaaaaacagggaagccgcgttaattcgcaccaaaataatatcggtacggtacaaatagccatgctacaccctgggtgcgctattagctgcacgggtgccggattcaggttaaacaacaatatttgaaaataaatccatcagaatcagtaatgtgaaaattgcacaggccggatatctcctgcgccggatgtaattgatattagcaccaaagaaaatatcgccacaatgataaaaatatgttaattttcaaaaaaaatattcctcgttcctcacaccttagaaggatataaagatgatcgcatggagcggagtgggttttttcgtcgcagtattaatttctgccgcctacctcctgtgtaaatggctgttagatatttattactacgacggtttctttgtcgcccatctatgggcgacaggggctacgctgatcgtttctgcccttttttgtgcggcctttgtctgggtgcttcggcaggaaaaatggctggactcccttgcacaagcaacgaaaagccagccaatgatggcccctgaaaaaacccacaacttcttttttattcccgttctctactggccgattattctgtttctgctcggctcagggatctgtatttacgacctgacccgataacacttcacatcactgatacaggccatactgatgctgtatcagcgaaatggaaatatcatcaatacgaaggagttcatggtgaaattaagaaaatcattaaacattatgggtgcgatctgcctggcaactgccatcggcggtacttctctgatggcatcagcagctgagacagcaccagctgcaaacacgcagactcagacgatctctttgctggatggcaaacagacgttcaaactgcagggctatgaaaagcagcctgtgccgggcggcggaccaggcaccatgtatgtgaacaagcaggaaaaacgcgtattgatcattggcgaagaagagatcccattgattgcgcgcggtggcagtgacgctgattttcttgaaggcgggaagtctatcaaagacaagcagaagcaggcttcaccttcttatacggtgatcagtgagaaaactgaaaataccaacggtttgccggtttatcatattgaagccaccgacaaaatgggtggcaacgatgtgcaacaggcgacgctgctggcggtcgccaacaagaaattcaccgttattcaggtggtttcaaaccacaaagacaaggctggccacctgaaagcagtaaacaatatcctcggtaagtaaggtctcagtcgctaagcccggttagctgatcgacccggataaggggttgccggtggggttcatgagtttactcagaacacacctgcaatgccttgtctgaacaatgctcaggctgacgcgtctgcgcgtcatcacggcttgcccgcaaatccctttcctgacctctttcttctggcgtaatgccaggcctgaaaacagaaaaggccgtctccggcctctcgttaaatccctgcaaacatctacttcaggctgcgcgaaacctgcggcatcgctatatccgcgctgatacgagcaccttcagcatcaaacaccatacagtggtgcggatggaaggtggggcgcagcgtctgataaggacggaaatgcacatcgccgggcagcagcatcttgaagccgtcgtggccgtggctctgaccaaacagataggtgttgttgccaagtcgctcaaccacttcgcagtggaaattgatattcagtggcgcatcgccgttgatctgcaactgctccggccggatacccagcgtgatctcatcaccaggctgcaactggcggatgggcgagggaagctgcagccgatgctcgccgtcattgatcagggcgaccaggccagcaggaccacactgctccacgcgcgcaggcaggaagttcatcttaggtgagccgataaaaccggcgacaaagcggttaatcgggttgtaatagagctccatcggtgaacccacctgttcaaccttgccgtagttcatgaccacaatcttatcggccagcgtcattgcttccgtctgatcgtgcgtcacatagaccatggtggttttcagctcctggtgcagcttcgcaatgtgcagccgcatatcgacacgcagttccgcatccaggttcgataagggctcatcaaacataaacacccggggattgcgtacgattgcgcgaccaatggcgacacgctgacgctgaccgccggaaagctgctttggtttacgatccagcagatgcgcaagctgtagcgtcttcgccaccatctctacctgatgctgaatctgcgctttcggcacgccgttcaccttcagtccgtaaccgatattttccgccaccgtcatatgcgggtaaagcgcataagactgaaacaccattgccactccgcggtgcgagggtgcgacatcattcatgacctcatcaccaatcaaaatctcaccgtcactgatctcttccagcccggcgatcagccgcagcagtgtggatttaccgcagcctgacggaccgacgaagaccgcaaactcaccggcctcaatatcaagcgcgatatttttcagcgtttctgttttaccaaagcgtttggtgacgtttctcaatctgatgctggacatgctgatcctcatggcaagggatttggcggctgaaatgtatgacgtataacagtttgtctttttacacgtcagccctgatggtgcctgcgctgactatatcgctccgccagagtgcgccctaccgctgattttgatttctgtaatagcgatcacacattgatgcgaacgggctggagcgcggtacgcattccgcgtagcgtatggctcaaatgcgatacgttactcacactgcatatgctcaataattccttgttcagcatgtgcctgaaaaaaaatatcagcaaatgacagcttaaaatgtcataccttcacatgaggccagtaatgaaaatcaaaatcagcgttacgctacttctttccgcattgatgcttaatcaatccgcctgggccgctcagcaacttaccgtctgggaagacattaaaaaatcagacggcatcaaaacggcgatcgccgattttcagaaacagttcggcgttgaagtaaaagttcaggagatgccgtttgcacagcagattgagaagctgcgtctggatggcccggcgggtattggcccggatgtcctggtgatccctaatgaccagctcggtagcgcggtcgtacagggattactggcaccgctgaaaatagatgcagcagagcagggcgcttacaccccctcagcaatggcggctttcacacagaacagtgtggtctacggcgtacccaaagcggtggaaacgctggtgctgatctacaacaaagatctgctgccgtcaccgctgaaaacgctggaggaataccgtgccttctcccagaagcagcgtgaggcgaagcagtatggcctgctcgctaagtttgaccagatttattacagctggggtgtgatggctccgatgggctcttacatctttggcaaagacgccaaaggcgcaattaacactcaggatatgggtctgaacaccccgggcagcgtggaagcggtgacatatctcaagcgcttcttcagtgaaggattgctgccaggcggcatcatgggcgacaacggcctcaacgccatcgactcgctgtttaccgagaaaaaagcggcggcggtgatcaatgggccgtgggcattccagccttatcaggctgccggaatcaactatggcgtggcaccgctgccgctgctgcctaacggcaagccgatgagctccttcctgggtgtcaaaggctatgtggtctctacctggagtaaagatcaggcgctggcgcagaagttccttaccttcatcaaccagccgcagtacgtgaaagagcgttatcagaaaacccaggagatcccaccggtcaccgcgctgatgaacgatccgattatcaaagatgatgagaaggccaacgcggtcgcggtgcaggcggcgcgtgcgtcagcgatgccaggcgtgccggaaatgcaggaagtgtgggggccagctaatgctgccctggagctgagcgtatccggcaagcaggagccaaaagcggcactggataatgcagtgaagcagatcaccatgcagattgaagcgatgcaggccagcaaccagtaatgcaggttcacgggataaccgtacaggataaggatcagggtgtggctatatcttccgatgaaaatctggtgacggctaagcgtccgcgtcgtcatgcgacctccggtgcgctgttggcactgctgcctggcttcggccagttttaccaccgccagtgggctaaagggctctgttttctgattttgctcagcagttttaccggcgtcttccacgattttctgcgtgagggattctgggggctctatacgctgggcgaatcggtgccgcgtgataactcaatttttctgctggcagagggcattatcagcgtactgattgccgccttcggcgtggcggtctggggagtgtcaatgcgcgacgcctgggtcaatggcgtcaggcgcgacaagggtcagcagctgaacagcgtgcgccagcagtatcagttactgctgcgcgatggcttcccctatctgatgatttcgccaggctttattctgctggtgtttgtagtggtgtttccgattctgttcggtttcgccatcgccttcaccaactacaacctctatcacacgccaccggcgaagctggtggactgggtggggttcaaaaacttcatcaacatttttaccctgtcgatctggcgctccaccttctttgacgtgctgcaatggacggtggtctggacactgctcgctaccacgctgcagtgcaccgtgggcgtcatgctggcgattctggtcaatcagaaagacctgcgctttaagccgctgatccgcaccatctttatcctgccgtgggcggtgccgggcttcgtcaccattctggtcttcgccggaatgttcaacgacagctttggggtgatcaacaacgctattctcgacttctttggcattgcacctaaagcgtggatgaccgatccattctggaccaaaaccgcgctgattatgatgcagacctggctcggtttcccgtttgtgtttgcgatgactaccggcgtcctgcaggcgatccctgacgatctctatgaggcggcgatcatggacggtgccagcgcctggacgcggctgaaaaccatcacgctgccgctggtgctctacgccattgcgccgatcatcatcacgcaatacaccttcaactttaataatttcaacatcatctatctgtttaacaatggcggtccggcggtggcggggtcgaatgccggaggaaccgatatcctggtgtcgtggatctacaagctcaccatgtcgtcgtcgcaatatgctatcgccgccactatcaccattttgctgtcgattttcgtggtaggtctggcgctgtggcagttccgcgcgacccggtcgtttaaacaagatgagatggcgtaaggaagcagttatggcgaagtccggcagtattaaacgcgaaaggtggatacgcctgtcgctgacctggctggtggtgctggccgtctcggccatcattatctatccgctggtctggacagtaggagcatcactgaatgcaggtaacagcctgctcagcagttcgatcattccggagaatgcgtcgctgcagcactaccgcgacctgttcaatggcacggtgccttacctgacgtggtactggaattcgatgaaaatcagtttcctgaccatggtgctgacgttgatcagcgtcagctgtaccgcctacgctttttcccgttttcggttcaaggggcggcagaaacggactaatgctgtttctgttgttacagatgatcccgcagttttcggcgctgatcgcgattttcgtgctgtcgcagctgctggggttgatcaacagccatctggcgctggtgctgatctacgttggcgggatgatcccgatgaacacctggctgatgaaggggtatctcgactcgattcccaaagatctggatgagtcggcgcgcatggacggtgcgggcaacttccgcatctttgttgagatcattatgccgctgtcgaagccgatcctggcggtagtggcgctgttctccttcaccggcccgctgggtgatttcatcctctccagcaccattctgcgaacgccagagcagttcacgctgccgattggcctctataacctggtgtcgcaaaaaatgggcgccagttacaccacctatgccgccggtgccgtgctgatagccgtgccggtggcggtgttctatctggccctgcagaaatacttcgtttctggcctggcctcaggcagtactaaaggataaatcatgacgccaaaaacattgattctcgccctggcgctggcctgggcgacaccgctgctcgccgccgatcagcctgtcatcggctctgccgggccgtggccagccgattttatcaaaggtgcggatatctcatcgctggccgaactggagaagcagggtgcgaaattctataacgcagataaccagcagcaggatgccatcgccatcctgaaagccagcggcatcaacaccatccggctgcggctgtgggtggatccccgcgacggcagcggtcagacctacggtggtggcggcaacgatctgacgaccacgctggcgctggcgaagcgcgtaaaagcggcgggcctgaagctactgctggatatccactacagcgacttctggacagacccaggcaagcagttcaagcccaaagcctggcagtcgctgccttttccgcagctggaaacccaggttcatgactatacccgcgacaccatcgcccgtttcaaagcggacggtgtgatgccggatatcgtgcagattggcaatgaacttaacggtggcatgctctggccggaaggcaaaagctggggccagaacggcggtgagtttgatcggctggccggtctgctgaaagccgggatcagcggggtgcgtgagaacctcagcgacccgcatcaggtgaagatcatgctgcacctggctgagggcacaaagaacgacatgttccgctggtggttcgacgagatcgttaagcgtgatgtgccattcgatgtgattggcctgtcgatgtacacctactggaacggccccatcagcgccctgaaagccaacatggatgatatctcccggcgctatgacaaagacgtgatggtggtggaagcggcctatggctacacgctggaaaactgcgatagcgcggagaacagtttccaggccaaagaggagcaggcgggcggctatcccggcagcgtagcaggccaggcggcctatctgcacgatctgatcaaagcggtgctggcggtgccggaccatcgcggcaagggtgtcgtctactgggaaccggcgtggatccctgcgcccggcaatacctgggcgacgcccgctggcatgaaatatatccacgacgaatggaaacagggtaacgcccgcgaaaaccaggcgctgtttgactgtcacggcaaggcgctgccttcgctgcaggtttttcattaaccattagcgcaaacgctgatgtctacctctgaggaacaggtatgaataaatttcccccgctcagcgcccgggttaaccggctgctgcatggtgctgactacaatcccgaacagtgggcgcaccagccgggcattattgatgacgacgtcatgatgatgaagcaggcgaaactgtaacgttatgtcggtgggtattttcagctgggcgaagctggagccggaagaggggcgctatgaatttggctggctggatgaggtgattgatacgctctggctgcaggggatatccgtgtttcttgctaccccgagcggggccagaccagcctggatgtcgcaggcgtatccggaggtattgcgtgtggggcgcgatcgcgtgccggctctgcatggtggccgtcataaccactgcatgacctcgccggtgtatcgccagaaagtgcaggcgatgaacagtcggctggcggcgcgctatgcgcatcatccggcggtgctcggctggcatatttccaatgagtatggcggagaatgtcattgcgatcgctgtcagcaggcatttcgcggctggttgcagcgccgttatgagacgctggagaacctgaatctcgcctggtggagtgatttctggagccatacctacagcgactggtcacagattgtgtcgccagcgccacagggtgagatgtcgattcacggtctgaatctggactggcggcggtttatgaccgatcaggttactgacttctgtcgtgaggagattaaaccgctgaagcaggccaatcccgatctgcctgcgaccaccaattttatggaatatttctacgactacgattactggaagctggcaccggtgctcgattttatctcctgggatagctacccgatgtggcataacgagaaggatgagaccacgctcgcctgttataccgcgatgtaccacgatttgatgcgcaccctgaagcagggcaagcctttcgtgttgatggagtcgacgccgagcgccaccaactggcagccgaccagcaagctgaagaagccggggatgcatattttgtcgtcactgcaggcggtggcccatggtgcggacgcggtgcaatattttcagtggcgcaagagccggggttcggtcgagaagtttcatggcgcagtagtcgatcatgtgggtcatcttgatacgcgcaccggtcgtgaggtaagtgagctgggccggatgctggccgcgatgacgccggtgatgggcagccgggttgaggcgcgggtggcgattattttcgactgggagagtcgctgggcgatggataatgcgcaggggccgcgcaatctcggcctgcattatgagcgcacagtgaacgagcactaccgtgctttctgggagcagggcgtggcggtagatgtaattaacggcgactgcgatctcagcggttacgatctggtgattgcgccgatgctgtatatggtgcgggatggttttgcggcgcgggtggaacagcatcttgagcggggcgggcatttcgttgccagctactggagcggcatcgtgaatgagagcgatctgtgttatcccggtggcttcccggggccgttgcggccgttgctcggcatctggtcagaagagatcgatagtctgactgatgaggagttcaatggcgtacgcggggtacgcggcaatgagctgggtctgagcgggccttatcaggcgcgagagctttgcgagcatattcatctggaaggggcaacggcgctggccagctatgagagcgatttttatgccggtaccccggcggtgacggtgaatcgcgtgggtcagggcaaagcctggtatatcgcgtcgcgtaatgatctgtcgttccagcgggatttttatggtgcgttgattaagcagctggcgttgccgcgcgcgctggcgattgatctgccaccgggcgtggttgttcagcggcgcactgatggcgaacaggcgtttctttttgtgcagaattttaccggtcaggtgcagcagctgtcgttgcctgctgggctcagcgatttgatcgatggctcggttgtgggggaatcgctggtgctggcgccatggggatgtcgcgttctgagtgtgccgctaactgagggcgcaagcctttaaagttagtttaatgccgtttgctggcatggagcaggtcaggtggacgttgctggtagcctgagcactggctcagggggcatatgccttccgcaaagacgcaaaagatggcatccctgccagctcaacacgggccatccctggcccgtgatgctttgctccaggcatatgcccccatcgctttgagtctgggcgttgtctgtggcaggggcgggaaccgttgatattgagcaggtttggttaggtttgttgccagtctgagcagaggctcagggggccagtaccttccgcaaagacgcaaaagatggcatccctgccagctcaacacgggcaattacgcacctcatccctgaggtgcgcccgttcccgggccaacgcgttgcgttgttcaaaaacgctcccggcgtttttgtccctggcccgtgatgctttgctacaggtactggcccccatcgctttgcgcatgggagttgtctgttggaagttttggaccggctttaattgcggactttgtggcggaggaatagggtttgagggcaggaagagtgtattttctgtgagtgccctgaagccagtccccctcgttttcgtttatcagtcgtgagtggcgggcatcagcccgcctttttattatctggaggagaacaacatggtgagtctgaaatcgtttaagcaatatttcagtcggcagccgctgacggcggaagaggttgagatagacagtgcgctgctggagcgtcttgtagagtgcttcggcgggcgtgaaaatattcagcaggtggacgcctgtttaacccggctgcgggtgaaggtgacatcgctgagggcggtggatacggcaggattacagaaggcgggggcgattggcgtggtgattctggggcaggaagttcatgccatctttggtacgcaatccgatcagctgcgtcagttgctggaagcccgattctttaagccgcttcagccggagtaaaaaaaatggataaccgtcgccggttatccaaataagcccctgcataagagcttaacaatgatcacaatgaggagactgctcggttaccaccaggcttcgacctgtacgccgaagttccaggtgttgttactggtgttgtcctggaaactgtgtccgtcttctgagtcattcaggtaagaggcaaacagacgcagttccgggcgtgacataaattcgggaccagctgcgagacccagcgccagcgtatatttctgacccgcctgtttgtagtcgctgcccactttgttctcatctttctgccagaaactacccacttcgccgatgccgcggacatactgcgtgaactgatactgaccacgacccaccagcgacagcagggtgcttttgctggtctgcgcggtgacgtcatccgctgaaaccccaggtaaagacctgattcagggagaacttgtcggtgatcggcagcaggccggtattgattacgcggtagccggtggcatcgcgggtatcgttccacatgtcataccagccaccgccctgtgaaatcatgttttgtgccaggcctttattggcatactggaataccagtttctgatagccgccccacatatcctgactgatttcactggtgagcataacgccgttttccgcatcatacaggccaccatactcttcctgctttttggtggtgttcggcatggcgtaatcaataccaaactcggtccaggcaccgctccacggtttccagccagcataccgaagatcgaggtagttaatgttgacgtcgttatcgccatccaccctgtaatcgacgtcattggcatcgccacggatccaggcaaaggagatcgcgcccgggcccagagtgtaattttcgatacccgcaccggagccggagatattccagtatttggtatcaatgatgtgcaaatcgtgacgctggtagtaacgtttaccgccccagatcaccgcattcttgtcacccggcaccagccctttgatctgcagattaagctgacgcaaaccaaactgcgcatcgtcaccgaaggtggtttcgttatcgttagaaccgtcggagaacatgctgaccatggtgtcgacgtaaaaactgacgtcatcctttttgtagacttcgctgcccagctcaacctcgccgtaggtgtcagcttcgttgccgagacggccaatcttgttcttttgatactcttcaataccgccatcctgcgatacgccaacgccaccacgcagatagccatggaaatcaatgttgtcgatagcagcatagagcgtcggagaggtcagggccgcagcgagcgccacagcagcagtacgtaaccttgtttccatgttatcctcaattttatttgtaatacgttcacatgacagcggcagttaacgctttttgtcagatgagtgacaaacaaaatcgcgataatgtgtgatgcagtgcaaataaagtggcggtatttgtaacgattagtgaatcagatcaccaaatctcgtgatgtgaaggtatgacttttactttttatctgcgcaatgtgactgcggtaacctggcttattcggctgctgtgataccattccgccatcggtaatcagggatgcgaattatgaaatcaaaaaatgccaccttagaggatgtcgcccgccatgctggcgtctcttatcagacggtttcgcgggttttgaataagtcggcaaacgtctcagaatcaacgcggcgcaaggtggagaactctattgaaaccctgcgctacgtgccaaacagacttgcgcaacagctggtgggtaagcagagcacaacgctgggtctggtgaccacatcgctggcgttgcatgctccttcgcaggtggccgctgcggttaaacgatatgccaatgccgctgactatcaggtgctgatcgccatgattgatgagaacgtcaatcaaagtctgcagaattgtatcaatgaactgaagtcgcagcgcgtggataaggtgattatcaacgttccgctggagagcagtgatgcggagcagatcgtgcaggagaacgacgatatcctgtgcctgtttcttgatgttgatccctacagtgcggtgtttaacgtttcgtttaacccggctgacggcacccgtgccagtgtcaaatatctctatgagcaggggcatcgggaatttgctctgctggccgggccagaggagtccgtttctgccaatctgcggttaaagagctggctggatacgctggagagctatcgtctgaagccggtcagcgtcagccacggtaactgggatgcgcaaagtggttacaacggcgtgctgcaactgctgcgtgaagcgccggagttcagcgcgctgctggtgggaaatgatcagatggcactgggtgtgctgagcgcgctgcatcagcgtggtgtagcggtgccggggcagatttcggtgattggctacgatgacacctatgaaagtgccttcttccatccggcgctgaccacggtgtcgctggatctcgatttacagggcaaagaggcggtcgcgcgtctgttgttagccagtgagcaggatgagcagcgttcctcttctatccttccggcaaaactggtggtacgcagctcgacgggtatcgccggtcagcagcaacgtgatttgaagcagattgctgagcagctgcggctgctcgccagtcgccttgagtagcagaaaccccgtaagcagataaaaaaagcataagaacgcgccgctgctatgctcagatcaggataacgattctgcacgtcggaaaaattatccgatcactaaatcggtcagtgaacgggcattctgcttcgcggtaatgcagccgacacgttcagcccggtttctctaccttcagggagtgacattatgttgtggcttgaacaggggctttacctcaggattgaagagttagcgcatggccccaggccattgccgctttccagcggttttaccccgcagacggcttatcgcgcgctgggctgttttaacccctctgaaacatcagatgcttactacattctttcaaatgaccgcgatgaaatatggttcatctgtaaccgtcatctgagaaccgttttccttgatgccagcaacacggcgtttcgggtgaaaatgcaggagccagcagagagtctgccggtactcgctgctgcacccgatggtcaaatcgtctcctttgagcgctctgtctgatgtagcctgttacgcatcagataataaaaaagccgccatcgctggcggccctgattacgtttaagtcgatgcgttatctgtaaatctgccagtaacgttttttaactcgccgtggcggtcttgattgccgggcgctggggcagtatcaccagaagagcgatgatgattagcgccagtgtcagcgaggcaccgtagcggcttagagcgagtccgcctgaggcaaggggtttgtccagaaagtcgccgaccacggcacccagtggtcgggtcaggataaaggccgcccagaagagccccgtacgcgaaagtgatgtaaagcgactggccgcccagatgattgccagcgcgccaacaaatagcagtatcccgccatcgtagcccagcccttcagtgtctgccgtccagtcacctaaggccgtgcccagggtttgtgaaaacataatagtgacccagtaaaaactctctgtgacgccgttgttcaccgaactgaccgcgactgtaccgcaggtgattttccacaggaaaagcgagaggataagcagggtgctcagcagcaaggtgccccctaaatatcctatgcccagtgagcgatcggcaaagtctgccatcgtcgtgccgacggtggttgtggccaccacggtgaaccagtaaatccatttgttgaaactgtggcgatttatctgcaccaccaccgcgatcagaaagatgatggcgaaaatcaatgtcccggtcaggtaaccgagattcatcgacatggtcaccgcatcgccgccggtttcacccagggtagtcgcagcgattttggttaaccagaaagccgcggtaacggccggaactttactgagagcgtgagaagctgtgttgttattttgcatagggtgatactccggaacagcccaacatgggctaatacagagacgatgttataagattaatcttaagaaaaggttaaactaaagaaaactatgacaggcattttgatcacagcttgtcactcactaaaccggcatttaccctttgatttaatgtaatatttgctctgtcggagtgcagtgtttgggctgttttccctgttaacctataagaattaattctgagttactctgttttcttcttaattttcaggcgatgcaaagagtgatagcccggcggcttaatcaggcgaaaattgaaggaaaatagcatcagggcgtgcgagccatgccggggcagtattgccctgataatcagcatcaggacagagtggatggcgtggcaaccccgacaatctggcgtaccagcttatcgaggccgttctgatccactactgccgctacaatattcaagccatggcgcgcaagttccagcgcggtggccgcgccaatcaactgcgaaataatcataccccagcgcttttggcagaggtggtatcattaaagattctggcccgatcggccgataaacactggctcgtacttctgacactgaatcccgggtttcgctcactcttgtgcgggcagggcggcacctcagcagctgcagacggataagcgcagcgtcagccgccgtcaatggcgggtattctcgcaatggtgaacctgtctccggatcctccttcagctacaggcggacattaacggttataatcaggtctgtagcgacgagtattgagcctgtttaatatcgtcagctacgtcggagtcggccgccatgaacacaatgatcaaaccctctttcaccgctgtctggtctacagatgcccagggtatctgcgtcgccagtcaggaaagccctgctggtctgatgcctgaactgaagggtgtgacgcagagttcatggctgagactggcacaggccgacgacgatgcaaagatcgcgctgcaactgaccgcagcacttgatttcctgacgccttttcatattgaagtgccaatccattgtctggatggcaagacgcgtcgggttattgtgtctggcctgccggatcgccagcctggcacgtcccgtctgcagtataacggcttcattcttgatgtgaccggacagcgtaaagcgctggaagatgcgctgcgcacggcggcagaatatcgtctgttaattgaaaacagcaccgatctgattgcccattgcgacgcggatggccggtacgtttcaatctcgccctcttatagcgaaatgattggctggacagccgaagaagtcgtcggtcagctggtggtggatttcctgcatcccgatgaccgcggccctgcttctgaagcactcgcctgcatcttcagcggaggagtactgccggacgtcgttgaggtgcgcaagctgcatcgtgacggccactacatcattctgggcaccaaagcctgtggcgtcatcaatccctctaccggcaaaaatatcggtgcagttctggtgtcgcgcgacattacgcgagacaaagagaggatgcgcaatctggagaagctggcaacgctggatacgctgaccgggctgcataatcgtacctggatcaacgaccaggtcgggcgcatgctggcgaaggtggatgatgaggcctatacgacggtgatgtttatcgatctgaatggctttaaggcggtgaacgatttgatgggccacgcgacaggggatgccttgctgcagcaggtcagtgaacggctgcaacgctgtatgcgtccgggcgactcactggcgcgactgggcggagatgaatttgttgtggcggcaaagtgcagaaatcgcgatacagccgctgccattgccctgcgtattattgaaagtctacacgcgccattcgccattgataatatggacgtgcgcattggcgcggctatcggtatcagccttgcccgcttcgggacggcatcggccaaaatattattcgaaaacgcggataaagcgatgtaccaggccaaagcccgacgtgatgggtcgtatcagttttttgagtcagaagagccttagtcgatgcatatgattgctggtatgaccttccggatttgaaggtaatggatcttacgtttaacgctttgccgcctgttcccgcaaggatacatttcctgaacgcctgattaacccgcctaatattctgaaaccgcgcgccacagcagaaagattttctgtttcaggctcaaaaagaagtctgttgctgatgaccaacatctatgtgcgagacaggctactgaattccctcaaacgtctgtgatgaattggcctgagtgactttacggatctccgcttacggtaactcattattcctgctggaatcatctggtcattaacctgacgctatcgacatgcaggaacgccacccgggcggagttcatacagactcatcgatatcccgtccataatcataaaccgtctgcgcctgttccatcgctcccccatgttgctttgcccagctcaccagcgcgataaaaggatcctgcaacgttcggcccagcggcgtaatcgcatattccaccgccacaggggaggaggcaatcacgtggcggctcactaatccgttgcgttccaatcgtcgtaatgcctccgtcagagacttatgtgtgatggggtcgagcctgcgcttgatggcgttaaaacgtgagggctgggagcacaacacggtcaggatcagtactgaccacttgtttgccacctgttccaggatagggcgcgtgctgttgatctcggccagcactacggtgatatcagtggtcatttggtttccttgaggatatctggtgtacatcaggtgcgtaattgacactaaatataataaatataccatcaggtgtctaacccctatccggagtggtaatgatgaaactaagtggaaagatcgccctggtcaccggtggtagtagcggtattggcctcgctgttgctcgccgttttgttcaggaaggcgcacgggtttttataacgggtcgacgtgaagcacagctggcagaggctgtagcgcggattggcggtgaggtcgaggcgattgcgggtgacatcacccacacaagcgaccttgagcgtctgtttgaaaccctcaatgccagggctggcagacttgatatcctcgtcaactcgtctggcgtgtcagaacctgcgagcctggaagagaccacggaggagcaccttgatcgcatctttgatctgaatgtgcgtgccatggtgttgacggtgcagcacgcggtacggctcatgggggagggcagcagcatcgtgctggtggggtcgatcgcgggaagcattgctaatcctggctatgctgcctattccgccagcaaggcagcggtgcgatcctatgcccgcacctggaacagcgagctggcaccgcgtggcatcagagttaatacactcagtcctggcccaactgatacaccgatgtttagccaggccagcgatgaagtcaggcagacactcagcgaacggatcccggcaaagcggctgggtaatcctgatgaagtagcggctgcggccctgtttctggcctccgatgaaagcagttacgtcagcggcaccgaactggtgattgatggcggcatgactgcataggggattagcggcggacgttgcggggttgctcgatggcatggcggggaggcttttgactcattgagaagctctccccatgctattccagctaagaacatttctaagactggtattttattcctggatttgttctggtccccctttattgttcagactcagaagtaacttcgtagcgtaaaattatattgcgtcagttcattatttctgttggtttttcactttcaggagaccaaaatttagtactcattgtactcattgtactcattgtactcattgtactcattgtactcattgtactcattgtactcattgtgaggcagaacgtcggtccatgatttctttcacgtaatgctcaataacaatgtgatgttcatggcttatctgagaaatgaatgtttgcaggaaatcgggtgtggagtgaagggtgttcgtgaccagtttatcgaagtctttctgggtaaagcggtcatagccttttagcgtcgaacgctggagcaaggtatgcgcagtaatttcgagcacggcacgtctgtaatcatcggaaagcagaatatccagatcgtgccggctgatctcaaaggcaaattcatagctgataaaaccagaatcgacaggcaatgagtaggtcagtttaccttcctcctgtgtcacatgaggttcgtatccgtcacccatgaggcgaactgattgcatattaatctcctgatctttcagacctgagttgttacttcaacagtctaaaccaccgatatcgatattattccgcttctgacgacgagcgcaaatactcacaatatcagatcgttcgatagcggaagttcccggttgttcacctgttcactaacggcaaaactgacaaagtggtatgcctgttacggagagtcatgtcaaccgtgagcagtgagctaaagttttccaggtgactttatgagccggtcgcctctccccgctggttttcttgtctgccacggataagcgctttcaggctgatccgccagtgccagcattaaattctcctgattaaatcctgcgcagaactgcatgccaatcggcagattatgggaagaaagaagcccagaggaacagacatcgcggggggtttcgccagcgcagtaaacggtgactgattgaaaacgtgatgttagcgcatcgactggctgctttgagcgaggagcggtcgcttaaattgtgacatggaagcatctcgattgttcgtgtctttacgcatagaatttgataacttgagttgccccaccaccttagagtgcgatcctactaataaaggaataaataatgaaagcaaggttgcttttaagtctattacttttggcaatgtcatttaatgtcgctgcatttactcaattcaaaccagcagtcttaaatgctgctcttttgttcgagcatgatgcaactaccgggaacgtaaaacatagcctccagtggatccgagatatttacggtaaacttcaggcgatgacagaagttagatacgatcgtaacgggtgctttactaatatcaacatggttgataaggcaaatggccatgaattccatttggtaaacaaagatggtgtactgacctcttttaaaggtcagagtattaccggaaaaatcaatgaacgctgcgaaatcactgagcttgagaatgaaaaaggcaattatgtactcagctataatgtgcgcggattgcttgaaacaatcgcggacaaagacacgggcgaagttgtaaagcgatatgaatatcacaatagccaatttcctgtgcgtataagaaactataaagatcggaaggacacgcgtatcttttatccatccggaagtgcgcaatttgttgactcagagagcgtatcaaaaacaggggacttaattgtccgactgaagcaaagctgtgcttacaccgctgatggtaatgcagataaatgctcgctgatcgcctccactaaagacgactatcgtagctcaatcttgatatggatctctaatcacgaaacggaatatttctgaatctattaaaaatatcaaagccaacgcaacctctcccgagagattgtcctgcttcctaatttttaatgccattgaaatattatcaatgtccgctcctagcacgaagcggacaagctaactgagctagaggccgctatgagcgaggagcggacatcaggttagccggtattatgggtgccgcctgtaattttcccggacagacgtctgtagtttttaatggtcgcactggaaagggttgctgccgtatctacgatgacaaagctgaaagtgttttcagttatcaggggactaagatctgtacaggcaataagaagagcctccacattaagatttgccactacagacattaaattcatccactctgcctgtacaccggagtcatgaaaacctttcgttttaatccgtccaattagcgatgtggtcatctcacgaagcagaagtggatcaataatctctttgccagaagcttctatccgcgcctgataaaaacccgcttccagtgtaggttccgtagccagtacagcaatcctggttgcctctgcaggcagtgactcaagtgcaatgtctgcgatatgcagaagtgggataccggagctcaccgccttcatttcggcaaagtagcagtgcgcaagattacagggaacagctatcagactcactttggccctgacgagttcggtaataccctgctgcagggttgcgatcatcgcattatcatcaactttcttgccaggccagaaaggtgtcggcaacgagataatatgcattttaggaaaatccatatcatatttcgctccgtacccgatgtaacagtctgttaccagcatatcaacgaagggggctgtggagcggggtcccattcctgcaagcacacctatagaaaaagtcattgtcagtgcctccttttaagatcttctttccgcttaacaaattatcgctaagttgcctgcaaaattacagacgaacggaatgaacatgccggaggtcactcagaaaggtgcaggtgaactgccgcaattgatcaacacatcatgatgcggagagagcaggcttcaggcacaaagcggacctacgctccggaaggtccgctatgagcgaaaagcgggcattcataacacagccttttttgacgcgagaatagcttttatgaacgatgcctgaaaccatctcctcttagtgcagagatagctacactgacaaagccatatgcccataagccgtcacgttctgtttattgcttgtcctggcgcagtttttccagtaactgctctgcgcctttgtccactcctgtttctgccgcactcattgagccaaacgttgcacccacgttcatagcattggggtactgttccgccacgtaggccagcaggagttcaccggttgcggcatctttcacttctacggcatagttgacgtaaccgctcatcagtccgcgcccgcctcgaacagactgaacgatattataagggccgcctgccaggtcgaatttcgtaaaggttcccacaacctgtggcgtggtgtccgcgccggtcagcgtcagcttaagccggagagaaggggtgttcccggcgctgttgatgacagtaaacttctcccgcagcacgtcggcaaacttcttctgcatgtaatctgccagattgcgtcggtcttcctgagacaggtcattaaactgtgcgtcgctgccgccatagatttcaacgggatcgatagtgatgctgcggtatttgctcaagtcaaccggggcggtgtagcgaaaggggatccggtcgctgtcatcagctgtgttgggcgtcatccgggacgtggcctgaatgccggaatattttaccggtgacgtggacgaacatcccgcggcggcaatgacggcgatcaggataagcgagcgggacagctgtttagtgaggcgaatcataaatattctccggttactttttgatataatgaactgtacggtatagttaatatggtttatcctgacactgtcaagaaaatgtttcatcgcgtgtcggtaactttcacatgaggagtgcggaatgctttatttaaacccggaagtttcgtcgtcaggcatcacgtgcaggctccgttctcggctgaccatcgcgccggtactgagggagggcaggccggaggcgatgcgggaagtgggtgctgagcgctactgtattatcctgagcctgccgctccgctattccggtctgccagtgcggcgcaggctgataagaatgatgctgacgctgcaaaaatatggcgaagccaggatcagccctgacagcccgggacgagacgcctttacaccggcagcggactatgcgcggagcgttattgatacggcaatgctgcgtggagagttgcgctgccggccctctggcgaaatggctcatgcctacctgaagcagacggaggagttacggagcctgatggctggccttcagctggataagccgctgctccgtaaagaagtgaggcgcagaacaactgattttctgctgctgtatgcggcaggtgcaggagcatgaaggtgctgcttatcaggaccgtttctggcgcttgtgtttattgccggcggcattctcactgcatttgacgcccaggtcagctgatgaatggctggctgatggccggtgcgctggaaaacacgtcggcgcggcaatggttcgtatacggggtcatgttactgatcgtggcaggtaccctcctcagaaccgccggtaatctctctgaactgggccgtctacgccggttcgggcagcgccgggccggatactatgccgtcagggtgtggggggcctcatcagggccggtgcaaatatttctggtggctgaatgcctcattgtgaatgcgctttctgtgctgctgctactgatgctcagcgatgtcaccctctggtgaaaatcctgcagcatctgtcccggctcaaagggattcgtgttttcagaatcccacaatggaagactttacatgaaagagaatacaatgatgaagaaactgtcagtgattaacggcgggggttcctggatggactggagcatcctgattttatttggtgctctcgcggtgaccgtcataattatgtggtggcacgtcatcattaacgtaaaagaaatcgttcatatccggcgcctgaaagcccgccgcggaagaaaatatacagagggggcctggggagtccaccagaactcgttaatgacgctgcttgttgcagaaattatggtggctatggccataagcaccctgattgtggtcatgctgtcggaggtatcattttagccgtgcacaggcggtatcagaaaattgcccgcctgaaggcgggctggtaaagttcagatgtggctgttgatggaaagacacccggtgagcatcaatacggtcatgccggtaatgaggctgtaaaaaagacgcatattacctcctcagaataaagaaacgcagccactcagcagaagcgaacacacggtcaggcctaccaccaaaataaaacgatttagcattgatataacctccctataagtaaactgtacgtatcagtttatatgcacccggagagtagtcaactgcttatggtgagtaatccgtctctgctcgtcaggtcagcgtggtgatgcacccgatataaatatctctacagcgcttttcaccatcgcgatgatatcttcgtgtgtataaaccggcatcttgtaccggagaaagagctcatcagcctcggcctttaccagcgcagaaaactgtttcgccctaaggtctgggcgggcgggaacaaggtcaccagcctcgatatgctgtttcatcagcgctgccagagcgttcatgctttcgcggacaccggactcataaaaaatatcgccgatgccggaatgtccggcctctccgataaccatgcgatacagctggagccccttccagtccgatgtcattgcacccagcatgccctcaccaaagcgctgcagcctttcagccaggggcaaatgacgactgtcctgactgtaaatatcgtccgccgcgcgcgtcagaaaattggtgccgtaggccctgacgacggcgtcaagaaggctttccttggaggagaaatagttatagagcgtggctttggagcactctgctgctctggccacagcatccatggatgcgcgttcgtaaccctgctcgagaaagacggtcgtggcggcgttaaggatgtcagttcgtttcttttcagtcagtgttcgcatgtggtttctccctgtaaacagactcatgttaacagaaccacccggttcattaaaggcatgcatttttagtttcagtatccagattgctgactctgaactgctcctcataattaatggaatgcagactcagcaacgtccgcttctggcacaaagcggactaaatgcaggccaagattcggtatgagcgaggagcagaaattttgacatgagctacccacttgccttataaaattgttttcacaacaaagggatattgaaatgaagatctatacttaccccaaaagccgatcattaagagtactctgggctcttgaagaaatgggagtgaattacgagtctatcagagtcgatcttttgaaccctgcttctgaggttaaatcaccccatccattgggaaaagttccttttttgaccgatggtgaagtgtcaatcagtgaaaccttagcgatctgtatttacctgtgtgaacaacataaaaacatctctatttatcccgcaactgctgaagaaaaatcctccgttaattcgtggttaagcttcacgctatccgatctggaagcccccgtctggagtctgctcaaacatgttgtcttcactcccgaaaatcaacgttccccagatttaatgaattacctcagtaaggaagcagataaagttatctctcagattaggtttaacccaactcaaacatggattgcgagtaacaactttacactggccgatatttttctttctcatacgttgttatgggcaaaactgtgcggattggaaatcaccgaagagcttgatagctacatatcaagagcaacgagtcgccccgctttcttaaaggctcaggaaataaataatcgctaatcaggttttgtcatctcttaaggatgcattgatgtccgcttctggcacaaagcggacattcttaagagtcaatacggaaaaggagagaggctgcgctctgcaggacgcagccagatatcagaaggtcgtccagtttccgtctgtatcagcaggcgcatctttcttcactacggctggtacagatacaattgcatgccgggtggctgcaggatgagagactgcagcaagcgtgaacaccgacaccgactgcagcagcagggatgcctgttcgcgcaggctctgcgaggctgaagctgattcctcgacaagtgacgcattctgctgcgtcacaccatccatctccgttacggcgatgccgacctgctcaataccgcgggcctgttcggcacttgcagcagtaatttcctcaacggtatcacttaactgaccgaccgatgacactatatccgccatcgtggtcacagaccggctcgccagggtgctgcctgcacttacgcttgcagagtttgcctcaatcagctgacggatctcaccggctgctgtggcgctgcggctagccagcgtgcgcacctcaccggcgacgacggcaaaaccacgcccctgctcacccgcacgcgccgcctctaccgccgcattaagggccagtatgttggtctggaaggcaatgctgtcaatcaccgatgtgatgtccgcaatccggccagaactttcgccgatagatttcatggttccgaaaatgtcggaagtcacctcgctgccctgacgggcgacctctctcacgttaacagcaagctgtgccgcctgacgggcattgtcggcattgtttttgactgtgacgctgagctcgctcatggtagcagcggtctgctccagtgcactggcctgctcctcggtgcgctgagacaggtctgtgttcccctgcgcaatctgcaggctggctgcggcaacgctctcggcattccggcgtactgtgctgaccgtctgcgccagcgagtcctgcatctcagcaactgcggtgagcagcataccggtttcatcccgtccgctgacagggacggcctgactcaggtctccgcgtgcgatgcgttgtgcggcggcaagcgttatgctcagtgggcgggtaatgctgcgggtgatgagccaggctgcggcgacggcaagcagaattgcggcagcactcagcgaagtcagcagaatggtggccgcatgttgttcatcttcagcagcactacgcgccgtttgcatctgttgttcctgaaaagataccaggtctgcaatagttttcagatagtcaacctgggtctggtagcgcggaccaagaagaagttgtgcggcctcgtcccgcttgcctgccattcccagcgcgacaacgtcatcagaaaaggcaagatactgactgccggtgctcctgatttgcgcaatcagctcccggcttttgggtgccttcagcagggcatcaacctgatcaaccgtagcggtaattttatcatgtaccctgtcataatcttttttaaagacggccttccggtcaggtgcatccgccaggacaacgttacggaccagccggctaaggtcagttgaatagtaacgcagattggttgcagtcgaggccttctgatagcggctgcctgcaagcgtatccgccgtctctcccagagactgaatgcgggtaaatccggtaaacgcaacgataaccagaagaagaaggatgaaggcaaacgcagcgccaagccgcgtgccgattctgatgttgttcataaggttcctagctgaaataacgtttaattaatagagctttacatgtggattaatgcttatcttttatttttgtagggtcattcagaggcagttgggggttattgctgtatgcggcttgcgcaaaatgttggactacagggaatgcatatcgatgcacttacctattcatgctgtgatgattttttgaagattaaaccggtgtttctccggcaggtctggtgacagaaataaaaaatcccggcacaggggaagcaaagccgggaaccacttctaaaagcacaaacgctgtcagtgacagaggcaatcataccgacaggcatagcttttatcggttcgcttatcagaaactttatttcttatgaaagattacgcctgagtgagtgtatgtatctccattgggaaaggatgagtgcttctgccggttccgtgatatgcaactctattgatgttcgctttgagcgaaaagcggaccaccaaggggtatgtcaggcagcatggtgtggaaaatataataaggatttgcttccaatgaaaatgagtaatttttagacttgtggccagccgatgagtacagcaccagaaacactgagtttagaataccttgtgcagcagaccgagtatcatctgcactatgtacactaaaaaatggcattgttcagaccccatatctgcagctgactaaagtgaaaataaaatgaacaaaagcagtcttaaagcgtttcccctgttacgtgttctgacgttgacgtgtgtgccaatgcttttactgggttgcgccagtgcactttgcccttttggcaccactgaaggcacggttccggactttaaaaatagttactggagatccactgaaaaaaaaccggctaagaccaatgaacaggttctggaggaatgcacccatactgccgatgctgaagagcaacgcctttcgcaggcctatttgcagctgtgtaaaaccggccatataaccggtgaaaaccaacgctttgcacagaaattactgggaaatccactcttttctggctctaaaacagcaaaagcggtcccccagcatcaatcagatgaatcagttgaagctcagctgagatggccggtgacttatagcgataatccaaagtattttaaggaaatttgcggctattacgttgaaaaaaacgcagcggaacggtccagcaccatgctgggtttacaggtggggcgttacaaagagcaggtttttaaacagtgcatggcagaaaaccatatggcgctcattgttccaaatactgaattcagtaagtgcgatatgatatcgtggtaagcaaccgtgtaagccgtgaaagcaagcgtccgattctggcacaaagctgactgacgcggccccatggtccgctatgagcgagaaacggactttaggatgatatgttaggtaacatagaaatgaagatctaaaaacggatgccacttccagtgaaagaaaacaattgccagacctgtaatcagccactgagtgagacaccagacatattgaattttgactgtggctgagactgtttaagttgcatggcctggcatggcaatccagacgtattggaggtggttgaaagacttacagatgaaaaatttgatgtccgtggacatcgaaagctttcatgtaagttttaaagtcagccatgagcgaggatcggacacaacgttttgtgtagaaacggtaagcctacggagttatataacaattcattattagaattcttccatcatacacaacattcctcttggagaaagaatcatgcgaaaagccttcaactatagaaggctgttatttgataaaaattttactcactgctaatttttgacagacatattgcaatacgggtgagttaactgagtattttttgccgaacctttaccaccatctgcaactcttttgatgtgatcatacgagacagattttgaaggatctaaatatcccctacagatagggcatgtaattgctgaagctaatgcagtatcaatgaatacagaattcttcgcttcctcactaattttagttgcattactgacacttgtcccagacagtatattaccttcaaagtgagcaagctggagtatttcactttctataaggctgaaatcactcatacccttgcgtttctttttcacctcaagaaggaaatcaatcattgactcaaataaattagagtaatattcagttcttttcttatgtcctgctctattcactaacgatgctagcattggcttattatttattagtgttttttctagattaaacctaatggttgtgaatcttttgaagaaatccttgtcattaaattttaattttttcgctatcaacagagttgtccctaaaaacatagggttaacatgtcttcctgatgcactataaaaatatacggccggatgtaatcctaaactgcccttgtcatttccagtaatccaatttagtaattttgtggttttttccaaaacaataactgtttcactgccatctgaatcttcgacttgattaagcaattctttttgataattttcgctctgggacacggaaatagacataagatctattaggatatcaagagccaacctcacgccgcgtgagccacccagaggtaggtcgagtgttttgatttgagatttaacgtctgggtcgaaaagagaggagtttatatttgaggagagttgctctatctttttagttttatcctcagggaaagaggaccagtatctatgtccttttcctgcgcgtattattgctctagctgcaatggatataggtttcttcctatgtcgaagtaaagtttcctcaacctcatctaaaggagtcccttttttatttatattgaaaaatgacgtttctgccttatcagaatcacctttaacccactggacttgcaaagctcttacgtaaatatttgtaagccttctactctcatcatggtcattattagaatcctgcattttcctttctatctcagaccatttaccaactgtggagtcaaccaattctcttgtcttctgtgcgatctttctttgttctccggaaatactgttcccaaagaatttctgcgatatagtgccatcaccatagtcattttctttccatgctcttaagacactaagcctatgtccaccgtctataacaaacacaaaagaactctttcataaaatcacggatggtattaaatcacctgtaacaaaactctttagcaatgatactacttgttctggagtccagtgatttgtttccctctgaaaatctggttttctgagtaaaccagataacatgccgatatctctcatcgctatgttttgtatagattcgaaagataaatcgttgtcggattgagcagagaaatcttctcttgaaatcatcgcatccaaattaacaaggttagctttgcttgccattcattttttcctttatcgtagggctctggttagattaaataacgtatgaaaaataaattccgtttttctgccatcactgcttaacttactttcaacaaaatagtttgtttttttacaaaaatgttttagcgaaaattttatttcgttcacaaatagacgaaaagtgggtagtaaacacatattatttttaataacacgtaataaaaatgatatcaattttttataccaaaaaatgttattaacatccgcttctggcacaaagcggactgacggcagcccagggtccgctatgagcgagaagcataagtcgctgctgcgtaagccggaatagagctttggtggtgcggcgggcgagaagaacagtccgcattcaaaaagctttctcgatggcgtcaaaaagttcttctacgatttgactcgctaagcggaaacgctgcggtaaacataaaaagctcctgctgtgcaggggctttttttattgctgtactattcagcaaaacgtatccgttaggggtacttaaaaatttttctcatgtttccgctttcgttgtcgataacctgattgctggttgagtgatgatttcactcagcatttttttcatttcaggcgataaggatatttatgaacaagctttgtgttgcggcgttgttggctctgagtttaaccggctgtgcgcagcagactttcgtaatgaaacagaatcaagttggcgcggcgacgaaaaccaccagccagccgttctttgtttcaggtatcggtcagcgtaagagcattgatgcggcgcaggtgtgcggcggccaggaaaaagttaaccgggttgaagtgcagcagacgtttgttaatggcttactgagcgtggtgacgtttggtatctacacgccacgtgaagcgcgcgtttattgcgccatctgataatgcctcaggccggttcgccggcctaatcctgcgcctgttattaaatcgcattagtatattgtaactattaaattctgctctcgcaccgctgcgcggctcgcctgctgacgacgatatccgaaacgagttcaggcaacgtcgtccagcctggtaaaagcagtggtaagctgttgatgcgtgtcagtccgctttgagcgagtaacagacattgctaaaagcgtgctgtaaggattaacagggagcaggtcagtcgccttcatcacttatacgcataaaaagatcaagcctaaggcatgcatctgcacgggcatccagatacggttttctcacctcctccagctaactcctccacaccccgacttcaatgatgacgtcgcgtagccccacaccggttaaatctgacgattgagaaagtaatgttttcactgatgatatgtcctaaaatcatgatcattgagtaaaaacgatggctgcaatcagattcatagcatcataagccgtgaaacagtcaatctgcatttcaattatttctacaaaatgaggtcaaattgaggcctttaagacaagctgctacggagtgactggcatgagtgagttagtgacaatggctttgagggtcccacctgatgacgaataaacagggtgttttgattgttaaccttggaacaccaaaagaaccaacgcctgttgcggtaaagaaatttttatctaaatttctgcatgactacagagtggtcgacttaccaagaatcatttggtgccccattctacatggcgtgattatcccattacgtgcaaggcgagtggcgaaattatattcttcgatttggatggaggaaggctcccctctcatggtttacagcgtcaggcaagcccgtgcgcttgaagaagtgacaggtatgcccgtcgagctggggatgagttatggcgagccgagtataggtggtgcaattgacaggctactggaaaaaggcgtcgataaaattatcgtcattcctttgtatccacagttttcatcttcgaccgtttcttctgtttgggatagcgtgagccgtcacctgcagataatgaagaaccggtatacaccctccataaatttcatcaatgactatgccgatcaccctgcctacattgaagcgttaagagcatccgtttcaggcatctttcgaagctaacggcgttccagatgcattgttaatttcatatcatggtataccggtaaggtttgtcaaagagggggaccgataccaggaaagatgtgagttaacgacaaaattactcattgaagcaatcaatatgccgtcattgaaaatattgatgacgttccagtcaagattcggcagagagccatggttaacgccttttactgatgagacaattaaaaacctaccgaatgaaggaataaaaagcctgcatgtcatcagcccggggttcgcatcagactgtttagaaacgcttgaggagcttgatgagcagaacagggagatttttatgcatgcgggtggtacatcgtttacttacataccggcgcttaatgataaaccgattcatatcgagatgctgcgacaacttgtgaaccttaatcggtttcagggatgattttcacacgcttgggagcagggtgttgcaggtgtcaacattcatagtgaaaccagaagtgggccctctcggacatgtatgtgatacgtgccggggcggcgttataggggccgcctggaaacccgctactccagctgcaagcaactgtcttgtacgagggtatgagtcggagattattcgtgggcaagtcagctatgagcgaggagcggacgtttagtatttacgggtacgcctgcgctggcgcacccggttacactcagggcttccagcggcgcagagaggtatggtcttcatacggcagctttgaaggcaaagaaatcagttcaatgacgctaccccacggcgtgcggccgtagcagaaaaagttattctctcccacctcagttggaaacatcaggggctgaggagaagtaaacattttcccgccagcctgctcgaacaggctgatagcctcgttgatgtcatcaacgtaaacagcaaaatgctgcaggccataatcactgggtcgcacgggctgactttgctctggccccttcatttcaaaaagttccagtcccgggccgtgcttcagcttcatcattctgaccgtggtaattttcgttcccgggaacaggttcagaatattttccgtttcttcgccttttacgtcatcgtctgaaggcgagacggagtcataaataacttctgcaccaaaggcgtcagaaaagaagcgggtagcctcatcaatatcagaaacggtaatgccgacatggtccataccgcgaataacgttggtagacatagttttctccctgtggttgttcagatgtgagtaatgttattaatcagccctggcgggccgccattgtcgcgagcgcactaagctgagccgaaatatggtcacgggtgtccgcatccgttatgtggccggattttggatcaagccgggatgaggcctgtccaatcatgacctctggcttgttaagcactctgccgtcgagaaagaccagaatctggcgcaggtgatactgcgcccttgcaccacctatggcaccgggtgacgcagtgattatggcgacgggcttaccggcaacaggggtatccggaagacgtgaaagccagtccagcgcatttttcagggcacccggcacagaatagttatattcaggtgtgacaataatcaggccgtctgctgccgctatcgcttgtcccatttccacaaccgattcaggaaacccctgagcctgcaggtcagcgtcgtaatgcggtatttctccgacagagctgagcgcgctgacatccacgcctgccggcgccagcaggctaagattgcgggctacgacggcgttaaaagattccgcgcgaagactgcccagcagtgagacaaatttcaaaggtcttgtctgtgacatgactgctccccgtgtttttaagatggatacgccgacaggtgccggcactttgttttcgaactgacttaagcctggtatagaattacacatcgataaacacgctatgagtcgccagagagtcaactttatgtctaccggttttacagcggaatccttgcgaggaatcacgacttttgtcacaacggccaggtccagcagctttactgaagctgcggagcagttgggcattacaaaatctgccgtcggaaaaagcgtggcgcggcttgaggagaggctgggaaacgcggctgtttcaccgctcaacccgtaagctaagcctgaccagcgacggagaggcctatctcaccagttgcctctctgcgctggaaattctggactcggctgaaaatacgctcagccggcggcaggacaatcctgccggaacggtgcgtatagacatgccagcatcattcggacgcaatctgatgatgccggtgctgcttgaagtgatgaatcgttatccagccctgcgtctggtgttgacctttaacgaccgtctgattgatccggttgaggagggcgttgacctggtactgcgcctgggcgaactgcagagtaccgatgagctgattgcgcgtcgtctgagccggcagcgcctcatgctctgcgcatctcccgcttatgttgagcggcatggtcagccctttgatgtcgatgcgctaaaaaaacactgctgcattatggggtaccggcggggggcgccgcttgcctggcggctgcggccagccggggagcgggaattaaagtttatctcggcctcggcacaccagataagcgacggagacgccatgcttcaggcctgcctcgcaggagcaggtattgcccagtttccggaatcgatggtgaacagccatattgatgagggcaggcttgttgctgttatgcccgatcatatgcccgtacccgtcgggctgaacgttgtctggccccggacaaggcatctgatccccaaggtcaggcttattgtcgatgaactgctgagtaaagccgaaaaaggatactttggcactcttaagtagaatttttgtcacctctcaggcgatttcagggctgtttatcaactctaagcaagcttatatcctttctgtcctgctgccatcaccgtgtcatgtgccggttctctaaacgaaagccggcacgtgttatgcgcagctcagacaaaaaaataggttaactgacaggatatttgttatgccacttgctctctgggcgctggcgattggtgcattcggtatcggtacgactgaattcatcattgccggcctgcttcccgttattgccgctgatttcaacgttactattcccgtggccggaaatctggcaacggcttatgcgctgggtgtttttgtcggcgcgccggccctgattattctgggctcaaaagtgccccgaaaagccatgctggttttcctgatgctgctgtttgtggcgggtaacctcgttacggcctttgcgcccacgctgggcattgccattctgggcaggatcatcacgtcgctgactcacggcgccttcttcggtattggttcgatcattgctgccgatatggttgcgccgtctaagcgggtaagggcgattgcattcatgttcatgggactgaccgtagcaaatcttattggtgttcccgtcggtacctggatcgggcagcatctttcctggcgagatgcttttatggttattgccgcaattggagttgttacggttattagcgtcggtatgcttatcccgcatcagccccgtccggagaaccataatttcgcacacgagtttaatgccttccgcaacgtcaatgttctgctggcgatgggcataacggtctttgggccgggtgcattttttacctccattacctatatcgcacccatgatgatcgggctggctggatacagcgaaagcagcctggcatggctgatgctgctgttcggtctggggctatttgtcggtaatcagctgggcggcagatatgccgatcgcgcgctgatgccgatgctttacgtcaccctggccgctcaggccgtagtcctgctggtatttaactttactgcccacagccaggtcatgtcagcggtctgtatttttctgatggctgcgtttgggtttgcgaccgtgtcccccatccagaaactggtgatggacaaagcgcgggcggcaggggctccgacgctggctgcagccgttaacataggtctcttcaatctcggtaatgctctgggtgcatggctgggaggggcagttatagcggccggctttggtcttcagtcgcctgactgggcaggcgcgatactctcggttatagcgctgattctggcggttatatccggactgactgacaaaaccgggcatagcgctgctatgcgttcagcttctcacagtgagtaacgtccgcttctggccctgaacagacgtcgatgagttacaggcgctgccagatggagcggaaagaaacagtttactggtaatcccgtcattgacagtgagatggtaaaacacctcacttaaagagcagcaagaatggcggattccattttctccggggtggtggtcggggcaaagcgtttgatcggttttccgtcgcgcccgatcaggaacttagtgaagttccacttaatacgaccacccagcacgccgggtaattcatctttcaggtaacggaaaatcgggtgcgttgaggtgccattgacttcaactttcccgaacatcggaaaactcacaccatagttgatgtggcatgtctgcgcgatttcttcggcaccgccgggttcctgcttcccgaactggttgcagggaaaacccagcaccaccagcccctgcgcggcgtactttttatagagcgattcaagacctgcgtattgtggcgtgaatccacaatggctggcggtattaaccaccagaaccaccttgtcagcgtagtcggccatcggaataagctggccattcagactggtggcagtgagttgataaaagggagacatgtcgcaatcctcagagcaaaaaccgtgtgacgttaacattaccacagagtgcataacgacagcggggtctgggaagcagatgcttagttagcaggtcaggcatcctggcttcagacgctaccacaaggcttaatgattatttctcacttcagatctggttgttattcctgatgaattttaaccacgactttaccctttgcatgtccctgttcaaggtaagccagggcatcttttgtgtctgcaaatgggaacaccctgtcgattaccggtttgatatgtcctgcttcaataagtttgccgatttgggtgagttgattgccatcagaacgaacaaagagaaatgaataatccagaccgcgcttttttgaaaggcgcataattttgcgactcatcagggcaaaaatcatccgcaggaagatattcagctgccgggctcgtgcgaaattaacgtctaatggaccgaccagagaaacaatctttccaccaggtttaagaatctgcatggatttttcaattgaatccccccgcagcgtgccgagtacaagatcgtagccactcagcacggtttcaaattcctgctttttatagtcaacaacttcatctgcgcccagccgactcacccactccacgttggctgaactggtcgtcgtcgctaccctggcgccaagatgtttcgccagctgaatcgcaatagtgccaattcctcccgaacctgccggaataaacactttttgtcctgcccgcagatgtgctctctctgtaaacgcctgccaggcggtgaggctaaccatcggcaacgaagcagcctcaatgaaatccagattttcaggcttaatagccgcgagacgttcaggaacgcatgcaaaatcggcgagtgaacctgttcccctgtcgaaaatgctggcgaagacttcatcgcccggcttgaaacgtgtcacccgacttcctgttgcaatcaccacgcctgacaaatcactgcccagcgttgccggaagtttaaaatgcataatcggtttgaaaattccgccggggatcatgttatcaatgggattgagaccaacggcatagacttttaccaggatttcatcggcaccgggggaagggtaatctacattttcaaatcccagctcaggtgacttcccgtagcgtttaaacgtaaaggctcgcatcgtcctggttttcatttggtgtttatcctctgatgtttagcactgacgtactttcaggtgcctctgttgctgagcaaaaaagcggctccggggagcaacgtaataaataatggaataaggttttgccggttaatatgctcatgccgccattaagacattcttggtcgatttaccgctcagcagaaccctgtaaaaggttctgctgagcagggcttagctaaagggttttgtatcgctctgcggcctcttcctgtcggatgtccgagagcagaccctgacgggaggcatcaagaacatcccagcgatcagctttatgtaatggcggaatcgtcacgtgttcgcggcggtcaaaacccgccagagcggcgtcaaccagttcgcccacttccatcatttttgaggcgttactgatgtcgataccggcacgatcccagatttcggtgtacgtacctgcagggagcaccgcctggatataaatgccttttgaagagagctcaacgttcattccctgagagaggaaaagaacaaaggcttttgttgcgccgtaaaccgtcattgcaaattccggggcgagacccactacggaactgatattgacgatcgaaccttctccggcttctgcgaaccggcctgcagcagcagtggccagtcttgtcagggcagtgacgttaagcgcgataaggcgttcaatggaatcaggcgtctgctcggtaaacgtgccggactgagcgatacctgcgttattgataagaatacctatccgcgtgtcttcccggaggcgtgcttcaacagcagttaaatcactcgccagcgtgaggtcggcaggcagcacatcgacggaaatatgattttcctgtcgcagccgttcagcaagcgcctctaatttcaatttgtcgcgagcaaccagaacaaggtcatgtccacgacgtgcaaagcgctcagcgtaaacagcaccaatacccgttgatgcgcctgtaatgaggactgaagtacgagtcataattttatcttcttcatttgtttgataaaaatcgctgttagcgaagcagggttaaccgtgatacctgaagagtaattaactgttaccgctaagcgatggatagtcggtgtagccctccgcacctccgccatacagtgtttcaggattaagcggggccagaggcgctcccgacttaagtctttcgacaaaatcggggttagaaatgaaggggcgaccgaatgcgaacaaatcggctttgtcctgtgcaagatggtcagacgccagcgccaggtcatagccattgttaccgatgtaggtgtttttaaagcggcgacgcagcgaagcgtaatcaaacggtgaggcatcacggggacctcccgtcgcgccttcaacaacatgcagataaacgatacctgaagcatcaagttgctctgccaggtagtcatattgttgctgcggatcgctgcatgaaatcgcattagcaggtgagaccggtgagatgcgaacgcccgtccgcgctgcgccgatctcatctttcacggcctccacgacctctaatagcacacgcgcacgattctcaactgaaccgccatattcatcggtgcgctgattagcaccatctttcaggaactgctcaagcagatagccattcgcaccgtgtatctctacaccatcaaaacctgcggtaatagcattggctgatgcctttctgaaatcggcaacaatgccttttatttccttcagctcaagcgctctgggttctgaaacatcaacaaaatggttgttcacgaaggttttggtttcagcacggatagctgacggcgcgcctggtgcggcaccttctggctgtaaatcgacatgtgaaattcgacctgtgtgccacaactgcacaaatatccgtccgcctttgtcatgtaccgcgtctgtgactttacgccagccctcaatctgggcctgcgtgtagatccccggcgtatcctgatagccctgcgcctctgctgaaatctgggtggcctcggtaatcagtaaccctgctgtggcacgctgagcgtagtaagtcgctgccagttcacctggcaccaagcctgcgcctgcccggttacgcgtcagcggagccatcacgatgcgattcgcaagcgtgacagatcccagttcatagggctgaaataaggattgattcgtcatggttattcctttgcggattagcgggtcagttaactgatttaatgatgatgatcgtaatcattaaagtcaactggtttgattatgatcatcatcaatgtatacttaagctcagtttcaggaggaaaagatgaaagtgtcaaaagagcaggttcgcgaaaacaggaaccgaatcgttgaaacggcgtcagaactttttcgtgagcggggttacgatggggtaggcgtcgctgaactgatgtcagccgcagggttaacgcatggcgggttctataagcactttgggtcgaaagccgatttgttagccgaagcgatgagctgcggcttcgcgcaatcggcggaaaaaactcagggtgtgagtcgggaaaagttcgttgaatattacctttcccgccagcatcgcgatgatatggcaaaggggtgtgtcatgtcggctttgggcaccgatgcagcgcgccagtctgaatccatccgcgagacctttgcggccggaattgaacgacagcttgccgttttagaaacggaacaggtcacgcgtgcggatctcatcaatacgctcgcgcagcttgtgggtgccctgatgctttcgcgtgcctgcccggataattccgggcttgctgatgaaattctggaggtctgccgtacgcgtctgctcagcccgaatgactgtaaagattgaatcgatgctcttgccgttcaaccttactgaagccgttgcggcctggactgaacgcaccagcccgctggcgttttattatgaacggcgggaatgcgtaatccggacttcccgttccggataccatttccatcaacgcgctatcaatcagtcggccatccacctgggacagtgacgcatcactcagccgttgtcgcggaatccgggataaaggctcattccaccatcgataaaaagcgtggtgccatgaacgtaatcagagagatcactggcaagccagacgacggcattcgccacatcttcagccgcaccgatacgtccataaggaatgagctttaacagcgctttgcccgcttcaccctgggtgctttcctcgttgatggcggtagcgatagcgccgggtgccactgcattgacacgaatacgttcttcacccacttcctgagccagcgttttcatcagcaagtcaacgccgccttttgatgcggcatagttgacgtgtccggcccagggaatgagctggtgaaccgaactcatatgaataatcttaccgacagctttgctgatgtcctggcgatgctcctgccgcttgaactgccgcagcgcagcgcgcgcgcagaggaactggccagtcaggttcacgtccagaacggtattccagtcctctagcgtcatctcaatggacggggcatctttctgcagtcctgagttcgccaccaggatatccagcctgccaaattccctgatcgtctggtcaaaaagattctctacatccgcctctttcgacacgtctcctttgacagcaattgcacggcctccatcggcgcggattttctcagccagctcctcggccggttccgcctggctatggtagttaatcactacacaggccccttctttagcgagtgcttctgcgcaggcatagccgagacccgagctggcaccggtaaccagcgcaacctgatttttgagagaaaagatcatgaggcatccttatttctgtaaatgatgagcgtcttaaacccggccggtatcatcgggaaagtgaattttgatgtatcgctgacactacgacgtccagccacccccaaactgattaatcggctagccggatcgggcgcatgggcctgagtcactgaattatagatgtgaagtacagggttagccgctaatgcggtcctggtggatagtcaggaaacgttgaagcaggaacataagcagtaaaaaatgggatatctgaaaggcaaaaaagcagctatcagaagatagctgcttttgacgctcaggcttttctggctggaatcccttttactatttattgcttattgcctgataaacaggccagagcttgatcattttctatcaagaccacgagaccggcccccttttcctgaggcagaggaggtggtaatgaacgctaaagagtctttaccaccattccagccgcggccagcatcatgatggtaccggctgaacggaaaaggagtcgttgcgctttagcgctggtcaggagatggcgtattctgagggctgcaaaaataaaaacggctcccacactcaaaaggactaacacggtaagcggaaccagcagtcctccccacatctgaaaagatacattatcgagagagataaccagaggcagtatagccagatagaaagcgatggttttagggttgctcagcgttatggtcagtcctgaaaaccaggctgatgccagttctcgttttgtcgctttttgatcgatatttattgcctgaggctggtggcaccagaactgccatgccagcaggcataaaaagagtgaggcagcccagttaatcagcgtaaagagagaggtaaaggtatgagcgatcaccgccagaccaaataccgccacagataaataaatcaaatctccgagaatgagaccggccagcatcgtaaagcctgttattgcgcccccactcacgctgcgagcgactaatgcagtcatccccggacccggaattgcagcagctaaaccgagtgcagcaatataagatagtatttcagtagttcctgacatagttattcctgttgaaatgcacttcggtaaaagggaacagagttagttgttcaaaaatgcctggttctgagcgatggttgtcatataaaaagcttaattaagggttaaagatatgcatcctttttatcagttggtttaacgttgaaagtggaggttcgattattccaaagcggatattgctgcattaatttaactacgcagatgacaagtttaattttcatgtgcgcgcagtgctctatccgatcctctcttcaagagatgatcagctccctgcattctttaaattaaattgaaccatatgcattaaatcagggttcagtttttccttatattgtttgtaataacaggctggaaaagtaaagatattatgcagcatgaaagcggaaaattgttacctatattatttacttaacgcctgtttttaggtaaaagtaaccctaaaccgcctccataaagaaaggaatttccccttatgacgctcagttcgacagatatgaaaattctcgaaattttacaggacgatgcccgggtaactaaccaggtgctggcggagaagataaacatttcagcatctccctgctggcgcaaagttcgtaagctcgaggaagataaagtgattcagggctatcgtgctgttcttgaccgcaagaaaattgggctgggagtaatggttttcattcgggtcgtcattgacagccatagcgaagcggaggccagaaaatttgaagaggaagtgactgccctggaggatgtggttgcctgttatagcatcggtggggatgctgactttctgctacaggttgtggcttcagatctggactcctatgctgattttgcaatgtcagtggtacgcagattgccaggaattaaagaaatgcagagtatgtttgtgcttaaagagatcaaaccactcgttagttatcctattaagaaaatctctgagtagtctattgctgacgggatgcccagtgactgattatcaattccgcatagagcggatttaatgatcaggcacgctacctgcgtgattcagcgcacaaaactgatatccggcatgatcttacacaagttaaaagcggcatagcgttagcaagcttgctgactctcctcatttttctgctttaacaacacgagtatttgtgatgacttgattgttgataacgaccaatagtgcctttcaaaacggagcagccagcagcttaaactttaattcatagcctctcttcagccaaagtcagcttaaaaagagacgcttatttacatgaaattatgccatcaatcttcccccagccataaagtccatgctttaccgtgacgataaccgttgtaccgggatttgccggcgtagtttaagctttaatgtcagggcagggttttcacgatgccgcgccctgacaatctttctcgcgactggatgatttcagtcgccgagcctatttaaggcgtctcatcagaaaatcgggcgctaatcgcatcacgtttcgtagccctgcggttgtgtcagaatatggtataaatcaggacggcgaccatggatccagcgacgtcctgtactcattgcaagcagactcaaatcaaggtcagcgctcaccataaaatcttccgctgcccaggtttcattaatgattcttccatagggatccaggatcattgcattacctgtgcgcacctcatcatcatctgcacctacgccgttactgaagagaataaataagccgttgtcatgcgcacgagcgggtagccacctcatcagccattcccgaccatttgcccctttgaatgcagcagtaatttcctcccttcgcgtttcccgttccgcccagagcgtcagcggaatgggtttcatcgcataaggactgcgggaatcggtaccgcctgtctgatgtggcgcgagaagaatatctgcacccagcaatgccgttgcacgcacattttctaccagattattgtcccagcaaatgaggatacctacttttactccccagggcgtttcaaaaacggtaaagcggtcaccgctgctgattgacggatgttcaaaagcgtggagtttgcgatgagtgtgcattgatccgtccggcatacaggcaacatatgcattatagaggcggccatcatcggctctttcgataagcccggcgccaatcagcatttgatgtttcatcgccagggaacgaatcaatgtaagggaaggactcccctcgatcggctcggcgagagcagttacctcagccgaggtgagtttgagtacatgccagtagccggtaatacacatttccgggaatgtgaggattttcacctgctcaatcgctgcctgttcaataaatttctccattatcagcagattataatttttgttatttgcctgatgctgaaattgcacggtggcagcttttaaggatgtatggttgctcatggtacttctccggtagtaatcgaaactgaattacataaccattgctgataactgtataatcaaaacatttccggtttcgataaccttttggaatgtaaaaaatgaacatccgcttgcttaaggcctttttgatgctggctgaaaaaagaaattatgccgacgcggcacgggcgttgtttatttcgcaacctgcattgaccaagcagattaatctccttgagtccctggtggaaacgtcactgttttcgcgggggcgtcatggagccacactcacgggcggtggcaggcgtctgctgccagaggctgaaaaagtggtcaggcaaacccgattatttatgcatcatgcagagcgggtttcaaaagggattgaagggcatttagccgtggggttcggtctctcaagtttttatcttgcaccacgctgtatggcagaatttcgtcgggagtgtccggggatagagatgtcattgacagatcttccttccttccagcagtacgaacttttgcaaaatgatgagctccagatcggttttgtcagagtttccgcctcctgtagcgctggattacctgccattgtttaccgatcgattggttttgattgcgcctgcaagttcaccgtcattgcctgctgatgactggctgaagaaacgtcctctgttgcgacttcatgccgggcgaggacggggtttaaatgcgcaaattgaccgttttcttcatgacaacgcgcttttcatatcatccattcaattgagtgatgatatacaaactattgtcgcgctggtcatcgcgggcacgggtgttgcccttgtgccatacagtgttatgcatattgcaccgccggagctggttattattccgttaacaggtgagtcaataagctggaaagttggcattgcctggaacgcgaaccacgaggatataatccgtgataattttattgccagtataaaaaagggtatcgcgcttcatgacgtctgaccctccagaaacaggcactccttttgccatattggaaagggcaggattactgacataattcttagccccctcttcagaacagggtcatgatacgaaagcgaccctggaggcgaataatttcctgttgcggataggacttcttaatacaaaccgtcattcaaaacgttctgcacagcaggaatagcacccccgtttcgcattatgtatctggatataactaatctgcgggtcggcaaaaaaatggccgatgagatcttcagcaactttcccctcagctatatccgcttcttttaaaaaatgctttccgtcataggcccttaatgacagcgttctgcttagcaggacttcaggtaattcattgatgtaaatgccttgccggttcatccctcccatatatagattgcatgagtgccaaaatagggcgtgtcggcaggctgatagatgtgattaatcaggagggcgctttctccagcggggatatcgcacaatgagattctgtcgggataacccggatagcactctaccgtttgtcgtactgcatggtgttttttcagatattcatcgctctgtccaaaaagatgagcaaattgcccggcgttcaggccagaaattttatatttcatagcatccctctcttttcatcgtaacaccgcgaataatgacgttatcgaatactgtgaggagaaactcgccgttatcggtcagggaattttatgatgtggccgtccgacagtggcaggcgagtgcttcatcagctgcgaaacttctcagacgctggctgatatctgcacacaagtgctaaggcctcacttcccgacaaaggcgctcaaattactctgttccccctcactctttcccgttcttctgtcgtcacttcattaaaaagaacgctgaactccacccggtaacgacatactcgtcacataaactaaggttgacgaatacttttttgtgacaaataacacaacctgattacatcttccggcgggaaagaatttttatcgtgataatggttttaccaagtacattacagttttacagagtaaaacaaaacgctttgcggattgcacgtaaagcgatgacaaaattgtgaggatcatcatgtctgaaaaacagcacatcacgactttctctgccgatattgagcagcagaccgttaagaaggtggtctggcgcattttgcccttcctgattgtttgttatctgattgccattatcgatcgcggcaacattgggatggcttcgttgcagatgaacgaagatttagggttgtcgaaagcggtatttggttttgcgagtagtctgttttttgtcggttacttcctgtttgaagtacccagcaatctggccatgcagaaaattggcgcaaagatttggatctctcgcatcatggtgtcgtggggtattatctctgtctgtaccgcctttgttgaaagtgccaatacactctatatattgcgctttttactgggtgccgctgaggccggatttttccctggcgtcattctttatctgacttactggatccccggaaagtaccgtgcacgcgtgattgctacctttatggtggccattcctgcggcgaactttattggatcgcccatttctggtctgattttgtcactggatggctggtacggtatgcgtggctggcactggttatttatcctggagggtattccggcggtcattctgggaattgcagccttctttttactgagcaatcgtcccactaatgccagctggttaaatcaggaacaaaaagagtggctgaacagcactctcgaagccgaaaatgcgaagaagaaggcaataggtcatatctctttgtggcagttgctgcgtcacaaacatatctgggtgatggcgctgatttatgcaggcgcgtctgcggcgggctcaacgctgagcgtctggtctccgcaactgcttaaatcgtttggactggataacttcaccaccggtttagtcaatgcgattccctacggcctggcctccattctgatgattatctgggggagaagttctgaccgcagcggcgagcgtcgctggcacaccgcgttaacgctgttcttaattgcaggtggcctgctgtcagcctttatcaccaatagtctgaccggcagtgtagtgatcctgtcgctggtattaatcggagcctactcaatgaaaggacctttctgggcgctggcatcgggatggatgtcatcgactaccgctgcagcgggtctggcggctatcggtgcgatggcgaatctgatcggcggtggggtgatggtcaacgtttatggcattatcaatcaggcgaccggcagccatacgctggctatggtgccactggctatcctctgtggcatcggcggcattgccgtgctggtcatgggccgcaaaaaagagttaaccatcgacgttgaaaatagcgcttcgtcagtcagtaaataaagtaatcccgcctgcagacgcttatcagcgcctctgcaggcgggttcttccggctttatctctgccatataaaaattccacatcctgtcattaactgaatcagtctgctggttgttgatgtctgttatgtgtcagatgcggaaagaacttacctttggggatttactgacaatacccagtttaagagctttcagaactgttaagcatgagatcaataaaggcgcgtacagcaggatttgaacgcctgctcgcatgccataccgcagaaatattatgccgctctactgaaaaatcagtgagaaggggcactaactccccgcgcttaacccaggaagcagccataaaacttgacaccatgcctattccggcaccggccgccacagccgcgataacggcctcgcttgcatcgacgatgacagcagatgatggcacaatttcaatctcccgctcgccaacccggaacggccagcgaaaaatctgccccgtattttgatatcgcaaattaaccgttttatgaccgataagatcattggggtgttcgggttccgggcatcgggtcaaataatctggcgaagcataacaacctatctgatagggcgacagtcgacgcgacagaagatttgaatctgcgaggtcgccgatccggatggctatatcaatactctcgtcaacaatgctaattacgcgatcactcagctttaagtcgattgtcactttaggatgaagtgcacagaattgcggaaggaggggcgcgatcacatgaacaccaatcggaaacgatgccgcaatgcgtaatgttcccgctggctcctctcgcgatcgcatggcgacctgctcaagctcctcagcatcgcgtaataactgcagcgtgcgctcgtgcagttcacgaccttcagcagtcagcaccagcgaacgggtggttcgggtgaacaatgtgatgccaagacgctgctccagtctctggatacttttacttatcgcggaaggggatactgccagcgagcgagcggcagcggtaaagctgccgagcgatcccgcacgagcgaatgcaatcagacctgttagtctttcaaagattatttgttccttcatggcaatattaaagcgaaatcaagccccattatcaatcatcacaattggtcatattctggcacctgaatctgtgttggagtgaaattgccatgactgaaatgatgaaagcagtacagctacatgcgtttggtggcccggagaatctcaggtatgaagatgcaccccgcccaactatcggggctgacgaagtccttgtgcgcgtgcatgccgcaagtctgaacccaccagacttgtatctgcgtgatggttatcgggcgcttccggctgagtggcggcccgaaccccactttcccttaatcctgggaacggatgtttcaggagttatcgaagccgtgggcgaaaatgtttccgcattcagcaccggagatgaagtctattcaatggtgcgttttcctgatggggtaatggccggtagtggagcttatgccgactatgtaagcgttcctgcatcagaggtggcgttcaaacctcatggaatagaccatatccaggcagcgggtgccccgatgtcactgctcaccgcgtggcaatttcttgtcgacgtcggccatgatgcgcccaatccgtttcaatctttcaaccataaaccggttctgcttgaaggccggacggtgttggttaacggtgcaggaggaggcgtagggcacattgctgttcagatcgcgaagtggaaaggtgcgagagtcatcgccgtcgcttcttcccgtcatgaagtgcttatgcgcgaactgggtgcggatgattttatcgactacaccaaagtagccgctgagaatgtagtgaaaaacgtcgatctggttattgatgctgttggcggaaagcatatagagcgctttttaagctgcatcagacagggcggagcactatttctggtgaatcctttgagttttaccgggcagactgaggctgctcaaaaagggattactgtgtcaacaacgcaagtgcgttcaagtggtctgcagctatccgaagcggggcttttactggaaaaaggcattatcaacgtcgtgattgacagcacctatccgttagccatggcatcagccgcacatcggcgcgcttcgtcaggaagtatccagggcaaaattgtgctgactaacttctgataaccccatacctgatcagccattttctgagggcgagtagcagtcagttaaaggaaaaataagacgcttatcatttccggttatatgtacattgatccttctgtcctggaacaatttatgggagaacttaagttattggcgaatgccgttcgacaacgtgatggaaacctttcatataacgctgtcgtggaggactatcagaccggaagattgcttatatcagaacgatggatagatcaggacgcgctcaaagcccatcttataaaaaccgacacggtagagtttatcaaccgatggcagggaaaaatgaagggggaactcttcaagtatgacgcctgtaacgagagagggcttatggatgggtaaatacaaatcttattaaaatcgagagtgctttattatcaagcctcggatctgagagtaatcgctcttcgctcatagcaggcataagcctggacgatggtctgctttgtgccagaagcggacatcagaggcttaagcagcaaggatatttttcggagctgagcaggccggatctgtcagataaatatattgagtgatatttaactgctttcatcttttgcaaaactggcgtttagtcttttcagcacttcacttatgcccctgctgacaatccgatcctcccgcattactgtccccagagtccggtgaagcgagggcgtcacagagtaaaggctgagaccctgactttcttccataccagcaacggacataaggggaacgatgctgtagcccagaccggaacgtaccattcttttgattgcttcaatactgccaagttccatcacagggctggcagtatgcccggcataccggaaccattcgtcgattagggcgcgtgtcccgcttccgggttcaaagataatcagcggcagtgacaaaagggcgtcgggagacagcgggtttcgcactctgctctgatgcatccttttccatgataacaacaaactcatcagtacccagcgggcttacgctcaggcatttgccggttactggaagcgttacaagtccaatgtctatacgattctcccctacgctccgaacaatatcggaagtattgcccgtgcgtacgtctactttcagcaggggatgtgcctgtcgcagctgttgcagtaagggaggcagaagatgaatacaggctgttgcaccagtgccaacagtaacggtgccggtgatgtcgtctgaatgcagagacaccgattcaatggccgtatttaccactgaatcaattttcatacagtgctcagaaaaagtcagcccggcaggagtgggccttatcccccggctggttctctcaataagccggacatggagcgcctgctccagctgtcttatctgcaggctgacagcaggctgtgatagtccgagagcttctgccgctccggagaaactgccccggctgatgaccatcctgaaagtagcaaggtgatcaaggttcaggtttgccatgccaaagttttccttataccgctgataagtcccgcggcctgtctgaaattatttacccgggttaatctttgtttctgaccggataaagagcaataccgatggaaataactgaagcagatgaaagacattttactgctatccagcagatttatgcttatcacgtattacatggcaccgccacttttgaaaccgaaccgccagatgtacctgaaatggcagcccgcctgaaaaaggtgcgttcagcaggactgccctggtttgtggcggttgatgatgggcaagtccggggatactgctacctgtcattttacagggaacggcgcgcctaccggtttaccctggaagactcagtctatattgacgccacttgtcagaggcggggctacggcaaaatgctgttatcccgtgcgatagcctgggcagaagcccgtgactttcgccagctcgtggccgtggtaggtaatagcgaaaatactgcctcccttgccctgcaccgcgccgcaggcttcagcatcactggcacactcagttcggtaggattcaagcacgggcgctggctcgatacggtcattctgcagcgcacgcttggacagggcgactccacgcttgcggagagcatagtttgacagccggacatctgacaggcctcagcattttctgtatcggtatgacacagcttattaactggggtattacgttctacatgccgggcgttttcggagccgccatcatggcggagacgggctggtctcccgtggtgacattctctggtctgactgttgccatgctggttatggggctggtttcaccgctgaccggttccgtcatggcccggaccggaggacgcatgatgatgatggcgggaaccttcgccataaccattgggtgttttctgatggcgattacccattccacggtggcatggattgcggtttgggtcctgacgggagtcggcatgcgccttgccttgtatgacgctgcgtttgccctgcttgtggaaaccgcaggtgccggggcccgaagggcagtctctctggttacactgctgggcggcctcgcgtcagctgtgttctggactgctggcgcggccctgctgcacattaccgactggcggcatgccttactcgtttacgggtgtgcgggtctggtgggcctgctttttctgaccgccgtttccggcaggccgtcgggtaaaacctcccgctgctggtcgatctgagcttccggcggcagggaccgcagaggaacgaaaaggatttatcagcggcctgtggtatgccgccctgatagcgctgctcagctttgtctccaccggcgtgtctacgcatttcccccagatactggccgcttatagcatgcctgctctggccggcatgctttggggcgtgggacaggtgagtgcccgcctgctggacgtggcctccggcgcacgaatctccgcactacgcctgaaccttattaccggtatcctgctgccactctgttttatgaccggccttgcggggtacgttacgcctgtggctacagccctcttcgtcctgggttatggagccgtgaacggactgtgcacggtcgtgaaggccttacttcctctcgtgctgtttgatccgcaacattacgcccgcaaaacaggcatgctgttatcaccaggattttttctcgcggcacttgccccttctgcttatgccatgctgctggaacgggacggcgtaggcggtacgctgcttatttcagctttcctgacactgttcattacggcgatttccgtagtgctctggcgacgtcattccggctcaggagtacagagccgagattagaaaatactacatctgcccgggaaaaacgtttgatacggttcgcgatgctatcaggatttgatctggattaatccgtatcttgtgttttcgcttttgcacatatcggactttatctgatgcagatatccgctttgtgccagaagcggacatcggataataatttatgttaatatttagaagaacaacattcagccataataacctcctgaattacagtcattaattttcattcatgcagccttaaaattaaatctatttttgcacttttaattttacagtcatgggaagattcctggcaggtttgcccttttcaaaacgccattttgatacggctgttattacagcatcatcgaacaagtggtctggcgtagactcgataattctcatctgacttaccctgccttctgcatcaacgtcaaagttaaacttaaccataccttctatccggttcttagccgcatagtatgggtaaacgggccgatcttgtcgaaggggcttgggttgttcaactttaacaggtgaataagtagtacatgcattgagtacaagaacagccagaatcatcataaacccatacataacaatatccttttgttgataaacattatcattatacttaaacatcaacggaaggacatttgctgaactcatcggatatcgcgttataatccaaaaaaacagtggatataaccccaataagtcttgcccccgtcttgctgcaaactagtcatccgctccttgctcatagcggacatatccttcataacacatgcccttcaattaacacttcaatgaaaccgctgcaggcagctacctcattcaatacgcgggaagagtcgttaacgattgaagggtaataaacccatttatgtgggcgaaggaagtaagccaggacggcatagaacagaatgagattcgtatcggaaaccctgaccgctaagcattacgctctaatgcagcagatttacctattaaccagccgaccagaaagcgctgttacctgtctgatcggctggagagggcggttcaggctaccggactttcgtttttcaatggttctgccagtacgtttaatatgttactggccgcgacggtgcccatcttcacgtaggagttatcactgacgccgccgatgtgtggcgacagaatcacatttccaacagtctgccagatatgcggcgcagtcaggggttcagtggcaaaactgtccagtgcggcccaggcgacagtgcctttatccagcgcggctaacagcgcttcttcatcaatgagaccaccgcgcgccgtgttcaccaggatggcgccttttttaaacagagccagtttctcagcgttaatcatctgttgcgtctgttcggttaacgggcagtgcagcgaaatgacatctgcctgtcgcagcagatcgtcaagtgaggaggattcacactcatcaggaaaggttctggcaaaaggatcataagcgagaaccttcatgccaaaagcacggccaatgcgggcaacacgaccgcctatggcaccaagccctaccagacccagcgtttctgccctccagctccaccgacttatgggtcgatttgtcccagtgtccctggcgcatgcgctgatcaagcggtatcaccgattttgcacaggctaaaattaacgcccaggtatgctcggccacggccgctgcgttggcccccggggctgactgaacactgatatgacgttcagccgccgccttttggtcgataacgtcaatgccgctgccgtgtttggaaataacccgcaggtcaggcgcggcatccataatgcgggcgttgatttttccgtatcggacgataatcgccacaggattatgctgctggcagaactggaacaggctatcttcgctgggctgtttgccggcataaacaatgctgaagtcactaagcaggtttattgcctgcggtgccaggtcattacccgtcaccaggatcacgggagaagaggttgtcatcagagcgtctccccatcgtccagcatgccagcggtttgcagggctttttctaaccacggcgcgcgaaggtcgccatcacgaatggctgcaatacggctggtctcgaaatcgagttttttctgtgccagttcgagcaacgcaggaacgtcttcacgcggcagaaccaccacgccatcaatatccccgatgacgagatcgcctggctgaatggctgcgcccgccacagaaacagggtagttgacccgtcccgcaatggacttggtcgggccgcagggattcaggcccgcagagaaaaccggaaagccgttcgcgctcagtgcatcggcgtcacgcaccgcaccatcaataataattccggcgatgccggaggcttctgcctgggtggacattatctcaccgattaatgcacagctgatatcgcctttgccatcgaccacaatgacatcgcccggctgggcaatcgccagcgcggcgtggatcgccaggttgtcgcccggtctcacctcgacagtgatagccggtccggcgactttcattgtgggggacacaggttttacgcgaccgtgcagcgttccgcgtcgtccggcaacatcagcaagaatcgccgcctgaaactgagcagcctgttttacgcgctctggtgcgatacggataatgtcgcgattgatgaaggtattctctgcatggggcatagattaatcctctttgttttatctggtacaactaagttgtacaatataaaactactatatcgatgttaattgagttcgcaccagtgttaagcattcatttgtgatgtaaatacgatgtgaatcacaaaatgcgcggtaaactgcctgccgtcgcaaacaggaggacgtaccgatggggaatgaaggcgtaattgccgtagaaaaagcgctggcgctgctggattgtttcaggcctggtgaggaatcactgacgctgaccgcgctggcgcagctttcggggtaccataaaacgacagtttatcggctaatgaactcacttgagcgcatgaactatgtcattcgtcgcgacaatggcgtttataccctggggccaagactgctttatctgggcaagctctatgaacaatcctttcatctggccagtatcgttcagcctgaacttcacgcactggcgactgcgacaggcgaaagcgccacatggtatgtgattgaaaacggtcaacgactctgtcttttcagagcggagccctctgaaggactgcgtgaaacacgtctgcccggcacttatctgccgctggataattcggccatcgggcaggtgcttcgttactgggggctgaatgaacctctgtttgactctgtacctgaactcccgctgttcacgtcaggtatccgcgatccgcatatcgcggcattctccgtaccggtgtttggtgaaggtaacaaactgctcgcggcgctggcattaaccggtccggcttcacgcctgacgcagtcgatgcgcgacagtgagatgggaaaactgatgaaagaggcagcgtgcaggctttcggtaaaatcaggcgcacataaagtgatgtgtgataacgtttataaaatttagtcgtcttgctttgctgtgaccggaacgtttcagttgccccatccatgctgcgtttaacgctctgcgggtgggaaaccgattgatttccgctaaatgactaacagcacgctggcgtgcctgattatgggatcatgaaagcctccgcgccttaagttgaggcgaaagatcactccacctctgacatctcttgctaagccctctttgtgcgaggctttttacacccggattttacatcaggtgttaaaagactcgcagcctcatgaaaatttccccgctttactgccccaacatgaatttccttcatgttcgttgaaatttaatcactttttttcaaccgggtgttgaggcataaagtaagaattgttaataactttgagtcatatgaatagttgtaaagggatagccacgctgggtaacccttaaaagcaacaacgcatatcagcgaccaggatacccgatagcgatgaacaacttagcctttaccctcaagcgcattcgtttcgacgaaaactataatccttcgaaaaatacgcgggcgacgactaacttcgctaatttagcgcgcggcgaaaaacgtcaggaaaacctgcacaacgccctggtgatgatcgacaatcgtttcaactctctggcgcactgggacaatccaaagggcgaccgctactcagttgaacttgagattatttctgctgagctgaatcttcgtcccggaagcagcgacgaaacgttcccggcgattgagattttaaaaacgcatatcgtggatcataaaaccgttcagcgcaccgaggggattgtcggcaataacttctcttcctatgtgcgtgattatgatttcagcgttgttctgtcagaacataacaaaggtcagactgaattcagcctgccggatgattttggtcagctgcatggcaatattttcaaaagtttcgtgaactcagcggtctataaagagaacttcagtaaatcgccggttatctgcctgagtgtatcgagcaaaaacacctacgtgcgcaccggtaatcagcatccggtattgggcattgaatatcagcaggatgaaccttccctgactgacttctatttcggaaaaatgggtctgaaagtgcgtttcttcatgccgcagggcagtgttgcgccgctggctttctatttccacggtgacctgctcagcgattacaccaatctcgagctgatcagcaccatcagcaccatggaaactttccagaagatctatcgccctgaaatttacaacgcgaattctgctgcgggacagtgctatcaacccacgctgcagcatcaggattattcgttaacccggattgtttacgatcgcgaagaacgcagccgcctggccgtcgaacagggtaagtttactgagacgcatttcattaagccgaatcagacacttctcgcgcaatggtctgctgaattcgttctttgattaattacatataaaaggtcacctgctatgaaaaccttattaccgacatctactgctggcagcttgcctaaaccctcctggattgcgcagccagaggtgctctggtcaccctggaaactgcaggatgaagagttagttgacggcaaaagagatgcgttgcgtctgtgtctggacgatcaggtttcgggccggtattgatatcgtcagtgatggcgagcagacccgtcagcacttcgtgacgacgtttattgaacacctcagcggtgtggattttgaaaagcgtgaagtggtgcgaatccgtaatcgctatgatgcgagcgtcccgaccgtggtgggtgaagtctcacgtcagaaacccgtatttgttgaagatgcgaaaatcctgcgtaagctgaccgatcgtcctattaagtgggcgttgccgggtccgatgacgatgatcgataccctttatgacaatcactataaaagtcgcgaaaagctggcctgggaattcgcaaagattctgaatcaggaagccaaagaattagaagccgctggcgtggatattattcagtttgatgaacctgcgtttaacgtctttttcgacgaagtgaatgactggggcatcgccgctttggagcgcgctatcgaaggtctgaagtgtgaaaccgcggttcatatctgctacggctacggcattaaagcgaatacagactggaagaaaactctgggtacagagtggcgtcagtacgaagaggtcttccctaaattacagcgttcagctatcgatattgtctcactggagtgtcagaactcgcgggttccgatggatctgatcgagctgattcgcggtaagaaggtgatggtcggtgccatcgacgtggcaacccataccattgagacacctgaagaagtggcgaatacgctgcgcaaagcgctgcagtttgtggatgctgaaaatctctatccttcaaccaactgcggcatgattccactgccgcgtcaggttgccaatggcaaactgcatgcgttaagtgcgggcgctgagattgtccgcagagagattctggggaaataatctttccctgagcagattcagtccggctggcgatttgatttctgaaagcgatcgatagccggactgagtgacaatcatccctctgccaatggtcgatttactcagggatttatgccgtctgcctgctcaggcaggccggagtacgataacggcatatcgacagccctgagtcgttttatttctgaacacgcagtcagccggatcgcccagtttccagacagtcgccagcagccatctcataggtgctggaacctgcttcaaaagtcagtgtcccttcaattacccatatcagctggcgtcttgaaacataggagattgccggcatcggcacagcggtatttgccggcagttcgacactgaccagatcgaccggcatctcgcccggtgaaacgtggcgacgcagatagccggtttccggatcctgccacaccggctgattttcatgcctgaccagcgtcccggtttgcacttcagtctgagcaagcagctgtgagatagtcatatcaaacgagcctgagaggcgcgctaacagaaccgccgtcgggctgctctccccacgctcaatcttatggatcatcgcccgtgaaacgcctgagttatcagccagctcggtaagtgaccagccgcgtttttccctttcctcttttaccttctgaccgatgcggacattcaggctgtcttctttgctggactttttatctaacataatggataactatcatagtgaacaattcatctactttagtgagtgagcaaaggggtgtccaccatgattatccgtgcggctgtagagagcgatgctgaaatcatcgcagagatttataacgacgcggtgcttaacaccaccgcgatctggaatgaaaatcgtattgatgtggctaaccgcatcgcgtggataaacagccgccagcaggccggttttcctgtgattgtggcgacagacaaagatgataccgtgctgggatatgcctcttatggtgactggcgtccctgggacggatatcgtcatacggttgagcattcggtttacgttcataaagatgtacgaggtaaaggcgcgggtgccgccctgatgcaggggcttatccagcttgctcgcgaagccgggaagcacgttatggtggcggcgattgaatcggaaaatgcagcatccatagccctgcataaaaaactgggatttattgagtctggcagaatgacggaggttggaactaagtttggacgctggctggatttgacatttttgcagctgcgtctggatgaacttaaacgaccctgagttgtcccttaaagcgaatcctttgatgatacttccggcaggatgccgatccccgcagaagaaagctatgtctggtaaatgtttgattgctgcagatcgtttaaagcgagaaacgaagccgcaacgaaccaggagatagcaaatttgcacgtcagccgatataacagataaataacaacccatcgctgaggacatcatggcgctttcgcacgaattaatcctgatcttcaccacctactttgtcgctacagccagtcccgggccaagtaatatggcgataatgggaacggcaatgaaaaagggcaggggggccgcactggcgctggctgcgggtgtcgtgagtggttcgatgctctgggcgctgctggccgcctgcggtgtgctgaccgtgctggccaccttcgcacagttgctgatcgtgctaaaaattggcggagggttatatctgttatggctggcgtttaaagccggcaaatctgcgttacgccgcactgaggccagcgattttaaagccagcgatgagcgggtcgcatatggcagactgtttcgtcagggtatcctgatgcatatcggcaatcccaaagcgattcttacctgggtggccattatgtcgtttgcactgaagccggatgtggtcgccgccacgctgccgataatcatctgcggctgtgcggtgatttgcgtggttgtgttcggcggttatgctctgctgtttctcaaccgccatgatgggcgcattctaccgtcgcattcgtcgcggactcgatgcgctattagcctgctgctttgcgctggcagggctgaaactggtattcagccgcagttaatactgatgaaggtgtacgaggggttatccgcttctggctcaaatccgcaaaagatcatgtaatgagccggagcggcattaaattaacaaggttgcggtagcgcttcagcagccccttactttaacaccactatgatcaggcaagtagtcagacaaaccaggaatctgagtgaacaggatgatgaaatgaaaggcgcatgtctgtgtgaaaccgttgctttcgaaatatcagtaacccccacgcgctattaccgttgtcactgttctttgtgcagaaaacagagtggaaccggctataacctggcaacgatcgtaaaagagagtgactttagctggatttccggtgagagccagatcgcgtcatggcgcaaacccaccggttatcgcaacgatttttgcgccagctgtggctccacagtgcctaaccggttgcgtggcaggccttatatctggcttccggttggtttactcagtgagcctgccgatatgcagtgcacaggtgattattgtactgatgacgccatgccctgggacacaatccgttccaagacaaatcattccggaccggtagaatcgctggactctcttctgacgagcttaaagcttattgattgatggcagtggtgcttctttgttattcaaaaagggttactgagtcagagcgaccctattaacggaaaacagacgttattcctgcagcctgtgttcatcgatcattattcgttagctgtaatccccagtagtcagaacaggctttaacatcgcggggagaaggaagcagaagttttggcagtctgacctggtcgtaaagctttttatggtgctttcgattttgcggggcagtacggagaatatatttcagcatctccaggttcatcggctctctgcctatccccagaccgccaatacgcggcgtggatgagtaacatctgcaaatgtaccgcagcagtgccactgtcacttttacatccagcagaattaagcctgtggcacgcgcgaatcgttcttcaatgcatttggtgtaattaccctccatcacccatctttcctgactcaccgcctcagcatgcaaacgaagaaattctgccggtgctctgggcatccattggctgtccggaatatggtgaagctggtccagatgaaccgcgggtagatctgttttgcgagcaatggcctcagctaaggtcgattttccgctgtttcgatggacccataatacaaatgcgtggcccaagcgcgtctaatggaagtgcactattcacaacgtttcctctgaattaaccctgtctgaaaatggataaatgcgtactgctctgaaactttcctgtgcaccccgcaaagtcttaaacgctgccgggagccgttggctggtcagcctggggattctgagccttttctggatcaaagtcaggccgcagcggcgatgatagccagacttgccctgagacgtcttaacccaggcagcaataagatttcggtaaagattggttacattttgccgataaattgttcaaccaatcaaaccgtagagggcattatggggttaatcaatggcgtgacaacagaggtggcaagaggatatttagccacgctcaccgtaacaaacagatctgagaacacgactaaagaaactattaccggaaaagaattacctgccagtgtggtggtgatctcgcccgaggcaagagcgcgcctggtgcaggctatcgctgagcccattacggcagagcagcaggccaaaaattcagaggaactggcaaagacaaagtcatccggtcagggaccgtccgttaacctcggatatgcgttattcaacgatccctacaccagctgggacgccagaacatttactccgcttctgagtatgacggctgccaatacgcagaccgctatggatgagtttgccgctgcactccatgaggtgctggctgaaggccaggtgggccgtaatcagtacgataattcggatacctcggaagccatggcgctgaccctgacgcagtctaagctccataaactgattgaaaaatatgtctccggcgataaccagaagcaggcgaatgacattgctgatgagatgataagcgtcaaagtcgccattcgtgaacgtcagacgttgctgggagcacaggatacgctggcgttagccatacgtcatggaacacgcgacatgcaggagagcgcacgtgactatctcagccaggttaagagcgcaaccgcacggccacaggtggagctggccgggatgatggaagccatgaagtcgggccgtgatatggactctgtcttcaacacctttgccgatttgattcgtaccacgccgaatcctgacaacaaagcacagccctccattgatggcgcactcagtcaactggaggtttatcgccagcagtggcaggcgttcactgaaaaatacgcttcttaatgttcttatgatcctgcaggcagcacctccgtcccggcgaagcaatttgcctgaaagcggcgtctgcaggatcacctcctgactttacgcagtcaggcgctgcgatgtgagactgttaatcccacgcgctgtcagcactccatccagatagtgaccctctgccagaaaccacagataccgccctggacaaaaagcacagattacacatttacaaatttaaatgtgtaaatataatgtcgcctcttcacacatcagaggattttttgtcatgccgtcactttttacccccttgagtctgggcgaccttcagcttcgtaaccgcattgtactgccgccgctgacgcgctgccgcagtgaacaaccgggcaacattcccggcgagatgatggtggagtactaccgccagcgttccagcgcgggactgatgatcaccgaaggcacccagattgagcctcgcgggcagggctatgcatggacgccggggatccacagcgaagcgcagatcgccggctggaaaaaggttacagaggcagtacatcagcaaggggccacgattttctgccagctctggcacgttggccgcgtgtcgcacaatgaactgcagccgggcaagcaggcacccgttgccccttcagccatcgcagccgataacgtccgggtatttattgaaaccggacccggcgccggcatattgaccgcacccagcgagccacgcgcactgactacatcggaagttaaagagatcgtagagctttaccgacgcgcggcggagaatgccaaagcggccggtttcgacggtgtggaactgcattccgccaacgggtatctgattaaccagtttatttctgagcacaccaacttccgtacggatgaatatggcggatctgctgagaatcgtctgcgcttcctgcgagaagtcgttgaggcggtcagctcggtatttggcagccaccgcgttggcgtcagatttgcgcctctgtttaccagtaccgacgaagagcgtgtctatctcggtctggttgaaagtgatccacacgcgacctacatccgcgcagcagccctgctgaacgagctggaagttggctatctctccattgctgaagccgactgggacaacagcccggagatgccagagagcttccgtgtcgcgctgcgggaaacattccgctctccgatcatctattcgggtcgctacacggctgaaaaagcgcagcatgtgctggaaaaaggctggggcgatctgtttggttttggccgctcatttatcgctaatcccgatctgcccgcgcggattaaatcaggatatccgctgaatgaggtcgatcacgcctccctgtatggcggcactgagaaaggctatactgactacccattttacccatcctgatattctgtgaggcggcatgtcccccgaaaatgccctgaagttactgtccaacccgaccagagtggcagtgctgaagtggcttaaaaatcctgacgaagcgtttgcgggctatacccagctctaccccttcgatcagtatggcgtctgtgccagcctcatacaggacaaggcgggcttatcacagcccgccacctcgttatgcctgaaagcacttcacaatgcggggctggttgaagccagcaaagtcgggaaatggacttactatcgccgcgccgaaaccgcgcattcgtgaaataaccgatgcggtaacccaatcgctgcaggcgctttaaaagcgacggcttacagggtaatgtagatgtcagcgccatccttctgatggtgatctcaccgaacgcattaactcagggtcagaaaatgtttatgtcagttcagtctttcaccaccgtcaccaccaccaccgcccctggcggcggcgtgagcgactctgtgacaggcacctgacacaactgattctcactccccgccgaaccggacggggagctgttctccgttcttaaaactgaatggagacacgtcatggctacatctgaaagtgcacttttaattatcgacatgcagcagggcctttttaatggtcccgaggctcccttcgccgcaaattcgatcttgtcgaacatctcacttctgattactaaagcccgggcttctgccgtccccctctttttcgcacgacatatcggcccggatgattccccttttaacgagcaaagcccgctgacgcgcctgatcccggaattgcaggctaacccgcagagtgatgtcgtcttcaccaaaagatatcccagctgtttcagggatactggcctgcagcttcagctgaggcaaaagggcattaagcaactggtgattgcggggatgaaaacggagttctgcgttgatactacctgtcgggcagccccggagctgggttttaacgtcgtactgatttccgatgcgcacaccaccgtcgataatccccacctctctgcggagaagattattgcgcatcacaaccagacgctggcgggcccctttgtgacgctggcaaccgcaactgactggcatttcggttctgccggttaagtccgattttctgacccggttccatgcagtctgcttgacgaagctgtctgcttaacctacaactaaacccgtcaggggagtctcgccagagagactgagaggctaatagcgcaccgcgcggcttagcgacccttagaacctgacccagttgatactggcgtaggaagacgggtatctcatcagatacttgccgcaggggcgcattcgcaacgttcctgccttttccctctgtatcacgggtcttcgttaacggataacgaggccaaattgaaaaatctcatcctgaatctttcttttcctgtccggtggacactatgagccgctggtcggtgctcggcagcggcgtggccgggctttgtgtcgccacgcagctgctggagcggggagaaacggtcgaagttattactcagcctgactgtcttgcggcctcgcactgggcgggcggcatgctcgcgccctggtgtgaagcagaaagcgcaccgccacaggtgatcgaatggggccagcacgcggccagctggtgggcgaaacgcgttgatggcgtggaacagcagggcacgctggtggtggctccgccgcgtgacagccgtgaactgacgcgcttcgccagcatgacgcagcagcatcagtgggtctctcccggtgacatcgaacccgcgctggaaaaccgctttgcccgcggcctgtttttcgccgcagaggcgcatctcgatccgcgccgcgccttgcagcaactgcgcgacaaactgcaacaggctggcgtcccctttcacagcgttaaacccggcggcaaaatcatcgactgccgtggcatccacgccaccgatcggcagccagccctgcgcgccgtgcggggcgaaatggtgatcctgcacacatccgacgtacaactctcccgtcctgtccggctgctgcacccacgctttccctgctatctggtaccgcgtgacgggggccacttcatgctgggtgccaccatggtcgaaagccacgacagcagctcgatcagcgcccgggcgatgatggaactgctcagcgccgcttacagcctgcatccggcgctggctgaagcgcggattgtggagagtggcaccggtctgcgtcctgcttatcggcagaaacctgccggaagtccgctacgaaaatggccgtttctcacttaacggcctctaccgccacggctttttgctggccccgatcatggctgaaaaacttatgttgcaactgactcaggagatgactcatgcgcgttgaactgaatggccgcacgattgaaaccggcgcaacgacgctggcggagcttatggcggagcagcagatcgatccgcggaccgtcgccaccgcgctgaacggggagtttgtaccgcgtagccgctatgccagccagcaacttgaggcgggcaaccagctcgaaatcctgtcaccgatgcagggaggttaaccatgttctatcaatttactccgcaatcccgatttctgctcggcacggccggttatccgtcaccggacattctgcatcaggcgatcaacgcgtcaggcgcggagattattaccgtcagcctgcggcgggaaggcagtgaaggcggcgctttccgcacgctgctgcaacagctcaacaaacgtattctgccgaatacggcgggctgccacacggtgaaagaggcggtgacgacggcgcagatggcgcgtgaactgttcgacacaccgtggatcaagctggaggtgattggccatgccgacacgctgcagcccgatccttttgccctggttgaggccgcacggattctctgcgctgacggattccaggtgtttccctacactacggaagatctgattgtcggcgaaaaattgctggaagcgggctgtgaagtgctgatgccctggggcgcgccgatcggctccggccaggggctgcgtaatatcgaggggctgcgcgctatgcgtgcgtggtttaaagatgtgccgctgattattgatgcgggcattggcgcgcctggtcaggcggctcaggcgatggagatgggttttgatggcgtgctgctcaacacggcggtggcaaaagcgcgcgatccggtgcgcatggccggtgcctttgctgctgcgatccacggcggacacgaggcgtttcaggcgggattgatggagcagcgcgacatggcgtctgcctctacgcccatttttggtctggcacaattcagttaaggagcagcgatggagcgttatcagcgacagacgatgttgccagagattggtgaagcggggcagcagcggctgagcagggcaaaggtgctggtggtgggggcgggcgggcttagtgcgacgctgctgccgttactggcaggcgcgggtgtgggatttatccgtctttacgatggcgatcgggttgaactgcacaacctccaccggcagacgctgtttggcgtcgacgatgtgggccagcagaaagtattttgcgctcagcgtgcgctggcgcagcgcaatcctgactgccacgttgaggcgcatccacacgcgctaagcgccagtcaactgccgcaggcgctggagggaatcgatctggtggtggatgcggcggataacttcgctattacttatcagctctccgacgcctgttatccggcaggcctgccgctgatctgcgcttcggtgctgggacgcaaaggctatgttggcggattctgtggcggtgcgcctggctatcgcgcgctgttcccgcagctgcccacggcctcgggtaactgcaatacggcaggcgtaatgggaccggcggtagcgacgctgggcgcaatgcaggcacagatggcgctgagcgtattgttaaaactgacgccatcgccgctcggctgcatgatccactgtgactttgttgactggcatatcaggcagtttcgttttgatgacgcacctgaacctgacgcgcccggcacgccctttatcgatcgggccatgctgatggaggatgattgcatagtggagttgcgcagcctggaagaggcaccggtcagtgtggccgagcgggtggtgcgaattctgccgcagcagatagcggcctggcaaccgccggtcaatcagcgtgtggtactggtgtgtgccagtggcatgcgcgcagcccaggcggctgataaccttgccgcgcgggggattgcgcggcttgcgctggtggcggcaaacaccctgtagcgtgccgatttagactacctcgaccagctggaacgtctcgaagatcagctccatttcgctgtgaaaatagccttcacgctcgaagtagcgctgatgttcctgacgccagtggtcgaggctcagatcgccttcaccctccagcatcgccatctctggcgtgacgcgatcaaagcgcgtcagaaacaatccggtggtgcggatcacgcagacgggctgctgttcgccgttgagaacaatgctgtaaccgcccggttgaggcaatacttcctgatcctgccagctccgcaacgacccgcaggtggccactttcttaccggcaataatcagcgttgcgagctcgctggctaattccggggagtcaccaaatgcatctgtgaaggcacccggatatttgtcctgcagttgttgcagcgtcatcgtcatcagcaaatcctcaatgaattaggcgtgcgggcccggcgtaacgtcaggttatcgccatgcaggccagcggtgccgttaagatgaacaacagcagcggctttaatcccaccgtctgctgctgatagcggtacagcttacccggcctccacatgggaaaacaggcttaattatcaggatattgagtttgcgcgtgagtagggtcgcaaaggagagactcagtctggcgcggccaggcacagccgcgcactaagattaacgaatcagaaagcttgcccagtgcgctatatcgtcaccgctgctgatttcgggctgtaccagaccgttaaccataaaggtcggtgaaacgtgaatgccgttctgacgggcatacttgcagtgccatttaatggcgtttctgcaggtcgggctgatcaaacgcggcgctggcattcacgccgctgtaatctttcaggcgggcgaggatctgattcggcgtggcatcgcggttcggaccggtacagtgatcggtgaactcaaactcttcacggtgatcggccaccgcctgcatcacctttttcgcggcctctttactttcgcatgcggcggcaaggatatagcgcactatcagcccggaatagaggtgccacggctgtgattgcagacggatcttcagggtgatgttctcttcacccgcgtgcgccagtaacgcgtcgaatttattgaaggcgcgcaccgaaaaaggacaggtgggttccagaaagacttcaaatatctcagggccgtggccccataccagtacattagcgtgctgactcatcgacaactccttgaacattaacgagacgggaaacctgtttaccctggcaaatccctctgacatcagccagttaagaatcagctgcaattgttacaaaaaacagcaatcagctgatgagtcgcgtgtaatacgcgacaggcaggtccattagtcgttagaattgccaactttggcattttcaactgctggcacggcgtagccgcccacgaacagctatagttgtcagcagtgtgcaatcttttgcaggatgcagccatttaagctgcttcactgctgtttgtttgcccggagctgataagcgttagaagaggttaattttgcataccgatctcacctggaaaactctccatcacgtcatcaatcagacgatctctgacatgcttgacgagcagcagaccattgatgtgttatcactgcgcgcccgcctgcatgaactggctgaaaaagaggaggatgaggttatgctgctctgttactggcaggcgagcaaaattctgatgcgcttacccacgaccgtcaccgccagtcagttaatgaccgcggcacgccacgcttttcgcactcccataggtcacgatttgctttgagctgactggctcgcggcatcagtaaaaatcacgcaagtcgaaaacctggtgtggctaatgatgtaaaacccgaggtgagccgctgctaatcaccgctgagaatttccggcactgcataattttcacggcggccaacttatatattcgcattctggaatgaatatatatttaaggtttatattaagtgccgtcttagtaaaaatagtttttcaataaataatctttttaccttcttaaagtgatgtagatcaaggaaggctaccaatgtatctcttctgtgtaagaacctgaacgtctcgtttaatttttatatagccgagagaggctaatatagcagcaacataataaacctcaggttgttatgttggcgcatttctgtaaatgcatatttatccatcaggtgactcattgcagccactttgcatgtattaaaagagacaggtttgatgaatatcagaaaacatattctgcccgtggcactggctggccttatggtgtccggatcagcattagcaacgcctgctgatggcccatcaccgattactcctaatccgggagcagcagccggtacacagggtgccggtggtgaagtgaaatttaccggcgaaattaccgatgtttcctgtgacgtttctaccgccagtaaaaaccagagcgttgatttaggtaaatgggcgaaatcgtatttcgaaagccgtaacgaaactacagaaacgccattcactatctctgttaaggattgtccttcatcagttaaaaccgtggctgtgctgtttgatggcgataaagatagcggtgacaactccctgctgaaagtcaccagcggtggtgcgtccggcgtaggaattaaactttatgaagctgaccgcagcacaccgattgctatcggatccgtctccaaagcggtcagcctggtaacggctgacgagggcggtttctgcggacttaaatttctttgccgattataaaagtgatggtgcgccgattgctgtcggtgctgccaactcagtctctaactttgtgatgatttataactgattaatagcaggggtaaccctgcttcccctccgaaatatcgatggcacaaatatctatgtttaaggtaataagacttatttcactcttttctgcgtgcatgctgggcatggctgcccatgcgggtgtggtaatgggagggacgcgtgttatttttgtggaaggcaaaaaggaggcaacactttcggttaccaatcaggataaaaatacgccgtatctggttgaatcctggatagagaactttgatcaaaataatcattcccgggtaccatttattgttacgccaccgctattccggcttgatgcggaaaaagagaatctgttaaggattaattatctggggatgcccctgccgaaagatcgtgaatcggtattctggctgaatgtgaaatctatttcaccgacgccgcgcgataaaagtaaccagcttcaggtcaatattaaatcgaaatttaagcttttttatcggccaaaagatttgccgggtaatccggctgatgcctggcagcaactctcattccgccatgaaggcaatcagctgattgcgcataacccaacgccttactttgtctcattttattcgctcagcgttaatcatcacgagatacaggatcctggcatgattggccctggagaagatcggcactggcgcgtcgctgattccggcgcagtgagctggtctgcaatcaacgactatggcggcattaccgaacaacgtacgcgctagttgttatttgtaatttattttgttttaaacccggggccatcatcagtgaaagttaatcagcacgctcagagaggaaagagaaggtacgcaaagccgctttacgcctctccctggttaatgctgattttgttctgcccgctgcgtggtgctcgtgcggatgactattttgacccggcggcactggagttctcatccgatcaacatcacgccaccgatctccactattttgctcgtgagggcggacagcaacccggcacttatcatgtcacgctgttgctcaacaacagagttattgatagccgcgatgtcagcttcgtacagggcagagcggggctggttccgcaactgacggtggcagagctggccgcgatgggagtgaacgtcaacggtttttccgccctcactaatctgaagaaagatgaggccatcgaagagttaggcgatttcattcccgatgcatcgacccactttgatttcgcgcatcagcagttaaacctttcaattccacagatcgcgctgatggtgaaagatcgcgattatgtcgatccagcacgctgggatgagggggtatcggctgcttttgtgaactataccttgtctggcagcagtagccgcaatcacagggaccgctggaaactcgacgttactcagcctgcgcagcggggctaatcttggtgcatggcggctgcgtaacacgtccacatggcgctacgatctggtcagtcaatggcagtctcagacctcatttctggagcgggatcttaagacgctgaaaagccagtttcgggtaggggatacctatacgtccggcgatatttttgacagcgtgcagtttcgcggtatgcagatcatgtctgatgacaccatgctgccggaaagccagcgcggcttcgccccgatgatccaaggcatcgcccatagcaatgcgcgggtaacggtgagccagcacggctatgtgatttatgaaaccgtggtcgcacccggtgcgttcgaaatcaaagatctctatcccacgtcccagagcggtgaccttgagattatcattcatgaaagtgatggctcggtgcgcaccttcactcagccttactctgccgtgccttatatgctgcgtcagggccatctgaaatacagtgtcagtggcggtcgttatcactactcaggcagcagcaacctgcgttcgcctgaatttgtgcaatccacgctgttgtacggactgccgcatgactttaccgcctttggtggcctgcaggttgcgcaaaactatcacgctgtggcggcgggcctgggtaaaagcctgggtgattttggctcgctgggaaccgatgtgactctggcaaaaacccgtatgccggaaggacaaagccggagtggtcagtcggcgcgagtgcaatatcagaaaaatttctcctccaccaatacgaccttcagcatggcaagctatcgctactcttccagcggtttttacgccttcagcgaggccaatgcgatgaccagtccggcaagctatgtggcaaataaacgcagtcgctcagaaatttcagtctctcagggtatcggtgattatggcagcctcagtgcctccgcgtatgttcagcgctactggcgatcagacaatgaagatcgcacattacatctgggcttctacagcaattacaaagccatttcctggggtgtcgcctggttttacaccgactcgaccagtgcccgtaaagctgatcgcgcggtctctttcaatgtcaccatccccttcagcgcactgctgccagaaagctccgtcagctacagcatgaatgccactaatgatggcgatatgtctcagcaggtcggcctgtcgggcagcgcgttgcaggacgataacctgcactacaacctgcaacagggccatgacagtcagggacagaacgtgaacagcaacggctcgctggactatcgcggcagtcgcggcagcgtcagtgtcggggtcagccacgatcggcacagcagccagtttaactatggcctgtcgggtgggatcgtcgcgcatgaacacggcattacgttgagccagccgctgggcgataccttcgcgattgttcgggtaccggatacggcagatgtgggcatccagagcggcagcaaagtggtcactgatggccgcggctatgcgattgtgccttcactctcgccctaccaggaaaacgctatcgaactggaaacggatacgctgcccgacaacgttgacgtcgaactggatgggcaaaaggctatccctacgcgtggagcaattgtgatgaccgactataccacccacgtaggtaacagggtgttgttcacccttacctggcaggatacttttccgcccttcggtgctgctggccaggtcgcacttgctgccgcgggtaaagagagcagtaccagcggcatcgtggccgaaaaaggggaattttatctgagcggtgtaccggctcagggcatcatcgaagtgaactggcaggatgagggagggcagaaaagctgtcgcgcaccgttccgcctgccagccgccactggctctaacccggtcaggctggtctctgcggtttgtcagtaatccacaggaatttaagatgaaatcagttcagcgattaatgacaggaatcatactgatgatcccggcgctggtttgtttgcaggcgctggggcaggagtcctgtcagggtatcagtcaggttgtggtacaggtgcaaaacgtcaactatgtgccgggcgcagccgatggcacggccatctcggcgcagatgcctttgcaaagcagtaatgcctttacctgcaatagaaacagcggtgagcagggctataactacaaggatctggggtttgagattaacgccgaagagtccggcttacagacgaatattgcgggcggtcataatacgccaatatatcgtgtgccgggagtagatagcatcggattcgctatcggtttcagggagccctcctggtgcgccggtaccttctctgataccagcggcaagggcaaaatcagctcgatctgtaattcccagaccggcccacagttgaattctgcacatgacattacacttcagtcctatgtggtcttctataaaatcccgggccagcaatcgccgcttaatccaggcaatcaaccggccaatgtcggcgaggtgaatattggcaatgccagcttaaaggtgggggatagtgcagccagtagtcagccgatcaatgataagccgcagatcttcctctccagctttaccgtgcaatatggcagctgtgccgttgtcacctcccagtccgtgattaatgtggagatgggaaaagtgagtaaggcagagtttagcggtatcggtagccgggcgggaagtgaaaaaggttttcagattcaggtgatgtgtgaacacagtgcagcggttaaagtgggcttcttcggtatggctactgcgggtgataaggatgcccttagcctgacgccacagagcaactctgcttcaggtgtgggcattgccctgacctatgggtcgggcctgcaggtttcctgaaggccagcgggtccctctgaatgtgccgaccgatcaactgccggtgctgacgacgatctcctcacccaatcagacgaagtcgatggcgtttaacgcgcaatatattcagaccgacgggcaggttatggcgggcaaagcggacagcacggtgacctttaacctggtttataactaggttgttcagacggtgcattacaggtggggacggtgtaatgcatgctgaatgcgccacatgtttctaccctgagcgctgacacaatcattatccgggccatctcctgcagcaatcgttaaaaccggcacaacccgacccgctgttttccccaatctctgttaaaattgaacctctgcgccactttgcaggatgcatgttcgggagaaactatgttgtggatttggaatgccctgattgttctggtcactgttatcggaatggagataacggctgcactggcgcacagatacattatgcatggctggggttggggctggcatctgtcacatcatgaaccgcataaaggctggtttgaggttaatgacctctatgccgtagtgttcgccgctctgtcgattttgctcatttatctgggcagcacgggtgtctggcccttgcagtggatcggcgcgggtatgacgctctacggcctgctctattttattgtgcatgacggcctggtgcatcagcgctggccattccgctatgttccgcgccggggttatttacgcaggctttatatggcgcaccgcatgcatcatgcggtacgaggcaaagagggctgtgtctcgtttggctttctttacgcgccgccgctgtcaaaactgcaggcgacgctgcgagaacgtcatggcgttaaacggggcgctgccagagatcagcggagcgtggagcgtgacgcgccacccgggaagtaaccgcctgacccgatgccgccaccagcagtgccagtttctctggcgtgctggtggactggcgttgctcccacgcctgtgaacccgcctgaaccaccttcataccgattttacgatagacctgctgcgcggtagcaatcgcccacgctgaacgcagcggtaaacccggcaggccagccgacgccgatcgataatagggctccgccgtttccaccagccgacgggcgacgcggcttaatgccttgcgattttgcggatcggcgagattctctcgggtcagcccctcttcagccagccacgcagcgggcagatagcagcgtcccgcttcagcatcttcaacgatatcgcgcgcaatattggtcagctgaaacgccagaccgagatcgcaggcgcgatccagcgtggcgttgtcgcgtacgcccataatctgcgccatcatcaggccaaccactcccgcgacgtggtaacagtaacgcagcgtatcatccagcgtctgatagcgtgtctcatgcacgtccatcgcaaagcccgccagatgatcaaaagcgtaagcaggcagaatatcgtgtgccattgccacctcctgaaaagcagcaaaggcgggctcatgcatctgcgatccggcataggcctgacgcgttttcatttccagctgcgccagacgctgttcggcggattgcagcgatggcgtatcgttgctgaatcccaggacctgatcgtcaatcacatcatcacagtgacggcaccaggcgtagagcatcagcacgctgcgtcgggttttggcatcaaacagttttgacgcggtggcaaagcttttcgatcccacctccatggtgtctacggcatgatcgagcagtgacggactattcaagccagatcctccagcatcaatcctgcggtagccttggccgagccaatcacgcctggaatacccgcgccaggatgggtgcctgcaccgaccagatagagattattaatatttttatcgcggttgtgaggccggaaccaggcgctttgcgtcaggatcggctccaccgagaaggccgaaccctgatacgcattcagctcatcgcggaaatcaaacggcgtgaagatgcgatgcgtgaccaactggctccgcaggcccggcatgtagtgctgttccagatagtcgaaaatacgatcgcgcaggcgcggaccttcaacggcccagtcgatatcggcggtgccgaggtgcggaactggcgccagcacgtagtagctgccgcagccttccggtgccagtgagggatcggtcacgcagggcgcatgcagatagagcgagaagtcctctgcaaggccatctttgttaaagatctcatcaatcaactcacgatagcgtggaccaaagcagaccgtgtggtgcgccagctgatcgtgatgatgattaaggccaaaatagatcacaaacagcgagttgctcatgcgtttgttctgcagtgatcgtccctgcgcctgcgaagcgggatgctggctcagcagttcgcggtaggtgtgaaccacatctgcgttggaggcaaccgcgcgggtcgggaagacccggccatctttcaggtgcaccgcggtaatcctgttttcctgggtctccagccgggcaacgctggcattgagctccacttcgccgcccagatcttcaaacagtttcaccatgccctgcaccagcgcgcccgtgccaccgcgcgggaaccagacgccccattcacgttccagcgcatgaatcagagtatagattgaggaagtggcaaacggatttccgcccaccagcagtgagtggaaagagaaggcctgacgcagatgctcatcttcaatgtagctcgccactttgctgtaaacgctgcgccatgcctgaagttttgccagctgaggcgcggcccgcagcatgtcgcggaatgacagaaacggcacggtgccaagcttcagatagccttcagcaaacaccgctcgggaataggccagaaagcgacgatatccttcaacgtcacgcggattaaacgcggcaatctgcgcttccagcgcgggctgatcgttgtcataactgaacaccttgccggactcccaacagaggcgataaaacggcttcaccggcatcagctcgacatagtcagagagctttttacccgcgagggtgaacagctcttcaatggcgctgggatcggtgattaccgtggggccggcatcaaacgtgaagccctgatcctgatagacataagcccggccgccaggcttgtcacgctgctccagcagtcgggtgggaacgcctgacgcctgaaggcgaattgccagtgccagaccaccaaagcctgcgccaattactgtagttctattcattgcatcgcctgttgacggtgaggagtcataatagcctgtaacgccgccagaaacggggaccgggggcttgccgcttaagatgcgcagccgatcaggcaaagtgagttttcccgcataaaaacgggcgatcagaccttcgggaaggccgtagaaacgttgcataacctgccagcgctggtcagccggacccgccagaaacagcatacggttcagcatgcggaagaagcgctgttgctgccaggcctgactggcgaattgctgaatggtggcgtgcagggtctcagaggtaaacgtctgcatctgcgccagccggtcagccagcgcgaccgccagcggcagagaatagccagtagtgggatggaataaaccggcacgcaaaccgctgcagggcagatcgcgtttctgccagaaggcggccacgtcgccagtcagcgtaatgggtaacgcgccttgctcttcgcgtagcagccggtctaatcgccatccctgctgcgcggcataggcgcggatattctgacgggcgcgatcgccttccagcgtggcgttatcaatgtagtgggtatcttcaatcagcagggtgtctgcagaaaagggcaggctgtagacaaagcgatagcctgcctgctgatctaccgtggcatccatgatgatcggcgcggtcaggccatgtggctcgctgagctgccactcctgtccgacaaacgactggaagcccatgcgcagcgcggcatcgggctggtagccacggccatcaatcactgcgtcactctccagcacccggccatcgtccagcgtaaccgtgcgtgaagcgatgcccgcaacccgggtattcagcagcagatccggcgcaaacctgtcgcggatgacctgcgcgaagcgctccgcagtcacgcaaaaatagccactgttcaggctgcgactgcgttggggaaagcggacctcatagccaggccagtaatgtactaccagcggagcgatccagcgatgctgcgtttcggtgagatcttccgcatgaaacgaccaggtgtgattggcacccggttcacgttcggcatcaatcagcagaatacgcagggaaggccgttgctgccgcaggcgcagggcgatcagcccgttggccagtcccgcacccaccagaatcagatcataccgcggcatagtctctcctggtgagcaccggctggcgggtcagcatcgcctgttcgacaatgtccgccgccagagaagttccgcccgcctgacgaagtgcgctacgcagcgttttcatctgcttaacgtagctttcatccgccagtaaggtctggagctgacgcgccatggagtggctggtggtaaagcgtgaggcgcgacgtccgataccgtgccagaccactctggcagccacacccggttgatcaaaggccagcgggatcgtcagcagcggcgtcaggtgattaatcccatccagcaccgtattcatgccgccgtgcgtaatggcaagatcggcctgcgccagtgcagccgcctggtcggcaaaatcgaccacctgaacatggctggcctgcgccagtttctccgcctggaaaggtgacaaccgaccgcagtgcgccagcaataattgagcgtcgatctcctggcaggcgcggacgatggttttaaacaggccgtagcgatgtccctgcagcgtgccgagggaagcaaaaatgcgcggtctgtcgccatgcgggaagtagcgaggctgcgcctcggcgggtgccggctcagtggtacgcagcgggccaaccgaatggaaatgatcgggcagcgtctggcggggaaaatccagttccgggatcagctggctgatctgcgccagcggtgaaaaacagtgatgcagtttttcccgtggcgctaatcccatcgcatgagcgttgcgggcgatcacccgatcgtgacgtcgcatcagccagtcatagattttttcactggtgcgatagcgtttcccgtgcctgatcggtcctggcatagtcaaacggcatcacggccagcgggaaatccgcttcacggttaagtggcagcgcacaggcaaccgaaacataaggcaggttcagcgcttctgccgccagtgcaccggcaggctccatctgatcgacgatcacgccatcaatcgccagcgtgctcagcaccacgggcagttcacgacagagcatatcggtgctgcgggccatctcattgatcagtttcagcattgaggggccgagaggatgcgccgccagttgcagggtgtgtgccagactgcccgccggatgcgaggctaaacccagcgggaaaaagccgatccggctatcggtgagtagcgcgctaacgtccgtctgctggatgaaagtgatctggtgtccgcgtgcgattaaggcctggctaagatgctgaagcgcctgcacatggctatagaaaggcggtgcaatgaccgcaaagtggctcatgcagcatccttaactgacggcagcgagttttttctcaaaccaggcctgaacaaaatggtgtgtggcataaccgtcccggcaggccgataacagatgctcgctggcgcagcgcagatgatcgcgcagtcgcgtttcaaccgcctgtggccccagcagattcaccagcgttgatttcccgtcatcctgatgagcatctttaccggtgtcggccatgccgtcagtgagatcgtccagtagctggaaagcctgaccaagattaagcgaaaaacggtgcagctgttcgcgggcttcacctgaggcttcagccacgatagaggccatctgcatggaggcgcagaacagggtgctggttttatagtgattggtcatcagaatggcgtcagcgctgcgtggcttgtcaccttcggagagatccttaaactgcccctgcaccagcccctgcatgccgactgcgtgggataattctgccacagcgtcggctctggcggttgccgttaagccttctgccgcagcgaccacgccgaatgccttactcagcagggccaccgcggccagaatcgcgacatgttcaccatactggcaatgaatggtcggacgtccgcgacgcagttgcgcatcatccatgcagggcatgtcatccagaatcagtgatgcggcatgcaccatctctaccgcgcaggcgagatcaagcaggccggcaggcgtggcgttgcagcccagatcgcgcgctgccagcaacaacagcagtggacggatacgctttcctggtgccagcgcaccgtcgcgcatggcagcgcccactaagtcacgttcgctttcaaccggtaaaagctgatcaagccgttgctcaatgtcgttcaacaggctggctgcatcgctgtgtatgaaattgacgtgttgttctgcacagaccgtcatcatggctgtccttatctacagaggaagtcacagcaggtcgaatgattcgatgccatcttcaataatcgtccccgactgccatagcatagttggcaggttttcaaagaacggcgggttaatccattacaactaagagtagttcacgataataaaaatgtcggagaattcagcagccttccgcgttttacggcgatagccggacgggcattatgcgtgatttaacccagtaatgcgcgcagctgtttcatcacgctggcgacatcctccgcagataatgcgccatctttagcaaagcgcacaatgcctgccggatcaatcaccaccacggacgcgctttccggcttaagatgccagctgtgcgcggttacgccactgctgtcgataatgaattgctgccacggtgccgcttttttactggaagcgatgctgcgcaccacaaaaatggcactgccaggcagcgcatcgtcagtattcacgatggtggtggtctgaaaacggtcacgcggcaggctggcctgctgaatggcttcgattaatcgtgcactctgatccttcgctgaaagacggcccgccacatgaatcaccagacgcacttttccggtcagagtctgactgttccagcgctgataatttatgtcgccctgattcagcaccatttcgcctttatcggcaacgaagacaggtggtacaggctgaccgggggtcagggtgtgggcggtggcaaagccggaaaacagcagggcaatcatcaatccataatggcgcacgggttcctcacttctttctcgatttgcgtcaggcgcggtgaacgctctcattagcaggcagaagattagtaccacatctatgtttcagatcaataaaagcattcaggatttggcctgaaaatgcaggggagattgtgtttacaggaggtgggaaatgagtacagcattgatgacattacctgaatttgcccgttatatcggcattgccaccccaacgctggcgcgcgccttttgctgccggggatcgctggcgggtgtgccgctgccgcaggcgctggatgatgcaccgctgacgcaacgccactggctgcgcgatgatgtacgtcagttcgatcatgcctataaacgggttcaggcgatgcagcaaggtagcacgctttaatctgcttaaagcaagagatgagcgcgggaatttcccgcgcttttttatgcaaaattatcgggctttaccaggaagcagaccagattggcatcccgatcgcccacgatctcaatgctggaatccagcccgctgacggcatcaccgcgactcagtcgcagatcgccgacgcgaataatcccttcaagcacggtaagataagcgacaaagcccggcatcgacggcacgtccagcgtatggttgcgctcaagcagtgtgtcgaagatgtagacttcctggcgcagtttccagcggcgcatcagactcttccggcccggccagttcggtccagccattggtcataatgccctgatcgcgctccagcacctgggtcattgcttcaccgccccgaagtgccggtcggataaccgcctgtaacagctccgcttcatataacggcaccgactcttcatattgaacgccatcacccgcgttcaccaccatcacgcgttttgcagagagctgggtacgttcgccattactgtcctgatgctgcatcgaaccacgccacaggtaggtgaaaacttcttcatcctgatgctgctgcatcggaatccgggcatcgagttttagcgacatcagatcaacactgaccagcgggcttaacgcctcgccaggacgctggcgacggacggtaaaaggaccgtactcaaacagttgttcaggattagctcgcacaatgttcatgatttgctctcaaataaagtgactcataacaacgatcatagacctcaggcggagaatgagaagccgggagttttgcccggcttcgtcagttattttgaataatagagtgttcggcgtcttgccagcttacttgccctgttcgtcgctctcaccgaggaagaaataccagagtggaatcgacaacagcccggtaaagaccgtggagtagagcaggatcatcatcgcctgggtgatatacatggtcagcgaccagtgactgaaggggatctggtactgatcgatcactccgccaatcatcgcattcgccatcaccgtaatgacaatcagcgccagcaccgtcacgctgcgcagaaaatagcgcatctctttgcgcttcccggcaaaacgcgactggacgatggccagcggcgactgcttgtccggagcgacatccacgcggacgaccgcggcgcgctgtgcgctgcgccagcgctgaatatccagcagcaccagcaccagcaggctgatacccataacgggcagggcatatcccagtgccagcatcactatcagactggtgccctgcgcatagcgcggcagcgccagccaggcggataacagcgtctgcgaggggttgagctgcggaacagccgggcgacgaatccaccacatgcggtagcccagcacaatcattgtgcagagtccaaagccagatagcgccagaattagctgattaggcaggccaaacagcacgcccatatgcgcatccacgccccagcgggtcagtttcgccaccagcgggaagctggcaaactcaacgcggtcgaccacgctaaaatcagtcggattaattgaaaccgcatcgacctggcttggccagctgcggtcaatctccgaaaccgtccacgcctgttcagcgtttcttaggctgacgtagttccagtttcgccgcgtgcagtccggcctgacgcgccgctgccagcgcctgatcccagctggcattcggctgattgagaatcaccggcgcagcggttttcgctggcatggtcattccggacatcgtcatcccttccatcgcaccgcgatggtcagcatggggatcggcggcttcagcgggcgcgttaccgtttagcgcggtattaacctgcggcgttttccagccaaaatcgctgcgcatcttttcaatattattgcccgcccactgtgaccaggtcagcccggttactgaaaagaacaccagtccgattgccagcagcagccccagcgtgacatgccagtgacgggttgccgcgaagccgctccgtgctttactgcgggtgcgcggcggccgggtgccggaccataagacaatcccacccagcgcagcgacccacagccaggaggctgccagttcactgtagtttcggccaaaatcacccagcaacaggccgcgatgcagctgatccagccacatgcgcagcggcagcacaccgctggtgccatacaccgtcatatcgcctttcacctgcagggtgtaggggtcaataaacagcgatcgtgattccgatgggccaagctgtggctcggcaaactgcacgcgggttgtatcctgcgggccgggtgccggacgcacagcgtaaatgcgtgctgattcaccggcacgggctcgcgcagcggcaatctgggcggacagcggttgtgccacaccctgcgcgtcggtggtcagggcatcatggtagatagcctgttccagttgcggtgtcagaacgtagagcgtgccggtgagtgccgcgacaaaaataaacggcgcaataaacaggccgatataaaaatgcaggcggcgaaagagattaaacaccgtgccgcgcggtgcaggggacatttcctgagaagaggacatagcattccacacttttcaaaagacaaagacgatcaggtgacgttgtcacgcaatcggattagtaagcagtgagtgtgacgagataaagggtggcgcgcgcggtcgatgaagacgcaacagccgttgccattggggtggattgatagccgctggcggcggggcgcggctgatcaggcacatccaccagataaacgggataaaaacccagagcatcagcggaacatgcaccagcagatcgcagtagccacaggcaaagcccgggcccatcatcatcccgtgatcagccatcgacatctcgctgtgatgatccatcatcggcatctctgcgctcatgatcgaagcgccttgcatcctggcatgatgttcagcgagattctttgagatcatcggtgcaacaaacaacagcagcacggccagtatcgcaataccggcggtgagtcgttgtctgagtgaagatcccggcatgatttcaacggtcgtatgaggtcagaattcagggcggcagtgtaacgcgaagggaataaaagggttaaataaagtggcatctgttccgaaaaaattcgcactctttgaacattttcactttaatttcagcatcatttaacttagttgttactcgcggtgcacatacaaataacattaatcattcgcctgcggtttaaccatacccaatgaaggaataaaaaatgaaaattgtaatgctggatggtgacacgctgccggtacccctgccgaccggtcaacagcaggctgactgggagattcgcgcgcagactccggctgaagacgttgtgtcttcgctggcgggcgcaacggtcgctatcactaataaagtgccgttgcgggctgacacactgcaacaactgcctgaaactgcgttttatctgtgtcgcagcgacgggctatgactgtatcgatcttgaggcctgccgcgcacgcggcatcgtggtcagtaatgtcccaggctattcaactcagagcgtttcagaggcggtgatagccgcgatttttgccctgcgccgtcagctgatggcttatgccagcaatacccgcatcgactggccccaggctaagcacttttgtgtgcatcatcagccgataggggatattggcggtgccacgctgggcatcgcgggcaaaggcgacatcggccaggcggtcggcaggctggcccaggcgctgggaatgcaggtgcagtacgccgagcgaaaaggcagtgaaagggtgcgtgacggttatatcagctttgagcagatgctggcgaccagcgacatcatttcgctgcactgcccgctgagtgacagcacccgccagatgattgatcgcgaggcgctggataaaatgaagccacaggcgctgctgataaacacggcacgtggcggactgattaacgaagccgatcttgctgccgcgttaaagcaggggctgattggtggtgcggcgctggatgtgctgagcagcgagccgcccgctccggataatccgctgctggcggatctgccaactctgctgctgacaccgcacatcgcctgggcaagtcgcagcggcgtggagaatctggtggctggcgtgatggccaatatcgcggcctttattcagggcgagccaattaatgtggtgagctgagtcagatggaatagtttttaatgcccgacatgggttgatattcagagcaacctcgtagatttcaggaaaagccttttacgcgctttagtcatcagggtattaatttcgttatttccatcaggactttaaacgttagtgcgctacaggaattaacgtcttttactggctgaatcagccgttgtaagcgcttcaggaacagaaaggattctggccagtgaaaaagaagaacagcacgcctgtgcctcatgatgccacattccggcaatttctgactcagccggatattgcccgggatttcatggagctgcatttgccgccagagctgcgcatatgctgtgatctcagcacgctgaaactggagtcggggtcgtttgtcgaggatgaccttcggcagtactttagcgacgtgctttacagccttaaaacaaccgctggcgatggatatatccatgtacttattgagcatcaatctgtgccagacaaacatatggcatttcggctgatgcgttatgcagtggctgccatgcaacgccatcttgaagcagggcataagcggttgccgctggtgattcccgtcctgttttacactggcagacgcactccctatccctattcgacccggtggctggatgagttcgacgccccggcgctggcggacaggctttacagccgtagttttccgctggtcgatgtcacggtgattcctgacgatgagatcatgcaacatcgcagcatggcggctctgaccctgttgcagaagcatatccggcagcgtgatctggctgaaatgatggacaggctggtaaccattttgcaggctggctatcactcttcatcacaggtgataacgctggtacactacattgtacaggcaggtgaaacatcggacgccaaagcctttgtacgggagctggcacagcgtgtgccccaacacgagaaacgcacttatgactatcgcacaacagcttgagcagatagggcttgagaaaggcattgaacagggtattgaacagggacgtacagaaggtagtcgtggagcaagcctcagaattgcccacaccatgctgaagagtggcatggatcgcaataccgttatgcagatgactggtctgaatgaagacgatctggcgcagatttcgcactaattaattttttgagttctgattatcgctgacgactcaaatcgccagcgcactacacggaaaatgcaaaatcagcttcctgaaatcaagggaaccccgtcgcatttcaccacggcgagcctgtgacttgcgcgctcagactcagaatatcgatcgccccagcttctcggtcagcaattccagcacagcggtaccggccagagaattgcccgcgctatccagcccaggcgaccagacggcaatgctcatctcacctgggataatggcaataatcccgccacccacgcccgattttgcgggcatcccgacccgccacgcgaattcgcctgcgccgtcatacatcccgctggtgatcatcagtgcgttaatctgccgcgcctgacgtggagtaatcatctggctgccatccagcgttttgccctgattcgccagatagataaatgtgcgggccagctcaacgcagttcatcgacagggaacagtagtggaaataggtctgcatcacgctggtgacatcgttatcgaaatttccaaacgacttcatcagccaggcgatcgctgcattgcgggccgaatgttcgaactcagagcgggcaacgtggcgatcataattgatatcggactgctgactcagctggcgcacaatttccagcattcgctgacgcggggcggtcagtcgggtttccagcagatcgcaaatcaccagcgcaccggcattaataaacggattacgcggcttgccctgttccagctccagctgaaccaatgaattaaatggctggccagaaggctctttgccgacccgctgccagatttcgctgtcctcatagcgggtcagtgctacggtcagagagagcgccttggagatcgactgaatcgaaaagcgcgtctcagcatcgcccgcctgaaagagggtgccatcacgcaggcaaaccgctattgccagatgatcggcagccacatccgccagcgcagggatatagtcagccacctttccctgatggatcagcggacgcacctgatccaggatctcctgcagcagagcattattcagttcagacacgcacattctcccgtcgattcccgccgacccgtgatgctaagcatccgcgatcggcgagtcatttattgttaacggctccgccgcattttcagctaatgggttttgactgcgctgccagcggagccagcagcatctgtaacaggctcagcattgccagcacgctgaagggcagcgtccagttaccgctctgctcatggagcacgccaaagaacaaagggccaagtgccgccagcgcatacccgacacactgtgccatgcccgacagctgtgacgcctgacggtgatgagtggctcgcagattaaacagtgagaggcagagcaccagtgatgcgcctgcgcccagtccggccagtgtcagccagatgacggcccactgcggattgagcaataggcccagcatgccgaggaaaatgcctgatgaagcaatgaacgcggtaagccgggcatcttttacccgcttcagcgccaccatgcagcccaggttagcgacgatcgcaattgcctgataccagaacagcagccagcctgcgtgggcctgactgaagccgttatcctgggcaaacagcgtaaaccagtcaatcagggtataaaacgccagcgattgcagcgccataaacagtgcgatttgccagccgccgggcgtttcgccacggatggcgatatgtaacgggcgcgtcagcggacgctgcggttgaccgccgttgacgtaacagcggcagccagacgagtagcgcaatcagccccggtagcgcccagacaaccagcgagagtcgccagcctgccgctgaaagctggctcagcggaacggcaatgccagatgccaggctggcagtaatcgacatggtggcggcataaaggccaatatatttagcggtgtgggcggtgaaatcgcgtttaatcagtggcggcagcagcacgttggcggcggcaatacctgcgctgagcaacagcgttccgctccacaacgccgcttcatcaggcagccagcgcaacagcgaaccggcagtgatcaggcatagcgcgccccataaactgcgctcaagcccgacacgatttcccagccaggcggccagtggggcgagcagggcaaacagcatcagtggaataaagttaaacagacctgcttcaccgacactcaggccaaaggtctggcggatatcctgtagtaccgggccgatgacagtaatgggcgcacgaagattagccgcggtcagcagcaggacgaacaaaaaaaatgtggcgctggaatacgcagcgagaggtttagctgggttttgtacaggcatcatggcagggatcatcacatgcagcagtgctgcgggggcgttggttgacgttaacgcttacgcatcagaattgatgtctgggcgctactttactgaccggttagcagcgtgtaaagccttgttatgcgatgaaatagcgtaattgagatctcacagcagcgatcgccttgtgacaggatcaatggaattcaggttcagggaaatgaccgcagtcgttctggctgggattggagcctggctggcaggtctgctggcgggtttcggccgccggaaccggtttttcagcgtgccatggggcactacaggcactgagaagagaaaccagaatcatcacactgataacgcgcatatccgctccttattaaccgtcatgaacaaggccacgtcggtgatcggcggtttgcaggtcagggacgtcttacctgagtgtggtatctaaggggataatgtcaattaaaacagagcaaacatcagcgcgacaggaaaactcatcggccaggtggcccccaccagaaaggcgctcagcagtttgatgctcagcttatctttggcgatgaagaacgtgatcagcgtagcgatcaatgcaacaacggcatagaaaattagcataccctggtacagtgtcattgatatctccgcagcgtcattaaggttttcgctgcgcatgatgcggatttttgtgatccagatcaagtgaatcagggtttagcatctaaagaaatcatgggtaaaggcagttggttcgctcgctgaacttcatcgtaacagcgggcgatttcaggctgaaaccaggcaggataaacgcggctaaaaccttggctgatgctgtaagccagactgaacaacctctggcgaaggctcccggattaagcgttgccatgacgtaaaaaagcccgccagcgtggacgggcctgttatcggcactgcatcactacagggtatgcgctttaactctggcggtataacgccaccacgtcctccaggtccggcgtacgtgggttgccgccggtgcagacatcatccagcgcggcctgtgccagtgcagggatatccgcttcttttaagcccacttcacgcagtgagcggggaatacccacatcgcgacagagctgacgcaccgcggcgaccgccgcttcccgcgcctgatccagcgacaatgactcaacctgtttcacacccattgcacgggcaatgtcgcgatatttttcgccagtgcctgaggcattccacgccatcacctgcggcagcaaaatggcattggctacgccgtgcgggacattgtaaaaggcgcccagcgggtgtgccatgccatgcaccagaccaaggccgacattagagaaacccataccggccacatattgtcccagcgccatctgctcaaccgcctcaatatttcctgccaccgattcgcgcagtgactggctgataatctcaatggctttgaggtgcagcatatcggtcagggtccaggcaccgcgtgtgatgtagccttcaatggcatgggttagggcatcaataccggtcgcagccttcagcgacgcgggcatgctcgccatcatctccgcatcaatgatcgccactttcggaatgtcatggggatcgacacagacaaacttacggcgattctcttcatcggtaatgacgtaattaatcgtcacttctgcggcggtgcctgccgtggtcgggatagcgatgatcggcacgcatggatgacgggtggggctgacgccttccaggctgcggacatcttcaaactcagggttattaataataatgccgatcgccttgctggtatcctgtggtgagccgccgccaatggcgatcaggtagtcggcacctgactctctgaacaccgcaacaccctgctgcacaacccgaatggtaggattcggcaccacctcatcatacaccgcccagtcaagctgatgttgcgccagcagatcagtcacccgcttcagcgcacccgccgcgaccagcgctttgtcagtgacgatcaatgcttttcgcatcccgcgacgttgcacctcttccggcaaatggcgcaatgcaccagcaccaaaccaggcggtttcattgagaatcatacgttgggtcattaaaacatcctctgttaacaaatgaatttttaccatccgtgatccccggttcatgttctgcgcagaaacctctcactttcaggtaaagacatttgataaaaatcaatcaattagtaaaaatcactgcgcctgtgtcagctggttttcgtgcggtatgtctgaaatcagactacagacctgttaatggatttctcactgtcgtcagtggtatgtaacactgggtcatcagcaaacccgcatgcctatgaggaaagaagacatgacccgattcgtaatgaataaaaaggatgatctcgtcgacagcgcgttagatggcatgatttacgccagcccgtggcgcaatctggtccggttgcaggtcgatccgcgcattcgcatcgtgatgcgtaatgactggcaaaaacagcaggtcgcgctgatttccggtggtggttcaggccatgaaccggcccatgtcggctttatcggcaaagggatgctgacggctgccgtctgtggcgatgtttttgcttcccccagcgttgacgcggtttacaacgccatcatcaatattaccggtgaggcgggatgtctgctgattgtgaaaaactacaccggagatcgcctcaacttcggtctggcggcagaaaaagcgcgcaaagcgggattcggcgtcaatatggtgattgtcggtgatgatgttgcgttgcccgataaccctcagccacgcggcgtcgcgggcacgttgctggtgcataaagtggcgggcttcgtcgcagagcggggtgatgacctgacggcggtgaccgaggcagcagaggcagccagtcgtgctatcgccaccatgggcgttgcgctctcaagctgccatctgccggatgaacagaccggccagcgagtgccagacggcagcgttgaaatggggctggggattcacggcgaaaccgggcgttgacgtcatgcagacgcaaaacagtcagcagattgtgcagcatctgctggagaaagtgatgccggacaacgatcagccacgcgcgctgttaatcaataatcttggcggcatgtccgcgctggaaatgagtctggtcacacgcgacctgattgagtcgccgctcagccggggcagtgattatctgattggcccggctccgctgatgaccgcgctggacatgaagggcttttccgtcacctccatgacgctgacgccgttgttcgaagaggcgatctgtgcgccggttgaggtcaccggctgggttcaggcggttaaaatcgcaccgctgcagccggtaaacgcgacaaaagaggcaacagcgcatccggcgcaaccctcagataacccgaccgtcgctgcgtttgttaacagcatctgtgaaaccctgatcgccagcgaaagcgagctgaacaaactggatgcgcaggtcggtgatggcgataccggttcgacctttgctgctggcgcacgccagatccagcgcgaatgtacagataatcagctgccgttaaatgccttgcccgatctgctcgcggtgacgggtgagcgactggcgaccgtgatgggcggctccagcggcgtactgatggcgatcttcttcaccgctgctgcgcagcagctggctgaagaggatgcgctgcccgcggccctgcaacagggtctggagaagatgaagcagtatggcggggcacaaccaggagatcgcacgctgattgatgcgctgcaaccggcaatcgaggcgctggtggcgggtaaatcgctggcagaggcggctgatgcggcacagcagggcagtgatgcaaccgccagcatggggaaagcaaaagcgggccgatcatcttatctcaacagtgctaacctcaacggcgtgtctgatccgggtgccgttgctgtcgccagggtctttgcggcattaaaaaaactttagtgctgtcacgacgctaaacgcgcctggagaaaggccagtaactggcggtttacttcgctgcgctgacggtgctgcgggtaaaccgcattcagggagagcgggggcggcagatagtcgtccagcacggtcaccagctcaccgcgttgcagggctgtctcaacaataaaggcgggtaacaataccagtcctaagcctgccagtgcggcatcacgcagaacctcgccattgttactcaccatcggtccctgaaccgccagccacttcggtttaccattgacctgcagtttcccagccattctgaccttcacgtccgtagcgcagacaggcatgttgcagcaaggcttctggctgctgcggcacgcctgcccgttccagatagcgggggctgcagcagataacccgcttcagctcgccgagcggacgggcaatcagcgtggaatcagccagcgtaccgatgcgaatcgccatatcaacgccttcgccaatcacatcggcatagcggtcagccagctcaatatgaaactgcaatgacggatggtggcttagaaactcggcaatcaggggggagaggtggctcatgccaaaggacatcggcagattgattcggaaggtgccgcgcagcgcctgctgctgctctgacactgccagttgcgcttcctgaatctcatccagaatgcgctgagcatgttgcgcgaacagtaaacctgcatccgttacagacagcttacgggtgttacggatcaacagtcgtacccctaatgatgcctccagcgcagccatacggcggctgacatactgtttcgatagcatcagatgctcagctgctgcagtaaagttgccagcatgcattaccgcaacgtaaatccggagatcttcaatctgcatagtgtccacttatcggtgacagtgacgatgattcaggcgaaacttcagccagatgcgttaacttatatcgggtaatgcgtcacagggcaacgcgtcagctctctcagccagcgcgacggagatcatagatttgccgtttccttacccctgaacaggcggtcagtcgggtcaatcgcgttaaagccgttatagtaatcaggcagtgacgcaatccatacggaacataatctcttgagtaatctgataaggagtggctggtgaaaaaattactctgcgcgacggtgctggccgttttgccaatgaccacgctggcagcgtcggtatttacgctgcaatcacaagacttcagcgataatgcgctactggataaaaagtttgccggtgcgaataaaagtaatccttcctgtaccggtgagaatatctctcccgaattgaactggtctgcgattccggcgggcacccgcagtctggctcttctgatgaccgatccggtcggggccaaagggctcggcgttacccacatggtggcctataacattcccgccagccgctcgtcatttgcgcagggggctctgacaaagggcaaggactacaccggcggaaaaaataccccagggacgctgcactattatggcccttgtccgcctgcaggcagtgggctgcatcactataactttgtgctgatcgccaccgatttgccggtgggtcagttgaaagcggggttaacccaggcagagctggttgcacagctgaaaggccatgcgctgggcgcggccagcaccgttggccgctttagcaatgagtgacctgcacgcttgcagaggcagcgctgaacagcctgcctctgcgcgcagcggattagtcgccactgaacatctcgcggatgcgcgacgcaatgtgatgcgtgtgtgtctccagcgcgaagtgaccgctatccagcatctcgaccaccgcctgtggattatcccgctgccaggccactgcgcccggtggaataaagaacggatcgtgcttgccccagatcaccagcgttggcacctgctgctggcgaaagaacgcctgaaattccggataacgtttcagattactggcgtaattgagaaacagggcctgctgaatatctttgttaccggggcgctccatcagcagagtatccagggtataggtttccggggcgatctgctgcggatcgctcaccccatgcagatactgccacttcaccccttccagcgtcaggatggcgtcacggatcacctgaccatttgcttcgctgggatcgtcccagtaggcgcgaaccggcgcccaggcctctcctaatccctccagataggcgttaccgttttgtgatatcagtccgctgacgcgatcggggtaagccagtgccagtcgcagaccggcaggtgcgccatagtcgaaaacatacatcgcataacgttccagccccagtgcatcgacaaaggcggtcagcgtctggcccagcgcgtcgaaggtccaggaatagttgcgctcagcaggcacttcagtgaagccaaagcccggcatatcgggtgcgatgagatgaaatttatcggccagaagcgggatcagattgcggaaactgatgtgaagaggtgggaaagccatgcaacagcagcagtaccggcagggaaggatcgcccgcttcgcgatagaaaatattgacgccatcggcctgctggtaacgatacgaaatggattgatcacgcatgctgaactcctgtaactggttaaatgatgtttatgcggttactaagagtcattatgcagccagaatgtaacctgtcaaatcaatttataatggttacaaaaggtgcggtgtaactattcaaatagtactttgtcggttacagtggcatcagcagagttaacaagggaggcaatatcatggcggaaacgcaatcacacaccgcccagggaccgtggtttctggctgatcatccggcgctggatttcatcaataccctggccatcgtggaaggccagccgcacgacttctggcaaaccgatcaggatgttgaagcctggctacaccaggccggactggcaccagatgccccggctccgcagcatgaaccgggtgcgcttttggaagcagcgcgtcacttacgtcagatcattcgtgataacgtgcagcagcacaaagcgggagagggcgttgatattcaggcgctgaacgcctggctgggtgaagcgaccagccatctgcaaatgaccggggagccgggtgccttaaaaatcaggcgggtctatgcgggccagagtgtgatgcagcggctgggacaggttgcggaacaggctgcgatgttgctggcgcaggaggatttcagcagagtccgtggctgtgaacatcccgcctgtacactgtggttttacgatcgcaccaaagcgcatcgccgtcgctggtgcagcatggcgctgtgtggcaatcgggcgaaagtggcgcgtttcagggcagttaaatcagctgggtaaacagatcggacggcagataaaaaaacaccctgcagagcagggtgccagaacagttatttcgcagtggtcgctgatggcttgtgccgcttgcgcagcttgtcgatcaggcgatgcgcttccgctttggtcgccaccgctggggatgaaccggtcagcggttgacgggctgtttcacgtaccgtcagaatggtgagcaggccaatcacgcccgcgcccatcatgtagtaagccggcatcatattgtttttagtggtatccaccagccacgcggtaatcagcggtgtcgtacccccaaacagcgaaaccgacaggttgaagccgatggccagcgcactgtaacggatatcggtagtaaacagcgcaggcagcgtcgaaggcatagtgccgctgaagcaggtgtgcagtacacccagaatcatcaggccgccaaataccgcccacatattacccgacccgatcagcataaagctcgggatggcgagcaggatcagacccaccgcaccaaaggcaatcaccggacgacgaccaatgcggtcggtccagcgaccccacagcagcgtcagcggcatcatcacgaacatcgccaccatcaccagcagcaggccacttaactctggcagacccagcacgccggtcagatagctcggcatgtacgaggtcagcatgtagttagagacgttaaacagcagtaccagaccgatacatttcatcatcggtgcgcggtatttgctcagcatctgcatcagcgtcagacgcggcttgctttgctccagtgcttcctgtttttccatgtgctgctggaaagccggagtctcttccagcttcagtcgcacatagagaccaaacaggcccagcggcgcggcgataaagaaacggcacgcgccagccccaggacatcatcgcctcattcgacatcacggtggtcatcaccgtgaccaggctggcacccagcaggtaaccgccgatggtgccgaattccaggaagctgcccataaagccccggcgtttatcggtagagtactccgcgataaaggtcgctgcgccaccatattcaccgccggttgagaagccctgaatcagacgtgccaccagcagcagaatcggtgccatgatgcctattgaagagtaagccgggatcagaccgatacagaacgtaccaatcgacatcatgatcatcgtcatcgccagcactttctgccgtccgatgcggtcacccagcgggccaaataccaggccaccaatcggacggaccaggaaggccgccgcaaacgtaccaaaggtggcgatcagctgcaccgcgttgttggcatccgggaagaagactttgccgatgatcacggcgagatagctgtatacgccaaagtcgaaccattccatcgcattacctaacgcagctgcgccaactgcacgcttcagcatgtcgttgtcgattacggtaatgtcgtcaacagtcagctcttttggcttcctgttccagaaatgtttctttgggtgttcagacgatgagtttctggtgtccatattctcctcaggtgcatcaatgaaggagtcttatagctttcgcagccgcaaacaatgttcagaagaaaccgtggaaatgaaagctataagaagccgaataagttttaagtgaagcggcagaaaccgcagccggtaaactctagactacgattgtaagtttttgcaagttttcagccgaaataactgcatttactgacaaacccagcatagtgaacttattcacgcctgcttacgggtctgaacatttggtaatagcttgcggctggtgctctggttatatctggaactgattttcccgatactgatgcgctacttaaacagtttcagttcgtcgatgcgatctagcgcctgcagtaattgctccgtcccggttgtcaggctgatgcgaataaaatcccgccccgctgcgccaaacccgttacccggtgccaccagcagatgacactgggccagtagcagggcggcgaactgctccccggtgaaaccagctggcgctgccagccagaggaaaaaggtgccctgacgggcgcgaaccggccagtgcatcgctgccagcctggctaaaatcactctacggcgctgatggtaatgctctgccagcaagctgagttgttcagcgggcagcgacaacgcggtgatggcggcatcctgcaccgcgccatacaccgtgctgtagctatgagtatgaagttttttaaatgccgcaatcatcgaggcgtttcccaccgcaaatcccacccgccagcctgccatgagtgcgctttttgacagcgtgtagatttccacgccccaggctttgccatcgggctgtgccagcagactcagcggctgttcgcccgactcactgcccagcgtggcgtaggcgaagtcatgaatcagcggaacatgatgctggcgggcgaaggccagcgcgtcggcgaaacagcgcggctgtcgccagtgcgccggtggggttatggggataattgagcagcagcagaccggcactcgccgcgatatcgtctggcacctgggtgaaatcgggcaggaaatcattgcacgcctccagcggaatgccataaaaatcggcacctgcctgacgggccgctgagcggtagagcggatagcagggatcggtagagatcaacacctgacccggattaagcagggcgcggggaaaaccgttgacgccaatgtgcgcgccctggaacagcgccacttcagtttcaggatcgagcgtgacgccgtagtgacgctggtaaaaggctgcgatagcacggcgcagcgcgggtttgccccagaacgagggatactcatggttctccggtttcgctgccgcagcctgtaatgaagcgattaccgcgggcggcgttggctgacgtggactgccggaagagagatcgatcagcggtaacagcgcatcatccagttgtgctgcctgcttttccagcatgctgaagaggttctcttcgagccctgcgaccatctctgaagctgcaaactccgccatatctctcccgcaataaacagtgttaagcgaggaaggatgacacagctgacattaaaatctttagcagaaataacgctgttctttgcagggattcgaatatccagcatgtgactatcgttagcataaataagccaaagtcggggctgggttttgcctgttcctctccgcgatgcctgtgattaaatcgatcgctctcacaataatgaatcagggcaaacaatgcagatcacatcccggggaattattctggcactgaccaccgccagcctttttatttctgccgctcaggcagccgaccagaagaaaatacggattggatttaatccagggccttataaagagcaatttgaaaaaggcgtcgcgcccttattaatcaggcaggggtatactctggagtataaagatttcagtgatggaattcaggttaatgatgctgttcatcgcgggacgattgacgccaatatcatgcagcatcccgtctatcttaagtcggttaatgaccggcttggcattgataacgttgggattgtgcaggtgccgaccccgccaatggggctctactctgggcgcgtgaaaacgctgactcaacccgcgccaggcagcacggtctctgtgcccaatcagccctcaaatgagtaccgggcggcgctgttactccagagcatcggctggctcaaaatcagccccgatagcgatgctgccactttttcgcagaaaaatatcacggaaaatccctacaaaatcgtgcttaaagagatggataacgctcagcaggtgcgtgcactccccgatgttgactatggagtcattcagggcaacttcgcggtatccagtggcatgaaactcaattcggcactgaaactggaagcggcaaccagccagtttattaacgtggtgacggttgccggtaaaaataagcaggctcagtttgcccgtgacattattgccggctaccactcagcagaatttaaaagctatatcaccggtaatgcgcagtatgcgggctatctgctgccagattatttcaaatgagtcaggtagccattgcgtttcgccatgtcagcaaaacgtttgcgcgtaacggtgcagaagtgcaggcgctgaaggagattaatctgcgcatcagccagggtgacatctttggcgtcatcggcaccagtggagccggaaaaagtacgctgctgcgcctgattaatcacctggagacccccacaaccggctcggttgaggtgcagggtgaagcgttacaagggatcagcaaaaagcgcttaattcaggtcaaaaagcagattggcatgatcttccagcacttcaatctgctcaatgccagaaacggtgtttcacaacgtcgccatcccactgattttacagggccgggataaagattttatcgccacccgtgtagcggagctgctggcgtttgttaacctcagcgacaaagcccacagctacccggatgaactctccggcggacaaaaacagcgcgtcggaattgcccgcgcgctggcaaccaatcccgcgattctgttgtgtgatgaggcgacctccgcgctggatccccagaccacggtacagattctgctgctgttacaggagattaatcagcgttacggcatcaccattgtcctgatcacccatgagatgtcggtggtccagaagatctgcaaccggatggcggtgatggagcagggccgtatcgttgaacagggcgatgtcctgtcgctgtttgctgaaccgcaacagtcggtgagcgccagctttgtgcagtccgtcatccacgatcgtctgccacagcagacccttgcgctgttaagccagcatccggctgtcgacgtgttgcggctggagtttgtcggcagcacggcacaacagccgatcatcaatcgcctgatccgtgaacatgaggttgaagtgaatatcctgttcgccagcatgacggaagtacagcgtaccattctgggtttcatgattgtgcagatcaaaggcgagcccgcaagacgcgaggcggccatccagtttctcatcgcgaccggagtgaaaatcagtgatgtcagaactctttgaaaccgccgttaccggcgatcagttcctgacggcgatgcaggacacgctgattatggtggcgctgtcgctgggctttggttcgctgctgggcctgccgcttggcattgtgctggtgatctgtcgtccgggtgggatacagccgaatcgactggtacatcagttgctgaacccgatcgtgaatatcatccgttcactgccgtttattattctgctgatcactattctgccgctgacgcgcctgctggtgaacaccaccatcggtacggcgggggccattgtgccactggtgatatttatcgcgccctatatttcacggctggtggagaatgccctgctggaggtggatgagggcattctggagtcagccaatgcgatgggtgccaccacgctgcagaccatctggtatttcatgataccggaagccgcctcgtcgctggtgttagccctgaccaccgccactatcggcctgctgggtgcgacggcgatggcgggcacggtgggcggcggcggcattggcgacctcgccatcacttacggctatcagcgctttgatgcctttgccacgatttcgactgcgctggtgctgattgtcattgtccagctactgcaaaccctgggtacgcgtctctcgcgccgtatccgacgcgagtgagccatgaaaaagaatgatttagctgttatgcactggggcacgtatcacgtcaccaccgaaggggacacgctgacgtcggtcaggccggtggcgtgggaccgtaatccctctgcgatcgggcagtcgttaccgggcgcggtgcaaagcgaaacccgggtcaaaaatccggccgtcaggctcggttatctccagaacagaagcgcatcccgcaacgggcgcggcaaagagccgtttgtggaagtgagttgggatgttgcgttgcaactggtggcggaggagctggggcgtgtcaaaacagagcacggcaatcaggcgatctacgccggctcttacggctggtcgagtgccggacgtttccatcatgcccagagccagcttcatcgtttctttaaccactatggcggctacaccgccagcaccaacacctacagcattgcggccggtgaacgcacgttgccgcacatcatcggtaacctcgatgagttacaacgtcaccatacccattggccggttcttgcagagcattgcgaactgtttgtggctatcggggggttgccgctgcgcaatgcgcaggtcaatggcggcggggctaatgaccatgcgctttctcattggttaaccacgctacggcagaatggcacccggtttatcaacatcagtccggtcagaaacgatctcgctggggtggcggatgcggagtggctggcgatacagcccggctccgatacggcgctgttactggcaatcgggcaggtgttaattactgaatctctctatgacgcgccattcacagaacgttacacggtgggctttgaccactatgccgcctacctgctgggtgaacgcgacggtatagctaaaacgccagaatgggccgctccgctgaccgggctggcggccgcggaaatccgtgcgttggcacggcagatggcggcgcataaaacgatggtgaatattgcgtggtcagtgcagcgggcgcggcagggcgagcaggctttctgggccaccgttgcgactagcgctctgctgggtcagatcggcacgcccggcggcgggctgggctttggttacgcctcaaccaatctggccggtgccgcccggcgacagttttccgggcctcgtctgcccgccggtcataatccggttcaggagacgattccggtggcacgcatcgccgacatgttgctcaatcccggagggcactatgagtttgatgggcaacagcgggtctatcccgacatccggctggtctactgggcgggcggcaatgtctttcatcatcatcaggatatcaacaagctgatacgcgcctggcagcggccggacactgtaattgtgcatgagcagttctggacggcgcaggcaaaatttgccgacatcgtgctgcctgcgaccacgtcgctggagcgtgaagatattggcagcgccagcaacgacggttttatcatcgccatgccgcagcatctgccgccgtttggcgaggcaaaatcggattacgcaatttttgccgctctgtcgcagcggctcggttttgctgacgcctttacgcaggggcgtgatgagcgccagtggcttcagtcactctatgaagattcccggccacgcgcggcagcgcagggcatcgaaactgccgccctttgaggcgttctggtcacagggagtggtggagtatcccgcgccagagacgccgcagatcctgctaaaagcgtttcgcgataacctggagtcagccccgctcagcacgccgtcggggaaaatcgagcttttttctcagcaggtggccgatttcgggtatgacgaagcgcccggatttgcctgctggtatgcgccggaataccaggcgcaacagcaggaaaagcagcagtggccgttgcatctgctctccagccagccacggacccggttgcatagtcagtacgatcatggacgggtcagccgggccaccaaaattgccgggcgtgagccactctggatgcatcctgaagatgctgctgcgcgcggcattgaggagaacagcatcgtaaaagtctttaacggacgcggcgcgctgctggcgggtgtgcatctgacgcaggatatcctgccgggtgtcgtacagatgtcgaccggcgcctggtatgacccgctcgatcagcaggagggccagccgctggataaacacggcaatcccaatgtgctgacccaggatagcggcagttcacgactcggccaggggtgcagtgcgcagacctgttttgtcgagattgcgctttatcaacagcctttgcctgagattacggcatggttaccgccggcattcgtggcgtggagcgcagagtaatctgcgggtttaaagcccgcggcgtggtaggatattcccatccgtcgcatatacatagcaggattagttggtagttaacgcataaatgaaatggcagtgtaaagcgattccatgccaacagagtgtcaatcatgagcgcgttaaccacagcagaattgccggtaattgatttcgcattattgtcaggtaatcaacagcagcagcaacaggtcctggaaaaattaagccaggccgcgcgtgatgtcggtttcttctatttaatcaatcacggcatcgaccgtgaactattagatgaggttcagcacgtcgcgcggaaattttttgccctgccacaggcggataaatccgcagtggcgatggcgaactcgccgcattttcgcggctataacctggcgggggttgaaataacccgcagccagcctgactatcgcgagcagtttgatattggtgcggaaacgggaagcgctgcccgttaccgccgattcacccacctggcaacggatgcaggggccgaatcagtggcctgaagccttacctgaactgcaaacggtggtcacccgctggcagcagcagatgacagcggtggcgctggagctgctgcgcgcctttgccggggcactgaatctgccgcgcaacgccttcgataacctctatggcgactatcccaacgaacatatcaaactgatccgttatccgggccgcacggagggcgaatcacgccagggtgttggcgcgcacaaagattcaggcttcctgacgatgttactgcaggacgatcagccgggcttacaggtggaagtgacgccggacaactggatcgatgcctcaccactgccgggcgcgtttgtggtgaacattggcgagctgctggagctggcaaccaacggttatcttcgcgcaacggtgcaccgtgtggtgtcgccaccgcagagcagcgagcgcttatccatcgcctttttccttggcgcgcaactcgacgccgtggtgccgatctatcaactgcctcctcagctggctgaactggcacagggaccgagcagcgatccgcttaatccgctgctgcgcgaagtgggctggaactaccttaaaggccggctgcgttcgcatccggaagttgcccagcgtttctaccccgaacacaacacccactgataacgataagagataaatgatgatgattaaaaagcgctttctggcccttgccggtctttcactgctgattgcccagagtttacaggccgcgccgctgcgcgtagcggccgatccgctgccccatgcggaaatcctggagtatgtcaaaaccctggatccgaaactggatctcaaaattgttgagctgagcgggggcgtgaatgccaatgagctgctggccgccggggatgtggatgccaactacttccagcatctgccttacctgaaagatcaggagaaggcgctggggaaaacctttgccgtggccgccagtgttcacatcgagccgctgggtatctattcgcggaaagtgaaaagtttagcggcgctacctgaaggggccagcattgcggtaccgaacaataccactaacctgagccgcgcactctggctgttgcaggacaaaggggtgatcaaactcaacgcgcagggtgaaacgggttcgacgctggtgacgccaaaagatatcagtgaaaacccgaagaaaattaagatcgttgagattgagtcgccgcagctgccacgctcgctggatgatgtggatgccgcaattatcaacggcaactacgcgctggaagccggtctgaccccggcgaaagatgcgctgggactggagtctgcagcacataacccctacgccaacctgctggtaacgacgccagaactggcgaaagatccccgcgtgttacagctggcgaaagatctgcgctcgccgcaggtagcggagtttatccgtaaaaattatcagggctcagtgattccggttgcggaccagcagcatgattaaactcagtcatctcagcaaacagtatcctggcgcatctgcgccagcgttagacgacatctcgctcaccatcgaagaagggaccatctttggcatcctcggtcggagcggagcgggaaaaagtacactattgcgctgcctcaatcggctggagagtcccaccagcggcctgattgaaattgacgggcaggatctcgccgcgatgagcctggcgcaactgcgtcagcagcgacagcagatggggatgatcttccagcacttcaatctgctgcattcgcgcaacgtgcaggacaacgtcgatctggcgctggagattgccggtgtgcctgcggctgaacgccgcgagcgggtcgcatcgctgctgaaactggtggggctggcctcctttgcggcggcctggccgtcgcagctctccggtggacagaaacagcgcgtcggcatcgcccgcgcgctggccgcccgaccccgttatctgctgtgcgatgaggcgaccagcgcgctggatcccgaaaccaccacttcgattctcgatctgctggccgatattcagcagcagctcaatatcaccattgtattgatcacccatgaaatggcggtggtgaagcggatttgtgacggggcggcgctgcttgagaatggccagctggttgagagcggcagcctgagccagatcatgggacgtgaagagggacgcctgcgcaaaatgctgctgaaggatggcgaagcagaccgggcgtttatcgaaaaatatcagcacgaggtgttaacccgatgcgtagcatgagtagtgagcggtttcaggaactgctgctgaacgccactggcgaaacactgtatatggtgttgctggcggcccttttcacggtcgcgatagggctgccggtaggcgtgctgctatttctgacccggccaaaaggcattctgcccaatcgcgcgatttcactgctgctgaatacgctggtaaataccggacgcgccttgccgtttgtggtgctgctgattgcgctgatcccctttacccgtctgctggtcggcaccacgctgggcagcactgccgccattgtgccgattacgctgggggcatttcccttctttgcccgcatcgtggagaacgcgctggatgaggtcgaccgcggccgcatagaagcggtggtatcaatgggcggtaccctgtggcatatcgtcagccgtgtgctgctgccggaagcgcttcccgcgctggtggcgggcgttaccctgacgattgtgatgttgattggcttctcggcgatggcgggcgtggttggcggtggcgggctgggcgatctggcgattcgctacggttatcagcgtttcgataaccaaatcatggcggccaccattgtggtgctgctggcgcttgtgatgctgattcagaaactcggcgaccggctggtacgctcgctggcttatcgtcgataagggggaacgatgtttcgcgtgatgtcgccgaaaggctatctgcaacggccagggctgcgggccggggtgggagaaattatccggccgcttgcctcgcatattcacatcctcacctcgccgcgggcctggcaggcggtgaatcctgacatgagcataagtctggaacgggcggggatccgctggcagctcgacaccctgaccggtgagtgtaccgacgcggcgattgctgccctgcaacagcaggtgcagacgcacggcgctaccctgattctggcagtcggcggcgggcgggtgctggactgcgccaaagcggtcaacgacgcgctgccggatatccggctggtgaacttcgccacgctggccgccacttgtgccgcctggtctccgctggcgattatctatgatgagcgcggcggccatctgcgcagccagccgcttaatgccatgccggagcggattctggtggacagcgaggtcatcgcccgcagcgaggtacgctatctgcgggccgggatcgtggatgcgctggccaaatggtttgaatttgagccttatcagcgacagacgccgcaccagctggcgctgtatcttaaagtcgcagccgcctggcaggcggtgacggtgctgaaacgctggggcgacacggcggtggccgataacatcaggcagcaggtcaccccggcgctggagaaagtgattgaagccaacattgtgctggcggggctggctaacagtattcaggatgcgatggcaacccccggttttgcccacatcatccacgatcgcctgactcaccagccggagctgcatcactggctgcatggtgaaaaggtcggctttagcttgctggtacaatcctggattgaacagcagggtaagcaggtggagcctgaactgctggcgctgctgcgccgtttccactcgcctctgacgctgcctgcggcgattaacgcggacaggatgagacagattgcgcagcagatccatttcccctccgccagcctggcgcaccttccctttacgttcgatcaccctctgctggagcaggccttgctggcgacttctgcgtttaaacagtaagtgcggtcagcgaatcgatcaacggtcgccgcttgctaacctaccaatagtaacttacctttagtagcttaatggctaatcaggtaaggtgacgacgatgcatgcattaatagtgacttcccatcccaatcaggacgctcacacccatcgcgtggcggaccagctggcgcagggcattatcgcgacaggccaccatacggctgaaaaggccgatctggcggcagaagggtttgatccacgttttacgctcagcgatcacagacatttcaacggtctggcaccgacgccgcccgatgtgctggcagaacagcagcggctggatcgtgccgatgcgctggtgctggtctatccggtctactggtggtcatttccggctcagcttaaaggctggatagaccgcgttttcatcgcgggctgggcctttgatgagcaggatggccatatcgtaaaacgcctcggccatcttcccgtgcatctgcttgcgattggcgcggctgacaaccgaacctttctgcggcgcggctatttcgccagcatgcggaatcagattgatcacggcatctttgactattgcggtgcgccggtggtgaccagtgaactgttgctgagcggcgatgaaggttatcctgagtcacactatcagctggcgcatcaactgggccagcgtctgttcgcccatcaggaaaaacatgaccgttgaaaaaacaccccgtaagcgtctgtcacgcgaagcacgacgcaggcagttgtcagacgtcgcgtggcagataatgcaaaccgaaggcagcgaggcactgacgctggccagagtcggcgacgcggcgggggtcagtaaaccggtggtttatgaccacttcaccacccgtcatggattgctggcggcgttgtatgacgattttgatcgtcgccagaccgaaaagatggaagcggcgatgaatgccgcaccgatggtgatgcaacaaaaagcggaagtgcttgcggcctgttatgtggattgtgtgatgacggaggggcgtgagattccggagttgctgtcagcgctcagcacctcaccggaaaactggctgccgtcaaacgccactatcagctcgactttatcgcccgctgtcagcgctggtttgtccctctggcaggcagcagcggtattccggaagcaggcatgtggggcttgctggggggcgcggatgccatcgcaggtgcggtggcacgcggcgatgtcagcaaacgggaaggagaacaggcgatcactgccatggtcgtggcgctggtggcaggcagccgtgcgtcggaatcggattagcataaaaaaggcggcccgcaggccgccgaatccttcaaccacaacaggcgttgtgtaagtagtggcaacgtacaatgatgatcgttttagcctttcaccccgcctgcggttaaaccgctcaccagccagcgctgcgccagcaggaaaaccagggtgatcggaatcgcggagagcaccgccgcggcggcgaaatcgccccacagatagttctgcggattgaggtactgctgcattccgaccgccagggtgtagctgtttacatcgcgcagcagcagcgaggcgaccggcacttcagtcaccgcggcgataaacgccagaataaacaccaccgccagaatcggcaccgacagcggcagcagcaccagccggaacgcctgccacggcgttgcgccatccagcgcggcggcctcttccagtgacccgtcgatagtttcgaaatagcctttgatagtccagacatgcagcgcgataccgcccagataggcgaatatcaccccaccgtgggtattcagcccgataaaaggcagatactgaccgagacgatcaaacagggcatagagcgccaccagcgacagcaccgccgggaacatctggaaaatcagcattccttttagcaggctggcacggccggtaaagcgcatacgggcaaaggcataggcgcaggtggtagagagcgccacgatgcccagcgcactgattgccgcaatcttgatcgagttccataaccagagcagcaccgggaagggcggcggtgtcacccggccatccgcatgttccacgctgaaacccagcgccagacgccagtgctcccacgagatctgctccgggatcaggctgccggtggcgaagttcccggcacgcagcgaaatcgcaatcaccatcagcaggggaaagagaatcgccgcgataaataacagcagcagcagatgcgtggtgaacagacgcagccgttgcgatttcggttgtaccatagccataacaactcctctgagcctggtccatcaggctattttatttgtcagtctgaacccgggcagtgctcacaatcctcacctcccaggttgcggttgttccacgctcttcgcgtccggactgcctgcaaccatgacgcctgtcgggccaggcgcttagtcgaatttcatccgcgaggctttcaggttaatcaccgccagcgcacccaccagcaggaagatcagcgtggcgatagcggcggccagcccaaagtcctgcccgccgccgccttcaaaggcgatacgccaggtgtagttcaccagcaaatcggtgtaaccggctggcgtggtggtgccgaggcgatccggcccgccgttggtgagtaactgcaccagcacaaagttattaaagttaaaggcaaagctggtgatcatcagcggcatcagtggtttcagcagcagcggcagagtaatcaggaagaagttctgcagcggtcccgcaccatccatcgccgaggcttcatagagatcgtccggaatcgccttcagcaggcccatgcagaggatcatcatgtacgggtagccgagccaggtattgacgataatcagcatggtgcgcgccagcgtcgggtcgctgaaccaggccggcttcacgccaaacagcgcgctgagcatcacgttgatttcaccaaagctctggttgaacaaccccttgaaaatcaggatcgagataaacgccggcacggcatagggcagaatcagcattacccgatagaccgctttgccgcgcaacgcctcccactgcaccagacacgccagcaccatccccaccgcgacggtcagcaccaccgtgatcagcgagaagagtagcgtccagccaaatatcgccaggaacggcttctgaatcccttcgtcagtaaacacccgcacgaagtttttccagccggtattcacggtaaagccgggactcagggtttcgttcgcccaactgccgtcggcgttaatcgcctgatagaaaccggtctgcggattagcgcgatagcgcgcgttgctctgctgattgatcagctcatcctgcgcacccacccgatagagcggctgggtgccggagaactggcgcagtgaactcatccgcaactgacgaccatccggcagttccgcccggatctggctcagtgcctgacgatgggtcgtgatcgctctgaagttcgcccgtttcacctgaaggtgcagcagcaggggccattttcagggtctgttcagcgccaaactgaaacggcggtgaaacatagtttttgccatcattcagcaccagctgccagcgctcgccgaccgggaacagagaaaaactgactgcttcacccgactggaaggtgcggcccagcaaaacctgctgcgcccgttcaaaggtgagctggttgctgctgctgtagttggtaaaggcaatggcaatcgtgcaggcgagagggaacagtacaaacagcgccattcccgccacgccgggatagacataacgccacgcataggcgcgacggttagcaaaaatccacagtccggtcgcactgaggatcagcgtcagcagcgcaaacagatattcgccctgcgcgtacatcagcaccagcagatagccgaccagcagacagcagatcccgatgagaacgcttttcaacagcacactgcgcgttttcggttttcctgacatgatgcggttttccttaacggtcactcaagccgggttgccccggctgcaaggggagaattacttcttcagacgggcctgagcatctttcagtgcggcgtcgacgctctgacgaccgcccagcgcgttcagggtagcggtgcgcatcgcataccagaatgccgccatctgcgggatattcggcatgatgtcaccctgacgggcattgttcatggtggcggcgatacgcgaatctttttccagcgtctgctggaaagatttcagcgccacggcacccagcggcttatctttgttgaccgcatccagaccggtgtcagtcagcagataattctccaggaactctttcgccagctctttgttaggactggcggcgttgatcccggcactcagcacgccgacaaaggctttcgacggtttaccgttcagggttggcaattcggtgacgccatagtcgatgccgctcttgtcgaggttgccccacgcccacggaccattaatggtcatggcggtttcgcctttgttaaaggcggcctcagcaatcgaataatcggtgtccgcattcagggttttggctttaacctgatcgaccaggaactgcatgcccgctttagcaccggcgttatcgacgccgacatccttcacgtcataatgtccgtcggtgagcttaaaggcgtaagcaccgcctgcggccagcagcggccaggtgaagtagggttcctgcaggttaaacatgatggcgcttttgcctttggcgcgcagttgcttgtcgagaccggcaatctcttcccaggtttttggtgggttcggcagcagctttttgttgtagatcagtgacagcgactcaacggagatcggatagccaatcagcttgccgtcaaagcgcaccgcgtcccaggtgaacgggaaaatcttctcgcggaagctggcatccggcgtgatctcagccagcaggccggattgcgcatagccgccgaaacggtcatgtgcccagaagataatatccgggccatcgccggtcgccgcgacctgcggatacttctcttccattttgtcaggatgttcgaccgtgactttgatgccggtctcctgctcaaatttcttacccacttcggcaaggccgttgtagcccttgtcaccattgatccagatgaccagtttaccttcctcaatttttgccatcgcgctggccgaaaagagcacggcagagagggcagaaagggccagaattcttgctccggttttcatcatcataaatccatcctgttagcggaagtggtgaatgctgtaccggcatcattgtgcttatccgccacggcttctcatcctcctctgctctacgcccctcggcctgccgctgtgatcgcgctggcaaaaagcccctcaagcgggcgcttacgcggcaaaaattcctgcgggtctgcgttagcgatcacaaaaaagcgcgtcagcgtgcgggccgcggcgtcagcctgcgtttctcctcctcccgcctcctcccccagcggattgcagtgcggtggaggatgttaccgtcagtttcctctcgcatagtgagccccggaactcgtctgccgctgggcagacacgactatgcagctaagagggaagggatcatggcgagcgttgtgttacgcaatgtcacgaaagcctggggcgatacggtggtgtcgaaagatatcgatctcactattcgtgaaggtgaatttgttgttttcgtcggcccatcaggctgtggcaaatcgacgctgctgcgcatgattgccggactggagaccatcaccagcggcgagctcttaatcggcgaccggcgcatgaatgaagtgccacccgccgaacgcggcatcggcatggtgtttcagtcctatgcgctctatccccatctgtcggtggcggagaacatgtcttttggcctcaaactggccggggtgaaaaaagcggaaatccagcagcgggttaatcaggtggcggagattctgcaactggcgcatctgctcgatcgccggcctaaagccctctctggcgggcagcgtcagcgcgtggcgattggccgcacgctggtggcggaaccgcgcgtcttcctgctggatgaaccactgtcgaaccttgacgccgcgctgcgcgttcagatgcgcattgagatctcccgtctgcataagcgcctgaagcgcaccatgatttacgtgacccacgatcagatcgaagcgatgacgctggccgacaaaatcgtggtgctggatgccggacgcattgcgcaggtcggcaagccgcttgagctctaccactatcccgccaaccgctttgtcgccggatttatcggctcaccaaaaatgaatttcctgccggtcaaagtgaccgccaccgccatcgatcaggttcaggtgcggctgccgaatcagcagctggtctggctgccggttgacagcgccggtgtgcaggtcggcagcaacatgtcactgggtattcgcccggaacatctgctctccagcgatatcgccgacgtcaccctggaaggggaagtgcaggtggtggaacagctggggcatgaaacacagatccacatcgagattcccgctatccgtcagaacctggtttaccgccaggaggacgtcgtgctggtaaaagagggcgccatcctcggtattggcctgccgcccgagcgttgtcacctgttccgcgaggacgggagcgcgtgccgcaggctgtatcaggagccgggtgtatagccctgccaaaaacaataaaagcaatgacctcaggagatagaaaatgttaactctgcgcaaacttcccatcgccgttgccgtcgcggtgggaaccctctccgccccgacgatggcggttgattttaccggttacgcccgttccggcattggctggaccggcagcggtggtgaacagcaatgtttccaggccaccggtgcccaaagtaaataccgtctgggcaacgaatgtgaaacctacgccgaactgaaattaggccaggaagtgtggaaagagggcgacaaaagcttctatttcgacaccaacgtggcttactccgtggcacagcagaatgactgggaagccacatcgcccgccttccgtgaagccaacgtaaaaggtaaaaacctgatcgacgcgctgccaggctctaccatctgggccggtaagcgtttctatcagcgtcatgacgtccatatgatcgacttctactactgggatatttccggtccgggtgccggtctggaagatgtcgatctcggcttcggtaaactctctttcgccgcaacccgttcatctgaagcgggcggctcttacaccttctccagcgatcgtatccgtgacttcgccaccagtactgccaacgacgtgtttgatgtgcgtctggccggtctggaaaccaacaccaacggcgtgctggagctgggtgtcgactacggtcgcgctaatgcccgtgacgactaccgtctggaagagggggcttctaaagatggctggatgttcactgctgaacatacccagagcatgctgaagggctataacaaattcgtgctgcagtatgccaccgatgcgctgacctctcagggcaaaggcgtgccgcagggcaccagcctcaacaacaatggtgacatgtatcgcatcctcgaccacggtgcgatctcactggccgaaacgctgggatctgatgtacgtcgctatgtaccagaacatcgatctggacaacaaccgcggcaccgagtggtacaccgtgggtgtgcgtccgatgtacaaatggacgccgattatgagcacgttgctggaactgggctacgacaacgtcaaatcacagcaggctaacgagcgcaacggccagtacaaagtgacgctggcgcagcagtggcaggcgggcgacagcatctggtcacgtccggctctgcgtctgttcgcgacctacgccaaatgggatgaaaagtggggttacaacaaagataactcaggcgatctcaccaccttcgcctctgcggacaccagcggcaacggcatcctgactaacagccgtggtaaagacgatgaagtgaccttcggcgcgcagatggaaatctggtggtaagccagcactttttctgacaggcgcgcctgcgcctgatggatctctttggtcgcggtgtgccattgcctggttcacgccgcgacctgcaataaggtagacataatgaaaatgaaaaaactggctgcactctgcctgagtgcggcgttactgacaggacacgcgcttcccgccctggcggatgtcaatctggtgccgcaggatctctcgtccgcaccggtcgtggcagccgaaacactgcaacgtctgagctggcaaccgctggctgcttctcagacacagaccacaaaactcgctaacagcggacagacgctgaacgcgccacacattgccggtccggtcgcggcctacagtctgcccgccagtatcggcgaactgacgctgacgctgagcagtgaagtggcgaacggtcaggttttcgcgccgaacgtgctggtgctggatgaaaacctgcgtcctgcggcctggttccccagccgctactttacctatcagaagccgggcgtgatggcggcagatcggctggaaggggtgatgaaattaaccccggcgctgggtcagcaaaaaatctacctgctggtgttcaccaccgacagcgatctgacacaaaccaccacgctgcttgacccggccaaggcctacgcccagggcaccggtcatgcggtaccggatattcccgatcccgtcgcccgccacagccgggaagggacaatcaagctgaagatgcagaccagttccggctcatccattctggtcgggccgctgtttggttcatccggcccgagcgcggtgaccgtcggcaataccgcacctgcggcagcgtacagcgcagcaccggcgcctgcacccgccgcagcgcccgcgccaaaagcccgtgcggaaccgatcatgagcgacaccgagagttactttaaccagaagatcagacaggcggtgaacagcggtaatatcgataaggcgctgaaactgctggatgaagccgagcggctgggttccacctctgcccggcagacctttatcagtagtgttaaaggcaaggggtgaagctgccccgacaatactgatgttgttccatctggtgcgctgcggcgcacctttttttgttgcagagatcctgattgcatgatttttttgcgtggttttacgcattgcgtaagtcatgctgtgggcaatagcgtttgatgaatataggctaactaagctgtttcagggatgacttttctggaggctaaatgcgaagttacacgacaacacaggcccgaaaatatcttgctgaaatcatggatatcgtgatggcgggtgagcctgtgattatcacccggcggggcggtttctgctgctgtgcttatcagtcgcgaagagtttgatgtctggcaggaaataaaacagggtgccaatttttcaggcgatacggaaaagcgtaatcagaaacttttaatgaagacttagtaacaaaacattcgctcaatcgcgatcaatgcatttgcattgccaatgcacttgcattactgttgcgctatcttgttttttctagtgagaatccgcgatgggaactctgactcatgcaaacatctctctgcgtgcttcatcaaaactgacagcccgcagccagaccactatccctgccgcagtttcgtgatgcgatgaatctgcaaccgggtgagaatatcgaatacgctgttctgccgggcggcaaagtccttattacccgtcaggaaacggtgactgatgatgatccagtgatggcgagctttctgagttttcttgctgctgacatacgcaacacacctgcaaatattaaaacgctggatcgaggattattaactcgcattacatcgttgaccgaaggtatggacgttgatttggatgctccactcatggacgatgagtaattaagtatggaagacagcacggttataaatggatggcacgtttatgttcatccgtgttttgaatcgcagctgattgcgctgaccaatgaagtggagttactcagggctaaatatcctgaaagttaccagcgaaaagcaacgactaatcttttagctgctgtgtttaaagttatcaatagtgagatttgcgccgatccacatcaggcaaagtttcgccagggcgatacgctgggagaacaaaataagcattggttccgtgcaaagtttttgatgcagtatcgtttgttctttagattcagcgagcaacataaaaccatcatccttgcatggatgaatgacgctgagaccaaacgtgcttatggcagtaagcgtgacgcctataaagtattttcaggaatgttgcataacggctatccacctgacgactgggcattgctgttaaagcaatctcagaattgggcgaatacaaattcggaatatccataaatcctgaaaaatatccggttagtgtttttagacgctcgtgctcagggtgatcttttcactgttgagaggtgctgattacagtagcagcgtgcaagccgttgccggcccgcacgctgtaataactgaaaattatgtaaaacaggctgcgtgagacacgagtctgagtcgcgcgttaaccttcaattgcgcagtagtcgcttccggcgtgccgtcagatcacgcagcagcgtgtcagtggcaggatcgctgaacagcgtttccagcgtggcgctgagcttgcgtcgccagttcggatattcatcgctggtgcccggaatattgaccggcgctgccatatccagccagtcctccggttgcagtcccagcagggcgctgtggctatcagccagatagcgctgcatcgcccggtttaatgccttgctcatgccggtgcgacgtgcatcgcgtccggcacgtttcggcagggcaccaacgcgatgcagactctgcagcagcgcctgctttgcccgcaaccgatcctgatatagcccggccagcaccaccttgtcgggatagaggccgagttgtgcgccggtggtcaaatcatcgctctgccaccagccacgcagcgtcggaagatcgtgagtggtcgcgaccgccattgcctgccgtggccattcggcaggcggacgaaaactgtgggctgactcctgctcaaaatagagcaccttataggagtagaccccgccgtcccgcagcttatcgacaatcgcttccggcaccgtaccgagatcttcgccaatgaccatgcagcgatgacgctgactttccagcgccagaatcgccagcagatcgtcgatgggatagtgcacgtaggcaccgtgcatcgcgctatcaccggccggaatccaccacagccgcattagcgccatcacatggtcaatgcgcagtgcgccgcagtggcgcatgttggcgcgcagcagggcgatccacggctcccaggcgcgctgacgcatcacctgcggatccatgggcggcaatccccagtcctggccgcgcgggccgagaatatcgggcggcgcaccgatgctggcatccatgcagtagagatcgcgctcgctccaggtctctgcgccaccctgcgcaacacccaccgccagatcgcggtaaagtccaatcggcatctgctgctgctggcagatgtcccagcagtcggcaaactgcttcgcggccagccactgcagccagagccagaagcgcacctgatcggcgtgctgttgcaggaaggcctgcacggccggactgccgggatcctgcaacgcctccggccacaccgcccagccccagcgctcactatcctgtgctatctgatcggcgtgcagcgcatcaaacagcgcctgatgctgaagactctcgcctccttcacgtataaatccattaaacgcctgcacctcgggatcgctggcgtcacgctgagtaaaatgcggccacgccagtctcagcgcgtcaattttcagccgggtcaccgccgcataatccacccaatctgctgcgcgagcctgttccagtgcctgttctgtttccggacgttgccaccaggcctgagcggcagcgctctgccggaagtcagcgactgcgcccacatcgatgtagagcacattaagccagcgccgggacgaggggctgtaagggctggcactctccgggctggagggaaacagcgcatggatagggttaagaccgataaacgcgccgccgcgtgcagcgacctccggcagcatccggcgcagatcgccaaagtcgccgattccccagttctccgccgaacgcagggtatagagctgcacgcaggcgccccataatgactcacctgccagcagggccgggggttcataacagcgggccggggcaattattatccggcacgaccactgctgcgcggcctgttgcagcgtcagctgatgatagccttctggcagcggcggcagatgcagcggctgagcgggctggcagcgacctgagctgatttcacccgcttcactggtgagatgccagtgggcatcgttagcgagctgtggcgacaggctcagcagatcgccgctgcgaaaaatcaccaccggtggcagcggcgtgctcagcggatgggaaggttgcatcaccgccagcaaacgctggcgggtcagggtcgggatcgcctgtggcttgccgtgagcattgatatactcagcggcgatgcccgcccgggagaaatcgtccataaccggatctgttttcatggcgttccttagcgtttcgcttgccagatgcgctgctggtaatcgcggatagcgcgatcggaactgaacatgccacagcgtgcggtattgaggatggtggcacgtgtccaggcctcctgatcgctccacagcgcttctacctgcgcctgtgcgtcaaggtagggctggaagtcagccagtaccagataaggatcaccgccttccgggccgagactctgcaacatcgcatcaaaggcgtggcagtcgccctggctgaaggtgccatcttccagcgcctgtaagacctgatggagctgcggatctttcttgcgccactgcgccggggcataaccgtctgcttttaaagccaccacctgttccacggtatgcccgaagataaagatgttctcgctgccaacctgctcagcgatctcaacgttcgccccatccagtgtgccgatggtcagtgcgccattcagcgccagtttcatatttccggtgccggacgcttctttaccggcggtggagatctgctcagaaaggtcggcagccggaatcagccgctcggcgacggagacgttgtaatcgggaataaacacgactttcagacggtcaccaatgcggggatcctgattgatcacctcggccactttgttgatggcatagatgatgtttttcgccagtgcatagccgggtgcggctttggcaccaaacagcaccacgcgcggcgtccggttagcctgcggatcggtgaccagcgtctgccacagcgcaatgatgtgcagcaggctcagatgctggcgtttgtactcatgcagtcgtttgatctgtacgtcaaacagcgcggtagggtcaatctcaatgccggtccgctgtttcacccagtgcgccagcgcgactttgttctgctgcttgatggcgcgatattccgcgcagaaggcggcgtcatccgcaaacgcttccagcccctgcaaggcatcgagatcgttcagccagggtttttgcaatgtccgggtgatcagggcactcagcgccgggttgcactgattgatccagcggcgcggcgtaatgccgttggtcacgttgtggaatttctccggccacatctggtgatattccgggaagagatcctgcaccaccagtttcgagtgcagcgccgccacaccgttgaccgcgaacccgctggtcacgcagaggtttgccatccgcagctggttattatggaccagcgccagtctggcccacttcgcttcatcgtccggccagcgcgcggtgactgccgtttttagctgcgtgttcagggtattgatgatcatcatatggcgcggcagcaggctgcgcaccagacgcacatcccagcactccagcgcttccggcatcagggtgtgattggtgtaggcaaaagtgtgctgcgtgatctgccaggcgcgatcccagctcagctgatgctcatccagcagcagacgcatcagctccgggatagccagcgtcggatgggtgtcattaagctggatcacttcatgatcggccagggtttcgatgctgcgtccggcccgatgatggcgacgcagaatgtcagccagcgcgcaggcgcattgaaaatattgctgcatcagacgcagttttttaccgttctgatgattgtcattggggtagagcactttagtcagtttttcagcatcaataccctgttgttcagcgcgcagaaagtcgccgtcgttgaagcgatcaaggttaaacggctgggcatgtttcgcctgccatagacgcagtggctggctgataccattctgataacccaccaccggcagatcccaggcttcgccgagcagttcaaacgccggttgccactgtggctgacccgcaaccgtcaccactttaccgcccagcccgacccgcacgttaagcgcggcgttgtggttaaaccacggatagcggtcgcgctgccagtcatccgggccttcaatctgcgcgccctgttcgaagcgctggcggaacagaccgtactggtagttcagaccgtagcccgtagcgggctgacccacattcgccatggaatccaggaaacaggcagcaagacgacccaggccgccattacccagcgccggatctgtttcggtttccagcacgtcagtgagtgagatatcccaggcggccagggcctcgttgaccgcgtcataccagcccaggttcagcaggttgttgccggtcaggcgaccgatcaaaaactccatcgacagatagttaacatggcgcagtttctgtcggggccgggggagcaggctgtgcggccagcatatcggccagcgcaccgctgagtgcctgccaccactgtgtcgtagtcatctcctgcgcatcgcgcaggccaaaacgctgccactgacgggtcagggcagcattgaactgaatcgggttgaaatcgggctgtgtcatggttgatgtcctgtaaaaacggaaaatggatcaatgtggcgacagtctgcccgcgcggaaaccctcgctcatcctcctgcaaagaattagcggaggaggatggggagggtggagaggatgaggctaatccgaaatcgttgaaggagtgtgattgcgcacgcttttgtaaagtttaattaatgggtttgcttgcattcatctgacgaaatgctgaacctgtgtaagtaataattacgaagcgtaaaataatgatgcgctcgacaaatggagaaacgcgcgcccatgttaatacccgctaaactcagccgcccggtgcgtcttgaaggcactgtgattcgggagagattgctgcaaaagctcaccgctgcaggtaactatcggctggtgctggtcaccagtccggcgggctacggtaaaaccacactggtgtcgcagtgggcggcagggaaaagcgatctggggtgggtttctttagatgagggcgataatcagccggagcgctttgccgattacctgatcgctgcactgcaacaggcaacccacggtggctgtccgcgcagtgaactgctggcccagaagcggcagtatgtgaatctcaacgccctgttttctcagctctttatcgagctggtggagtggcagcagccgctgtggctgatcgttgatgactaccatctgattaccaatccggtgatccacgacgcgatgcgctttttcctgcgccatcagcctgaaaatctgacgctgattctgatgtcacgcaacctgccgcaactcggtatcgccaacctgcgggtgcgtgagcaactgattgagctgggcagccagcagctggcttttacccaccaggaggcgcgacagttttttgactgccgactggcggccccgctggaaagcgaagagagcagccgactctgtgatgatgtagcgggctgggctacggcgctgcaactgatcgtgctgtcggcgcgacagggtgccagttcggctcagcattccgcccggcgtctctctggcattaatgccagccacctctccgattatctggttgaagaagttctggataacgtcgatctgcctacccgccatttcttactgaaaaccgcgctgctgcgttcaatgaacgatgaactgatcgcctgtgtcacccgcgaagagaacggccagatgcggctggaagagattgagcgtcagggtctgtttctgcagcgcatggacgactccggctgctggttcagttaccatccgctgtttggtaacttcctgcgtcagcgctgtcagtgggaactggcggcggagctgcctgcgctgcatcgggctgcggcagagagctggatggcgcagggctttcccggcgaggcgattcatcatgcgctcgcctctggcgacgccactatgctgcgggacgtgctgctgaagcacgcgtggacgctgtttaatcagagcgaactgccgctgctggagaactccctgaaagcactgccgtgggagatgatgctggaaaatccaatgctggtgctgctgcaggcctggctgatgcagagtcagcatcgcttctccgaagtcgacagtctgctggcgcgttttgaacaggccagccgctgcgagatcgacgcagcactgcgcggtgaatttaatgcgttgcgcgcccaggtggcgattaacgatggcaataccgatgaagcggagcggctggcgaaagtggcgctcgataccctgccagcgagccgtcactacagccgcattgtggcaacctcagtgcatggtgaagtgatgcactgcaaaggcgagctggatgattcactcaaactgatgcggcagaccgaacagatggcgcggcgcgatgaagtgtggcactacgccctctggagcctgattcagcagagcgagattctgtttgctcagggctttttgcaggcagcctatgagatccagagccgcgcctttgtgctggtcgacgaacagcatctggcgcagttcccgctgcatgagtttctgctgcgcatccgcgctcagttgctgtgggcctggggacgactggaagaggcggagcaggcggcccgggaaggcatcaaagtactgaacggtttccagccgcagcagcagattcagtgtctgggattgctggtgcagtgctcactggcacgcggcaatctggataacgcccgcagctacctgaaccggctggaaaacctgctgaacaatggcaactggcacagcgactggatagccaatgccgacaaagtccgggtcatttactggcaattgaccggcgacagccagaacgcccgcgactggatgcggcagacgcctaaacctgccttcgccaataaccattttctgcagggacaatggcggaacatcgcccgcgcgcagatcctgctgggtgatgtcagtcaggcggaagtggtgctggaggagttgaatgagaatgcccgtgccctgcgcctgatgagcgatttaaaccgtaatctgctgctgctgaatcagatctactggcagaccgaccgcaaagcggaggcgcagcgtgtcctgattgaggcgctgaaactggcgcgcagcaccggttttatcagccattttgtgattgaaggcgagatgatggcgcagcagctgcggcaattgatccagcttaataccctgaatgagctggacagccaccgcgcccggcgcatcctgctggagatcaataaatatcaccgtcacaaattcgcccatttcgatgaaggctttgtcagccgtttgcttaaccatcctgacgtgccggagctgatccgaaccagtccgctgacgcagcgtgaatggcaggtgctgggattaatctattctggttatagcaacgatcaaatcgccggtgagctggcggtggcctccaccaccatcaaaactcatatccgcaatctctatcagaagctgggcgtcacccatcgcagcgaagcgatgaatcaggtgcagtcgctgctgaaaataatgggatatgtctgacgacaggcgtttacaggggcggctttagcccgctttgccgcatgtcagcacaccgtcgaaacaggcggtctgtatcaatgggaagcgcataactactcctgactactcataggggcattcccggtaaggatgaaagggtaaatgcccttttaatggctatatcgccagtacaactaaactcagcctgaaatctgcagcctgaacacggagcacctgatggtcaccatacacgtttttatcgcagttagtcttgatggttacatcgcccgacaggatggcgatatagactggctgttgcagcgcgcggatccgacagaagatcatggctatgccgcattcatcgcggataaagattggattgttatgggccgggggagctatgagaaggtgctgacctttgatgtgtggccttatgatcagcccgtgctagtgctttcccgacagctagccgataccccggtgcccgaggcattaaaaggcaaagtgcaattcacccgccgtactccaaaggaggtgattaatgacctggcagcacagaacgcacatcgcatctatatcgatggcgggcaggtgatacagtcgttcctgcgtgaaggactggtcgccgatatcgttatcactaccgttcctgtcctgcttggttcgggaaaatccctgttcggctccctgcaacaggatatcgatttgacactgctatcaagccgcagcttcccttcgggtctggtgcagtcgcactatcggctggcgtcataaaccccacatagacatagcggcggcctgcggtaacgcgagatgaccgcccctgaggccagggcggccattaattaaaggatgaaacttctatgtcaaagctacacaacacgctgatttttttccactatctgcagggctgctcctttccctaccggtattcagtcagacactcccgcaggacactattcagctctctgcctgtgagagccagaacggacaggatgggaacggcagttcgcctgatggagaaaagggtaaagacggcgtgcccggtacaggccgtctgaacggaggtaacggcggtaatgctgacacaggctccaattcaaatggcggagatggcgaaaatgacggcacaaatggagccgatgcgtgtcctggcggcgtcggcgggcagggtggcagtggcgggaatgagggaggacatgatggttctcccggaatgagtggagctaaatagttatccctatgcagttaacgtggtttgccggaggttgatgaccccggcgacctcataaacacagactaagcagacagcaaggcaatgctgagacaccgtgccgcaaggcctgaaatgcaaagccggtgaagtcatatcagtcgtttttaccggcaccagtaaatcccgatcttccttaaaagacatcgcatagtgtcagcctgagtgatggcagcttatccggcaccacccaacgatccatttcccgcccggcctctgccgactcctgtgacataaccccagcctcttctccttcggggtgtgctcagtgctcacattttacataacagtgtgtgcctacagttaatgtgaacgtccgctcctgtcacaaagtaaactgtcatcgggctgatgaccggtatatgccaaaagcggatactgtttttaatgtgatttatttatttgatcctgcctttgctggagcacaaaggaagtcaaactacgtcgcgattactgctagccccgccagggataaaaccccattagctaagcaaacgaaccgcgcctggagacttgcccgttacacgcttaaaagcccggctgaaagcagcctgagaggagtatcctaaccgttgcgatgcggtgtcgacggtaatgttttctgacgacagccagcggacagcgagatgcatctttacttctgttgcataccgtagcggtgggacgccgatggtggtctgaaacctttcggcgaatgcggagcgggatatatgcgattcggcggcgagttctgccacgctccagtcccgacccggttcgcgatgaatcgccaggatggcctgagccagacgcggatcgcgcagtgctgcagccaggccagggctattgccgcaaccatcttccacccatcctctgataaacatcgctccagccacatcggcaagcctggcgagaatacctgcatagcccacgcgtccggagcatatctcacgcttcatcgcatcaaggatatgcatgagtcccggccactgaatcccctttgcatcggcatgcataatttcaggcagcacatccgccagccgctgcatgcttcccagatcaattttcatacaaccaaaaaacagcacagcgcctggtgtttcttgggtactcgggcaggtatcaatgccactcactttttcatccagtggtgccgtttcaatattgtcgatatccagcacgtcggcggctgttgccgacaaaagctgatgccgtttcgccgtggggaagaaatacagcctctccggccgaaagcgtaagaatttctccgtttgcactatgaagcaccatctcccctacagcgacgtagtgcagataagcatgaccgggcctgcttgcgaagttcaggccaaacgtatctcccgtctggatacgctgatatcgcacgccgtatagccgcaggccggaaagcaactcgctgatgagttctgatgacagagcgaaggatgaagtcatatgcctttccgggttttgggtaaaaaagtgagggttttagagcatagatcatccagctgcgcctgaatagacttcttctcctgaaacgactttccaggagacttagaaatgacggatgaaacttctatcagggttcacaaagaaagagtgcaaagagatgagaaaatccagccagcctggcttgcggttttttcgttaaccatgggtgtttttggcctgctcaccgcagagtacctgcctgccagcttattaacgcctatagcccgggatttgggtgtgtcagagtctctagcaggacaggccgtaacagtgactgcagtgattgcgttatttgccggattactgataccgcgattaacgcgtgcgctggaccggcgcgtcgtgttgttgagcttcactgcccttatgatcttctcaaatctgctcgtggcgctctcttcaggtattgtcatgctgctggcaatgcgcatcctgctgggtattgcgttgggtggattctggagtatggcagcggcggttgcgatgaggctagtgccggagaggctggtaccgcgggcgctgtcgatcatttttagtggaatcgctgtaggtactgttgttgccgtaccgctgggaagttatctgggcgagatgtctggctggcgtagcgcgtttattgccgctgctgcggttggcgcactctctttcatttttcagtggctgaccctgcccggaatgccgccggtagtcaggaccaggacagcatccgtattttctctgctccagaggccgggcgtgagcgtgggcatgctggggtgcgtgctcgcacacaccggccagtatgcgctgtttacctatatacggcctgcgctggaaggactcgcacacatagacgcaaaagggctggcgttaatacttctggtgtttggcattgctaactttatcgggacactgtcggcaggatggctgatggaacgcagcctgcgttttacgctgattattatgcctgctctggtgggagcagcggcactgggtatgatcactctgccgttatcaatcgccgggcttacggcgctggtcatgctgtgggggctggcatttggtggcataccggtggcgtggtcaggttgggtcgcccggactcttcccgatgaggccgagagcgcagggggtatggtggtcgccgccgtccaatcctccattgccgcgggtgcagcaataggtggcctgatatatggcctcaacggggtgacgggggtattcattactgcagcctgtatcatgcttactgccgcgctggttattgcattccgggtcagagtctcatcatcagctgaaggaacgcaaaactgaccatttcagtgacattttaaaatgtcaggacatctcgatcgaacagcttaacatccccggaccgcgcagcgttccgggcctgctgactgagtgtgatggcaaaggggctggttaacttatgaagctggttaacaggcgctatggcaaaaagcggagcttagcaataatcagtaagtgccgttttactcgctattctgaaatatcaccattctcagtggtgattcatgcgtgcagagaaaatattccttaacagagaagcttgaaaaacagtttccaggtgatatcttcaacacataactacctcatcaggaagatagtgtgattactctcaggaatatgaatgaagaagaattcaaaaattatcgttctcttttcatccatgaatattcgcaggatctgcaaaaaaatcgcggatatctttccgaaaaagcacgaatcaaagccatagaatctattgatacagtgttaacaaagggcgttgtgaccccggctaatcagctgtggtgtatccaagagcctgatgaaccagaggaagttattggcatcctctggttgtcgatcaccgggtcatcagcctggataagtgatttctacatttatcctgactggcgcggccgtggattcggtggtctggccttatgcgaaatgaaaagattgctaaaaataatgaacatcgatgaagtcggacttagggtagcgccgaataatgcctcagccaaagcactgtatcagaagaatggctttcatattaccggcatcaatatgtctcaaaatttaaactaaataatttaagaaagcgtttttaccaatagccaaagaaaatatcttttttaaagattccgcggtgcagcgccttataatacacatttgaggcatgagtttttactactcctgcattttctcaataacccgctgagcaaagaactgcctcttaaccacaacgggtttaaccgtgattttgactgagttcgtcccgtgaaatgtatcaactttgtgaggggctgctccgggcatagagttgtctggcgctggcacacggttagctaagagtgaggagcggaacataaatagttgtcatctcattgacggttctgtggctccttagaggatatggctgcattatcatcagaatttatctttgtcatacatggagtaagtcttatgagtataaatataaggccagcacaattttctgatgttgatggaattttctcagtccgaacatctgttacggagaatcatctgagccgcgaagaaatgcgaagaatagggatcaccgaaagcgtcgtgggcgatatgatcaaaaacgaccattgcgcatgggttgcctgtgataacgacgaaattattggtttttcaatgatcttaacggataaaggctgtctttatggtctttttgttcatcctgaatacgaaagcagaggtataggtcgcagactcactatgcttgcggaacaggagttattcagacatcacgaaattgcctggctggaaaccgaagaaaacagccgtgcggcaaaattttacatgcaactcggctggggtaataaagcaaatctggatggcactttcatccggttagaaaagcaacgtgatagttgatcttctatagctctcatctggttccgcttctggcacgaagcagccgaacgtagatgcagggttcgctatgagcacaggatgttagtcagttgcttgataagtagcctgatagcttctttactgcaactggataaaaactacaaaaacgttcaaagcaatttcaggatctcctccagcacatccgccggcctttcaagtacggccagatgagttctggccgtctctaaccgtttcacttcaaagaaattatgtttccttgagaaacgttgttgtaaagccaggtacttgtcgcttctgtccagggaatagatgtgagaagccttagggggatttctgagctgttcgagacgcaggagtggcgaaccatatttatggtatgcatcagcaatgacctgaccagcaagtcgccaaagctgatagctggattcagccatctcagtttttagatgatggatcatgactggagagtcgctttctgccagccaatattcgtaaagggcatcccgtgcatcttgccagctgtcttcattctgcatgtctctgaccgagtcgaaaaatccaggctccggctgattcatgatccaatcaagaaatatgactgcaggtatgcgatttcttaaactttccaccaaatcaatagatacccaactggcatgagcaacggaaacaggcactatccgtgttaagccaagatgtttaattagtgctaaagcatctgataataacgcctcaccgtcaacatcctgaccgttggtcgatgattttccatgaccacgccagtctatagtgacaacgcggaaaaagacggcggcctgctcagagaaatctttaaaaacggtttttggttggcaccagccaggcatgaggaacagagtcgtgtcacccgtgccaatatcatgataattaatatcaccataatttgtatgtaaaaccggcatattaatttctcttcataaagtgaatgaacaactaacctattctctcccgcatcactaaaaaagcatttattaacttagtagcacttatgtcatggtttatcagaattgagtaagtgatttacgggctgcttttgggctggaaatgtaaacctgaccacttccggataggatatacggctcgcagtatccgacagcgtcaatccttaaaacttcaggccactgcgatactgattccagcgtacgtatagcatgtccggataactttccgcagcctgtttctccagcgtctgtcaggcaccatgaagttgttgagtcactcaaaaatgtccgcttctggcacaaatcagacatgcttgcgggacatagtccgctatgagcgataagcggacattggccgtgtgctaaagaagaaaattgcgtggtgttaattccagaatggaacgaaatgcagcggtaaatgcagccggacatgagaaacccagttggtaggagacctgcttaattgagatgccattggcgaggagatctaatgacgcacaaattcttgctctttgcttccaggttctgaagctgaagcccgtatccttaataaacattcgcgaaaaggtgcgttcagacatattggcaatatgggccagatcgcttagagacgcttcccagcggtgactgaccagtaactctttggttgccctgtttaagcgctcatcatgcggcataggtagctccgcggtcaaaggcgttgcctcactgagaatttctaaaattaacagcgccattttacgctggctcggtccagtgtaatcggcattgaaaagcccggctatcagctctttcaccagtgcggtggctgtaatcacatgcacctggcgactcttcgtaaaattcaggcattcttcgataagactgctactgaaataaatagcccttaagtcggtgtgggatagcaggttgtagctgtgaatctgcagaggcggtagccacaatgcccgctgagggggtatcacccaacgattgccctctgtttcaaccaacataacgcccctggtagcaaataacagctgtccttcaatatgatgatgaggaggatcggtctctccgcgttgatagctgatggcggtgcaagaccatcccgtcgcttcatcatgtcttggcgctttatctatgctacttggcatttcaaatttagttcctgcagttatcttagttggactcacccgattcataacatcccggcagggtgaaacttgaaaaattaaggttaacataagcattacaggagcatctttaaatgcacgttcatttcatcatccatgaaagttttgaggctcccggcgcttatgagtcctgggccataggcaaaggtaatcacgtcacctattcacgagtttatgaaggtgaggctctaccgtccagcgtggatgacatcgattttttgattgttatgggcggtccacaggacccggaaaccacccctgaagagtgcccgcattttgatgcaaaggctgagcaggcggtcatcgcatccgctgtgcgcgcaggtaaagccgttattggcatctgcctgggttcccagctcattggtgaggcgctcggtgcttcttttgcacacagcccggaaaaagaggtcggcaagtttcctgtctctctgacgcaggcagggcaacagcatgagctgttttcacatttcggacacacgcttgaggtcggtcactggcataacgatatgcctgggctgacgcctgatgccacggtcatcgcccacagtgaagggtgcccgcgtcagatcgtcgcctacagcgatctggtgttcggtttccagtgccacatggagctgacaccggaagtagtcgaactgcttattgcccactccgaaaaggatctgggccgggcgggtgaataccgctttgtccatacgcctgcacaactgcgtgcacatgattaccgggagatgaaccaggctctgttcacattcctggacaaactggccgggcgttacaaccagagccgtcaatgatcgtcttttgcgcagattatccagctcaaaagaggcaattctgaaactaacagtgcaggtaacactatgactgaatcgccagccgcccttctgacgatagccggcgctatcctggtaggcgccatgagtcccggaccaagcttcatcatgatagtacgtactgccgtcgtctcatctcgcctcagtgcgctctccgccgccgcaggcatgggcgtgggatgcatgattttctcagttattgcgctggccgggctgcactctctgctggagctggttccctggctgtatgccgtgcttaaaaccgccggtggggtttaccttctctggcttggctgtggcatgcttttcagaacgggcgacagcctggatctgagcctgggaggcgaaaacgcacaccgtccgggccgcgcgtttattaccggtatggcgactcagctcagtaatccgaatacagcaattgtatttggcagtatttttgctgcgctgctcagtcagcatatctcgccctatctttatcttttgttgcccggtatggcgttcttcattgatgcagcctggtatggcctggtggcatggctgttatcggctgaaaagccacgtctcacctatatgaaatacaaatcccggctggataaagcgagtgggctggtgatggggtatctggggatccggctccttctgagatgatctttgtcagtgttgacctctccctctgttcttaagttaactgtgagcaaaattactttgaaagcccttttacgcaatgtcagttttatcgctgggttcatgctggcatgttacctccccgctgcagttgctgctggcacggtggcgtgttcatcttcacaaaaactgtctgaatgcattaagcaggtcgccggtggcggcacggtactgctcggtaaaggtacctggtttcaggccagcagcctgttgctgagcagcaatgtggcacttcaaggcacggggccgggtacggttatcacctggagtcctgcggtgaggagcaccattaatgcgccgcttctctataccactgccgccagccacgtcacgataaaggatgtgaaactggtcggcaccattgaccaacggtctgacagtcaggatttgaggaataatcagattggtctcttttttaactgcagcggagacccgaccgccggtgaaaaaaccggctgtaatgatattactcttcagaacgttgaggtggagaaacagcagcgatgggatccatatcaaaggcgccagccatgtcacggcgacggatctgaagttgcataacaatggcaacactgagaaggactattttcacaatatctaccttcgccgcgtcgcagatgttcgtctaatccagaccggaaaaaacagcggaggttattatgccagcccacgcgggcacggcattcgtggttcgcacctgatcaacgtttatatgagcgatctggaggtgcatgacaatgccgattacggtatccatatggacaccgtctttaatgtcagactgcataacatgcacgtttatcacaattgcctcagcggtaagcctgactgccagcagataaaatgctttggcccccagtgtgatgttcatctcaatgcactggctgaaccagcgtccataatatcccaataaattttgtccgcttttggcacagcgctgctgttgcagccctgacaagttagacttcaatcgactctgatatctccagggcatcatctacttcgatgcccaggtaacgtactgtgctttcgagttttttgtgacccaaaagtaactggatcacacgaagatttttcgttttttaaggatcagatatggcttggttctgcgcatggaatgcgtactgtagagcgtttcatcaagacccagcttctcaatccatccatgaaaaatacgattatattgtctggttgaaatgtgtcttgatgaactaatacgggactgagaaagatagtcgctactgcgtagatgagccattttgatccatgcggctacaacctctctggttcccttcgtcagttcaaactggacagggctgaccgttttttgctgcatcacagtcgctctgcccgaaacagtgtgtccataggccacatcagaaaatttcaacttaaccagatcacagccccgaagtttactgttcagagccatgttaaacagagccaaatcgcggacttttccttcccgctcaagacggatacgaatcccccagatatgaaagatctgaagaggccgtttctggccgataatgcggcttttgttccagggggatgttgtcatgttcaatctccattgggttaggagatgtgattatgagtgtcccgtatgagcgaggagcggacatgacatccaaaggatggtttgaataattgttgtcccatcacccgttttaggctgatgctttccttaacaggatgctttaagttggtcacatttatcctgcaggatataaccatgataacagtagaaaaatcagatccattttcttcagagtcccgtcgcttagtcgaagctctatcagcagaacttgccgctattactggtgataacggcaaaagcaatttcaccgtcgaagcaatgagtgatgacaatgctttatgggcattagcaaagaattctcaaggcaaagctgtgggatgtggtgctatacggccattaaccaaaaatatagccgagattaaaaggatgttttcagaccgaagtgcgtcagggattggcggtgctttactcacttttcttgaaaaatctgcaaaagagatgggatatatcgaaattaggctggaaacccgacacatcaactatcgtgcagtaaatttctacatgaaaaatggttatgtccctatcgagaattacggcccatatataggcagggcagaagctgtctgtttctcaaaggcattgcgctgattatattaattggaactgatgtccgctcctggcacaaagcagccgttcttgcagcgacttatttaaacaacacggggaacagtttattccccgtgtctggcaggaatatacccgccgcgcattcatcatgattactgttgcttgctgttacccagcactttgttaatcgcttcggtcccacattgatcgtcggattccgcgccgccggtgcccgccatgccgatagcgccgatccactggccgcgatattgcaccggcacgccgccgccaagcagcaatagctcattaaccgtattcaggttgacgctttccggtgaggattgcgcctttatggtcagttgtctggttggcgttttggtggagagcgcagtaaacgctttacgccatgccgcctgagtgttgtgcggccccacgttgtcatcccgcatcagcgtgaccagatttccaccccgatctaccacggcgactacgccttgacgattcatattatggcaggcggacaaggcctccgttgccagttgattactcagcgcctgcgtcatgtcatagacggaggctggctcagcagcgagcgccacggcaggtccggtagtcagcatcaatgccagcagtaaacgtttcatttatttcagctcccgcgataggtggaatatccgtactggctcagcagcaacggaatgtgataggtggtcgtggtattggtgatatggaactccaccgggatttcggggaagaaactctgctgttgatgtgccgcaaaatagtgaccggttttaaaaatcacccgatagtctcccgcctcaaagggctttgctggccaaagggcatctatccgaccctgctggttagtattggcggtattcagtactttccagctttctccctgtttctgctcaagcatcacctcaacctctgaggccggcagcccggtctgctggttcagcacatgaacgctcagcggatttttactggccgcgaaggtgaccgcgggaaacggcaagcagcgtagtgagggccagggcagtgagactctttttcattttttaatactccggtgttaatcaccccgctgttatacctgtacggttgttcgttctgcctgtcagaaagatgaccatattgtcatctgtcgctgaaacactggggcggtcataaatttcatggcaaactgcgccgatgaaactattactgattgaagataaccagaaggcgagcgcctgggtgcgtaaggggctggaagaagcgggctatatcgtggattacgccgcagacggccgggatggcctgcatctggggctgtcacatccctatagcctggtgatactggatattatgctgccggggatggatgggtggcaggtgctgaaaaccctgcgtaccgccagtcagattccggtgatttgcctgactgccagagactcggtggatgatcgggtgaaagggctggaactgggggccaatgattacctggttaagccgttctcttttgcggagttgctggctcgggtaagaaatcagctccggcagcagcagccgcacagtagcgtactacgggtgggcgatctggtgctggactcagcgcgctttcaggttctgcgtgacggtgtcactcttgcactgacgcgcaaagagttcatgctgttatggctgctcgccagccgtcacggtgagattctgccgcggacgctgctggccagcgaaatatggggcgttaatttcgacagtgaaaccaatatcgtcgatgttgctatccgccgcctgcgccgtaaagtcgacgatccttttcctcaaaagctcatcactacggtaaggggcatgggatattgcctgtcagaaaaaggaggcgagggtgactagcccttctctgacgctgcggctgacggcaatttttacgctgatcatggcgatggcctgtggcggcatcagcctgattctgtataaagcgttacgcagtgaactggtctggcgggacgatcaaacgctgattaatcgggcggcgcagttaagacaactgcttgaagatggtgcccatcccagctcgctgccgctctacttcaatcggatggtcgatatccatcaggacattctcagcatccgctcgcagcatgagcaaaacgtcagtattaatcataccgggataacgttgcccgcgatctcgcccacgccggtcagtacgccacccagtgagaaacagctgcaccgctggatcaatgcggacaagacggaagcgtcggcgttaagcctgcaggcaaactcctcgctcgggccggtaaccattacgcttgcccgggtcgcgcgggagcgagcactgatgctggagcgttatcgccagcaaagcattctggtttcactggcggccatattgctgtgcgccgcagtcagtccgctgttgattcgcagagggctaagggcgatcggccggttaagtaagatcgtggcagaaacggccagtgaccggttaaatcagcccgtgccgcttcaggctatcccgcaggagctgctaccgattggcaatgcgcttaacactatgcgtcagcgcttatccacggactttatccgtctgacccagtttgccgacgatctggcccacgaaatccgcacgcccattaatgtgttactgggccagaatcaggtcgcgctgggtcatgaacgctcagccgctgaatatcagacgctgctcgaaggcaacattgaagagctggagagtctgtcgcgtctcactgaaaacattctcttcctggctcgcgccacgcaccacaatatcagactcaataaacaggacttcctgctgcaggacgcgctggaatcgctgatcgactttcttgaaccggttgcggaagagcaggagaaggccattgagctgagcgccgcaggcagcctcaccgcagataaaatgctgttccagcgtgcgatgagtaatctgttgatcaacgccattcgttattcgccagaaaaaggcacgattcaggtcagtacctgtcatcacgctgactacgttgagattgaggtgttgaacgcgggcgaagcgctggaggagcctgaaaaattatttgaacgcttctggcggggcgataacgtccgtcatacggccggaagcgggctgggactgtcgctggtacgcgccatcgccgctttacatggcggaagtgcttactaccggcatgagaaacgggcacaatatctttggcctgcgcctgccccgaaagtgagtgtctgtacgaaaaacctcatccgtgcagctttaatgaaagcagagggggatggaagcgatctgcggaagtcataaagtcagacgcagccacccccttgcctgttgcacgttacctaaccggcacggtggtcaggtagcgtcaattgtcagaatatccctcgtcactttctccgggaaattcaggcaccactgagcatactggtgacatcctgcgggccccaggttcgctggagtctgcatcggcacatgacggtgaagtgtttaaaggctggccccttcaaccagcacaaacgtcccgtgcgcagcccctgcacgcaacagcctggcagcctgatacgcagggctttcataaaaacctttggcttcggcaaaagattcgaactcaaataccacatgccgttcatgcgcctctccctccagattttcatactgccctgaccaggcaacgatcttcggattaaacgcctgcatggcttcgcctgcagctctggcatagtcagcgtatgcgacagggtccgatacggtcacgtgagcgattaaataacctttgttcatttctcttttccttcctgacaggggggtgaaatccagcgtaaggcagcgcgactggcgttaaccaaatccggaatgggggctaagttttcaaatcttccttcgggtcaacggattgagtggtgagtaacaaccttttcactgagtgcttcccgataccctgagcaatgtttgccgcgaaccgacagtgctctgaatgatgcggggatctgaaccagtgcttatgtacacaaacctgcatggcagttcgcaacggcgttgagcctttcagaaagacggttcaccttcataacgttcagatcgcgttctgtaatatccgcggtgtgaaagcagtctattacccattaatatggtgataaataacgtaagaaataacgcactgttactctgaaggggaacaatgaatgaaaaaccttgaggcgctgattatttttgcacgcgtggcggaaatgaagagttttactcaggcagctgaaagcctgggtattcagaaaggacgcgcctcactagtggtgcgcgaaactcgaaagggagacaggcgcgacacttctgcatcgcaccacgcgaacagtgcagttaacggaagatggacgggctttttactcacgcgcccgcgatctgttatcggaagccgaagaattacagtccatgttctctcacgaggggatgtcactgcggggccggatacgcgttgatatgcctgccgtgctggcacaatgcgtggtaatccccgcgctgccgcagttgctggaggcacaccctgaactggagatcgagctttcaagtaccgatcggcgcgttgatttagttcatgaaggatttgattgtgtcatccgtctggggccaatcgttgatgacacgcttattgctcgcccgctggggcagctgcgcatgatcaatgcagccagtccgggctatctggcgcgcttcggggtaccgcagacgattgatgaccttctcagtcagggccaccagatggttcattaccagcggagctttggttcgaagccagatggctgggagtatccggcggatgacggctatcaattgctgatgttacccggcgccataagggtcaacagcgtaccggcctatcatgaggcgggactggccgggctgggcttgatccagggcggttactcaacactggcgccctatattgagcgcggtgcgctggttgaagtccttcccaatctgcgtcctgagccgcttagtgcctcttttgttgtcgcacaccgacgaaatctgtcgcggcgtgtcagagcctttatgcactggaccgaagaaattttaaaaccttattttgactgatagcacagtgattcttacgccagataaaagtacaacaacagggtatgtggcaaaccaaaccagaagtacaaatttaatcaccgctatgctaatatttccgcgcttattaaggcgtcctgccatgcgtagaatttttgggaacgcagtatgatcgataaatatcaaattcatcatgacgtcgatgtgctgcttttcatacgccacatctgcaaactcgtttatacgggacttattttgctgctgcttattcctcatattgccagtgccgaaataaaagatggcaaagccaatgatatcgtcagtggtattatcagcttcacccagtggacgggcttaaaacaaccgcctcaattatgtattttttcttcagcccggcatctctccttgccggacaatgcctcctctgcggcagccacattcaccgttgtttatcttgccagcgcaggcgacctgccgtcgcacagatgcgacgccgtctatttcggcgatcagacgtcacaacagcaggtggacctgattcagcagtttaagggcagagccgtccttaccctcgcggagaacaatgcggattgcacgcggggcgccgcgttttgcctgatttttcatccgggccacacgcttttttccgttaaccttgattcgcttgccagaagcggtgtcagggtgagtccggacgtgcttttgctgtcccgcgagagaagcgaataaaatgaaatttgataaattaagaaatgacaaatcatcgatacgcaataaactgcgaaaaataagcaccatcaacgctgcggtgatattactgttgtgctggctgttgctctcttcgacgtcgctgctattcattaaaaattacgagaagcgaaaccttgaattaatcggcgcaaccctcagcaccacgctaaccgctgcgaccgttttttccgacagttacgatgcgcacaataaaattgcacggctcggcaatgaagggatgtacgcgtctgcgaaactggtcactaaagatcaaattgttctggtcaactggcatgctcagcaggagcagacgggctggtattcgcggttattacgtgagtggatttatcttaaaccgcttaacgtcagtatcattcactctgacgttgctgtcggtacattaacgctggaaggcaccgtgaccggcgcggtgagtttcattcgatactccttcatgattctgaccagcggtatgctatgtgtactgattatctcccttttgctgagtgaatttctgcatcggggtatgctcgctacactgcgcaacattaccagtttcgattcactatgtgattcattccggtgatttttccttgcgtataccggagagcacgacgagtgagtttcagctattttcagatgatctcaattcgttgctgagggaaatgcaatcgctaaaggcttcgcttatccgagataatcgctcgctggcagccaaagcgctggaggacccgttaaccggtcttgcaaaccgcagcgcctttgctgctcacctttcccggcttctcgaccagcaatatgctgaggagcgttttgccttactctttcttgatggcgatcgctttaaaagtatcaatgataactggggccatgccgccggggatgaggtattaaaagcgatagcagcacgcctgctatcactggcatctgaacaggatttagtcgcccgtttaggtggggatgaatttgccatgctggtgagcagtcaggtcagtgaggagcaattacagcaactcatgcaggacatccatgacctcatcatggaaaaaatcatccttgcagaaggtacgccgataaatacctcggttaccattggctacgcctggtcacaacacggcgatacggttgagtctattctcgaacgcgctgacatgaatatgtataaaaataagcgaacaaataaggcttaaagatgaaaaaaaatatttccctgatgctgcttattttggcgctggtcggttgtcagtctaaagaacgttttactgaggcgcagatcgcagcgatgaagcgtgcgggattcacccaaaatatggaaggctggggattaggcttatcagataagatcctgtttggtgtaaacgaatcagaacttacaccctccagcaaaagtaacattcaggggatggcaaaaaacctggcgtcgaccggtattaagcatgtgcgaattgacgggcacaccgataattacggcaaaccagattataaccaacagctgtcgctaaaaagagctaacgcagtcgcggcacagtggtcggaaggggctgctataccgcgtgaaaatattatcacacgtggattaggtatgagtgcaccggttaccagcaacaatagcgcgcagggacgcgcgcaaaatcgacgtgtggcaattgtgattactgcgccgtgataatgagtagtgctgcacgctcaggccggtatgactcaatatcctgcctggcggctttatccggttaccgatgatgcgtgaagagccgctggaaaagatgaaacggagggggaaatgcacggcggaaacccgccgtgcagtgttgctatcagcgataaaatgccggtcttgctggcatactgaccggcacaacttcaccggaagtctgggccgcgacgcaggcatcagcggccaccgcggcggcgtagccatcccaggctgagggaccggtcatctcaccgctgatgacgttgttgataaatgcctgtaactccacgtcatacgcatcgataaagcgctttttccagtcagtcagaatggtggtggagagcttagccgcgctgcgaagctgcacagagaccggctccggcagacgagcaatgccgctttcacccaccacttcacactgaatgtcgtaaccatattcacagttcacgaagatttcgacatcaatgcgtgcccctttggtggtctcaagcagcacgatttgcggatcgcgcagatgtgacgacgccttacgggttttacgcgggaagatcacctgcacgctggcatagtcatcatccagcagccagcgcagcacatcgagttcgtggatcagcgtgtcggtgatcgccatgtcggtggtgtagctgtcgcccacttccgggttgcggtgtgcgcagtgcagcatcaaaggctcgccaatttcgccgctgtcgatcaccgcttttagtgcgcgatagccgctgtcataagggcgcataaacccgacctgcaccagctgacgtcctgccttaatttctgcttccacaatgttcatgcagccctgcgcggtgaccgccagcggtttttcgcagaacaccgctttacccgcctcaatgcaggccagcacgaaggcttcatgcgtcgggccccaggaggtgaccagcaccgcattgacctgcggatcgttaatcagatcgatagcattgtcataaatacgcgcttccggcgtcagctcgttaacgatttgctggcagttttcacggttgatatcgttaagcgccaccacgcgcgcattttgtaacacggtgctgcaacggcggatgtgttcgcgaccgattgcgccggtgccgatgacgccaatattaatagtcatgataattccttaagctgagtggtttaacagctggatgctgtcgcgaatttcgcgggcaatgtccgcttcctgccagctgttcatcactgaggagaacggctcaaaggcgtaaaggccggtgtaacccattttctccagtcgctcgacctgctgcttgctgcgcaagcggtcgtccgcgctgagcatgatgcgttcttcgtcggttagctgattaaccgggcgcgggtcggtgacgccggaaaggtgaaccagaccgatctgctgaatatcgatctcctgttcgaaagtctgttccgcatcttcaaacagatgatgatggaaggtatcgatcagcaatctgaatggcacacccgcttcatggatcagcgtctgagcctgagttgctgaacgcagcgagctttgcgggaagcccagcggttccaccagcccctgaatacctgcctcagcgaacagcggggccagggttttcagcgcgcttacggtgtcggcagcgctgatcggcgtgccgtcattaagcgggcagagcaccagcgattcagcgccgaccgcctgcgcatcacttaacagctggcgggtgcgttgcagcacctcttcattcagctgattaaagggatagagcgcattaatggtgacaatccggatgcctgactcacgcgccagagcttttacctcgtcgccgctgagatcgtcggtgacgcggccgctgggcatatcattacgcagttcgacattatggataccgagctggctgaccagtttaaagaactgcggaagggtgaggctgggcgcaattttacggttgatgcaaaagcgcgcgttgggaatattcaggctcataataatttccttgaatgtagggggtacagtgttaatagcaatcgggtagtcagcgtaatgacgcgggccgtgagttattcaatacggacgtttcaggcactattttttgccgttgccgttataaagcgcatagaaatagtgctcgacctgctcaagacttcttccccgggtctcgggaataaacttcacaacaaaaacagaaccgccgatgccgatagccgcgaatataaagaaggctccggccagaccaaatgcggctaataacagcgggaaggccatggagatggcgaagttagcaatccacagtgagaagacagcgccacccatacagatgccacgcatccgggcggggaagatttccgacagcagcagccaggtaacgggtgacaatgcgccctgctggaagcagagaaacatcagcatccccgccagcaccagataagcccgcagcaggttgaccgtgccgttgaggtattccggcatcagccagcagaccagcccgataaagaacaggcagcaggtgcagcccatctgtccgattaacaccagcggacggcgtcccactttgccgattagccagatacccgccagcgtcatcaccacggagatcacgccatttgcgatggtggcgaacagcgcggcatcgttgctcagtccggcggcggtcagcatggtgggggcgtaatacataatggtattcaccccggtcagctgctggatggcggcaatacccacgcccagcaggaagattttcatcagccagggtgtggcgagatcgcgcaggcggcctttgccacgctgacggttctcttcaatggtttcctcaatctcttccagctcccactcgacatcttcggcggcacgggttttttccaggacctcgcgcgctgcctgactgcggcctttcattacgtgccagcgcggggtttcaggcataaaaatcatgccgatccagagcagaacagcggggacaatcgacagcgccagcatccagcgccaggtattttcgccgccccagatatcgttaaaggtggcgttggagatgtacgccagcagctgaccgctgacgatcatcagctcctgcatggtgaccagctggccacgtttattggcgggggcgatttctgcgatgtagaccggcacggtcgcggcagcaccccccacggcaaagcccaggaaacaggcgagaagcgatcatccaggtgacatcaggcgccagcgccgagccgacagcgccaaaagcgaagataagcgccagcgcaatgataatgcgtcgtctgccgaggccatccgccagatgaccggctgccagcgcgccgaaggctgcaccaaacagcagggagctggtgaccagcccggtagtaaatggggtgagatgcagatcgccgcgcataaacagtaatgcgcctgagactacaccggtgtcataaccaaacagcaatccacccagggtggcgaccagcgcaataatcttcacaaaaggctcggtgcgggtggtgctatttggaccggatgccgggttcgacgagatataaagttctttttccatgaatactcctggtaataacggcaaagacaaaacgtcagaacatgaagaagacatcaccctactgatatttttatttcgggttaaattatatttgaaacttagttttcattatgtgagctcaacccttccgccatttttattttgatgggattccatcaaggcgaaaataaaaacattaaatttaagcgggttataggggagattgataagttactggcggttcaggcagggcagaacaaggggaaatcagcgtgtagaaagattaaatgatcgcagtcaggatgaaacatcccaaccgcgataaacagatagcagggcgggttagcggatttccagcgcggtgagcgccgataacagtgcatcgaccttaggcaggaactgtttacggcgtggccacaccacgctcagcgtcagcccctcgggctgcaactgcggcaaaattatctccagatcgccctgtttcacggcatgctgaatcagccacgagggcatttgtgccacacccagcccggcgatgacagcctgcagctgggcatcgacgtcgcccagtgccagccggtacggcacctcgcgccagtgcggctgaccatcttcggtggtgaacagccagggtttggtgctgccatctacacgctcataaaggatggcgcggtggttcagcagcgccgcctcatcttcaggtcgtccttcacgtgccagataagcgggtgaggcacagaactgcatctgctcgcggcccatattacgccagccaagcgaagcaggcaggtcgggcgcgccgccgatccgtaccgccacatccacgccctcttcaaacaggtcaacaaagcggtcagagaaactcaggctcagagccagttccgggtgttgctgacaaaagggcatcagcagcggcatcacattgaggcggccataggtggtgggcactgccaggcgcaggcgaccggaaggaatcgttcgctgtgccgccagcaccgcttcggcttcggccagatcctccagaatgcgcaggcaggtctggtaataggcgctgcccgcgtcggtgaggtgcaggctccgtgtggtgcgctccagcagtcgcgagcctaatcgtgtctccaggcggctgacgcttttactgatcgccgatccggtcacgtgcagacgctccgcagcggcggtaaaactgccacactctacgctggcaacaaacggcagaatatctttgaggcgatgatcgtgcatcgattaatgaactcaggttgagaatgctgtgaataaatgccagagataagaactgaattctctattaggcttagcattacgcaaaatgaggagaaatcaaatgaaaaagcatgctttgattgtgggcatcagtggcgttattggtcgcgcactggcagataaattacagaaggaaggctggcaggtcagcggtctgtcacgcggacgtggcgcggtacctgaaggtgtcaccagcctgacggccgatctgaccgatgcggatgccgtccgggacgcgctgaaaacagtgaaaccggatgcgctgttctttagcgtctgggcgcgtcaggaaaatgaaaaagagaatatccgcgttaacggcggcatggtgcgaaatgtgattgaagcactcggcgaccgcttacagggttcgcacgtggcgctggtaaccggactgaagcactaccttggtccgtttgaagcttacggcaaaggcgctgtgccagtcacgccgtttccgtgaagagcagggccgtcagccggtcgataacttctactacgcgcaggaagatgaagtgttcgctggtgcagagaagtatgactaccgctggagtgtgcatcgcccgcacaccatcatcggttatgccgtgggcaatgcgatgaatatgggtcagacgctggcggtctacgcgacgctgtgtaaagagaagggctggccgtttatcttccctggctcacccgagcagtggaacggtgtggctgatatgaccgatgcaggtctgctggctgagcagttgcactgggcggcgacctcacccaatgccgctaaacaggatttcaatgcggtaaacggtgatgtgttccgctggaactggatgtggccaaaactggctgactatttcggcattgaagcagcggaatacccggcgcagatgatgccgctggaagatcgcatgcaggaagccgccagtgcgtggcaggcgattgcagagcagcatcagttgcgtgaatcggatatcaccagactggcttcctggtggcataccgatgccgacctgggacgtccgatggaagcctttaccgatatgagtaagagccgcaaagcgggcttcaccggttatcgcagcacgctcgactcctttattcagctgtttgataagctgaaagcggaaaaagtgatcccgcaataacccagcaggcgccgcatcaggcgcctgttttgtttctgactgatagctatactctggcactcaatcagtaaatggaggattggatcctatggcgacatgtttcatcatcggcgcagcgggcaaagtgggccaaaagctgacccgtcagctgagcagtaaaggccatacagtgacggcgctgcaccgcaaaccggagcaggcagagacgctgcaggccgctggtgctgaaccagtggctggcgatattcagcagctgagcgtgacggcactggcagatctgatgaccggtcacgatgtggctgtcttcacggcgggtgcgggcggtgccgggatcgagctgaccaatgccattgacggagaagggctgaagctggcggttgccgcagcagaacaggcgggggtatcacgctttatgctggtttccgctttcccggatgcgggccgcggtaaaactccctcagagggatttgagaattacatgcgggtgaagcgtctggcggatgcggagctggtggcgagtaagctggagtgggtgatcctgcgaccgggtacgctgaccgatgaaggcggtaccggtcgggttcatgccgatctggcgattccgtatggtgagatcccgcgcgaagatgtggcggcgacactggtcggcctgattgaaaatccggcaattaagtatcagatcatcgaactcaccaaaggtgatgtgcagattgatgtggcgttgcagcggttgcagcggggctaagaaaggctcgttatcacagccaatacgcctgaatgcgtaacaaataaaagccccggagtcggggctttttgatttgttaacgcaggattttactaacgcatgtgctacttaacgcatttcgcgcagtgcgcgcgctcaatgtgctggaagaaatcgttacctttgtcatcgaccaggataaaggcagggaaattctccacctcgattttccagatcgcttccattcccagctcgggatactccacgcattccagacttttaatgctctgctgcgccagcaccgctgccggtccaccaatgctgccgagatagaagccgccatgtttatgacaggcatccgtcacctgctgactgcgattgcccttggctagcatgatcttacttccgccgtgcgcctgcagcagatccacgtaagaatccatacgaccggcagtggttgggccgagtgaaccagaagcataaccttcaggcgtcttcgccgggccagcgtaatagaccggatgatctttgatgtactgcggtaatccttcgccgttatcgatgcgctctttgagttttgcatgtgcaatatcgcgcgccacgataatagtgccggtcagtgacaggcgggttgaaaccggataagcggacagttgcgccagaatctcttccattgggcggttgagatcaacctgcaacgcttcaccttcgccctgctgacgcagtgcttccgggatcaggcggcctgggttggcttccagtttctcaatccagataccttcacggttaatcttcgctttgatgttacggtcagccgagcaggagacgcccatgccgatcgggcaggaggcgccgtgacgtggaagacgcaccacgcggatatcgtgtgcaaaatatttgccgccaaattgcgcacccagaccgagctgctgcgccgcttccagcagtttcctgctccagctgaacgtcgcggaacgcctgaccgtgctcgttgccttcagtgggcagcccgtcgtaatagtgagttgaggcgagcttcacggttttcagtgtgctttctgccgaggtgccgccgatgacaaacgcaatatggtagggcggacaggctgcggtgccgagggtacgcatcttatccaccaggtaatttttcagcttgcccggactcagcagcgctttggtttcctgatagagataggttttattggcggaaccgccacctttggcgatacagaggaacttgtactcatcgccatccacgctgtagaggtcgatctgcgctggcaggttagtgccggtattcacctctttatacatatccagagcggcattctgcgaatagcgcaggttatcttcgatataggtgttgtagataccctgtgacagcgcagcttcatcaccgccgccggtccagacgcgctggccctttttgcccatgatgatcgcggtgccggtatcctgacaggttggcagcacgcctttggcggcaatttcagagtttcttaaaaactgcagggcgacatatttatcattgtcgctggcttccgggtcatcaaggatggaggcgacctgctgctggtgggccggacgcagcataaaagaggcgtcatggaacgcctgctggctgagtaacgtcagcgcctgcggatcgactttaaggatctcctgaccctcaaactcggagacggagacatgctcacgactcagcagatagtattcggtatcttcgtgggacagcgggaaagggttctgatagacaaaaggcttgttcgacattttttctcacttaatgaccggctgaacctccgcggacaggctgcggggcgcaacatcataggcgaattaattgtttattatgcttccccaccgcgggtgcggtggggaagtgcaggaatggtatcttataacgcgttgatctgcatgttgtatccgtcagaacaaccacaccatccacggataggcaatcagcatcatggagcctaagaagatggcaccgaagatggttcccagacgccagtagtctttggtaggcagataaccgctgccgtagtaaatcgggcttgggccggtgccgtatggcgtgatgatgcccatcacacccagagaggtacacaacatcaggcagaagaccggcatattgatacccggaatggaggctgcaatggtcagcatggccggtaacagcgcggtggtgtgtgcggtggtactggcaaacaggtagtgcagcaggaagaaggcgattaacagcaccacggccgaaacctgcgggtcataaccctgcagcagcatgccaccctctttacctaaccaggtaataaagccgacgcgggccagaccatcggccagtgccaccagggtggcgaaccaggcaaaggtattccaggccggtttattactggtgatgtcattccaggtcagtacgccggtccacaacatcagtactaccaccagcagcgcagccatggcaggttcgatccacgaggtggcgaaaatccacatcagcagggcgcagaccacaaacaccagcagcaggatttcattgcgggtcagtctgcccagtttttccagttcagcgatggcccatttcggcacttcatcattgattttaacttcaggtgggtagaaccagtaagccagcagcggcatggtcagaatcagcagcacacccagcggcaggaaggccaggaaccacatgccccatgagatatcaaaaccgacgatgctttttaccagtgccagtgccagcaggttgggtgccagcgcagagagaaacatggaactggtaatacaggccgcggtaatcgctacccacatcagataggaaccgattttacgggcactcgggtcgttaggtttagagccgtaaagcggcggcaggttggcgataatcgggtagatggtaccgccactgcgcgcggtgtttgacggcgtgaagggcgcaagaagcaggtcagcaaaggtaatagcataacccagtgtcagactgcggcgacccagatacttcaccagaatcagggccaggcggcgaccaaactgcgttttgtcataacccgcggcgaacataaaggcaccgaagatcagccagaccgtggagttgccgaacccgctgaccgcccatttgaacgactcactggcgactttgaatttcgggttagtcagttcagccgggctgaagagcagaaactggctgaacagcgcgatgactaccacgccggtcaggccgatcaccgcgcctggcaggggttcaaagatcaatccgacaatcacgccgacgaagatggcgaagaagtgccaggcgtagggttcgagtccggctggtgtgggcaccaacaacagcagcacggcaacgagcaccggcagagcaagcatgatagctttctttttacccggcgccgcaggtgcgacttttgggggttcagttacagctgagagtggtttcatagtattttatctgcaagttaagaagaatgcgatttgcgccccggaccttcactgatgactttctttcttattcttaatagtgtgaataaaccgcgatgcactgatttttaatcgactgcttagctattgagctgcatttttaaatccatgtaaatatgatgcgatttttgcaaatatagattttgatccagatcaaagaaattaattcattattccccatttttaacatttattttttatttatatttacggcatcgacattttgacggttctgtgaagctggtcgacaaatcaccagctcacgcaaactgaatgccttgctttaactgcatgatgataaacgatttattttttatgtaaacgaatggttgatttttggttacccatggttaacaattaatataacttcactttatgcattcggcaaataaaaactccaaatcatttaaaagttaaaaaagtaaatttatcgcttatgaaagcaaagaaaagggtatattagtctcatgacatcggaccacttaattaagcgataatttgcgtccgctaaaaaatttccagacttttaaatcttggagtttatcgcaatgaaatctctcacccccatccttaatccattgactctgcctaacggcgctgtgttgaaaaaccgactggtaatggcaccgatgaccacctgtaccggcttttatgacggtacggtcaccagtgagctggtcgagtactatcgcgcacgtgcaggcagcatcggaaccgtgatcgttgaatgctgctttattgacaaccgtggcccggcatttccgggtgccattgctattgacagcgacaacaaaatccctggtctgaaacgcatagcggacgcgattaaatctgaaggctctacggccattttgcagatctatcacggcggccgtatggtggagccggagctgattggcggcaaaacgccggttgcgccaagcgccatcgcggcgccgcgtgaaggggcaaccaaacccctggcgctgagcgccgaagaagttgaaaccatgatcaccaaatttggtgatgcggtgaaccgcgctatcaaggccggtttcgatggcgtcgaaattcatggtgctaacacctacctgattcagcagttctattcgccgaactctaaccagcgcgatgacaagtggggcggcagccgcgataaccgcgcacgcttcccgctggaagtgctggaaatcacccacaagatggctgagcgcttcgcccataactctttcatcatcggctatcgcttctcgccggaagagatcgaagtgcccggcattcgctttgacgacacgctctatctgctggaaaaactggccgcgcgcggactcgattacgtccacttttcggtaggtcagctgctgcgtccgtcaattgttgatacccaggatccgacgccgctgattgagaagtttcgtcgcgatgcgttcgcctgtgctggcaaaagtgccggtgattggtgttggcggcgtcgtcaataaagccgatgctgagctggcgctggagaaaggctacgatctggtggcgattggtaaagcctgcatcgcttacccgaactgggctgaccgcatcattaataacgaacacctcgatctctacatcgacagcaacaaacgtgaagagctgcagatcccggaaccgctgtggcgcttctccctggtcgatgcgatgatccgcgacatgagtgaatcgggccgtaaatacaaagcgggcgtctatcaggaaaaagtcgaagccgaagcgctgaaactgaaaatcaacgtcacgctggatactgaccgtatcaccgacatctcgctggtgccggatgacaccctggatgtggacttcaccaccacctttgaaagcctgcgtagccgcatcctggtggctaacagcccacacgtcgatgcgattaccggtgcgactacccagagtgaggcgctgaaaaaagcggtttcacgcgcgctgaccacctccagcaaagagcatgtgattgaagagggcggcaaccctaacgcaccgcagaattacgatgtggtgattgtgggcagcggcggcgccggccttgcggcggcgattcaggcgcacgatgaaggggcgcgcgtggtcatcatcgagaagatgccgaccattggcggtaacaccattaaagcctcagtgggcatgaacgccgctgaaacccgtttccagaaactcaaaggcatcgaagacagcaaagagctgttctacgaggagacgctgaaaggcggtcagtttaaaaataatccggtgctgctacgtgagtttgtagagctggcgccggaggctatcgagtggctggcgaatcacggcattgagcttaacgacatcaccattaccggcgggatgagcatcgatcgtacccaccgtccggcggatcgttcagcggtgggtggcttcctgatcagcggtctggttaaaaacatcaacagccgcaacatcgaagtcctgcttgaaacctcagtctcagaaatcctctatgagaacggcgcggtagcgggtgtgagagtggtcgatgagtacaacgacagccgtatcctgaacgcgaaaagcgtgattgtggcgaccggcggattcagtgcgaaccgtgaactggtagtgaaatatcgccctgaactcgatggctttgtcaccacaaaccacaaaggtgccaccggcagcggtattgccatgctggaaaaaattggtgccggtaccgtggatatgggcgaaatacagattcacccaacggttgaacagaccacctcttatctggtctccgaatccattcgtggcggcggtgctatcctggtcagtcaggcgggtgagcgcttctacaacgaaatggaaacccgcgataaagtctcggcgcagattatcgccttgccagagaagagtgcctggattgtgtttgacgagcaggtgcggatgaataacaaagcggctgacgaatatatcgccaaaggctttgtggtcagcgcgccaaccgtggcagaaactggcggtgaaactcaacatgagtgagcatcatacgctggaagccacgctggcccgttacaacaacttcgttatcatgcagaaagatgaagacttcggtcgtcagaccgcgctgcgtcatcctctgagtgaagcaccgttctacgcgattcgtgttgcaccgggcgtacaccacaccatgggcggcgtcaccatcgacaccaccactgcggtgctggacagccagaaacaggtgattaacggcgcctgggcctgtggcgaggtcgttggtggcatccacggtgctaaccgtatcggcggtaacgcagtcgccgatatcattatcttcggcattctggccggtggtaacgccgccgcttacgcccgacgttaagggtcgtctccggcatccgcgctctgcggatgccgttcttttctctttaaagcagagtcgcctatgttaactgatgcgcgtgtctatgcttactccgctgtcttaatgggttcacccatcctgctcaaactcttcgacgataatcagaccctggccggacaggtcttccgcctgattaaacagcaggagaatctcttcacggttaaccgcgcggcgtctgaggtgatggcgattaatcacgcggcagggcagcatccggtggtcgtgagtcagccggtgtttgacctgatcgcctgcgcgcatgcggtgagcctgctgcccgacagcctgtttaatctggctattggcccgctggtgaagtgctggaaaatcggctttcagggccaccgtgttccatcagagacagaacttcaggcgcgcatagcgctgacgaatccgcatgacgttattcttgatgacgcaagccgcagtgtcatgctggcgcgacctgggatggagattgacctgggcgccatcgccaaaggctatatcgccgatgtcgtgcaggcttttttgcgccagcagcaggtcagcagtgcgctgattaatctgggcggaaatgtgcagacggtgggtgcgccgccagaagaggcgtgctgggcaatcggcctgaaaaaaccctttggtgaggccgatgagctgatcggggtgatcggcgttaataatcgctcggtggtgacatccggtatctatgagcgttatttcgagctggatggcgtctgttatcaccatatcctcgacccgcgtagcggttatccgctggataacgacctgctgagcgtcaccgtgatctctgaccgttcactggatggtgacatctacaccacgctgctttacggcctcggcgttgaacagggcattgcctgcctggcggagcaaccgggcattgaagcgatatttgtgacccgtgacaggcaggtgatctgctcgtcacaacgtcacttttcttttcagttactggacaccgattatcggctggttcactgacaatattgtttgagtaaagtgtgatactccggctgcaggcgatagcgataaaccggacggcccgtgaccccataatgaatgctggtgaacaggatattaatctgcgccagccagatcagatacttgcggcaggagacgcgggagatattcacctcggttgccagttcgtcggtggagaactcggtacccgggtgggcgtcgatccacagacacagggtgcgcagggtctgcggtgttaatcctttcggcagtcgcttctgctcgctggcccccggcggattgccatgcaacaactgatcaacgtccgactgctgatagaactgatgattatccatcagcgattttttctgtcgccagccagtcagcgcctcttcaaagcgggcaaactggaaaggcttgatcagataatccaccacaccgtagttgagtgaggttttgatggtggcggcatctgctgctgacgagataataatcacgtcaaccggacgtcctgcgctgcgcagttccggcaacaggtcgagaccgttctcctgctgcatatagatatccagcaggatcagatcaacctgaggttcggcctgcgccagccgctctttggcctgctgtaaggttgaggcggtgccgcagcaggtaaagcctgggatctgcccgatataacagcgattcagctcggctaccatggcgtcatcatcgacaactaacacattgatcattgggtaatcattcctctctcccacggaagttgcactaagaattgggtgaatacacccggttccgactcgacactgacactgccgcccaggctttcggtctgctgcttcaccagaaacaatccgacaccgcgatcttcgccttttgacgagacgccacgctcaaaaatggcactgagctgcgtaccgtcgatcccgggtccgtcatcactcacttcacaggctaaccagccattctgataatgcagcatgaggtggatttccccttcggtttccggatccagcgcctcaagcgcattttcaattaaattgcccagcaccgtaatcagtaccgcgctctgctcctcgctgccgcagtcgggcagaaaactcgcctcatcaataatcagctgatggccttcatcggtcacccggttgattttgctgagcaggaaacccgcaatgatgggcgatttgatcttttgcagcagcgaaccaatctccgtctgataggcgttggcggttttgaggatgtactcttccatctgcgcatagtttttcatatgcagcaggcccagaatgacatgcagcttattcatgaactcatgggaccgttcacgtaacgcgtctacatagtttaccatgccgtccagacgctgcatcagctggctgatctcggtcttgtccctgaaggtggtcaccgcgccgataatgcggtcacgactgcgaaccggcacggtattgctgatcaggatgcgattacccagcgtcagctcctgatcgtgccaggctttgcctgcatgcagcgcatcctgctgatggcggtgcattacgctctcttcagcaatcagatcgccgcttaatggcatcttgcgggtggtctcatgcagtagctgctgtgccgcgtggttaatcaggctgacgcgtgactcatcatcgaccgcaatcacaccctctttaatagaattgaggatcgcctgacgctgctcgaacaggctggagatttcatgcggctccagcccgagcaatatgctcttcaggcgtctgaccagaataagaatccccagcagacccaccaggccgccaaataagacagtccagacgatgttccagcggcttttggcaatctgcgccgccacatcatttagtgcgatgccgatcgccaccacgccaatctgctgatgctctgcgttatagaccggggtaaatacccgcagtgcctctaccagcacgccgtgatttaccgccacattttcccgcccgctgagggccggatagatatcgttgccgacaaaatgtttgccaatcaccgccgcgtttcgggtgtgaaaagcgaatgccacgcatatccgtcaccaccacaaacagcaggccgttgcgtttgcgcgcagcttcagccagtggctgaatctggctgctgccgtccggtaacagtaacccacgctggacttcagggctgtctgccagagtgcgtgccactgccatcgccttatctttaagatgcgactgagcaaagttatcgatctgcacaaaatagagcagatggacagcgagcagcacggtgacgataaccgcggtcatcatcagggtggtcagggtactgagtttcatgggtcgtttagtcacggcatgtcggttctgtggttggcttgtcattggcgttcagcacgggtgggagatcgcccggaaacatacgctaactgaccgcatcagtacagttttagcggtctgcgcgcgggcaatcgccggagaacaatatttgtgttaggggattgtataattcaaaggacacccttaatgtgtggttaaaatatgtgagcaattcggtaagccttttgtaattaaattaaggctaaattgctatttttaattttataactattttcacattaactcacaaataacattattttaaactttaaggactttttttaaccagtaccgtctgagctgtagattaaaatgatgaattcaaagaaagttatccccactctttccctcgcggccttgttagtttcttcagcactgcatgctgaaacttcaccagagaaaaccgacgtcctgttaattggtggcggcatcatgagcgcctcaatgggcaccatgcttgaagagctgcagcctggctggaaacagatcatggttgagaagctggatggtgtggcactggaatcctctaacggctggaacaacgccggtaccggtcactctgccaatatggagctgaactatacgcctgagcgtaaagacggctcaatcgacgtgacgaaagcgctggaaatcaacgaagccttcatggtttcacgccagtttctggagttcgcaggtcaaagagggtgtgatgcacgatccgcgctctttcatcaactcaacgccacacatgagcttcgtctggggcgacaacgtcgacttcctgactaaacgctatgcggcgttacagaaaaccgcgctgttccagggcatgaagttctctaccgatcacaagcagatcgagcagtgggcaccgctggtgatggaaggtcgtgatccccagcagaaagtggccgcaacctggacgccagttggcaccgacgtaaactacggtgaaattacccgtcagctaatcggcagcctgaagaagaatgacaacttccgtctggaaacctcgtctgaagtcaccgatttcaaacgtaacggcgataactcgtggcacgtcaccattaaagatgccaaaaacggcaatgagcgtgcggttgacgcgaaatatgtctttattggtgctggcggcggcgcgctgaaattactgcagaaaaccggcatcccggaagcggaaaactatgcaggcttcccggtcggcggttcattcctggtaaccgaaaacaaggcgattgccgatcgtcacctggcgaaagtctacggtcaggcgtctaccggtgcaccaccgatgtccgttccgcatctggatacccgttatctggatggcaaacgcgtcgtgctgtttggaccgtttgcgaccttctcaaccaagttcctgaaaaatggttcactgtttgacctgctgagcaccaccactactcataacatcgtgccaatgaccgatgtgggtatggataacttcgacctggtgaaatacctggttggccaggtgatgctgacagaagaagatcgcttcgaagcactgaaagagtactacccggacgcgaagaaagaggactggaaactgattcaggccggtcagcgcgtacagatcatcaagaaagatgctgacaaaggtggcgtgctgaaactgggtacagaaattgtgaccgatcagcagaaaaccgtggcggcactgctgggtgcttctcctggtgcatcgaccgctgcgcctatcgcgttaagcgtgatgcagaaactgttcccggaagagtttaagtcagcggaatggcaggccaaaatccacaagatgatcccaggctacggtcagaaactgaatgacaacgtgccgatgctccagcaggtatggaatgacaccgctgcgactctgcagctgaccacaccgccggttatcaacatggatggcaaagcagccgaggcgccagcagcacagcctgagcaggcagcgccttcagcgaagcacgacatggcgctgtaacagcgacctgacgtaaaaaaagcccgcacaggttatcctgcgcgggcttttttattgccgcgttgtctgcccgttactccggctggttaccgcgccagttgccccagggatcttctgcgggtgcttgatccgcctcttcagacggtgcttcgcgggaggccggtttctcttttaacgaggcgagataaagcgcttcgacttcagcccgcgcccagggcgtgcgccgcaaaaacttcaggcttgatttaacactcggatcgcttttaaagcagttaatgttgatccgttttcccagctccgcccagccatactgcgcgactaaactgtttatctgcatctccagcgttacgccatgcagaggatcttttgaggtttgtgcgttcatcatctatccgcctgattcattcaatgccgcacatcctgacaatcgtaaagccgttgtgcaaggcgtgaaggtgaaaaagggcgtgccgtggcgcgttaagcgcagatttctgtgtctgagttaacgtgacaggcagaagagtgcgcaggcgtgcggcgattgtgctaatcataagcgactgatgatgctcaaaaaggatctcctgccatgtctgtgcccgtcgataatctgctcagctccgccagccgtaaacgtgctctgatagccggttcggtaggtaatttcattgaatggtatgagtttgccgtctatggctttcttgccaccgtgatagcgcagaactttttccggctggaaggggagtcagtgctgaccgggcttctgctgacctatgcgtcattcgccatcgcctttttcttccgtccactcggtgcaatcattttcggccggatgggtgatcgcatcgggcgcaaacccacgctgatatttgtgttgatcatgatgacgctggcgacggcggctatcggcctggtgcccacctacgcccatctgggcatcctggcgccgctgatcgtgaccggtctgcgtattctgcagggcctgttcgcggggggtgagtatggcggggcggtatcgctgatgaccgagtttgcaccgcgcggtaagcggggcctttatggggcgtggcaatcttttactgtggcgctgggattactggctggcgcgggcatcgtagcgctgctctcactgctgctgtcgccggagcagatgctgagctggggctggcgcatcccgtttcttcattgctctgccgctgggtgttatcgcgctctggctgcgggttcagatggaggagaccccggcgtttattcagcagcaggcaaaatccgttgcaaaagttgacgccagccttggcgatacgctgaaaacgatcctgctcggtatctgtcggctgatggtctggtcggcggccggttacacctggctggtgattatgccgacgtacctgcaggcatcgctgcacaccggttttaaccaggcgttgctgattgcggtgatatcgaacctgggctttgctgccaccatcatcccggccgggatgctgagtgacaggattggccgccgtgcggtgatggtgacagcggcggtattgctgctggtgctctctctgccgctgcttaacatacttcaggcagagagcaccgggctgctgctgaaagcgctggtggtgtttatcgcgggcggagtggtcgggttgctggccggaccgggacctgcgatgctggcagagatgttcccgacgcgggtgcgttataccggactgggtctggcctattcgctttctaacgcggtgttttcaggctgtgccggattgatcatcaccgggttgattaaacagaccggtaatcccgatatccccgcctggtatgtgatggcgactgcgctggtcagtattgttgcgttgatgtccctgaacaaagatgatcatctgcggctactggatgagccaccgtcgcgctaagtgtcggcaagcaagctgagcgggaaatacaggctgctgaagtggcatgcagccttctttggcaggtctgccgggaagggcaacaaaccagcctgcttatcagaaatgcaactgtaatatcaccggcgtaacgtgccgctctgttcaggccgatgtaacagggttttatcccgtaagcgattcagccggatcaaagtttctggtcttcacgcttcatcaacaccgtcaacaggtctgaagacaaagaggatgctggagagaaggattcagacaaggtcattcactttgcgatgatggcaaactgaaaacctgatcgcggcaattaactttatgagcatggttgtcggcaataatgatgacagcagccataatcataccgagaagaatgataactattttacgcaggagcataagcgttaattcctgtgaaattaaactattcttatctgtaatatgttattcactgttatcagtgacttaacataagttttgattaattatggctgaaataaaatctttatttattgatcgcgatacggttttccagactctgctgaaataaaggcgtcatgcaaattcagaaataaacgaaatctaaatgagggaataaaatctgttaatttatcttgtatctgtttgactgaaaagggttgaacctgtatggcttcaggctgtgaagaggataagctgaataacggcccacaactgaacactgcgggcagcacgcgggacccggtcgggactcatccgacaaccggatcccgctggtggcggtcacatcactaactttaaacagattacagactgagaacggtgtcgtcagatttctgtttctccggctgagtgataaaatcttgtgccagatcggcgacgatggctgcaacggttcgcaccgatttgatcatcgagatgccagtgcctgtcgaaacaacgcctttgtcaagattgcccagtcgcatcgcctgccataaagagtggtagccattcattgcagtgaacagggtttcacggtcagcgccctgcgcatcaagtttctgccagcctggggctgagcggcgtgggcaatgtacggtaataagcgggcagggtgcggaaaagtagcaaatcttctgcgctcgatgaaacaatcagctgcttaaccttctcatccgccgggttctcctgcgcggttaaaaacaggctgcctatccagacgccttctgcacctaacgccatggctgcacgcacgccacgcacatccccaatgccgcctgccgccagcaccggaattttcacactgtcagcgatcataggcacgatgctgaacgttccgataatgcgtgatggcacggtgccgccttcatcaaatccggtggcgacaatgatatcggcgccaagcttttcagcctgctgagaattcgctacgtcaggcgtcagcgcacgataaaggattttgatgcgatgttgtttcagaaaatcgaatatttcggcatcaagcacttcattaactaaaacgacctctaccttctcttcaacaaacatttcagcggtgggccgccagaaactcatatccggcccattgatcagggttgccccaaaaggtttatcggtcagctgtttggtttttctgatttgctcacgcatgcgctccagcgccatgaaacgagagtctggcaatgtatcctgcccggcgttggggccaattatgcctaatccgcctgcgtttgatactgcggcaacaaacgttgcattggtcagaaagtacatgggtgcctgaataatgggatagcgaatattcagaatttctgtcacacggtttttcatagtttttccttatccggatactgtgtagccagacttattcgttagaaataagaattttttacgggccgttttatttttattctcttagccaaaacagggagtttaatagttgaaaataagaagtaaacggtcagaattgggtacgtgtttgccagatatggaaagataatggatctcaacgcgacaaaactctttattgcagtcgttcaggcaggcagcttttcagcggcaagtgagagaacggctatccccatctctacgctggtgcggaaagtgaacgagctggagcgggcactgggtgtgcagttactggagcgatcaaagaaaggggtcaggccgacctgcaaaggacaacagttctttgagcaatcgcgacctggcctggaattgctggaagaggccaccaaaacggtcaggtctgcgcacaaactggcgggcaaactgcgaatatcggtgccgcctgacttcactatctggtgggagttactgcatgcgtttcagcaacgctatcctgatatcaaagtgttttgccactcaggggaaagagtggtggatctgtttgaagatggcattgacgtggcactcaggctgggcgagttgcataccgaggatgtaattgcgaaaccggttatgaatgtcgaggcatggtttgttgccacgcctgaactggctgaacgctttggacatccgcagacgctggcggcgctggcgacgtatccgatagccagctgggaagggcttaacagtggttcctttgagtgggtatccggagacgagaaggtaaagtttgagccgtttttttcctctaacaacacgcagggcctgcgccactatgcactgagcggtgccggggtatcgctgttgtttgattttttagttaaacctgatgtggagagtggaaagctgatgcgactgctgcccgattatccgactcactcgatgcctttacatctggtttatgtccggcacaaacatccttcagccatcacactcgcgtatctggatttttgtgctgaatgggtaagtcaatacaagatcggctaggggctacacaaaaggggcagaggcggaggtgtccggcaaaccagcgcacaggcgctttggcctcaccgatgaatgaaagggataaacacagaaaaagaaaaggcgccctgaggcgcctctgatagtgaccctgacgccactatttacaccagctgctgtgccgtggtttccaccaatgtcagcaacactttgatatcttccagcgtcactgtcggattcagcagggtcatcttcaggcaggtcacgccatcgaaactcggttacaccaacgttggcgcggcccgattccagcagggcatcaccgatacgctgattcagcaacgcaatatccgcactgctgaagtgcgccagatgcgccggacgatagcggaacagcacgctggccagctgcggtttcatcaccagctccagcgcaggctgctcatcaacgtactgtgcaacctgctgtgccagcgtcacaccgtgatcgatgatttcggcatactgtttctgacccagcgcttccagacccatccacagtttcagtgcatcaaaacggcgggtagtctgaagggatttggacaccagattcggtacgccctgcgcttcatcaaactcagagttcagataggccgcctggtagcgcatcagctcatagtggcgtgcttccttcagcaggaaagcaccacagctgatggtctggaagaactgcttatggaagtccagggtaatggaatcgaccagctcaatgccatccagatagtcacgatacttttctgagagcagcagcgcgccgccccaggccgcatcgacgtgcacccagatgttctcttcggccgccagcgccgcgatttcacgcaggggatcgatcgcaccggcatcggtagtacccgccgtggcaacaattgccagaatgttttcgccgttggctttggaggctgccagtttgtggcgcaggtcatccatatccatgcgggcaaagcgatcgcatttcacctgcgtcacggattgatagcccagacccagcagcgccatgttcttctgaaccgagaagtgcgcattctctgaacagaagactttaatcttcttcagatcgccggttaaaccatcctgctgaacagaatgaccctggcgggcaaaccaagcatcacgcgccagcatcagacccatcaggttgctctgggtgccgccgctggtgaagacacccgcgtcgccggactgataaccgacctgggaacgcagccactcaatcagcttcatctcaatcagagtggctgaaggtgcctggtcccacgaatccatactctggttggtggcgttaatcagcacttccgccgcctggctgataaccaggctcgggcagtgcagatgcgccacacactgcgggtgatgaaccgacaggctgtctttaaggaagtactcaatggcgcgttcaatcgcggcctggttgcccaggccctgaggattgaagtccagcttaatgcgctcgcgcagctctgcgacggtttttccctgatacatctcaggttgttccagccacttcacgacggccgcgctactctgggcaatcgcctgctggtaggcctcggtactctgtgctgaggccgccagaatcgggtttaaccgggacattgcattcactccactcaaactggtttcacgccagctgacagcagggcgttttcaaatttatccataaacacgtccagtttctgcatctgtgatcagcagggaaggcagcagacgtaatacgctgccgtgacgtccgccacgctccagaatcaggccgttctcaaaacattttttctgtaccagcgcggagagctcgccgtctgccgggaagctgcccatgtgatcaacggcttcgtcaggtttcaccagctcaatgccgatcatcaggcccagaccacgcacgttgccgattaccgggtagcgctgctgcagctcgcccagcttgcctttcagccattcgccctgtgcagcaactttgtcagcgatgttgttatctttcagcagtttcagcgtagtcaggccggtcgccattgcgagctggttgccacggaaggtgccggtgtggtggccaggagaccaggcgtcgaactctttcttaatgcccagtaccgccagtggcagaccgccgccgaccgcttttgacatcacgatgatgtccggctcaataccggcgtgctcaaaggcgaagaatttaccggtacgggcaatgcccgcctgcacttcgtcgatgatcagcagaatgccatgctctttggtcactttacggatgcgctgcagccactcagccggagccgggttaacaccgccttcgccctgaaccgcttccagaatgacggctgccggtttgcgaacgccgctctcaacgtcgttgatcaggttttcgaagtagtaggtcagcgctttcacgcccgcttcaccgccaatgcccagcgggcagcggtagaggtgcggataaggcatgaactgcacttccggcatcaagccgtcgacggcttctttcggtgacaggttgccggtaaccgacagcgcgccgtgggtcatgccgtgatacgcaccagagaagctgatgatgccggaacgaccggtgtgttttttcgccagtttcagcgccgcttcaacggcatccgcgcccgacgggccggtaaactgcaggcagtactctttgccctgacccggtaataacgagagcaggtactcagaaaacgcatcttttaacggcgtggttaaatcaagagtatgtaacggcaagccgctggtaatgacattttgaatgctctgcagaacgtctggatggttatgacccaatgccagcgttccggcacctgcaagacagtcgagatactgattattctcgacgtctgtgatccagacaccctgtgctttcgcaatcgcgaacggcaatttgcgaggataacttcgaacgtttgattcaaattcagcctgacgggctaaataggtttcattggttgcgtttaagttctgtgcattcaaactatcaatacggactttatccgtcatcatatctctcctacaaccgggacgggcgtagcgtcgcagttgaataaatgtatttaaatgggggtatgtgttttaagcgcggccaatataggtgtttttaaggtccgactcaatgtttaattttatcggcagataacagattctttgctataggaatcaatcatttggtgagtttgtgaacgtatacattattgccgcttcgctagtcctttgttaataagtggcgtaaaaacaccagcttacccggcgcggggcgtgctaagtcaatgataataatctgtgtaaatagctgtttccggggcaaaacgctatcaaaaaggagccttttcagatggaaaaagcataagtcagtttgactgaagaagctgcatttatagcgggttaaaagcgcagactaattaaaataataaaccttttattaacatttaattaaaatctggcgttgttaaggcctttataacgcgtcagatccacgttatgacaggatatgatcaataaactgcgttaagtcagccatcccttcgcttgcctttttctccgacggattaatagtcagtaaatcggcatagccgttaagcatcgcacagatttgccgggcggtgcgtggaatatcggcacaacgcagcgttccatctgtgacgccgtcacgaattatttcttccaccagcgcctgccacgctgccgtcatctgttctgccagcgcggcataggcttcgtgatgcgcagccatctgccagaatgaagcataaagttgccaggttgcatccggtgcgctcggcagatgactttcgaacagcgtcagcaacctctggcggggtgtgagtagagtcagggagtcagcaaaattttctaaatccacgtgcataaagcgttcaagcgctgccaggcagagcgtctgccagttgctgaaatagtgataaatatgactgcgtgaaatgcccaccgactcagtgagttcccgagtggtcactttttcgatccctttctcgataaataacactatcgcggcatccaggattttggttctcagtgcttcagctgactctttcatctctctctcaatgagtgttacgttgactttgagcaactgctcaaatagactgcttttcgttcttgagcaaccgctcaagactcatgatatcagaaacagaaactatgcattcctcaaaaacgatcctgccggtagcaaaaccccgcagcgctattctgacattaaaaatgctcggccgtcgccatagccgcaagctgttcctcacgctgctgctggtggtggcggaaaatgttatgtatctcctctatccgctgctggcgggcttcgctattaatgcgattctctccggcaggacctggcatgcggtgctctatgcggtgatggtgtttaccatgtgggccatcggagcggcacgacgcagcgtcgatacccgcacctttgcccgtatttacgccgggctggccgtgccggtgattgtggcacagcgtaacgaaaaccagagcgcttccaccattgccgcgcgggtggccttgtcacgcgagtttgtcgacttttttgagaaacatctgccggtgctgattacctcgctggcctctatgaccggcgccgcggtgatgctgctggctatcgagttctggaccggcgcgggctgtctggcgatcctgctgttcttcgcctgtttcctgccgggatttacccgcaaaaacgatgtgctgtttggtcgtctgaataaccggctggagaaagaggtgagctttgtcagcaacgctaacgctgcgtcactggaccgtcattatggcgtgctggccagcctgcggatccgtctctccgatcgggaagcctggggttatctggccatcggtagcgtggcagcgctgctatttgctgtcaccattgcggtaatgtcgaaccgtggcgggaccaatgcgggtcacatctattcggtgatgacctatatgtggatgtttgccatgagcctggatgatggcccacagctgctggaaaaatattcccagctgaaagacataggtcgccgggtaaataccggcacgcactgatttggccgattcaggcgctgccttcttttgggcgttgtctcagttgagggctgaagcagccgccggagggaccggcggcaacggaggtgaagaataacgagccgactcgggaccgaaagcgatcacggctcaggggaggggctaataatccagctcacctggcgcaaatgctctgaatgcgttatcagatggcgtatagcccagcacttctcgcgtctgtgtcagatcaaagcgcttaaagcggttatcggaaatgccgtagccaataaagaaggtgatcttctctgcctcgacagcgccagtcagcaatctgacggcatcttccggactcagccatgcgctgtaatcccgtgcattatgcaggctgttatccagtgcaggttcaaacgccccgattcttaatgccacacagctcaagccgtgctggctggcatagaaggcgcaaagtgcttcaccataacatttggtgacgccatacagattcgcgggagagacagccatgccaggatgtatctggacatccgccgggtagccctcaatggtctgcgcactgctggcaaagaccagacgacgacagcggtgctcagctgctgccttgagtatccaggtcgtagagagaatattggcgggcagcagatcgtcgaaactggcctgcgcatccgggataccggcgaggtggatgacggtatcgacaggctcttcagccagtaatttctccgccgcaccaggttgtgacagatccgccacaataaaacgatggggtgcgggtatcgtgtaatccggctcacgtaaatcggtcaggataaaacggtagttgttctggctggccgcaaagaaagtgcgcccgattcgcccgctggcaccggtaagaaggataactctggtcgtcatctgctgattcctgttatgcaaaagaagcgctgagaggtcagttaaacagagattcacgactcaggcctgcgtagctttccggattgtgatcttaaacaggtcgctatgcgccagagtggcacggataaagacctatgttaccgcagccttcactgtgcgccagatcacataaatgggttgctaagcgcagcctgactttttatagtctgcccgcttaaaccggacgggaacacgctctgctttatctctccgcctcacttcagttttttcagttctggccattgggaatcaattttgttaagaaaaaatcataaaaccgacgatgccggttttgtccgctgggcattactggccctcgcgctgggcggctttggcatcggtaccggtgagttcatcatgatgggcctgctgccagatgtttcacgctcccttgcgattaccgagccgcaggcgggcaacgccatcgccagttacgcactgggcgtggtggtcggtgcgccgtttattgcggtgctggcggcgcgaatggcacgtaaatcgctgctgctgatcctgatggcgctgttcagtatcggtaatgttgccagcgcgatggccgacagctatcacggcctgctcgtggcgcgttttctgaccgggctgcctcatggcgcctactttggtgtggcgtcgctggtggccgcttcgctggtgccgattgaacgtcgtggccgcgcgctggcgtcactgatgctgggactgacggtagcgaccctgattggtgtaccgctgggctcctggatagggcagttatttagctggcacgtggtgttcacctttgtgggcgcaattggactgctgacctgcctgctgattggccgctatgttccttacacgcctggcgatgtggatgcgcatccgctgcgggaaactgggcgcgctgaaaaacgcgcaggtgctgctgaccctgctggtgggggcggtaggatttggcgggatgttcgctatcttcagttatatcgcgccgacactgattaacattgctggcatctccccctcgctgatcccctgggcgatggtggcgtttgggctgggaatgatcatcggtaatctggtggggggccgtctggctgatggcccggtgctgaatattattggctggacgctgttatggaacgtgctggtgatgctggccttcccggtgctggttcagcatgtggcaactggcctgctggccacattcctgatcggcacctgctcagtgctgctgccgtcattgcagattcgcctgatggatgtcgccaatgagtcgcaaaccctggcggctgcgatgaatcactcggcgttgaacattgccaatgcgatgggcgcgtatcttgggggcctgacggtgtcgctgggctatggctggatctccaccgcgtgggtgggtgttgcgctgggcgtggccggtctgatggtctttgtgctcacggcgcgacatgctgcccgtcagcagactcaactggcctgagttctataaagcagggcgcagcgataatgtttatcgctgcgctttattagtacagggccgccgtattatttttcagcaataattaaccgcattattatttactctctgaccgttcagcgaaaattatcattctgtcagccctgatatttcaaaatgctcggaaaatcaacaagggcgctccggacgtctggatgttaaaagtaaattaaaataatgtttgctaatgtcggtgaggcgtggcttaatagcgtcatcggtttggaacacagaccttatcaaagcagttttagtaaagcagtcctcagtgcaagcgatatcacaagatacccttattcatgagtctcctcctaaaagcctggtaagttaccttctgaaagacaggccatcttcgccacttagtggctcataaattaaggaattatcgatgtctaataaaatgactggtttagtaaaatggtttgacgctggtaaaggtttcggttttatctctcctcaggatggcagcaaagatgtattcgtacatttctctgcaattcagagcaacgattataaaactctggacgaaggtcagcaggtcgaattcactattgaaaacggcgctaaaggtccttcagcggcaaacgttgtccctatgtaagccttaattatcaatagtgcttatcaacgcgtgatggcaacagcctcagcagataagcctgatattgataattaattaaaacccgccttgtgcgggttttttgcgtttatggtttgccagatgcttacgcgatgttttttgcccgcgccagatatccgcgcgggccagtaaaaaaatgttcagcgcacgctggcgaccagccattgctgcaattctgtcagctccgcgcgttgctccggaaaatccgcaataagctgattcagcaccggttcaagggcatcgggccgataggtcacaccctgcaaccgctgcgccagcgcttccagcggcgcagggttgaggctgtcgctgaaaatctgacagcggctgatcacgccgcgttctacatcgaaatgaatctccacaccaccccagacaaaacgctggtccagcagatgcgagaaatcgggtgcctgaccgaaattccactcccagctactctgctttgcgaactgctctctgaaacccggcagatcgggcagggcgtcgggagagatcctctctggctcacagcgctcaccgtaatagttgaaaaatgcgtccgtcaccgcggagcagatcgcctgatagctgatacccggcgttaactccgccagattggtcactctggcgcgcactgaggtaatccccttcgcctgcaatttcttcacatccggattaaggtaatccgccaggcgggagaggtcggcatccatcagaatagtgccgtgatggaaaccgcgatccggcgtttcacggtaggctgaaccggatattttgcgcagcccgtcagcggtgttcaccactaagtcattacggccagaggcctccgcgggtacgccaagtgaagtcagtgcgcgcaggatgatctcagtcgagacgcttttatcatactctggcttgccggccataaaggtaaaacagcaattgccgagatcgtgaaataccgcgccaccgccgctgctgcgacgcgccagccggatgccatcttcggccatgcgtcgggtgttgcactctttccacggattctgtgcccgccctatcaccaccgtctccgcattacgccacaaaaacagcacccgctgggtggacggcatctggcggaaaatgcactcttctaccgccaggttaaaccagggatcgttggattcagataacagtaaacgcagcgtggacatcggtgactcccgttccttaagagaagaggcccataaagcagggcagaaggcagagtgtaccagccgggaaacgggactacatgcctcttcatgccgtgatgctgcggcaaaaaaagataaaatgccgtctgcaaggtaatcgcggcagattggtgtacgacattatgacaatatggatgaggagtgtgctgattcctctgcttattttccctttgagagaacaaaaatcgtatgaacgcttccgctggcatagcgatgaagatcaccgctgcattaagtagcacgctgatgctggcctgtgtaaaagaactcgatggggcgataccggtcggcgaagtgatattttttcgctcgctgctggcactggtaccgctgttaatctggctgcgtttgcagggtagcgtgctggatggcattcgcacccgcaatatccgcgggcattttgtgcgcggtctggccggaaccggtggtctctatttcagctatctgtcgctgctctacatttctctgaccgacgccacggctatcaactatgccgcgccgctgtttaccgtgctgctggcggcgctatttctgcgcgaaaaagtgcgtcaccatcgctgggtcgcggtctttaccggtttcagtggcattctggtgatgttctccgggcatctcacactgacgcgccaggcaacattttccctttctgcatcggcgggtattctgctggcgttgatggcggccttctgtacggcctgtgcgctggtgcagatccgctttcttaacggcaaagagaagccgggcgccatcgctttctggttcgctatcaccacggccttaacgtcgctggtcacgctgccaggcggctgggaagtgccgcatggcaatcagctggcgttactggtgggatgtgggctgctgggcggtattactcagattctgatgactctgagcctgcgctatgctgaagcgtcgttgctggccccgttcgactacaccaccttaatctggtcagtggcggtgggttatctgctgctcggcaatctgccaacctccactacggtgatgggtgcgattctggtggtggcaggcggcctttactcggtgctgtatgagcgttaccgcttccgtaaagcgcggatagttaatgccagtcgctgatcggcccgcccggcatcgccttattatttccagagtgataacgcagagttaataatttgtgatcgcggcgaaggaacagtcggctgcattcgtttacgttgtgagcaatcagaatgtaatcgattacttattcgtgaggttcccatgattgcaacagtgcaggagagagcaggccagcagatgcagcataagctgctggtgccgcgcctctctctgatgatgtttatgcagttctttatctggggcagctggtcggtgacgctggggctggtaatgactcgtcacaacatgccgttgctgattggggatgcgttttcggccggacccatcgcctcgattctctcgccgtttgtgctcggcatgcttgtggatcgcttttttccctcacagaaagtgatggcggtgatgaacctggcgggcgcagcgattctctggttcgtgccccaggcgctaatcgcggagaacggggcgcagctgatcgcaatgttatttggctatacgctctgctttatgccgacgctggcgctctcaaataacatcgcctttcacagcctcgccagcagcgagaaaagctttcccattgtcagagttttcggcaccatcggctggatcgtggcggggatctttatcggcgtaaccggcattgctgacagcgtggcagtgttccagctggcggcgctctgttcggtattgctggcgatctacagcctgacgctgccacatacgccggctccggccaaaggattgccgttaaaagttcgcgatctcttctgcgccgatgccttcgcactgctgcgactgcgtcatttcctggtcttcgctgtatgtgccaccctgatctctattccgctcggcacctactacgcttttaccgcctcctggctggcggatgccggtatccgggaagtcagcaccctgatgtcactgggtcagatgtctgaaattgttttcatgctgatcattccactgctgttccgccgtcttggcgtgaaagtcatgctgctgattggcatgacagcgtggtttgtccgctatgcactgtttgcgctgggcatgagtgatgagacgcgcatgctgatttatctgggcattctgctgcatggcgtctgctatgacttcttctttgtggtgggattcatctacaccgatcggatcgccggtgaaaaggtcaaggggcaggcgcagagcatggtggtgatgttcacctacggtatcggcatgctgctgggatcgcaaatctccggtgcgctctacaatcagctggtggcgggtaacgccagcccagagagctgggcgatattctggtggatccctgccgtggcggctgcggtgattgcgattattttcttcttctcattcaaataccgtgattaagcggtaactgaactcaggagtcacagatgaaaacagttaagggacccggcatcttcctgtctcagttcattgccacccagccgccttttaactcactggcggggctggcggagtgggccgccgggctgggataccgggcactgcagatcccctgccaccagcccgctattttcgaccttgagcaggcagcggtcagccagacttactgcgacgaggtgcggggaacactggccggtttcggactggagatcagtgagctttcaacgcatctggaagggcaactggttgccgtgaaccccgcatacgatctcgcttttgataattttgcgcctgccgcgctgcgaggcgatcccgcccggcgtaccgactgggccatcgctacgctaaagcgtgcggctgctgcttctgaaaaactcggcctgcgcgcacatgccaccttttccggctcgctcgcctggccctggttctatccctggccgccacaccacgaagcgctgtttaatgaggcgtttgctgagctggcgcgccgctggctgccggtgctggatagttttgaccatcacggtgtggacctctgctatgagatacatcccggcgaagacctgcatgacggtgtcacgtttgagcgctttttgtcagaggtgaatcaccacccgcgctgcaatatcctgttcgatcccagccatcttcttctgcaacacatcgactatctgcagttcatcgacctctatcatccgcgtatcaaagcctttcacgttaaggatgcggagtaccagttaaatggacgcagcggagtgtatggcggttatcagccgtggctggcgcgcgccggacgctttcgctcgccgggcgatggccagatcgacttcagccgcattttcagcaaactggcccagtacgactatgacggctgggcggtgctggagtgggagtgctgtctgaaggatggcgagaccggggcgcgtgaaggggcagaatttatccgccggcatatcatcccggtggctgaccgcgcttttgatgattttgctttagcagagaaaacgccccttcggtgcgccatcagctgggtctggatcgcgacgtctgaggcggcatggattcaaaggttttctgtgggtgagttaaaaacagagggatcgctatgtctattcagaaaatcgcccggatggcgggtgtttcggtcgccaccgtttcccgtgtgttgaacaacagcgacagcgtaaaaccggctaaccggcagaaagtccttgaggcaatcgaagagagcaactatcagcctaacctgctggcgcgccagctgcgcacggcgcgcagctcaatgattctggttctggtttccgatatctctaacccgttctgcgcagaggtggtcaaaggcattgaggaggaggcggagaaaaatggctatcgcatcctgttgtgtaactcgggcgccgatattgcccgttcgcgatccagcctgcaactgctctccggcaagatggtggatggcattatcaccatggatgcattcagcaagctgccggagctgagccagctgataggcagggcaccctgggttcagtgcgccgaacatgatgataatggccagatctcctgcgtcgggattgatgatgacgtcgctgcgcagtcagtggtgcactatctggccggacagggacgtcagcgcattgcgctgatcaatcacgacctccgctaccgatatgcccgcctgcgtcagaagggctacgcacatcaactcaaagagcaacaactggcatggcaggccatcgcttacgccagtgagttaagcttcagcgccggaaaagccgcgatgaatcagctgctggcgggcgagacacgaccggacgccgtgtttgcggtttccgatacgctggcagcgggtgccatggcggcgatacagcaggcgggtctgcggatacctcaggacattgccgtggtgggttttgacggcagcgaactggccgacatggtatcgccgccgctgacgactctggctcagccctccagggagattggccgtcgtgcctgtgagctggtgctgcaaaaaatcatccggccagactctccgccacaatgtgtgatcatgcagggagagctggtgatgcgagcaagtagctgaaggattaatccgcaaaacctggccccgctataacctcgtctttattgtctactaaaacgcgacagtcattgccagttcacgccattgtgtgactacctggtttacttatatgctgtttccatcgaagggcattcgcacttcccgaatcaacgaaggggcagaatatgattgagcaaagattgtcagagcaacgcggcgtgggcgatcacggctggctgaattcacgtcacaccttctcttttgcaaactactgggatccaaagcaggcgggcttttcagatctgctggtgatcaatgatgatcgggtagccaaaggtcgcggttttggcgcccatcctcacagcaacatggagattatctcctatgtcctggagggcgcgctggagcataaagactccatgggcaccggctctgtgattgttcccggggatgtgcagctgatgagtgccggtagcggtgtaactcacagtgagttcaaccactcgggcaccgagggtgttcactttctgcaaatctgggtggtgccggcagagaaaaatagtccgccaggctaccagcaggtctccgtcagcgaagcggataaacgcggtaatctgcgactgattatttcgcctgaaggtgaaaacggggcattgcgggtgcgccaggatattcgcatctatgcgggactgttccagggggatgagcagcagacaatcactctgccggacgaccgctatgcgtatattcatgtggcgcgcggcagtgtcagggtaaatggcctgcaatttaatgccggagacggtgcgcgggttcgcaatgagaaaacgctgtcgttcagtcacggtgaaggagcggaggtgttgttattcgatctgcgtcccaacgaagtgaatcatccaacccgttaaaatgaaaactgcgcggctttcaccgcgcagttttttttgcatcactgtgcgttaagaaacgccagcagatcctgattcagttgatcctgatgcgtcaccgcaaaaccgtgcggcgcattgtcataaaccttgagttcagcaccctcaatcatctccgcggccactttgccggtggattcaaacggaacgatctggtcgttgctgccatgaatcaccagcgtcggtacattcactttcgctacatcagcacggaaatcggtctcagcaaaagcggtgacgcaatcaacggtgctcttcagcgaagcgagcagcgcgatgttcagcgtctgcgtcatgacgccatcagaaacggtctgtccggcattggtaccataaaacggcgtagcgaattctttgataaactgcgcgcgatccttaagcaggccatcacgaatcccttcaaacaccgacatatcgacaccctgcgggtagtctgccgttttgccaaagattggcgtgacggcacccagcagcaccagtgccgcgacgcgatcgctgccatagctgccgatatagcgtgtgacgtcgccgccacccattgagaaacccaccagcgtcacattctgcaggtcgagatgggtgattaaatcgttgatgtcagaagcaaaggtatcgtagttattaccggtccagggctgatcagaacgaccaaatccacgacggtcaaaggcgataacccgataaccgtgctccgccaggaagttcatctggctgtcccacatatcggcatccagcggccagccgtggctgaacagaaccggcttaccggtgccccagtctttaaagtagatctgtgtgccgtcggtcgttttaaaggtgctcatggtattgccctctgtatgacgtgatggatgaaaagatggtgtgccagtcacgctggcgccaccagatagcgaacctcgggtgaatgttcaccctgatgaaaagcgaaaacccgtcgctctatctttttgtcgttgatggtgtagcgctctttctgacgcagatgctcaacccaggagccgacgacaaaggtctcaacgaaaatgccgggctgcagaatatcttcatacagtgaccagttgatggcgccaccgcgacgcctgacccgacgcatatcctgcatgcagacggtaaaggcatgtgcatcatcaatagtaatacggtattcgtaattcaccatcaccgggccgcgtttcgtgacgaatatccagtgcgggcgcgttaacgccatcaccaatcatatcgagattgaggtcgggatcctggtcgagacgccagcgccagacggtgctgctggccagcaccatgcccagtgcggcgatgcagagcgacagcggaatgctgaagtgcgaggcgagctgtccccagagtgcgctgccagcggtcatggagccgaagaacaccgtcagatagaccgccagcgcgcgggcttttacccatttcgcggcgctgcgctgtgcgccgagattcagcgtcgagagcacggcaatccaggcaaatccggtaaaaaattcaaacgcattcagtagccagaagtggcgtacaaaagccagcgccagcatggtcagggcgaaaacaagactggcgagtaccatcaggcgatcggagctcaggcgacgacgcaggcgtggcaacagcaccgcgccggtaatcgcgccaacaccgatacaggccagcatgatgccgtagccgccagggcccaggccgagttcacgacgcgccaccagcggcagcaatgcccagcccgcactgccaaacaggaagaaggcaaaggttcgcaccagcacattacgcaacaccggtgccgcgtgaacgtagcgcagtccggcacgcaccgccggaaagaagtgctcaggcgggaggcgctgcacgctcggctccgccttccagcgccagagcacccaggtgacgcccagcactgagagcgcattgagcaggaagaccatccagggaccagtgaacgagaggatcaggccacccagcgccgggccgatggcacgactgatattaataccgagtgagttaagggcaatggccgcacccagctccggtttcgacaccagatccggcactaccgcctgaaagggcggtgaactcatggcggcaccggcgctcagcaagaaggctgccaccagcagcacctcgggagtgacatggccggtccaggcgagcaccgtcagtccacaggcggcgataaaggtccatagctgggaaaacagcagatatttgcggcggtcaacgatatccgccatcacgcctgatggcagcgcgaacaggaacatcggcaggctgctggccgcctgcaccagcgccacggccagcggatcggcactcagcgtcagcatgctccagttcacacccacatcgttcatccatgaaccgatattggagacgacggtggcgatccacagcatgcggaacaccggcctgcgtagcggctgtaacggcgaaatctcgccagcggcctggacctcaggctgctcctgctccagctggtggatatcattaacctgcgccatgacgaaccccctgatgtttcaccgcgccgattcgccagccgccaggcccggtcagcgccagcgtggtaaagataatcagcagcagccagccaaactggccttccgccagtgaccagccagggtgtaccaccagcatcgcgaccagcagcaccgcgatgatcggcaggcaggcaatccggctaccccagccgagaataataaagatcgggcagatgacttctgccactatcgctggcagcaggctcatcatcggtcccagaccaaacgggtcttctatacgcgtcagttcttcgctgaaatgcagaattttcggcagtccatgcacctgtaacagcagcagactgccggtcaggcgcaggaagaacagccccgcgttgatgcggggcgattgagtgatagcgttattcatgattaaaacgcgaagcagctgcagccgagcgcgccccagaaggcgttatcttcggcgaccggaacgctggaaccacgggcgatctcatgcgagtggcgatgaacaccgcaggggccgctgcagtgatgcacggcgggcatcatacccgcacggctctgcgcaaccggcggagcgctgcgatagtgacctggcacattcaccaccggcgaccactcaggcagaaccggaatagcgggcggcgcatccgcgctgaacgatccggcggcatagacaataatgccatccaccaccgtcagcactgactcaatgcctttaatttcctcttccggcacgctgaagaagtctttgctcagcacagccagatccgccagaagacctacctgaatccgaccttttttattttgttcgctggagaaccaggcgctgccctgagtccagagcatcagcgccgtttcgcggtcaaggcgggcattgacgtcatacatctgcatgccgcccacggtgcgaccggaaaccagccagtagagcgcggtccaggggttataactggcgacgcgggttgcatcggtgccgagtccgaccggaacgccggtttccagcattttctgaaccggtggggtatggcgggtggcttcaatgccgtagcgttcagcaaagtattcgccctggaatgccatgcgatgctgcaccgcaatgccaccgcccagctctttgatacgatcgatattgcgctgagtaacggtttccgcgtggtcaaagaaccagtgcagaccattaaacgggatatcgcggttgaccttctcaaagacatccagcatccggctgatcgactcgtcataggttgcatgcagacggaaaggccagcgatgttccaccagatgacgcaccacgcgctccagttcatcctccatgccaggcgctaagtccggacgtggctccagaaaatcttcgaagtcggcggccgagaacaccagcatttcgcctgcgccgttgtgacggaaatagtcgctgccctggcctggcgtcagcatatccgtccacttctcaaaatcttccagttcatgccccggacgctgagtgaagaggttgtaggcgatacgcagcgtcatctgctttttctgatgcagttcagagatcacttcgtaatcttcgggatagttctggaagccgccgcccgcatcaatggcgctggtcagacccagtcgattcagctcgcgcataaactgacgggtcgagttgatctgctgttccagcggcagtttcggtcctttggccagggtggcgtagaggatcatcgcattgggacgggcgatcagcaggccggtgggattgccgttgctgtcgcgctggatttcgccacccggcgggttcggtgtctctttggtgtagccgacgactttcagcgctgcgcggttgagcagggcgcggtcataaagatgcagcacgaagaccggcgtgtcgggggcagcttcgttgatctcatccagcgtgggcatccgtcgctcggcaaactggaactcggtccagccgcctaccacacgcacccactgcggtgacggcgtgcgcagcgcctgctctttcagcattcgcagcgcatcggcaaccgacggaaccccttcccagcgcagctcaaggttgtagttcagaccaccacgtatcaggtgcaggtgggaatcgttcaggcccggtacggcggtgtgacctttaagatcgatcactttggtgccgtcgcagtgatactccatcgcctctgccagtgtgcctaccgcaacgaatttgccatcacgaatcgcaaccgcttctgccaccggattgctgcggtcaacagtatgaaatttgccatgggtcagtatcagttctgctttacccagcgtaaccatagatcctcctcaacggggttgtccgacgtagtgcgggacaggaagtgccgcagataacagggcacgaataagccggattatggtgagcgggttaatgcgtcgtctagttatacagagggatacctataccttcgtatagttatacgcagagataatagtttgccttcgcccgtcgccctacactgcgaccagacagccagcagcaggacgttaaacctgcactgaccgtccttttgctccgcgccaattggcgaaaattccgttacataacctctatgggtgaacgcatgtccaacgctaagcttgaagtcctcacgccacataacagccagattattttcatcgaccagcagccgcagatggcctttggcgtgcagtcgattgaccgccaggtgctgaaaaacaacaccgttgcgctggcgaaggcggcgaaagtcttcaatatccctgccatcattaccaccgtcgaaaccgaaagcttctcgggccacacctatcctgaactgctggatgtgtttccgggtcaggacattctggagcgcagctcaatgaactcctgggatgaccagaaagtgcgtgatgcgctggccgcgaaacggcaagaaaaaagtggtggtgtccggtctctggacggaagtgtgtaacaacagctttgcgctgtgcgcaatgctggaaggggattacgagatctatatggtggcggatgcgtcaggcggcaccaccaaagaagcgcacgactacgcgatgcagcgcatgattcaggcgggtgtggtgccggtcacctggcagcaggtcatgctggagtggcagcgtgactgggccaaccgtgacacttacgatgcggtgatgaacatcgccaaagagcattcaggtgcctatggcattggtgtggattatgcctacaccatggtacacaaagcgccgtcacgtcagaaaagtgaacatcgtactctggcaccggttcacgcaccggtccgctaaggggcgtcctgctgatcggctttcgtctgccggtcagcaggcataacaggagtccggttatgaatcctttactgctttctctggctgcaggggtattgattggcctgctttacggcctgctaaaggtgcgttcaccggccccgcccgcgattgcgctggtggggctgctggggatgttgctgggtggggcgctggttcatgcagtcttgcccgctgagcatacgaccaccctgcagcgatccgatgcgccgtttgttacacctgtttcgcgggtaagctgaacatgttgaaatcctacattatttctctcacggtggggctgcttgccggggtaatctatgccctgatcaacgtgaactctccggcacctccggttattgctttagtggggctgtttggcatgctggtgggtgagcagttgattccgctgggtacgcgtctgttccgccgtcagccggtgacgctgaagtggtttcgccatgagtgtgtgccaaaaatcagtgggacaccgccacccgatggcgatgaccacccttaagtcctcgcgtgccgtacgatgaggcgtttcagaggataactgcatggcgctgtcacagcgtattgtcattgtggacgatgaacgcgcggtccgcagtggactcagcaatctgttgcattcagacggctattcgacccgactatttgagtcaggtgaggcgctgctgagcgatgacgatgcgctttcagaggtgggcatgctgatcatcgatgtcggactcaagggcatgtccggctttgagctattcactattttgaaacagcgggcaggtgtgccaccggtgatttttatctcagcagatctggaagagaccaccctgtggtatgccattgccttaggtgcagtgacttttttgcgaaagccgattgatgttgatacgctgctgacactgatccgttgcgagttatctcagggaaaggtgcgctgatgagcatgctttcggttaattttcaggagagtgacgacgcagggatcgcgattgaagatttcgacacgctgacgccgctggcgcaggatggctgtctgctctggatgctggcgcgccgtcactcaggtgagtcactgataatcgccaccggacagagtgacgacgtcacgtttcaggcgacgcagcggttgaaaaatgagcgagcgctggccgcttatctttcgccccgctgggccattaccgcgacgggcaccacccgttacctcaaccgctatgcgctgatctaccccacgtttccgtttcgcagcctggcgaataacctcgcgacccctcccgataaaatcgctgacttcctgcaggttgcattgcagctttgctacacgctcggccaggcgcatcatcagggcatcgtgcatggggatatcaagccgggccatttttttgtcagtgatgatggccggttccggctgggcgggtttggtctcgcctcgctggcggcgcagtcggcggaaaaaaacagcctgcgcgtctcaggcggtacgctggcctatatgtcacctgaacataccggccgcacgccgcatccggtcagcagcctcagcgatctctacagtctgggggtcgtgctgtatgaatatctcaccggtaagttgccgtttggctcaccggatgcgggggaggcggagtggattcatcatcacatcgccagtgcaccccggccagccggacaggtcagagaggatgtgccgccgatgctctctgtgattctgctgcgtctgctggcaaagtcacctgctgacgggtatcagaccgtgcaggggctgatggctgatttacgccgctgtcaggcgacgctgaccgcagaaaacaccattgcgccgttcacgcccggtctgcaggagcggttcagcaccagtttccggcccgagacactgttcacgcaacatccgcaggctcgcgtactgctgacgacgctggatgcggtcaaccgtaccggcacgcagagcctggtgatgctgagcggtgcgcccggctcgggtaagtccgccattatcgcttccgccctgaaaaccctgcagcaccgacagattctgctggccgccagcaaggccgatcaacattcgcctgccgcaccttatgccgcagtcgcctcagcgtttcgcacagtcacgctttatctgctgggattgtcagccctggagctaagcaaatggcgggttcgcctgttgcgcttgctgggtggctataccgatttagccattgaactggtgcctgaactaaaacagctgctgaatatccggacagtgcagccggtggtgcgccatgccccggacgcccgcgagcagtttaatcagatggcgtctgcgcttatccaggcatttgccacgccgggccgtccgctggtgatgctgattgatgatgttcactgggcagacaatgccacgctgcaactgctggaaaatctgattacccgtaatgagcatctaccttttatgctggtgctcgccttccgggagggtgagtcgatgccctgtccgatgattgccgggtttctgctgcgcctcagagcatcagcggcacgtgtcgtggcgctgacgccgcagccgctcagtgttaaaagcatcacccgctggctggcgggaatgctgcatacccgtcccggcggcaatcgtgagctggcacagattatctttgagaaaaccggcggtaatccgctctcgatgcaggagttcttccgtcaggcggtggatgatggggtgattgtctatcgtcagaacccgctgaagtggcattacgacagccaggcgctgattgcgcgtcagtacaccgacaatgtggcgacgctggtattaaatcagctggcgcggatgccggaggcaacacgccagctgctgggttcgctggcctgcctgggggccagcggcgagctgtctttattaagtcatatcaacgcgacgtccgtatcgcggattcagcagcagcttgagcctgccgtcagcggccgttttataaccctgactggcgggaactacgcctttacccacgaccgcgtgcataacgcagcgtttttactgctcgacctcctgcagcaacactctcttcatcagcaggcggcggcatggctgtcggccgcggttgtaaatgccgattacagtgagacgctgttccgcgcggcttatcacatcggcatgattgctgaactgccgctaagtgtcgcagatcgtgaacgctattatcccctctgtttacgtgctgcgcagggagcgaaacgtgccggagattatctctctgcgctgcgctatctgcgcagcgcccagcaactcagccagcggatggtgaccggcaatgactttatgctgggcatcgatgaggcggagtgcgaatttctgcacggtaatctcacgaccgcgcaaaagctctgtacccgactgctgagtgagccaggcacgctcagtgaaaaatcgatggcagcctgtctctctgctgaaattcatatgcgtcagtccgacaaccatctggcgctggaaactgcgctcgcctggctggctgtctttggtgtgcatctcaggcgtgatccggacgacgcggagattgacgccgcctggcaggcgatcagggcgcggatcggcgattctccgcaagcggctttttcccacctgccacgcaacaccgatcaggaaactgagtcggtgctgaacctgatggccagcaccatctttgtctccgcctacgactgcccgcagctgcatctgttgctggtctgccggatgctggagatgacgctggatcacggcgtgaccggtgcttctgcgtttggtctcgcctggttcagcgtgctgatcagcgaacgctatcaggcctggcattttggctatgcctgtggtcgggtggcccgtgagctggtggagcggcatgactttacccgctataaagcccgcacgctgctgcctctggatcaactggggatctggacgcagccgctggatgtggccgtagagagtgcccgtgaaagttttcgcgtcgcggtgatgcacggtgaccgatcctttgcctgcctctcgttgcgtcatcagatcatgaacacgctgacacgcggcgatcacctggagtcggtcatgacctccattgagcgcggactcgcttttacccgcaaaaccttttatcccgatgttgagaacgtgctggtcatgcagaagcagctggtgatgcaactgcggaacagcaacgggttcagggcaggcgatcgcgatggggctttgccgatggtggcgggaagcgagccgggcgtgatctctggcccaaaagcgatggtgctgttctgggcggggttgtatcggggaatggcgcatttctttgcggcagaataccgggaggcgctgcgctgttttgcagaaattcgtccgctgaccagcgcagtgcccgcttacatctacctgatggatatgcatttttacagcgcactatcgctgagcctgcagcccggtgcggctgacagcaacacgctgcgctgcgatctggacaaatttgcgggctgggccgacctcaatcccggactctttgctgataaatatgccctgctcagggcagaatgtgcgcgtcttgagggcaacacgggtgaggcgctgaagcagtatgaaaatgcgatctgtctctcccgccaggggggatatctgcacatccatgcgctggcgaatcagctggctggccgctactgcaaagcattacagctagataccgccgccgatgcctacgttaaagcgtcgatgagaagctgggagagctggggcgcgctggcgatggtgcgccagcttgagcagcactatccgcatctgaccacgccgatgcaaaacagcgcggtggcgaccattccctttacgcaggatgcctcgtttctacgaccttgagagtgtgctgaccgccgtgcgcgccctgacggaggagatcaaccttgatcggttgattcataccctgatgcgcatcctgctggagcgggccggtgcccagcgctgtcggcttatccggattctggatggtacgcttccggaaacgcaggcctgggcagaaagcacggctgatggcgtgcgggtgcagattgtcaaagagcgccccgtcgcaactgacctgccgctatcggtactggccgcggtgatccgtaccggtcaggagatacgtactggcaagccggaagagttcagtccgttcagtcaggatccttacctggtggcctcgggcgctgcggtgttatgtgttccgatgttcaggcaggccaatatggttggggtgctctatctggagaatcgcctgatgcccgatgcgttcacggctgagcactcccacattgttaaaacgttgagtgctcaggcggcggtttcgctggagacggcgcgcctctacgctgaactgctggaggagaacaaccatcggcgacgggttgaaaagcagctgcgcgccagcaaaacctcactgatgctcggcgagaagatcagtcataccggcacctggcgctgggaagtggcagaggacatgatgatggtgtctgaagagtatggccgtattctgggcctgccagcccatcaaaaagggttgtcgatggcagattttctgacccgcgttcatcccgatgattatgagtgcatcagcgaactggtgacgcacagcgtcagtcagggacgtagtatgcaggctgagttccgtgtgctcaggccggatggtgaatgccgttatatcaaaggcatcggagagccggtagaaaacttccccgaggtgaaagagtacttcggcaccatttcagatatcaccttgcagcgccaggcagaagatgccgcgcgcatggcacaggcggatctggcccgtgtaacccgcgccaccacagtcgggcagttgactgcttcaatcgcgcacgaaattaaccagccactgatgtcgatcgtggccaatgccggtgccagcctgcgctggttaaagcgtgaaccggtgatgctggagaatgccagcagcagtctggatgaaattatcaaagagggaaaacgtgccggagagataattcgtggcctgcaagcgctgacccgcaatcatgaatcgagctttgcctcggaaaacctccatctgatcgcccgcgatatcctggcgctctcccgagtggagctggagcgacgcggaatttcgctggagctgaaactgagggccggaaaggcggatatctattgcgaccgcgttcagattcagcaggtgctgctgaatctggtaatcaatgccattgatgccatgtccgacgatttaccgcgcgcggcgcttttgcggctgacgtcagagaaacccgacgccggacacgctgcgttttgaggttctggatagcggctgcggcttgccggatggggtgcgtgaacggatttttgagtcgttctacaccacgaagaaaagtggcatgggcatgggattaaccatcagcaaagggattatcaaaaagcattgtggtgagttaggcgcagagaaccgggcggaaggcggcagccgtttctggttcactctgccactgggataatcgtattgaggccaggtgtctgcctggccttagcggcgtcgggtatgatcaatattgagccgctctgccgcccgcaccagatcggtgagcgaccgtgcattcatcttctccatcacccgccgcttatgaactttagccgtgatctcactgacgcccatttcggcggcgatctgcttattcagcaggccgctaatcgccagcagcatgacctcgctttcacgcggtgtcagggtctgatgtcgctccagtatctcccttcgctcctcggaagaggccatattctgcccggcgatctgtaaggcttctgcaaccgcctgcaaaatacgatcgggatcgacaggtttagtcagaaactcataagcaccggttttcatcgcccgcactgtgaccggaatagtcccgaagccggttaagaagatagtgggaatggcgtagccacgatcgatcaatgcctgtgcgacatcaaatccatctgcaccaggcagattaatatccagaatcaggcaacagggaaggggagtaaaagcgtgagccaggaaatcatcagccgaagaaaaagagataaccgtgtaatcgtcggcagtgagcagattacgcagtgcagcagtcacagcagcgtcgtcgtcaacgatataaacgatgggattcatagggacctcatttcagccaggtatttactgataatttaattaagcatgacgcgtaaagaggccctgatgagaaagtgtcgggcagggttaacaggatattaccataacagttatcattatcatcttataattatcagcttgttaaaattaagataaatggctgataggtatgactaaaatgtgagcgtcaactctggggtggagcgccactgttctgggcgtaaatgcggataactgtcatttgatcgacatagctatgccataaattgttcgctcactcacgggcaggagaatagtcccgtttaatagctaaaataatccataaacccgttatccagattaaatcgtttcagcctgatatgtactggaataagttagtggcggtacgtaattaattcggaagtagtctgttaactcgcggcggtcctgataattaatttgcctgagggcaaaacgacggattgataagcgtgccgatcattaccctgcgtcttatagcgaaataagctagttgattatatagttacaacatacaccgtgtttggttattaaccctaaacttcaccattgtgcggccaatgcttatcaacgcgaaaccgctctgccagattctgacgatcagccgggtaaaaactgacccgtttttagccggtaagaagtcattacatttaaaaaaaccttacctgtcagcgagtaaccttaataagcgtagcggtattcatggcgtggctgttaatcctcactaagcttgtgaagcaaccctttaaatagagggagatattccattcggtagctcgtcgcaatgtcgtcatgaggcttatatgagtcaaaattactgcaccattatctacaatggtgaacggttaaaagggttagctgatcaaccgctaatcgattttctggatgctcaagggaaaaaactacctcatgtctgttaccacccggcgttgccgccactgcaaagttgtgatgtctgctgggtagatgccaacggcgagcgggtttcgcggctgcacgctccgcactgaagaggggctggaggtgcagagtgaaggcagtgcgcttaaggccgcgcagcaggagggaatggatcggctgctcaatcgtcatgagctttactgtaccgtctgtgaacacaataccggtgactgcacgctgcataatgccgtggctgatatgcacattccgattcagtactatcctcatgagcccaagccctacgcaaaagatcattccaatccgttttacacctacgatcctgaccagtgcatcttatgcggtcgctgtgtcgaagcgtgtcagaatgtcgaggtcaatgagacgctgtcgattgactacacccaggcgcatcctcgcgtgctctgggatggcggaacggaaatcgccggttccagttgcgtcagctgcggacattgcgtcacagtttgcccgtgcaatgcgctgctcgaaaaaaccatgcagcccgatgcgggtccgttcactgcgatggatgaagggctgaagcgtccgctgatcgactttgttaaaacgcttgaaaacagcatcggcatggagccgattaccggcgtttcgaaaatcgatgtggcgctgcgccagtcggagatcaaacgcaccaaaactgtttgcacctattgcggcgtgggctgcagctttgagatctggacccgcgaccgccatatcctgaaagttcagccggttgccgaagccccggccaacggcatctcgacctgcgttaaaggtaagttcggctgggatttcgtcaacagcccggagcgcctgactacgccgttgatccgcgagaatggccacttccggcctgccagctgggatgaagcactacagcgggttgccgaaggattacagggtatcgctcagaattatggaggcgatgcgattggctttatcggctccagcaaggccagcaatgaagaagcctatctgacccaaaaaatcgcccgtttaatttttggcaccaacaacgttgataactcctcgcgctattgtcagaaacccggccacagaagggctgttccgcacggtgggctacggcggagatgccgggacgattgaggatctgcaagagaccgatttgattgtgctggtcggcagcaacctggccgagaaccatccggtcattgcttctcacatcaaacagagccacaaacatcgcggtcagaaacttctggtcgttgatccgcgccgtcatgaaatggcggaacgtgctgactgctatctgcgcatccgaccgggtactgacctggtctgggcctcggcgatggcaaaatatatgttcgatcacggttatgcggatgaggcttttctggcccagcgggtcaaccaggttgatgagtaccgcgcgtcactcgctccctttacgctggcctttgccagtgagacatgtggactgagtgaatcagaactgattgaagcagcggaaatgatcggccaggcgggcagcgcctgtgtgttgtgggcgatgggaattacccagcacagccacggggcagacaccagtacggcgctgtcgaacctgctgctggtcaccggcaactatggccgacctggcaccggcggttatccgatgcgcggacacaacaacgtacagggcgccagcgactttggctgcctcagtaatctctatcccggctatgaaaaagtcactgacccagcggtgcgcgaaaaatgggcgcgcgcctggggcgtctcgcctgaagcgctttccgatcagcctggtgctgataatttcaaaatggtgcagcaggccggtgaaggcaaaattcgtgcgatgtatatcaccggtgaagagacggcgtttgcggatgccgatgccacttcggtgcatgccgccttcagcaagctggaatttatggtggtacaggacattttcatgtcacgcactgccgaatttgccgatgtggtactgcccggtgcgcccagcgtggagaaggagggcacctttgtgaacaccgagcggcggatccagcacttttcacccgccatgaagccgctgggtgattgtcggcccgactgggagatctttaccgatctcgccgcccgtctcggtcatccgtggcattacccgaacccaggcgcgattatggcggaagcggcaggcatcgcagagattttcgcgggtgtcagctatgagcaactggtcggctggcagtcccagctctggcccgtcagcgccgcaggcgaaagcacgccgcgactctacacggaacggtttaatttcccggatggcaaagcgcgactctatccgctgagctggcaaccgcccgccgagcaggaggattcacagtataatctgctgctgaataatggccggatgctggagcatttccagtcgatgaatcagaccgggcagggtggccgcatgatgtcgctgtcgcctaatgcctttgttgagatctcaccggagctggctgccgagcgcgcgctgaacgaaggagagtgggtacgcattacctcgcggcgcggatcgctggatgtgcctgttgtgatcactgagcgtgtggcaggcaacgtgctgtttatgccgattcatcatggcaaagatggcgtcaacgccctgactggcgaacatcacgatcccgacgtcaacacaccagcttataaagagattgccgtaaatatgaagcgcgttgatcgccggtcgcagcctaatccggtgccactacacaacttccgtcacggcagtcgtacgccgctggatcacctgccgatagagcaaaaatggcagcaggctggctatcgggaaccgcctgaacatgtcgaaaaaccggagaaattctaatggcagaacggatgaaatatcaggtcccgccgacacctaccgagccgaccgcccgggaggcgatggatgagctaatcgaaaatcttcaccagcacggttttctgcggatggcgaacgatctggttaaatcaaacagcgaggtggggaaaatcctggtttcgggccttaatcagccgggtacgcagaacgcgctgcagaatctctcgatactgatgatgacgctgggcagcgtgccgccagaacggtttaatcatctgctgttggccgttcgcgatgccgcgatggccgttaaaccggcgcgcgatgaggcccgtcaggaaaaagccgcgccgggaatccgcggcattatccggttactcaatgatgaggatctgtggcgcggactgcgccccatcttcgcggcgcttgaagtcttctcacaacagatcgaccgtgaagagcaaaagccgattacccgcttcagtggcaagcccacacgggagtagttcagcctgcgatcgttcaggattgcgtgggggtgtagatcagatgaccggctacaccgcccgcgccgccatcttttggatgattgataccatcggagaccgggacatcggtgaaatcaaacggcgaaaccccctcaaggcaggcgacattcaccccgaactgatcgggctgtgagcggctctgatgaaaggcgtaaatgccgcaaacggaacagaagtagtggcccacctctttgctgttgaaacgatactctgtgagctgcgcttcaccccgggtcagctccacctttgtcgcaaataccaccaccgcgccgcgcatccggcaaaacgagcagttgcagcggcgcaccgtattaaatccatccttcagcgtcacccggtacgccaccgcgccacagtggcattgtgctgtcatttcattttgcatcgtgatctcctgtgtagtgaaaccagccagctttcagcctacgctaaagcctggaatttggcagcatcgggtgcggatttgtcgaccattagtacagccagggcagggtgcgttgatcgggtttcgtctgcgacacgatttatttcatcaccccgtatcagacagtaataagcgttatctcttccgcttcaaacgcctcaagcagttctttatcgagcttctcttccacgacgagcgttgaaatttcacggcatttcgccacgctgaatcgcgctacggcagggattttatccgctgtcagcccgacaatgacctgattgctttgtgccatggcaactttcttgaattcgcaatccgcatagttaaaaccggtcagaccggcctccggactcatggcacagccgccaataaacgcctgatcaaacagaatcccctggatctggttgatcgcggtttgcccgaccgcgccgccggtgctcttctgtatctgcccgcccagcataatcacctccgcagcaggatggttgatcagtagcgcagcaatatcgggtgcattggtgacgacggtgatattcaaatctggtgatagcgcctgtgccagcgccagattggttgtaccggcatcaataaagatgcagctattggctttcaccaggctggcacagcgctgcgcgatcagggcttttgctgcgtgatcgtgagctttccggctgacaaagctgcccgcctcctgaagctgtaacaccgcaccgccatagacctttttacataaaccctctttactgagttcatggagatcgcggcggatagtgtgctctgatacagccaattgccgtgccaggtcagcgcagaccacccgtcctttgtcctgcaatatctcacgaatcagcgcttgtcgctgctgcgggaaagctgcataatcgagcatataaacctcaaaatattcacaatcgagctatagtgagcataatcgttcactgccgggcagggagtcaatagcgatctctcggtcctgtcagctctccccgacatccctcaaaggaatgcaatggctaataacgtctcttccacgctggcaacacgcatcatcttttttatagccggatttatcaccgcgacctgggcggtgattgtgcctttcgcccgcggcaataccggcgttaatgaggcgcaactcggcaccttgctgctttgtcttggcgtcggcgcgctgattgcgatgccggtgacgggctggctgaccagccgctttggctgccgccgggtgattctggtcgctgtcgcgctggtcatcatcagtacgccatggctgtcggtgctcagcgacccgctgttgctggcgctggcgttgctggtttttggcgtcggcatcggtgtgaccgactgcgccatgaacatccaggcgatcttggtagaaaaacaggcggcaaagccagtcatgtctggctttcacggcatgtacagcgtgggcggcattgccggggcgggctttatgacgctgctgctggcgatgggttttagcgtgctcaccggctgtttgctggcagttgtggcggtgattatcatgacgctggtcagcgcaccgggtttactgacctacgcgaaccccgctgaaggcccggtatttgctgttccgcgcggcagcgtactgattatcggcatcatctgctttgccgtcttcctgaccgaaggcaccgtgctggactggagtgctgtctatctgaccgacgtccgggccattccggcatcactgggcgggctgggctatacctgctttgccattgcgatgacggtggcgcgtctgaccggggaccggattatctcatcgctgggacgtttaccggttgtgctgggcggcgcactgattgccgccgctggcatggcgatggtgacctttatcgcctcctggccgatggcgttgctgggctacaccctggtcggcgcaggctgcgccaatatcgtgccggtaatgttctccgccgccggacgtcagacggtgatgccgcaggcggtcgccgtgcctgccattactactctgggctatctgggggtcctgagcgggccagccgtgattggctacgtggcgcattacacacatctcgctttctcgttttcactgattatggcgctgatgctggttgtcggtgcggtctctctgaccctggatctgggccgtagccgcgcgggggagaatgcataaaattacccaatccgcgctcctgacagaatttcattgaacggggcgcggagtcatcttcaggaggaacggaagcggcgtgccattactctcccagcctgacccagcggcggcctgccagcaccgtcagcgccacgatggtgatgcccgcagccagatgcatagaaaaatcgatggcgtgcagatgggtatcgtggcacaacgacagcagcatcgatgaggtaaacgcactgccgcagccgctcagcgccagactgcgcgcgggatagagggatcgggtgcgctgcagggcgaacacggacatcagcatcatcgggacactggccgacagcataaacagatagcagtgcatcccttcacccaaccggtttcgcgcccgatggcggtgctgaagatgacatattgatcagattcagaaccagccacatcatcgccatcagcagcggccagcgcaggctgatcggttttctgcctgcaatactcagcgtaaaggctgccgccagcgtgctgcccgcgatgatgagtgacagcagcagggcaaccagcgcgaaaaacgcgccaggctgcgaccagtcagtgaaacggctgtgaaatgcccagctggtcagcgcgccacagggcagggcaagggcaatccagcccgcaacgcgccaggcggtgggccagacgcgctgcaccggctgggcagacgcgctgagctgattaattaactggtcatgatttctcatgatgaccccgtccatatttacgaaggttgaccattgcgcgatgcaacagagatttaaccgcagagagcgactgattagtttcagctgctgcctgcgccaggctctgctcgcgcagatgcacagattcgacgatctcccgctggcgcagcggaaggttatccagataacctgagaggatatccgtatcggctgaggactctgcacttgcagcgggttgtcgttgcagctcttcctcatcctgtacttcctggcgacggccgcgatggcgcagcgcatctatggcccgggcagaggcgatggcagcaacccaggggagtatcggacgctgcggatcgtaggtatgccgcacccgatgaatcgccagcagcgtctcctgaatgacatcctcaaccagtccctcatcacggatttttttgcataccaatgcccggatggcaggaaccatcgctttcagtaactggttataggcagctctatcacccgcctgcgcccgggccattaatgctggccactgctgtgcgcgttgatcagtttctggcatcgatcatcagcagttcagcacgtcgtcgccgtgccctgaccacgcgccaggcaatcgtttcatcagtaatctcaggatttatttcctttttctgttgcctgattcagcgctgaaatcacaatgccaggcgtcagcacctggggcagtacctcaggtttaccgccgtcagccggatagaccacgtagagcggtaatccaccgcgtccgaaatcgctcagcgcctgttcaacatcgggattgtatttggtggaatccgcgaccatataaatggtgttggttcgcgccatcgccgcttttaccgcctgcgtcgaaagcgaagtacgatcgttaacctggcaggtaatacaccatgatgcggtaaagttcaccagtattggcttgccctgacctttgatggcatcaacgttctggggcgaccatgccacagcggcagcagcctgtgaggcggttgccgcttcagccggagcttcggcaaacctgttcaggttcagtaacggcaccacgaccagcgccaggaagaatgcggtcgccacatgcagcacccaatgacgctgccccatcatacggcgtttctgcgccatgccatacagccaggcggcgaaactaaacagtaaacagcaggccagaatggcagccagcgccgccgatcccgcctgacgttcaagtacccagatcagccagcccaccgcgcccagcatgggaaacgccagcccctgctttaacgtgatcatccaggcacccggttttggcaaaattcgcgccagcaccgggaagaatgagatgagggtgaagggcgcagcaaagcccagcgccagtgaaataaagatcaccagactgattagcggaggctgggtaagcgcatagcctaccgcgctggccataaagggcgcgctgcagggagtggcgacaatgatggccagcgcgccagtcagagctgaaccgactaaaccaccgcgatcgcctcccacttcgccaacccgctgaaccgataatcctacttcaaacagaccgagcaggttcagtgccgacccaagcatcaccagaatcagcgcggcgatgaccagcggcgattgcagctggaatccccagcccaccgatgcaccgcccgccctggccagcaacagaaactgcggtcagagcgaccatcgtcacgactacgcccagcagaaaggccaggccttcggctctggcgtgggaaggtgattcgtgatggcggatcaggctcagtgctttcagcgagatcaccggaaacacgcagggcatgaggttcagaataatgccgcccaggaaggcggctgcaatcgcagtcagcatgatgtacctgctctgaagatgaagttatgccggattggcctgacggtattttttaacggcatccatcgctttctggatatgcgtatcaggatttttatcggtgaagctcagcaggattttgccatcgggcgcaatcacgtaagaggtacggtctgagagtttctgacctttcatctccatggtgctcttatattctgccgccactttggcaccgggatcggctgcgacggtaaatttgtcacggcattcaagctgcgagaatttcgcaatctgatcggtattgcccgcggtcacgccaatgacggtcgcaccctgctttttaaattcatcggtcgcttcagcaaaatcgtgtgcttccagcgtacagcctgcactgaaagcagctgggaagaagtagagaacaaccgggcctttctgcagcgcctgttgcaatgagaaggtggtcgatttaccggccagcgcggcttccagtttaaagtccggcgctttttcaccgacctgtaacgctgcaaaagcagatgttgccggaacactcagtgccagcagcgtagcgacggccagggttttcagggtgtttttcattggctttactctctccattgacgaacagacggagttgtctgacgtccctgataacaggttcgtttaaaaatggaaaaagttgcgcggttgaggaatttttttcgtgttttttttatggtgcttcaccagccgtcctttatcagaaccctcattttgagctgaatcgtataaagctaatgtcagcaaatttcacctggttcgctgtagttattcctctctggccgtaatcactgtgatttggcccacaataatagggctaactcactgccttttctcaacaggtgagcatcatcacgtttatcttcagtcccattaagtaaatttcccttacggaatgaaaaaacgattcagccaatgggatgacttatgaagattaaactggcgttaacggtactggcagtgctggtttcaggctctgcagcggcgaaaacctgggtgctgacgagtgctgaacagggcactgagcaaggaaactggaagatttccagcagtgagctgaagtttcagggcaaaccgttcagcatcgagcagaaagtcctgcatggcggcaagcaggaaggcagtaaaattctgacgatccgcagtgaggatggcctgacgattacgctaagcccgacacgtggcatgaacttactgcgtgttgaaggctttggcacccgcatgggctgggattcaccagttaaagaggtcgtcaatcctgcctacatcaatcttgagagccgcaacggtctgggatggctggatggtttcaacgagatgatggtgcgttgcggctacgaatggaccggtcatccggtcaccgatgaaggccgaatctatacgctgcacggtaaagcggggaatacgccggtttctcagctggaagttgaagtggcagatgcggcaccacacgaaattcgtattcgcggcctgattaaagagagcacctttaagaaagctgatttgcagaccatgaccgagctgcgttacgtgccaggcagcaacagtttcagcctgcatgatgtgttaaccaaccacgccgactatccgcacgattaccagatcatctatcacagcaacttcggcaaaccgattctggaagagggcgcacgcttcctggcgccgatgtccggcatcagcccattcaatgactacgcgaaagccgggttaaaagagtggcagacctataaaggtccgaccaaagacttcgatgagatggtgttcaacatcaagccactttcagacagcaatcatcagaccgtcgctgcggtgataaataaagcgggcaacagcggcgcatccattcagttcgatacgcgtcagctcccgatgctgaccttatggaaaaataccgacaccctgaaacagggctacgtgaccggcatcgaacctggtaccagttacgcctatccggtcaccattgaacgtgaacaaaaacgcgtgaagcagctgcaaccgggtgccagtacggcatttgatcttacgtacaccttgctgcacagcagcgagcaggttaatgacgttgagaaacgcattaagggcattcagggtgaaacgaagattgatgtgagcgagacgccgatagcgaaagagtaacgacccatcataaccccagctaaattgttggggtttttactttacaggtcagcgttccgtcacgggatgacaacacaaatgcgggaaagaggcaaagatctgcgcaggatactggcgatgctataaggtcgcggggttggtcaacgcaaagttacacgcaggtaaacatccggcaaacctgtggaagggtgttaagccgaaagttgatagagaagagtaactctgaaatactaacagttaataactgatagtaattcagcgggagaggaatcatgccaaccagcgtagcactcagtccttatttcgaagcgttcatccgcgaacagatagaaagcgggcgatataacaacaccagtgaagtgatccgtgcgggcctcagggcactggaagaacgggagcagcagatgaaacttgatgctctgcaaacagcggtcagcgcaggtataaaaagcggcgaaagcaaaaacgcggaagaggtatttggtcgcctgtcgcaaaaatatcggcggcaggccgaaggtggtaaagggtaatgaagtacgtgtgagatatgttatttaacataagatagattatgcgcactaaaggcaaggcggtaacatagaggctaaagctctaagctaaccttatccgggcgcttcagacaacctgctgaagccccttgtatgagtatgacggcctctggtgaggaattttcacgatcaataaagccgtcacctcaccaccactgtatctctcacggcgatcggttcaggatatacagtggcgatgatcgctggtttaagagcacgctgttgctctcaacccgtcgcgccctgacacactgcgaatcgacagcatctatggcttaggcaacgaagtctcgtgcagatgtcgccacaaaaccttgccagcatcatttacctcgaacacaaccgtagaaaaccgcagcgtggcctcctgacccggaagctgctgcaactccttatataccacagtggcatttccttcactctcagcaaccatctgcatgtcgcagatatcaatcgctaaacccggacgtgcaccgcgctgagtgcggaaaaacccatttagtgtcgtgaaatccagtaaggcaccgcccggtgtcaccatggaatatgcaggactaaaacgcgctaaaagttcctcacaaacctcatcatgtgcttctttgttacccagccagttgcgaatcaattcgtgggcgtccagtacttccttaaaataacggttcatttttggtcccttttaagcatagaaataaccttctgatttgaaatgcgtaaacagcacagaagcggaatcacagcgctgaatgccgctataataaaacagaggtgataagcgtgttcttcaggcatgccgctattcgcaatcagattgaacagcaggctgaccagcgtaacgccgagacaaaaactgagctggcgattgatattccagagtgcgctggcatcagcaagttcgctgtcggtgatgtgaataaaagcagaactctgagccgtgctgctgcacaggctgccgccaaatcccatcaaggcgaaagcaagtacaaagactaaggtgtccgatgtctggccagtcagcgccagcaggccaatacccagcgcctgaaacagacagccggtgataaatagcgggcgtggtccccagaggttgaacgtcttacctgtcagactaattgccgcaaaggaagccagagaccatggcagcatgagcgcgccgacaatgctggcatgcatacctaattgattttgcaggtatagcatagtgatcatactgacgccggtgaacacgcctggtataaactgatagatcagcattgcggtgtgtaagagcggatcctttatcagatgcaggttaatgagtggatggctttttcgaagtgcgtcccacacatagcccgccagagtaaggacgccagcaagcagcatcatcgccccctgataaagcctgtcagcatcgcccaggtatgtcagtgcgagaaggatcagcgtgagcgcggcacaaccactgactaaacccaccaggtccagcggttcagataagttcgccggtttgtctgctttgagccagcatcccgccagcagcaatgccgcaatcgcgagcggcaggctcacaagaaaaacccagcgccagctaaggctctcaaccactattccaccaacagctggcgacaaggcgggtgccagcaatgcaatcaacatcacgactgacgataacttcgcacgttcattgctcctgtataacgcataggtcatcgtctgaccgatggggatcaacagtccgccgccgatgccctgtatccatcggaaggcgatgagctgagaaactgacgttgatgcccccacaccacaggtgcccgcaatgaaaataagtagtgagagcataaacagacgttttgcgcccatgcgccgtaccagccagctacagtttcacgatgatcaatatgcaacggctggggatttttgtcgcagttgtcgaggcaggcagttttacaggtgcagctcagacgctcgggttaactaaagccgttgtgagtttcaatattaaacatctcgaagaggagctgggtgtctcgctccttatcaggagcaccagacgcgtttcagccacggatacgggtgaaagattttatcatcgttgccttcagctgcttcaggatgcggaaagcgtattagaggatgtgagaagtgatcacgctggattaagcgggacactccggatcacaaccactctggaatatggagctcgtgtgatcgtccctgcccttgctgactttgcagcccaacacccgcagttacgcatacatcacgtctcttcatcaaaaaatgacgacctgattgccggccgcttcgatgtggcgatacgacttgggcatcttgccgattccagtcatcacgcccgccttatcgatcagtttgatatcctggcggtcgctgcaccttgttatctcaacagcctgaatgaagcgtctatccgggatctttcacatctcgcgtcagcaaaatggattgcgcatagccgtttatcgacgccactcagctggcaggtgaccacgcccgaaggtgagtctgtgctgatgagcgcatttcagcctgccatgatcacagctgacagtgcctcttctttactcgcttttgctttagccggtgctggcgtggcgattctgcccgcctggctggtacaggatgagattgaaaaaggtggattagtaaggctactgcccgatcatcaattcccccgtcagggaatttacgcgctctaccctaatacgcgtcatgtgccagaaaaagtacgcgcgtttatagatttcctgcatgaacgtttagcgctctccagcagaaaataagcgcatccatcacattattctgatgggctaaccgttaatttatctgaactgatttaaaccccataaactttattttaagcagcgcgggaaggtaaatatttactgtctggctaatgacaattgagtttaacgcaggcgcattacttaattccctgtcctgataaatcactgctgcgcgataacctgtaaaactggcgctggggcttgtcttgttatcccatccccagcgcctgcggcttcaggcccggacctgcgccataccctggtatggctcagtcatttgatgcacagtattaagtaaaaattaacgccgtataaataattcgcacagtaccttaataacataagattttaatctggatgattgcggtttattcgctggcaggaaaacaggtcgcatgttattaaatttgaatgtcgcgcttaaattcatttgcatccgggaattaaaacatgaaaaagagcttatcccttgcattactgttttcgctcacaacagttagtcacgcggcactggcgcagcagaccctgcgctttggcgttgaccctacgttcccgccgtttgaattcaaggcggctgatggatcattgcagggctttgatgttgatctgggcaatgccatctgcgctcaggcaaaggtgaagtgccagtgggtgcaaatgggttttgatagcagcatccctgcccttcaggcaaagaaatttgatgccatcctgtcagcgatgtcgatgaccgataagcgtcgtcagcaggtggctttcagcgatatgttgtacaacacgcccagtgctttactggcaccggctgccagcacgctgacgaccgatgttgcctcattgcgcggtaagacgatcggtgtggcacagggcaccatccaggaaacctatgccaaaaccaaatgggagccggagggcgttaaagtcatctcctatcctaaccagatggaagtttatccggatctggtcgccgggcgtcttgatggcagcctggccaatgcggtctctgctgaacagggattcctgacctcagccgaaggcaagccgtacgccatcaaagggaccctggtggataaagtgatttttggtgatggcgtgggtatcgcgctacgcaaaggagatgaggcaaacctgaagatgattaatgcggcactggcggagatgcataaaaacgggacttatgaccagctcaccaaaaaatattttaaattcaatgtttatccctgatccgcacaacgtgaagaatcgcaggagtatgaagactatggcgttgcccgaataccacgttcagcgcgcgcggtttatggcagcggcgcagagcaaaggtgctgaaacgacctcttatccgcatcctctgcctggtcctctgggagaagctctgtatacagacgtggcacggataggaccggccagcgcatcacgtctgatgctggtcgtttccggcactcacggcgttgaaggctattatggttccgattgccagatagcctggctcgagaccctggatgaaaaagcgttgcccgctgataccgcgctgttgctgattcatctgctcaatccatggggcgcgtcgcatttacggcgcgtgaacgaagacaatattgatctgaaccgtaactttatcgatttcagtcagccacctcctgctaacccggattatgcacagtggcacgatatttatcatggcgaccgtgcaagcgccgatcggcaactggccgacgcactcgagggcgcaggctggcaggcggttaaacgtgtcacagaagccggacagtatagttttgctgacggcttttttttcggcggtaagaagccctgctggtcacaccttacgatggcggcgatcgttgaccagcatctctctgtggcgaaaaccatcatcagctttgaccttcataccggggctggcgcatgggggcatccgatgctgctctctattgcggagcagcgttatccggcgcatgactggggcaaagtcatttacggtgagtggctgaccttattgtttactggtgccggacgtgacagtgtaactggaatcacagcaacggcaaccggctatctgtcgcactatctgctgacgtcactggctgacacccggattttgcctctggtggtggaatgcgggacttacgagggtcaggatatgcatcagcgggtgcgtgaagatcactggctgcacctctatggcgaccctgccagtgcgggcggccaggtgataaagcaacaactggtcgaggggttctggccagaagatgcggactggcgtgcattggtggctttccgcacgcagcaaatctttctgcgcggctggcgtgctcttgcagacacgccatgatgtcatagtctgccgtaaaaggtcatacgcgcggtttctgacaacgcaatatccggctgcgtattgtaagccagcacggccagcatccgggtgacctcgccttcagttggggtcacacggtgcagggaattacggccacgaaacagtaccagatccccggcatctatctccagcgcgtcaacggtctggcgtttcttccagcactgcgtcgacaccggcaaagttcatctcaccggcatcggcatcccgcagatctttcacatactgaaacacgccgcccgccagcggtttctgtaccagtaaggtgatcgcaaatgaggagttgtcgaagtgccagcccagctcctggccgtgtgatgcatagtgcaggttgatcgaggaaagcgggtcagcatagggatagagcgctttttcacccagtacatcgcacaggaaatgtttgaacaactcatcattataaagctgacgcagcggcgagtcggcagcgataacatcatcagtgatgcagcctttggtgctgatcacatctctgttacgcggatgctcagcactgaaagcgtcatcaggtttcatcagatagacattgtgcatactgcgggtgtgataagcctggtgacgttgtgcattgccctcttcgatgatcgcctctaaagcgtatggttttaaaaactgacgcagtaccagcgcgccggactggtttaactgctcacgacaacgttgacgccagccatgatcggccagtggatgaagatcgagacggacaagggaaccaggcatagcaacaattctcatgatgagcaggtgtgatgttactctaccggtcgcctgcaacgctgcgtaacgataaaaacttaatgccctgataaggaagagttaatgcctgcccaattgccaaggttgccaaagatcagcgtcatacagtcatttaaagtggctgccgaactgggcagcctggcaaaagcggccgctcaattggccttaaccccggcggcagtcagtcagcagattcgccagctggaggagcaactcggcagcgtcctgtttttacgtacgcagagcggcgtgatgctgaccgaaaccggaaaagagtatctgcgctatgtcactgaggcgtttgatattctgcatctcggtcagcaaaacatccgccatgcggccagcgcgccaaaactcaccgtttacacattaccggcgctggcgtccaaatggctgttgccccagctggcgagctggcgcgaccattgcccgaatatcgatctctcgttacacggtacgcattctcaggtcgatttcaccgcgatgcccgccgattttgtgatctgctttggtgaggatcgttacccgcagtcagataagctgaagttgtttcatgatgacgtactgccggtggccagtcctgctctgttacatcgctttacgccggaaacgatcttaagccaggcgccgctgatccacctcgactggggtaatgaaggccgctttctgccggactggcgaagctggtttcaggctaaaggcatggacgaacctctgccgcagcccgcattcagctttaatctgacctcgctggcgattgatgcggctgtcgcgggagctggtgtgctgctggggcagcgacgccttatcgcggcggaactggcacggggcgatctggtggtagtggatgatctttgcctgccgctgagcaaaccctattaccttgtctggccgcaacgcaccctgagccagccaggcagtgaggcgatgatcagctggttaagccaactgggcgcgagctgcgaatagcccttcgccgtgatcggactcgcctgcgcccgccagtctggaaccatcagcaggcacaggatcagattatcactgcgccgccaggtgaccaggtgaccaggtgtcatcatccttccgcattatcctcaacaatcaccgccacgcgttgccctgcacgtacagcgctgcctggctgcacgctgacctgctgaacaatgccgtcgcacggcgccagaagcgggatctccatcttcatcgactccagcaccaccagaatatcgccttcccgcacccggctgcccgccgtcgcctgcacctgccataaattgccggaaaccgggctttcaaccccctgctcgcccggctgcagcggcgcgtcgccgccttcatcggccacactttcctggctgtcgaaatgggcctgcccgctggcgatccagcggtcacgttccgcattgaacgcggtttgctggtgatcgcgaaacagaccgatgctctgcgcttcacgggcgaggaaatcctgatattccgccagccgcagcgtgctgtgctcgatgcgcagcggatagcgaccgaggggaaaatcgcggcgaatctgcaacagctcactggctgagaccggataaaagcggatctgatcgaaaaagcgcagcagccagggtttaccgccaaaatcggcgacttcatgatatcggttccacatctgcagcgtgcggccgacaaactgatagccgcctggcccctccatgccatacacacacagataggcaccgccgatgccaaccgagttttccgccgtccaggtgcgggccggattatattttgtcgtcaccaagcgatgacggggatccagcggcgtggcgaccggcgcgccgaggtagacatcgcccagccccatcaccagatagctggcttcaaagaccgtgttccagacagcctgctcatccggcagatcgtttatacggcggataaattcaagattactcgggcaccacggcgcatcctgccgcacggtggtcatatatttttcgatggccttctgacaggccggatcgtcccaggagagcggcagatgcaccacgcgtgtgggaacctgaaggtcatcactcatgcagaccctctcccactcaccgcgcacccacatcagcagcacgtcgggcgtcagcgtctccggctgaaagtggatttgcagcgagcggatccccggcgtgatatcaataatgccgttgcgggattgcgcttccagcgcctgcatcaacgcatgaatgcgaaaacgtaacaccagatccagttccggctcgccagcctccagcagcagatgggtatcgccagagaggcgcgccaccaggcgtttatccgctgcgccgcaggtcatcacaatgggcgaaatcagcggtgcaggctgccagtctgtttcctgtggctggagcgtggtcagctcggtgcgtcggccctctgccagtcggcgggcggtaggaatatccaccgcgacaaactgcactttgtcaccggctttgagctgtcccagttgccagaggtcagcctcgattaccgtcaccgggcagacgaacccgccaaggctcgggccatccggccccagaatcaccggcatatcaccggtaaaatcgaccgcgccgatcgcgtacgggttgtcatggatgtttgaggggtgcagccctgcttcaccgccgctgtcgcgggtccagattggctttggcccgatcaggcgaacgccggtgcggctggagttaaaatgcacttcccattctgtggcaaaaaacgtctcgatatactccggcgcaaaaaactcaggcgcaccgtgcggaccataaatgacgcgcagcgtgcgcaccgtggcaagctctgtttgtagtccgacgggcagttccgatccggttgcgctcgcagaaacgcggagcgagatgcagcacgtcaccgctacgcagtgcccgtccggcatgtccgccaaactgaccaagggtgaaggtgcttttgctgcctaaatagtccggcacctgaatgccgccgctcagacagagataacttctgacgcccgcgccacttatcgcgcccagcttcagcgttgccccggccggaatggtaaaaacagaattcattgactgcccgacgccatccagtgtgacagtgagcggcgcgccagagatcaccgcctgaatctcagtgttaaatttcagggtgggtccattcagggtgatttccagcgcggcgtcaccctcctcattgcccagcagacggttgcccagacgcagtgcgcgatcgtccatcggccccgacggcggcacgcccaccgcccagtatcccagacgtccgggatagtcctgaacgctggtctgggttccggcactcaccacttcaaccgttgccgcctgataggcgagctgctccaggcagcgggtccagggttcgccagccgtaaagggcgcgaaggccagaatctgcaacagatagaggcgattggtttcgacgccatagaaacgggtctccgccagcgcctgtgacagggtggcgatggcttcctcgcgagtggggcgccaggtgataacttttgccagcatcgggtcgaagaatggcgggacttcacagccggcttccacccagcggtcaatacgcagggttttaccgtcggctgccggaaagaggacttgggttaacagccctggcgaaggctggaactgccgccccggatcttccgcataaattcgcgcctgcacggcatggccctgaggattcagcgcggcggctaacgcatgaagcggaggaagatcgcctgctgccagctcaatcatccactgcaccaggtcaacgccccacacctgctccgtgacgccatgttcaacctgcagacgggtattcacttcaagaaaatagaactgctgcgccacgctgtcatagacaaactcaaccgttccggcgctgcgatagttcaccgcttttcccagcgcgatagccgccgcgcataaagcctccgccatacctgcgggcagattcggcgctggcgtctcttcgatcactttctggttacgccgctgtaccgagcagtcgcgtacgcccagcgcgattacctcgcccttgccgtcaccgaaaatctgcacttcaagatgacgggcgcgttcgatatatttttcgagaaataccccggcatcgctgaagttgttctggccgaggcgctggaccgtttcaaacgcctctgacagcgcattcgcatcacgacagacgcgcataccgatgccacctccgcccgcggtgcttttgagcattaccggatagccgaccctctctgcggcgcggcgggcttcgctgatatctgccagcagttcactgccttccagcaacggcaccccttcggcttccgccagcgcgcgggccgtgtgcttcaggccaaaggtccgcaactgctgcggtgtggggccgacaaaaatcagaccagcagcctcgcacgcctcagcaaaggcggcgttttccgaaaggaaaccgtagccaggatgaatcgctttcgccccgctctgctgcgcggcggcgataatcttttccgtcaccagataggtttgtgcagccgggccttcgccaaggcttagcgctacatccgcctcgcggatatgtaaactgctcagatcggcttcggagtaaacggcgacccctttcacctgcatggcacgcagcgtgcgcaggatgcgacaggcgatagcaccgcgattagcaatcagtaaggtatcaaacataagcgaactctcagggatgcgggtcgtcccgcaaaattcgatattccctggggccgtccccggggctgaccggcacgtaacaggcgtgcgccggtgatgtgttgagaggtctggcgcaaaaggctgagaaactcagccctgcttttcgccatgacaacgctggctcagttccacaccagcacttcggcgggcgtcgggttccagccgttacaggggttattcagctgcgggcagttggagatcagcaccatcacattgcattcggctaccagctcaacgtatttgccgggcgccgatagcccatcctcaaaggtcagaccgccttccggcgtgaccggaacgttcatgaaaaagttgatgttggcaccgatatcacgtttgtgaaggcggccatcgtgcaggcaggcgcagagaaagttatcccgacagctgtgcatgtagcgcttatcctgggcatagcgcacggtgttgctctcctgcgagcaggctccgcccagggtatcgtgacggccgcaggtgtcggcaacgatagtcagcagcggattgcccagattcgaatagagcacgctgccggtggtcagatagacgtttccctgacgacgcagcgtgcgctgaggatcgtagcgttcccgcgggttatcgatgttatagaacagggtatcaattgcctgattcccttcgaggtcgagcaggcgcagcgtctgcccttttttcacttcgaacagccacggctcgcctgccggtatcacgtggcgatagacggcatcttcaggacgacgatcagagttaataagggtcatcgcagcctccttacagggcaaaaagttgggtgttatgaagcgcgcgctggttttcaccacgcgtgaccatcgcttcgctgacggcctgcatatcgtcggcctgataccagctcagctgaaccggtcgcgggagatagtcagcggcgggatcctgcggatgtggcagcgcggtcagcaccatcagcacgtccatgggtgcgtacagttcagtgaaatcgccggcgcggctgttgcccgcgctaaaccggaagcggcccttctcatcaaccgtgaccttgctgaaaaaattgacgaccatcagcagatcctccaggcccagatcccatttgcccatctcaaccagcagattatctgtgccgttgcggtagaagccgttgcgcagctcctgatagcgtccggctccatacttatcgtgcgcttccgccgcgttgagtacgccgccaaacgggtcgtgccagccgcagctatccgccacgatcgcggccagtacgcgtcccatgtcggagtagaaacagtgcccggtggtcaggcgagccgtatgctggcctttcagggtatccggcagattcagacgttcacttttctcgtggggattgagcatcatcatgctgacgttcgcgccgccctcgttgtcggtcaggcgcaggatttgccctttgcgcaaaatcagcgaggtgtgccctccgccaggcagctgctcttcgcgcaggctcggagctgaatgaaaaagtgcggtcattgagcggtctccttgaggggataaatgttgtttttgttgcgggttgccagctgcgacagccgcgtttcattaagcgggatgtcgtaagtgatacgcgcgccccaggcattgggggcctgaggatcgatgcgcactttgtcgaaaaccagcagccgggtgccaagattgaagccttcggcaaggtcgtgagtgaccataaacaccgtcatgcgagtttcgctccagagctggagcagcagcgcatgcatatctttgcggatgccggggtccagcgcgccgaagggctcatccagcagcagtacgcgcggctgcatcacaaaagcctgcgcaatggccagccgctgctgcatccctcccgaaagctgcgccggatatttatcgagcgaatggcccagcccgactttctccagcatctgttttgcctgctcacgggcatggcgttttcgggtgccaaacagccggccagtaaacggtgaagccggaagttcgaggccaatagcgacgttatccagcacgttgagatgagggaaaacggagtaacgctgaaacaccacgccacggctgcgatcgggttccgcgcgcagctgttcgccatccagcgtgatcgatccccgtgtcggcttttcctgacccagcagcaggcgtaaaaacgtcgacttaccacagccggacgcgcccaccagcgagcagaattcaccttctttgacctgcagattgatgcgttccagcaccacgtggtcgccatactcctgccagatatttttgatatcgataaaactcattcccggcctccttccgcccaggggaaacaggctttgtgcaattgacgcagcgcgagatccatcagccacgccagcagcgtgatccagatgacatagggaatgatcacatccatcgccatatagcgacgaaccaggaaaatgcgatagcccagtccggcggttgcggaaatcgcctcggcggagatcagaaagagccatgcggatcccagcaacaggcgcagcgaggtgatcagccgcgacaagagctgcggcagcacaacccgcagcaccaccgtccagctgttcgcccccagagtttgtgctttgataaacagctctgaggggatttcccgcgcccgatgttcaaggtcgcgcgccagcatcggcgtaatcccgataacaatcagcatcacttttgacagctcatccagcccgaagacgataaacagcatcggcaggagcgccagcggcgggatcatcgacaccacggtcataaagggtgacagcgcggcgcgactcatcgggaagacgcccgcagcaacaccgatgcagagaccaatcagtgaagagatcgccaggccggtcagcagacggcttaagctaatccacgtatccgcccacagcagatattcaccgctgcgcttgtccggcgtgaaggccatccgatcaatagcggcgatcatctgtgacaggccgggcagcagtttgtcgtgtgggttggcttcaagacgcaccgccgaactgataaaccagacggcgatcagcagcataaaaggtaatagcatcagcgtcaggcgcattccctgccggggatagcggttgatgtggcgcatggcaaatactcctgagatcggtgattacagcttgcccgcagcggccatcttcagatagctgtcgtcaaagcgcagtttgatgttcgctgtatcaccgacggtgatgttgccagggaagctcatgccgatgaagtcagcgctttgtgcaccctcgcccagtaatcccttatcaaaggagaacgcggcgacgcgttgcatggttttcgccagatcgggggaagaaacaaatgtctgggtttcggctggggtccagaacaggtgggtggttttcagctgcgacttgtatccggcgaggtcagtaccggaatcggcagccatcgcgctcagcgcctgcgcatctccggcctgcattttcgccatcatctcaaaccaggccccggtcagtgccttacccagcgcgggattatctttcagggtctcggtgttcaccaccatcatgtcaatcagttcgcccggcacggccgaagagctgaacacctctgtggtttgcggggttttcttgatcactgaaagctgtggattccaggcaaccgccgactgcacgcccttggtaccaaaggcggagacgatatcggcatcggaggtgttcacgaccttaacgtctttttcctgtaaaccggccttctccagaccgcgaaccagcaggtagtgcgaaaccgacagcgcaggaagatagacagacatccctttcaggtcgctaagttttttgtttgcgcctttcagcaccactccgtcattaccatcggagaagctgccggtgatcagcgccgtggaatcaatgccccccgccgcaggaatggtcagcgcatccatgttggtcatggtgcagccgtcgaaactgacccgcggtgtactggttgatcgactcgatatagtcattgagctgggtgatatgaattttgatgccgtatttgctggcccatttatcgatgattttctcgttgctgatggtgccccagggcatacagcccgcataaatggtccagcagatattgaactcttttttgaccgcggcgaaagatggcgcgctgaccagcagcgtcagcgacagaataagcgtcaggaggggtgatttcttcatggttgacctctggttggcacaaaaaaacgggagcagcgcaagacaccatttggtgccgctgtctcccgggcttttgtcccgccgtgtaacctcacagaggtcgccagctctcggaccagacattcacctgcgtgaaccggaaccctagccagctatttgctatcaattgtgtcgaacgctgcttactgttcagacttcagcaaatggcgtgccagaaattaaatcatgataaatcagataaatagaaggagaaaaatcaagaaggcaccgtgatggtgagtcagtaacgggcgttgcacataatcagtgccgggcaggcaagagatatcagaaccctcagtcagtctcttttcgtactcacatctatgccggaatgcagacccggaccgtgacgcccatcacttatcgctatataatccaatgcataacgtattttgaggatagttaatgaagcgcttctggcaggcatgcacactcggtttactgatactccttccgctcttttcccaggcatcgcgccagataaccgatcagacaggccgtcaggtcacgattcctgaccgtgttgatcgtattgtggtgcttcagcatcagacgcttaacctgctggtgcagatgaacgcgaccgataaaatcgtcggtgtgatggcgaactggaagcagcaacttggcgacagctatgcccgcctggcttctgagctgaatcagaaagcgacactgggggatctgacgcatgttgatcccgaaaaactggtggcgctgcatccgcaggtggtgtttgtaaccaactatgcaccgcaggagatgatcgacagcattaccgcgctgggcattccggtggtggctatctcactgcgtcatgacgagccgggtgaaaaggcaaaaatgaacccctctatccgcgatgaggaaatggcctatgacaaaggactgcgtgaagggattacgcttatcggcgagatcatcaataaaccggcagaagcaaaagcgctgattacggccaccgatgagggccgcaaaatcgtcagcgatcgcctgaaggatgttccggcggaaaaacgcattcgcgcctatatggcgaaacccggaactgaccacctacggttcagggaaatataccggcctgatgatgctgcatgcgggcgcggtcaacgtcgccgcagcgactgtaaagggattcaaaaccgtgtcgatggagcaggtcatcgcctgggatccacaggtgatttttgtgcaggaccgttatccctccgtcgtgaatgaaatcaacagttcaccacagtggcaggctatcgacgcggtaaaaaatcatcgcgtctggctgatgccggactacgccaaagcatggggttatccaatgccggaagcgatggggattggcgaattgtggatggcgaaaaaactctatccgcagaaatttcaggatgtggacatgaataagctggccaataagtggtatcagcgcttctatcgcaccgcttatcagggaacagagtgataagcgtactggcggcgggcagcctgaaagcggtctggcccgcgctgatggcgtactttcctgagccagttgaaacccggtttggccccgccggtctgcttcgcgaacggattgaagccggtgagccctgcgatctctttgcttcagccagtgaggagcatccgcaaaaattgctgaacgctgggcgagcgctggcagtcataccgttcacgactaataaactctgcatcacggttcgcagcgatcggctacaggcgggagacgactggtatcagctactcacccgcgacacactgcggatcgcaacctctacacccacagccgatccctctggcgactacgcgcaggcccttttcacccggatgggcaaagccggtgaagcggtgcgccagcgcgcaaaggcactggtgggtgggcgcgactctgcaccgattcctgcaggcaggctggcggcagaatggattatcctggaggatcaggcggatctgtttatcggttatgccagccatcgggcggccctgagtcagattgccgggctgacagtcgttgatatccctgcggctttcaattctgttgcgcgctacgcctgtgcagtcattacgccagaggcgcgtcggctggcggattttttagaatcggagcaggcaaaaaaggtactgcgggaagcggggtttggcggggagtaaatgccttttctgtcgcggatgactttgcgccctgccagcatgtcgctttaagggcgcgaaacaccgctcattaaagcttagcgaaatccaccttaagcttgtgactgatatgttcagcctgctcggtggcactatcagcctcgccagtcaggataaaagcgatcgcgaaggcgaaatcaaacgccgcgcccagatcctgtccactcagcaaattgccatctttcactaccgaggcattaacgtaaacgccatcggtgacaccttctgatgacgtcccagaactgacatagcgacgcccccttaaaagaccctgtggcgccagcactctggccgctgcggagcaaattgggcagaccaggcggcccgcctcatcatggcggcgaataaaatctatcactgccgcatttgccgccagatttttgctgccgtcaggaccacccggcacaatcaccgcatcaaataatcgctcccgattcgcctccagcagctcatcggcgacaaccttcacatgatgataactgttcacttcgcgatagggctgacaggccagggttgtaacctgaacgcccaggcgtgagaggatgtcgagagtgataatagcctcagcttcttcaaagcctggggcaagcagcagagcaacattcttatccatgaaaattcctttttaattggtgtggatgaagcagagagcgtttaatcctggtctgtgcaggcgcaccctttactgatccgaatcaagtctgagcagggtttttaaatggcagcgggcgacactaccgtggtgcgtcatgaagtaagtgcgcttaaaactcttccggctcgcccggcagtggctcggtcagttcctgcccctttacaccggcataggtaatcaccagttcggctggctcatccagggtgtaaccgcgatgcgcactgttgaccgtctcattgagggcttcacccgcatggaaggtgcgctgttcgccgctctctttatcctcaacaatcagggtgccggaaagaataaacgccgcattcggcattggatgggtatgccagggcaatgacgtatgggcaggtagcgagagccgcataacggtcagctcaggttcgccggtgggataggcctcaagaaacgtcaccgttccaggcatggctgctgcgcattatttcaaccgcgttaatttcgttatcttgcttcgacatggttaatccctgttaataatcaatagaatgccagtagtgaccgataagtaagcttagaagaaaattgcgttggtgcccgcctgcgttttaataagcctgttaacaggaattttccgccagcgaacaaaaggatgaaaaccggccattagcggactggctgaattgctgattaattaatgttcaatatttgcgttgtggttataagatatattcctcagtcagtacgcaacctgtgagttctgtattatctttgaagtcatcaaccacctgagggatttctgataatgaaaggtctgtttacggcattactcgccagttctgttctactattatccgcctgctcaaaagatgacgataacaaagttaaagttgcgattaataccgggcctgatgaagcaatctggcaggtggtaaagcaggtggcgaaagataaatacaagctcgatgtcgaagtgcttaacttcaatgactatgtgctgccaaatgaagcgctgaataacaaagaagttgatgctaacgccttccagagcctgccttatctggaatcacagtctaaagagcgcggctataagtttgcggtagtgggtaaaacgttcgtcttcccgattgctgcctattcgcacaaaatcaagaacatcagtgagctgcagaatggtgccactatcaccatctctaacgaagccaccacgctgggacgcagcctgctgctgctgcaggcgcagggtctgattaaactcaaaccggatgtgggttatttaccgacctcactggatatcatcgaaaatccaaaaaatctgaagctggttgaagtggacaccccacagctgacccgcaccttagacgatcccaacgtgaccctgtcgatcattaatactaatttctcggctcaggctggattatcagcgcaccgcgatggcttatttatggaaagtgcctcatcgccttacgtcaatgcgctggtatcacgtgaagataataaagacagcgataaaattcagaagctgaagtcagcgctgcagtcaccggaggtggcggccaaagccgaagaagtttacaagggtgatgcgattaaaggctggtaattcgcctgataatcgatcattaacgatcaaaaaaggccgcactctgttgcggccttttttatatctgcacttttactggcacatctgccagcacttacacatccgcgccagcccgcaagatcacaggaacagttacgcagctgcgccttttggctgagcagagagatgccctgcccacagactggcgacccatttcacccctttagacgtaaaacgtgcctgagagaaagcgtgctgattttcgcccgtgccggtatgcagcgtaaagtagccggcctgcatatggtagtgctgcggcgtcagggtgccttttgcgcgatacataatgttgcgctccagcagaaactggcgaaactccggttctttcactttcagcattttgcagagctgccgaaaacccagcgagtcatcaacctcaacgaagttatcaaagaaacgccgccttgggtgccgagagagccagctgctgctccgccgcctgacgctgttcaaactgctcagcccaggcgcgagcggcttcagccggattggtaaagtcaggcagatgggtcgtcttctcgcggtcctgccagcgatccagcacttctgcagtgaagcctggcgacaggcgtgccacggccagcagcgagtcacgcttgcacagacggaactcctgacgcacttccccttcccgctcatactcattcacgctgagcggctgggagagacgctgagccgtctccagacttttgattaaccgcttcacttctccgtgtgtaataccggtcatctgagccagttcacgactgctcattgtgaccgattgttccagagatttgaggctttcagttgaaatcatcatgggttcacccctcgctaacgctaccaatacccggcgggcagtcgattaattatacaaatacctgttcaaatatccagtattttatttaagcaataacgtaactggaagctgttacgcaaacaacagggtgtgaggcggtttggcgggctgaagcgtgcgtgttgaatgctttgcaggaggcgttgcgggctttagcggcagcataagcgggtaatccatcgctcagttatttacatataatcacaatgttggacacagactctttacattacagtatagtgaaggctgtcagcaggttacaggcctgccgcgcgcactatttttgattcggggtgcagaggcgcaatctggcccgttaccactggatgtcaccttttactggagtaagtcatgcagccgttgaaagtcgcctttattaaagctaactggcacagcgaaattgtttctcaggttctgacaggattcgaacaggaactggaaagccgcggtacctcatatgagattaagacatgggatgttccgggcgcttttgaaatgccgctgctggcgcaacgcctggcgcagaccggcaaatacgatgcgattgtctgtgcagcactggtggtggatggcggcatctatcgccatgattttgtcgcgcaggctgtggtaagtggtctgatgcaggcgcagctgacaaccaatgtgcccgtcttctctgtgtcacttacgccacataatttccagccatcggccgagtttatcgacttctatactcagcatttcgtgaaaaaaggtcaggaagcggcgcgtgccgtctgccagattcacgccctggaactctgatacgactgtaacgaatgctgacaatgcgtttgcctgcgctgttaaggagagaaagttggaaaattcacgtccgcctctaccgccatttaccctggctgcacaggcgattgaaaaagtccggctggctgaggatggctggaacagccgggatgcggagcgagtcgctctggcctattcagcggacagtaaatggcgcaatcgcgatacctttctgaccggccgggcagaaatcatcgccttcctgcagcaaaaatggcagcgggagcagcagtatcggctgattaaagagttgtggagttttgaccagaaccggattgcggtgcggttcgcctatgaatggcatgacgagcaacggcagtggtatcgctcatatggcaacgagaactgggcctttgatgagcagggtttaatgcagcagcgttatgccagcatcaacgatctgaaaatcagtgaagaacagcggctgtttcactggccgcagggccgacgccctgacgaccatccttcactgagcgaactgggattatagtgccagcccttccagcggagagcgcagctctccgccgtcatccactcagccctgctcgtccttgttctcaacaaaggtcgctttgttgcgtgtgaccgtataagccactttttttacatcttccggtgacgtggtcacttctaccggtgcaatggtcacccgacccataccaaacagagtgggtacatagccaccgacctggtgttttccggccggaacatgcagcagcatgctttcgccgttaggcaatctgccggcgtctttaccatctacagtcaggaatacactggagccatcatctgtgcgggtcttgatgtgtgagacatcaatctgcgttgggccagcagcaaattcatctggcgcatcgctggcggcatgttttgcacagccagtcagtacagcagcaaccgttacaacggcgagactaaaacgataacgcattgggcactctttctcctgatcatcagaacccgctattttagcgatttagcgggaggatgtaagggggataagagtcggcatgctcttaaaagaggcttaaaagtaccgatttcccggtatatttgcgtaaagaatatttactgaataaatacacagtatttttattgcctgatcgcagcgcttttaacctgctgatcagcataaatttaatcggagaataacaacgaataagcgtagcgtcacaggcacatagcgccgatttgccttaactctgcctctattaattgactgttataaggttcatagtggtggttcatccccggttaatcccggcggccttcccctctacagagggcacgatatgcattcttataccaccgatactgtttgcgccataaccggcacccatcccgctaacctgaagagctggatgaagcagggattactgacgccgcagcagtatcaggaacgctggagtgatcatcacctcagtgaaatccagaccctggttggcttaacagccactggcgcgacgctcgacgaaatctggcaaggtcagcaggctgcttcgacggtcaccacctttggctgggcggcgcgcaaaggtgacctgctctggcagctggaatatggcacaccgctgtcgctttcacgtcagatgcacacgatgtccagccactatagcggtgatgatttcgtcattaatctgctgcggccgctgagcgcctggctttacgccgatctccgtcggggagcgtcacgtcgcctcaaccgttttgagcaaagcgtgcagcagcaggcggataaagtcatgcgcgcctcatcgcgcaaggaatcttctattcctctgtttctggaagcggtgagcgtacttgataaaaccgaaatctggcttgaagccattcgtcttactgcgatgggctttaatgtcgaggttgactcgcgtgcaaccggacagccagccgttaaaactgacctccatcagcatcatgtgatgtggtgtggtgccggcatcagtcagcagatgcaggactattttgaacagcagagtctggatggtcatccggtaatgctcagtggacctgattgtaacctgcaatttgcccaatccaacgcctccagcgctgcctgacagcaggcagcgccttctttacccctgtttttccgcgccagtaaataatttttttcgttaagaatctcttaaggtggttccgtatactggtgccacaaccctgactcattgacgagactaagatgaaaaagaccttactgaccttcagccttctcctgttaccactcacttttactgctgctcacgcggcctctggcctgaccggttgtgcagccaaaaagcaggagattgagacccagctctcttttgcccgccagcacaataatacccatcaggttgccggccttgaaaaagcgctgagcgaagtgaatcagaactgtaccgaaagcagtctgctaaagcagcgtcaggaaaaagtggcagagaaaaagttgaaggtacaggaaacgcgaacaggaactggctaaagcgaaagcagaaggccgcagcgccagcaagatccagaagcgcgaagataaactggctgacgctcgccaggaactgaaagaagccgagcaggctctgcatcagtaaaactcattctggccagccactgcgctggcccgttattctcctttccccagccctgaccctctctcctttctaaatgcctgattagcctgcgctattaacgtccaatccattactttatgtaatcctttgattacttattctcatgcacttaattggtgcagtaaagtcaacatggttacgatcaattatttaactttttgaacgccctcaaagatttgaaagatagcgatatttcctgtcctatgcagaaaatacgcactccacgcgcatctttattcgtctgtaaggggccagcaatactaatctattcacttaccctgccccaaaacagggcattactgcgttgtgtcatggctgatgccacatcttatttgtttcaggagtgttagattatgtcggcgcaatgcaatgcgctctccatccacggctccacacaataaataacttcattaagaaaggttttttatggataagttatcttatgcgtctgaaagcagcacatctgcctggtccacctatttacagcaaatcgaccgggttgcgccctatctgggcgatctttcacgttggatagatactttgcgtcatccaaaacgtgcgttgattgttgatattcctctccagatggatgatggctcaattcgccatttcgaaggctatcgcgttcagcacaacctttcgcgcggcccaggaaaaggcggtattcgctaccatccggatgtcgaccttaatgaagtgatggcgctctccgcatggatgaccatcaaatgtgcggcggttaacctgccttatggcggcgctaaaggcggcatccgcgttgatccgttcaaactgtccgacggtgaacttgagcgactgacccgccgttacaccagcgagatcggcatcatcatcgggccgcaaaaagatattcctgcgccagacgtcgggaccaacagcaaagtgatggcgtggatgatggatacctactccatgaaccacggcacaacgattaccggcgttgtcacgggcaaaccgattcatctgggcggttcactggggcgtgaaaaagccaccggtcgcggcgtgtttattaccggacgcgaagtggcacgccgtgcaggtattgaaattgaaggcgcacgcgttgcggtccagggcttcggtaacgtcggcagcgaagcggcacgcctgtttgatgaggcgggtgctcgtgtggtagtgattcaggatcacaccgcgacgctgtttaatgccgatggcatcaacatggctgccctgaccgaatggcagatcgccaataagcagattgccggtttccctggtgcgcagagcattgataaagaggcgtttctggaccacagggatggatattctgatcccggcggcactggaaggtcagattacccgtgagcgtgctgaagtcctgagttgcaaaatcgtgctggaaggcgcaaacggcccgacctatccggatgccgatgacatgctggccacccgcggcattatcgtggtgccggacgtggtctgtaatgccggtggcgtgaccgtcagctacttcgagtgggttcaggacatggccagcttcttctggagcgaagatgagatcaatcgtcgctcagacaagatcatgacggaagcgatggtacacgtctgggaaaagtcgaaggagaaagattgctcgctgcgtaccgcggcctatatcgtggcctgtgagcgtattctgatggcgcgtaaagatcgcggtatctacccgggttaatgcctgtggcgctgttgcctgcagcagcgcccttttccctgactacttcatcagcacctgaaacttcggattaaattcatcgaaaatcggtaaagcggcggcgccgagagcggctgtatcgctgccggtcatgccaatttttagtcgcatatcgttaagatagcgtccgcgcaccgactgataaagcggcggcaatcgctgcaccatctgctccagcaacggcgcaggcatcatcccgccaataattaccgcctcagcatcaaacaccgactccagaatattgatcgcctgacgtaacggcgtcgtcacattctcaatccatgcggtaaaacgcgcgggttcaatctgtaacagatcttcgggcagcgcccgcattggatcgagaccgcagaattcataagcggcctgcagcgagacgtagcgctcgaggcagccctgatttccgcagtagcagtcgcgaccgcccggctcgaccacaatgtgtccgatttcgcccgcattatgggcgtggccggtatagatatgaccatcggtgaagatccccgcgcccaggccggtgccgatatagagatagataaaggagttcaggtggcgcgccgtgccgtgaaagcgtttcgcctatggcggcgaccgtagcatcattttccagcgtcactggcagaccgctaatggtggcgagttcagcctcgatatcaacctgctcccacccgttcagcgtggtcggccccactgatgaaatgccctccacaccaaaaggccctggcatcaccacgccaatccccagcactttttgccactgagtacccaggaaggcgcgcatctcctccagcacgctggcaatgcacgccagggtggcagcaggctgaggcttttgcaccagaacgaggcggcggaaacgcacttcgccgctgagatcgaccagaaccagcagcagcgtctggtgatcaagatggatgccgatcgaccaggcactggtgggattgagcgtaaccggaattgagggctgaccacgcccgctgcggcgcggctggcggctggtcagcagttcggcctgctccagttccgccacgatattcgagacggtctgcggcgtcagcgccgtcatgcgggccagttcggcacgggtcagttcaccgtgcaggcgaatggcttcaatcaccacacgtcggttgtgcgcccgcgcatgttcaaggttggtacccgaggttttcatgttgttttccatttcagcgggacccgacagtattggtctccgaatgcattcgggcaaacaatatctttgatgctgcacgcaattctcgcgcatcaggataggcaattttgccataaaagcgcagtctgagtttcagcgttgttacggctttgttgctatgccctccggcactgtggcacgccgtttgcttagattcagacaggtcagttcacccactgaccaaaattacgcccccgattaaatcaatcaaattgatttaattaaccgacagcctgttgctgcacagtggagaagaccatgtcacagcgttacacaccccaactaaaagccggttttgccgccttactgatgttaagcgcaggcagcgcggcggcggccagccagatcaatgccctgtttatgacccaggcggcttacagcgaaaatgatatccgcgcgatgacgcaaaattttcagaagcagcacccggatgtcagcgtcaatctggagtttgttccttatgaggcgctgcacgacaagattgtggcggcgcgtggcgcgggcggcaatggctatgatgtggtgctgttcgatgccatctggccagcggaattcgcccgtttcgatttgctgcaggatgtcagcgcacgcattacgccagaggataaagagaaggtcttcccgggcgcgatgaacaccgtggtttacaaaggcaaaacgctgggtatgccgtggatcctcgacaccaaatacctttactacaacaaagcgatgctggctaaagcgggcatcaccacgccgccacagacctggcagcaggtgctggatgacgcgaagatcatcaaggataaaaagattgtcacctggccgctggtctggagctggtcccaggctgaggcgctggtgtgtgactacaccacgcttgtttcaggctttggtggtcagttctatcagaaacggcaaacttaacttctccagcccggcttcactcaaggcgcttaacctgatgaaaagctcgcttgatgagggcctgagtaacccggcgtcgcgtgaatatctggaagaggatgtgcgtaaatcgttttctaatggcgatgcggctttcgcgctgaactggacctacatgtacaacatggccaacgatccgaagcagagcaaagtggcgggcgacgttgggatcatgcctgcgcccggcgatgcgccaggaaaagtgggggcggtaaacggctcaatggggctggggatcaccaaaggcagcacccatgccaacgaggcgtggcagtacattcagtacatgacctcacagccggtacagaatcagtatgcgaagctcagcctgccgatctggaaatcctcttatcaggatgaagcagtgaaaaaggatcaggagagcctgattgccgcggcggacaaatcgctaaacgtgatgctgtcacgtccggagaccgctgactattcccgtctgtcgaaccagctgcaacagcagttacagcaggtgttgctgggtaaagccccggcgcaggacgcgatggcgacggttgataaaagcgccgcccggctgcgttaaggagttatgatgctgagtttgcgtcaacgcgaacagcgtcaggcatgggtgctgctggcacccatgttgctggtgatgctgctgttaaccgcctggcctctgctgcgtaccatctggctcagctttaccgatgctgcgctgattggcagtggtgaaacgcctgcctggattgggctggaaaactatctctatgcgcttagcgatcccgactttcgggcgtcgatctggcgcacactctatttcacccttgtgtctgtcaccgttgaagggattatcggcgtgctggtggcgctgctgctgaatcagaaattcatcgggcgcaacgttttgcgtgtactggtgattctgccgtgggcgctgccgaccatcgtcaatgccatgatgtggcggctcaacttcaaccctgattacggcagtatcaatgccctgctcagccagctcggtatcattgacggttatcgcagctggctgggatcgccggaggcggcgctcaatgcggtgatgtttgcggatatctggaaaaactatccgctggtcaccctgctggtgctggcggcgctgcagtcgatccccgaggatctgtttgaagcggcacgactggacggtgcctccgcctggcggcgtttccgggcgattaccttcccggcgattgttgcgccgctcggcgtcgcgctggtgttacgcaccatcgatgcctttaaaatcttcgacatcatctacgtgatgacgcgcggcggcccggtggacagcaccaagaccctgagctttttcgtttatcaggagtcgttcagctatctgcgtgccggcagcggtgccgcctacgcgatactgatgaccctgatgtgcgcccttctgatcacgctctatctgctgatgttatggcatcagcgccgccggagtaccgcttatgaaaactaaactgcgacgggtcctgcgttacggggctgcgctgctggtcgccgtcagcattctggccccgatgggctggctgtttctgatgagcgtcagtttctgccagcgatctctcccgcgtgccgctggagtggctgccgcgtcaatgggatttcagccgctatcaggggctgatttcgctggcaccaaatcagcccggcaacgttttcctgcacgcgctgggtaacagtttgctggtggcgacggtggccacagcgatctcgctgctgctggcgatacccgcggcgttcagcttctcacgctacagtggtcgtgatgcctggctttccggcgctctggcaatctatatggtgccgcccgtggcgtttgtgctgccgctctactttctgctgcaacaactggggctgctcaacacccgtcccggcctggtgatggtctactgctcactgatcctgccgtttctgacctggatgctgaagaaccagttcgactcactgccacgtgatatcgaacaggcagcacggcttgatggcctgcgcttctggcaggttctgctgcgcattacgctgccgctggcaaagccggtgctgggcgctgccgcgctgttcggctggctgctcgcctgggatgagtttttctacgcgctgctgttcaccagcaatatttcggcacagaccctgccggtcgccattgccggttttaccgcaggacgcgcgaccgatgacgggctgatcgcggcaatcggcattctggcttcggtgccgccactgtttattgccatctggttgcagaagacgctggtcagcggtctcaccagcggcggaagtaagggataattatggtcactaccctcacgcccaccctctatgtggtgggcaatataaatgttgatttaatcatgagtacgctcagcgactggccgcagcgcggcacggaagtgatgctgcagcacagcgagttacgtcccggcgggtccgcaggtaactgtgcgctggcgctggaggcgatgcaggtgccgcatcgggccattgccaatcagggcgacgatggcttcagtcactggctcgccagtcactttcctcatagcgctgcatactggccgcgctatgcctgtgaaacctcgctgacggtaggcgtgacccatcccgataacgaacgctcgtttctcagcaatcacggccatattaccgtgctgaccgcggacgatgtgctggcccagttgccgtcgcaggcgacgccgggcgacatcgtactgctgtgcggcacctttctctgtctggaactctatgatcactacccggcgctgctggccgcgctgcaacagcgtggcttctgtgtcgccgtggataccggctggccgcctgcgggctggagcgatgggcttcgcttacagattggcaactggttagcggactgtgactggctgctgctgaatgaggtggaagcgctgggcttatcgggcgcagaaactgctggatcaaagcggtaaacagctggcggcccggctcagtggtcgcggcggctgtgtgattaagtgtggcgcagagggtgcacgtctctggtctgccgcctctgtgcagtatgctgctgcccagccggtaacggtggtagataccattggggccggtgacagttttaatgccggttttcttactgcactgctctatcaccagccatcgcacacggcgctgcgctggggcattgaagtggcatcacaggcgataagcagctctccgcgccgctatcccagctggcaacaactccaactatcaaatgaggtgcgctgaacatggccagtgttgaacttgtacaggtggcgaagcgctacggtaaacagagcgtgcttcacccgctggatttaaccattcctgatggcagtttcactgtgctggtcggcccctccggctgcggcaaatcaaccctgctgcggctgcttgccggtctggataccgtctctgacggggcgatcatgctggataaaaaacagattaacgatctcgatcctgctgaccgggatatcgccatggtgtttcagagctatgcgctctatccgcatctcaccgtcgcggagaatctggcgtttcacatgcaggtgaaaaaggttaagcgcgaggagcaaaaaagcaaaatcgcccgcattgccggcattctcggcatcgatcagctgctgcagcgttatccaagagcgttgtcgggtggacagcggcagcgcgtggcgatgggccgcgccatggtgcgcaatccgcaggtgtttctgtttgatgagccgctttctaatcttgatgcgcagttacgcatggagctgcgggccgagattaagtcgctgcatcaacgtttcaaaaccaccatggtctatgttacccacgatcaggtcgaggcgatgacgctggcggatcagattgtggtaatgaaggaaggggtcattgtgcaacagggtgcaccgctggcgatttatgaccgcccggtaaacaccttcgtggcgcggtttatcgggtcaccgccgatgaatctgctggatgcccgtttccagacacgcgatgggctgcctggcgtctgctgtggtcagcagtggctgccgttgccgcgtcgctggtacagtgcggcacagcagcaggccgatcagccggtcacgcttggcgtacgaccccacgatctgatttttgatgccagcgggcaacccgcggtggtcaatattgttgagatcaccggcgaatcgaccctgttacatctgaactggcagggtttcccgctgcatatgcaactgaccggccgtagcgatgccttgcctggcggcacgctgccggtgaccgttaatccggataaaatgcacttgtttgatgccagcagcggtgtgcggctgacggaacagtgataaaaataaacccgccagcggctaatgccagtcagttaagcgacagatgataacgcagtctggtaccgggcaggggctggcggtcctcgcgccgctgcgcggtcccttcacttcattcctctgcctgacggaccgccggggatggcacatcctgtgccgccccgcctttcgcccgcgtcctgcgggctctcctggcagactcattctgttcagcgctgcggattgcctgcccctgccctgcaccggcctgctctgaaacttcagtgtgtattgttaaaaaagggcacgagagtggaggcctgagcgcctctgctgctgaaagggctatccgcagcgctgaggcgtgacgacgggccagaagtccacgccgggaagcgtggacaggtcggggccgaccagggagggccgatccccgaacggttcgtcggcacgacgtcaaagccgaaggtaccgcgtgagcggcgcgaggacggcccggcagcagcagaggtgcgctggcccgcactgcggctcgctcgcccggaaaaaaaggctgtcacgtttaaccgtgacagcctttacaaatctaatcttaactaatcagcattacgccagcggcgagttttttattttgtgaagcagagtctggatcaggaaacatacgcctgcttacgccagatgaaactgctctaccgtctgtgacagctgctgcgcctgatcctccagcgaactggcggcagccgacatctgctgcaccagcgcggcgtttctgctgggtgacgccatccatttcattgacggcaatcgttacctgactgatgccacgcgcctgttcgcttgatgctgtaacaatctcactgataatcccctgcaccgaattcaccgcctgcatcatctcctgcatggttttaccggcatcgtttaccagccggacgccgctctcgacccgcacgctcgactcttcaatcagtgcgccgatctctttcaccgcgttcgcgctgcgctgggccagattacgcacttcagaagccaccacggcaaaaccgcgtccctgctcaccggcgcgtgcagcttctacagccgcgttcagcgccagaatattggtctggaaggcgatactgttaatcatggtggtaatgtcgccgatctttttcgaactgtcatcgatctgcgccatggtctgcaccacctcacccaccagcgaggcaccacgactggcgatgtgggtagcgttttcagtcaggctggttgcctgctgcgcgttatcggcattcaggcgaatcgtggcgctgatctgctccatgctggctgcggtctgctccagcgcggcggcctgttgttcggtgcgtgacgccagattgaggtttccgctggcaatttcacccgctccctggcgtactgattcactggaatctttaatctgcccgacaatctgccggagctggctttgcatggtatccagggcgaaaaagaggctgctgcgatcgccgtttttcaccacaatcgcgttatccagcttgccatcggcgacggccagtgcaatatgcgccgcttcagccggctcaccgccaatcggacgcaacactttacggctgaacagcatgcccagcaccgtcccgaccagcagaacgctcacgaccatcaggatcaccgcccacatcagctgccggtttgaggcggccatcacctgactgaccggtgcaaccacgcccagataccagggtttgtcgctgttacctatcatcaccggctgccaggtgactaaagcgtcttcacccagcacggcatcaaatcgctggacgacttttgacgtaaaaccctctttttcgcctttccagggcttcccggcttcatctttcactggcgaagagaccacattcccgccgttagaaagcagcagcgcataaccgcttccctgccagggtttgatctgattcactttctgttgcagtgatgccagtgaaatgtcagaggtaacgatcgcctttaaggtgccctgatcgataatcgcggcggcgacggaggtgagcaatgttggcacgccgttataggcatagctatagggttctgtgagcgtatctttttgtgttttttgcgggatcagatagtaatcgccctgacccggtgtcagataggagagcagcggatgcatcgagtaagtacctgacgcgtcacgatcgacaaaaaaggcatagcggccctgcggtgcctgacctggctgtgaagcgaactcggcatcacggccatcaaacgcattctgttcaaatatcactgacatcgacagatagtcagggttagcacgcagcgcatactccatcaccttatcggccgctttgcgatcggtaatgccgacgtggggcaaggcaatcagactttgtccgaggtgactcgcgacatcacgtgcatggctcaattcctgctgcacctgtaaggcacggctctgcgcaatctgctgcagatattgttcggccagcgccttctgctctttaccggattgccagctgagaaccccaatagtcacggtaaatcccagcactatcgttaaaccacccatgatcagcatctgggcacgggtactcattcttttcttatgtgttaactgactgaccatagtgcttcccctgaaatttacctggctcaatacctccttgtagttatggtgctcctgagatcatctatcggcggcgtttttttgaactttaatggccatttctccgccgtgatgggggtctcacagcgcgtgattacgggaagttgatcgcaaaggtattatggcgctgcgaatgaacggcctttttttgatctgcaacaatactggtgcccgccattactgtcagtttatgtcaacagttgctgtagcccccttatcgcagtggagatagaacaatgatcggtaaatcaggattagctgtcgggatggttgtctggctggcgtatgtcgcctggatcgttcactactattcagacacctttatgcagtttctcccgctaagcaaacaggaccttcgggtccttttttttgccctcacttcagccgggttggcctgtgagccaaatattcgctattatcgactcattctgtgagccgaataacctcctttattcggctcatccacccttagcgtgagccgattatgagcgttacctggatctggcaacagccggactggccccattttcagtggcaggacgccgtgctgttaccgcgcctgcgccatctgcagcagcagcgcggattgctgctgggccgtgccagcctgcattcagacagtgaaacccagacgctggataccctgctcagcaatatcctctcctcttccgcgattgaagaggagcgggtcaacgtgcaatcggtccgctcatcgctggcgcgtcggttaggcgtgacggaagagcagccctatccggtctccgatcgttcagaaggcctggctgccatgatgctcgatgccatcaacaaccgcagccagccgctgacgcctgagcgtctctgtcagtggcatcgctggcttttccctgccgatgagtggacggtgcagcgcctgagcgtcggcacgctgcgcggcagtgagccgatgcaggtcatctcaggtcgcatcgatcgtcccacggtgcattttgaagcgccgccgcgacagggactggagccgcagctggcgcagtttattgagtggttcaacagcagtcagcatgatgtgatgctggacccgttgctgcgcgccgccatctgccacctctggtttgtcactctacacccttttgatgatggtaatggtcgtatcacgcgtgcgttaaccgatctggcgctggcgcaggccgacagtcagagcatccggctttatgccatgtcacccgccattctgacgcagcgtgccggttattaccgcatccttgagcagacgcagaaaggcggcctggatatcactcactggctggtgtggtttcttgatatcctggatgagagtctgcaacaggcgatgaacgtcatcgatcgcactcagatgaaagcgcgtttctggctgcggcatcaggggatgggattgagtccggaacaggtgaaagtgctgaaccggctgctggatggcggcgagcagggtttcgaactggggatcagcgccagccagtatcagaaggtcgccaaagtgagtaaagccaccgcgacccgtcatctggccgatctggttgaaaaaggctgcctttaccggcttgaaggcggaggcaggagtacccgctatcaggttaacacccgcgagacgccctgagccgggctgttttaactgctaaccgggagtacatcgcgatcgttgtgatgtactcctgagtgcgggaattactctttaagtgaagccccgttggtcgcaatgacctctttataccagtaaaagcttttcttccggctgcgggccagcgaaaccttccccggtatcatcgcggtcaacataaataaaaccgtaacgcttagacaattcggcttttgatgcgctgacaagatcgataggtccccagctggtataacccatgacctccacgccatcgtcaatggcctcgcgcacctgaaccagatgatcgttgaggtagctgatgcgataattatcctgcacgacgcccgttgcatccggtatgtctttggcgcccagtccgttctcaacaataaaaagcggcttctgataacgatcccacagcagattcagtaaggtccgcaagcccaccgggtcaatctgccagccccattcagaactctgaagatgaggatttggcaccatgctcagaatgttaccccgcatctgctgattcagtgcttcatcggcggtcacgcagccggacatgtaatagctgaacgagataaaatcgacggtcgactggagtatctgacgatcggcatccgtgatatccagctgaatattattctcgcgaaagaaccgcaacatatagcccggataaacaccacggcactgaacatcgccaaaaaattgccatttccggttctcctgcagcgcttccagcacatcatcaggcttacaactgagtggatagaccagccctcccagcagcatattgccaatgctggcgtccgggttaatctcgcgacaggctttcaccgccagcgcactggcgaccagttgatgatgaatcgcctgatacacctcacctttgctgctggtttccggcagacctaccccggtcataggcgcgtgaagcgacatgttaatttcgttaaaggtcagccagagtctgactttcttcctgtagcgggcaaacaccgtgcgggcataatgctcaaagaagccaatcacctgacggttaccccagccaccatactgcttcaccaggtgccagggcatctcataatgtgacaatgtaacaagtggggtgatgtggtgtgcggccagctcgtcgaatagccggtcataaaaggccagaccggcctcgttgggttgttgctcatcaccgttcgggaagatgcgcgtccatgcgattgaaacccgcagacagctgaaccccatctctgcaaacagcctgatatcgtccgggtagcggtggtaaaagtcgatcgcgatgtctttgaggctttggctgccctcaacgcgctccgataccgggccaaaaattccctgtggctgaacgtcagaggtcgagaggcctttgccctcttcacgccatgcgccttcaacctgattagcggcaacagcaccgccccataaaaatgaatccgggaaagttttcatcctgttctccttttattgacgagtgacgctgagtaaaggcgtacctgcagtgaccgcagtccctgccacggtcatcacctcaggatactcatcgctgttagtgataatgatcggtgttgccaggtcatatccggcatcgagaatggcctgacgatcgaactccagcagcagatcgccggcactgaacgtgtcgcccacttttacatgtgccgtgaaaggtttgccgtcgagcctgacggtatcgatacccacatggatcaacagctcaatcccgctgtgactcagcagccctatggcgtgacgggtctgaaacagggaggccacctctcccgcaaaaggcgcaatgactttattatcagaagggatgatggccacaccctgtcccagcaggccactggcaaaggttggatcgggaatctgaccaagccccagaaacggtgcccgtcatcggtgacagaatgtcatcttcaccaggggtaaccgggagcgctgcgtctggcgtcgtgtttcggggcataccggctaccagcgtcatgccgcaagccagtatcagcgcgagtagcgttccggcaataccgccccataacgtggaatccacaccgccaggtgggatcatctgtgcgatggtaaagatgttggcaaaaccaaatgaataaacgtgggtgctgctgaagccgacaatggcaccgccaatagcccccgccacacagccaaagataaagggacggcgcaacggcagattaacgccatagacagccggttcagtgataccaaagatccctgcggtcacggatgaacccgccagcatcttctgtcgtgcatcccgactgcgcagaaacacccccagcgccgcgccaacctggcccatgacagcaggcaacagcatgggcagcattgagtcatgccccagtacggcaagattgttgatcatcagtggcaccagtccccagtgcaaaccaaaaatcacacagacctgccacaacgcgcccagggcggcaccagccagccagggtgccagcgcataaatccactggtagccgttcgccagtatctgacttaagcccgtggccagtgggccaatcaccaggaaggtcagcggcacggtgacgctcagacagatcagtggcgcaaagaagtttttcatggaggcgggaagtcgccggctgctctgtttttccagccagcaacttacccaggcagcgagaataatcgggataaccgacgcactgtaattaaaccaggttacagggatgccgagaaacgcgtccgtcatttcaccggactgctggctggcattaaaagctgcaatcatcgtcgggtgggtcagcgccccaccaatcaccatggtaataaagggattgccgccaaatttcttcccggcggtgtagcccagcaccagaggaaagaagaaaaacagggcatcactggctgcaaaccagattttatacgttccactttcaacagaaagccagccacagaccacggccagcgccagtaaaccttttaggatcccggaagcggcgagaatgccgataaacggggtaaaaatgcctgatacaatgtcgatcagatgattgaaaacattacccccggtcttttccccttctgttgctgcagaaagctcatcagccagcccagcttcactacgcacagcctgccagacatcatgaacgtggttgccaatcaccacctgaaactgcccgccgctttcaacgaccataataacgcccggatttttcttcagtccttcagcgtcggctttatggttgtctttcagtttgaagcgtaaccgggtggcacaatgaaccagacttacgatgttctcccggccaccaatatggctgaggatatcttgtgccagcgtgtgatattccatctcgatttccttacaaccgatgcctgcggacatcagttaactgagccaaaaatgaaaaaaacctgagaacgtcctcctttcagaggccgcgctcaggttttgcctgcgtaaagcagtaacaatccggtttatggagcttattgcccctcttttctcacccgttcgatgttaatggcgagaaacatgatctcttctgcggtcagatcacgctgatagctttgttgcagatgctgcgcgattttcaccgcacatttccaggctttgggatagttatcttttactgctgtatgcagcgatacatcgtcatcgtccaccacggtacgcgtcagcatccgctgagcaaaaaacttcagatgagtgacaaaacgctggtaactcagcgacgattcgatgtactccagctgcagttgatacttcaccagttgcagaatctcctgcataacccgggtgacatgcatgacttccggcatttcattattgagctgcgccgtcaccagatgtagcgcgataaagccggcttcatcctccgccagttcgacattcagacgacgtgaaatgatagccatggcctcctgacccagttcgaactctttggggtagaggcgtttgatatcccatagcaacacatttttaattgccagaccttttttctgcctttcaatggcaaagtagcagtggtcggtcaatgtgatatacaggctctcctgcaatgtccccagacgttgtgttgccagatcaataatgcggtcgcaggtggtcatcacttcaggagggatctggtgtaacaactcctccagacgacgtaccagcagatcactttgcagcgcaaataccttctcaatatgcgcagcgttgagactgtcaccgatgcgcttctggaaagccagtccacgccccatcacgacctgttcgcgtccctgctcatcctgaaccatcaccacgttgttattaagaattttggcgattttcatcggaaccccagaaacaaaaaaacctgacatccgacagaggccagaagtcaggttttgcctgcctaagcagtaacaatccagttcgggaactctatcagttttagtcgtgacctcaatctgtcagggcaaaaagcgtgacagcgatcgaaatcctcttattaacttaaaaagtgactaccgtgttgagttcagtcacccaggcatcctgcgtgtggcgatacccgccggacgagaccagtattaaagccgggggtgcggttccgggcagcaaaaggggtatgacgctcagtggaatgaaaactcacgttatgggaggaagatagtcatgcgaggaaggtcgtctgaaaaatcgactaatagactgcagtgttcattaactgccatttagcgattaaaaacacaccgctttgaacgcttttgtcactgatcacaatgttttgatttatcggacgaaaagcccttaatgtgtgaaatcgttctgttgagcgtcagagcccgttatgcagggtaaaagagtggaaggaagactatctgtaaaaaagttagcaggagaacagctcaaaccgctattcagaaacagcaacgccggaaggttcgcttccggcgctgttgagattacgcggctttaacggcgcgtactttctttgcaacaggctcttcctgcggctcatccgcgctatcgtctgagacagcttctggctgagagacgggtgctgctgccgcttccggcagtttgctggtgcgcagaatatgctgaacggcatctttctgctctgcaatcagcagacccagcgtttctgcctgagattcatccagtgcaggttgatgctgtaacagccagtcggtgaaggcttcggccatatcgagcattttgtcgtaggcatcggcctctttcttattggcaaacgtcatcttctcttcaccctttctgactactacaaattttgtttcaacagccatcttttcgccctcaggtactgtgtatacatacagtatatcatgccgatcctgctttgccagcagagaatagagtttatcggttgtgcacgggctaaccttaacctggcacaggcttttttcatttttcctgacacattctccgccgcgagggtcggcggctacaccagcagctcttcaagaaacatcgccaatgccttacggggatcgtcctcttccgagacgatcacctcgatcccccactgccccagcacctctttggccaccgggttgttccggttagtgaacaggtaggattttggccgggcggttgccagcccggtgcggccccacatcttggtcagacggtaaaacagcaggcgaatattgaaatcactgatgctgtagccgacaaacagtactgagttgcccatcacatcgtgagtcagtttaatgtcgagcggcgaatcaaaatagaggcgttcaaaatagctgctctcatcgagcacgattgaggtgtcatcatcaaaatcaccgtgcagcttgatgatgtgacgcttatcttcggtgagagagaccaggtccgcggcgttggccactttgtaatagggtacgccgtgcgcttcatgcgccgcttccagccagcgatcgtaattggtggtgtagatacgcgaaaagttaccctgggtaatcatggtatgaatttcagaagagcggacatcaatatcggggcgatgccattcgcgatccatccagctgcgcagcgggccaagcgaaccttttttctgtttgtaatactccgccagcgacaggtgcgtgccataggtattaaagatttttggatcgtaacccagctcattagcaagatgcgcaatcagttcatgccactcgggcaggccaaaattgcgcgaaataccggcaccggcaaacagaatcagtttgccggaatcataggcgcgtttgagttcaggtttcatgccatgccccgcgaggtttttaaaaaggtggcgaagcgatccagcgcgatgcgccgcatcgagatctcattcttgagttcgcccatttcagcaaacgtctgctcatagccttcgggaataaagacgcagtcccactgaaagccacgcgtttccggcaggtttcgcggcgatagtgccgcgcagttcacccgaaaactggtacattttgcggccatcgcagtagcccagcaccgttttggccgtcacggcctggctgtcgagcccctgcaccagcgcggtaaagcgctcagcgtccaggcggttccagaagatgcgggtcagaccggcgggcaggccattgaggccatccagatagaggccggtatgctctacaaatagcggtcgcccaatcagcgaaaaggctttggtcagtttgtcgcgtaccaggtcgagttcgttttcagtctgaatttcttcgatgcgacgggcgatgggcagaacttcgaccccgacaggttcgagtattttgcgcacctccgccagcttttgctcattggcagaaaggaatctgattttcatggggcttccaggtcaattactccgccacgcagtgaggattttacggaaacaggcgggcaggataaatcactaacgctggagagtgtagttcaattctgtgctcatcaggttgaagtgcgcagaaccggccgcagcaggcgagccggttctgcagactcagtaaacaatgccgggtggattcaccgtggactgagtgatggcttcatcctgttcgccccagcgtgccagcacctgctgatactgcccgcctgcgatggtgccatccagcgcagcctgcagcgcaggtgccaggccattgccctttttggtggtcacggcgacccaggcgcgaaacggtccgctgccaaccagctttgtctgtccgcgtgacgccactttccaggccgccatagagtgagggccaaacatcgcatctgcccgtcccgacagcaacgtcagcgtcgcggaggcatcatcagtcaggtaaatcggcgttaccgcaggcaaacctttagcccggttatgctcatcccagctcagtaaaatacgctcctgattggtgcccgaggcgacgataatccgcttaccggcaatatccgccggactattaatcttgctgatatgactgtcgcttttcaccgcaaaagcgtggttgtcggcgcgatacgtcgcaaaatcgaacttcttcttgcgctcttcggtcacggcaatattgaacatcgcgacatcatagcgtccggcgctgagacccagcggccagtcctcccaggaagccggaaccagcctgagtttcagccccaggctatcagcaaggagtcgggcgatatcgggatcgctgccgatccgcgtgacgttatcagacgccagcagcgacagcggcggcgagttggtcgccgaggtagcgaccgtcagggtgcccggttcaataaagcggtaattgtccggaatttgagcaatagcctgcggattggccggggcatgaatcggcgtctcgttttgcaggacatcgagcttctcagccgcagaacaggccagcgccggaagcagcgtcagaaccgttaacgttaatgccctcataacacgcgcgccagaaaacggcgggtgcgctcatgacgcggattattgagcacctgggtggtgctgccctgttccacaatccggccatccaccataaagaccacgttatccgccacttcccgggcaaagccgatctcatgcgtcacaatcaccagcgtagtgccggaacgcgccagctttttaattacatccagcacttcgcccaccagttcaggatccagcgccgaggtcggctcatcgaacaacatgacccgtggattgagcatcagcgcacgcgcaatcgcgatgcgctgttgctgcccgcccgacaggtgacgcggccacgcatcggctttatgccgcagccctacaatatccagcagtttcgcccgcacgctgtatcgcttccggtttcgttaactgacgatgggcaatcggcgcttcaatcaggttatccagcacgctgaggtgtgggaacagattgaagttctggaacacgtagccgacattgatgcgctggcgcagaatcgccttctctttcagttcatacagcttattgccgcgctgctgatagccgatgtagtcgccatcaatctgaataaatccttcgtcgacccgctccagatgattgatggtgcgcagcagcgtggatttaccggagccggacggcccgaggatcaccgtgacggaccccggtgccagtgacagcgatacatcatccagcgctttatgtttaccaaatcgtttactgacgccggtgatgctgatggcaccggtagtgtgtgaggtgcggtaatcaatggcttcggacatggctgatctcctcggtcggatgaagtggcgtgacgcggttgcgccattgtcgcaagcgcgacggttgcggttcacgggtgacgctgcgggccatccagcgttcggcgttgtactgaatcacggacaacacggtggtgataatcagataccaggcagcaccgaccatcagcagtgggatcacttcctgattgcggttgtagatcatctggatggtgtagaacagctccggcatcgccagcacataaaccacggatgtgcctttcgccagactgatgatctcgttgaacgcggtgggaataatggcgcgcagcgcctgcggcagaatgatgcggaaggtgcggcgtgtggcggagagacccagcgcggacgcggcctctacctgaccgtgatcgacgccgaggatcccgccgcgaataatttccgcgctgtaggccgcctgcaccagcgtcagaccgataacagctgcctgaaactgccccagcacgttaatcgtctgatacgctccccaggagaggccggtaaacggaatgccgacagacagggtgtcgtagagataggagaagttataaagaatgatcagcaccacaatcagcggcagtgacctgaacagccagatataaccccatgccagcgtgctcagcagccacgatgaggagagacgtgccagcgccagcagaccacccagaaacagactgaatatcgtacccagcagcgtcagcagcagcgtctggcccagaccgtgcaggatcaccgggtcaaagaaccagcgggcaaacacgctccattcccagcgcggattaaaggccactgactgcaccacgcctgccagaataaacagcgcaacgatagcccctgccgtgcgtgccgggtagcgtgccggcaccacctgcagatgttgatgtttgctcatggtcacctcttaacttgccgcggcgacgttatagacgccgatcactttgataaaacgcagtcgtccgtcgtgcggcggctggccataacgctccagatccccgctgagatcgaactgtggctgataaccgtgaccggtatagagccgcaccgcctccggctgacggaagccggtggtgagaaacagccgctgatagcccgcctgtaaggcgcgacgctccagctcctgtaacaccaccagcgccagcccctgacgacgcagatcgctgcgggtccagatgcgcttcagctcagcggtctgcgggtcatagggtttataagcgcccatcgcgatgatctcgccgtcacgctccagcacgataaacagcccctgcggcggcagataccattcggtcagctcctgttccagctcgttacgacgggaaaaatagtcgccatagcgtgcggaatattcgccaaacaggccgcccaggatcggttgcaactccggcgcgtcgggtgaaacttcgcgaaaagtggattcactcatggtcagctccttagtcgcccagcccggcgggattgatttcagaacgatcgatcttctcaacaccttcaccccagcggttcagcaccttctgatagtcaccgttgccgatcacaccgttcagcgcggtgctgatcggttccgccaggccactgcctttcttcacggtaacggcaatgtgcgccgctttgggccagccgccatcgacgctgccgaccagacgggttttaccggtcagtgccgctttccaggcaccaatcacattgggaccaaagtaggcatcagcccggccagcctgcagcgccagcgtctgagcggcatcatctttggtataaaccggcgtaaaggctttcagtccctttgcctgattctctttatcccacgccagcagaatcgcctcctgattggtgccggatcccacaatgatcctcagcccggcaatatcttctgctttggtcagtgactttatcgagctgctggttttgacataaaaacccagtgaatctttgcggtaggtggcgaagtcgaacttctctttacgatctttggtcacggtaatgttggagatcgccgcgtcatacttgcccgaggccacacccagcggccagtcttcccaggacgctggtaccacgttgagttttaatcccaggctgtcagccaccagccgggcaatatccacttcgctgccaagcagggttttattgtcatcggaaaacaccgtcaacggcggggaattcagcgcggcgaccgccacggtaaaggaacccggcaccacaaaacgatgacccgcaggcagttgcgcgatcgcctccggattcttcacggtattgatcggcgctttgttagcttcaaggctgacgcgctggccgttaaaggagacgctggtatcttcagccagcgcatggctactggccgccagaataagcagggcgataagacgcgatgttttgttcatggcttgtgctcttattgtgaggtgaactgattaacaggttgtttcagggcgaagctgtcacgaagcgtgctgcccggatagtcgcggcgcgtcaggccgcgagcctgcaaaatcggcaccacgcggtcgacaaaacgttcaaaggtatcgggcgtgccgccgttaatgatgaagccgtcagtggcgtgggtttcaaaccagagctgcaggccatccgccacctcttccggcgtgccgtgaaacagcgggcgtggcgttgccgcttccagtgcggcctggcgcagggtatgcccatgctgctgtgctttgcgtttgatctcgtcggtggtgctgcggaagctgttctgaccgatgtcaccgatatccgggaacggctgatccagcggatactgtgagaagtcgtgatggtcgaagaaacgcccgaggtagttaagcgcatcggtaatcgacaccagcgccgccgtggtctgatactggcgctccacgtcctctgcatcatcgccaacaatcacactgacaccctggaagatgtgcaaatcgtctggctgacggccattcgccaccagttgctgtttcacatcctggtaaaatgcctgcgcctcttcacgcgtcggctgatgggtgaagatggcgtcagcatgacgcgccgccagttttttaccgtcgtcggacgcgcccgcctggaagataatcggacgaccctgcggcgtgcgggcgatgttcagcggcccctgtacctggaagaaatcaccgtgatgatcgagcgtgtgcagcttcgccggatcgaaaaattgtccgctcgccttatcacgcacaaaagcatcctgctcccacgaatcccacaatcctttcaccacctgcagatactcatcggcaatgcggtaacgcaatgcgtgctccgggtgctgctggcgtgagaagtttttggccgagccttccagcggtgacgtcaccacgttccagcctgcacgcccgccgctgagatgatcaaggctggcaaactgacgcgccacggtgaagggctcgctgtaagaggtcgataccgtgccaaccagccccagatgttcagtgacgcccgccagcgccgagagcagcgtcagcggctcaaagcgattcagaaagtgcgggatcgacttttcgttaataaacaacccatcggcgacaaacagaaaatcgagtttgccctgctccgccttgcgggcgatttttttggcgtaatccagattaatactggcatcggcctgcgccgccggatggcgccaggcagacatgtttcccgatgcgccatgcagaatggtacccagccgaagttgtcttgtggtcatgatgctctctcttttttagtcgtagcgatgcccgacgacggtggtcagaaccgtcgtgctttagcgggttgcagatgaattcagttcagaatggcttcccgacatcgcgcgttaagatgttgcagcgcctggcgggccagtcgggcgaagtagtcggcggcgggcgcaatcagcgcctcatccggggtaaagctggcatggtgcagaccaaagtcactggcgctgccgatgctgacaaacgcccccggcacctgttgcagatagaaggcaaaatcctcacccagcagatggagatcggcggtctgcacccgatagcctgcctgctgcgccacttcgctgctgaaggtcgcccagtgcgcatcgttgatcagcactggcgggccaggatgccagctcagggttgcctgcgcgccattggcgtcggcgaagtgctcaaccagcgtgcgcacacgctgttccagttcggcgcgcacctgtaaatcgtgggttcgggccgtgccgccaaactcaacgccgccgggtaatacattccagcttttgccgccgtcgatgcgggtaatgctcagtaccagactgtccagggcactgaaactgcggctggtgagtccctgtaacgcctggataatctggctggccgtcacaatgctgtcgacaccctgctccggatacgcggcatgtgcgcctttgccggtgacgcggataataaatttgtcagcattcgcatagaacgccccgctgcgggtggcaaaggtgccgacgggcagcgaaggctcgttgtgcatcccgaagatagcctgcaccttatccagtacgcctgcctcaataaactgacgcgcgccgcgcgctatctcttcagcgggctggaacaggatgcgcacccggccagctaaccgatcggcctgtgcgttgagctgtaacgccgcacccagcatcaccgcgctgtgcaggtcatggccgcaggcgtgcatcacgccaggatggcgggagtgaaaacgcaccccgctcgcctcatggatcggcagcgcatcgatgtcggcgcgcagcgcgatcaccgtctctccgctgccaatttctgccaccaggccggtttccagtggatagtccagcagccggatgcccgccgcctgcaaccagccccgcagtcgcgcggtggtggcgaaactcctgacccgacagctccggccaggtgtgcagttcgcgtcgccattcaatcagttgtgactcagggttcatgatgactctccactgacggggattcaggctgcgaccagatgatgcgtggccagcagttcaagtgactgcagacgtgcaaccggctcagtaatcggcgtgtcgataacaaactcatcaatgtcaaaattatgatgcagcgcgtccagctgggcatgaacctgcgccgccgtgcctttcagaagtgacggcgtgcgcggctcaatctgataatcgcggtatccaccctgacgcacatagcgctccgcctgttccagactggcgacgttgacgctggggccatctttcaccgctacatggtagtgacgaagattggctaccagcaggtcagccccggcgggtgagtcggccaccaccacctgcacggccaccagggcgcgctgaccctggctcaggcgggagtaggtactcagtgcgtgctccagcaactggcggtcgccattaaggtgagcggcaaagacaaactgccagcccagactggcggccagccgggcgctctcttcactggcacccagcagaaaacggttcgccggacgtggcggcagtggcgtggcggctaaaccctcatcgtcaggatcagcctgaccgggcttcagccagctatccagcagctgaagctgttcggcaaagcttccttttttagcagcatcaacaccctgttgcagcgcatgggtggagagtggaagtccgcccggcgctttgcccacgccgaggtcaatgcggcccggcgccagcgaagcgagcagattaaagttctctgccactttataaggactgtagtgctgcaacatgaccccgcccgatccgacgcgaatatgtcgggtctgggcaatgatccaggcaatcaatacctcaggtgatggactggccagctgcgcggtgttgtgatgttccgccagccagaagcggtgataaccccactcctctgcccgctgcgccatctgcagcgtgcgctgcagcgccgcggcgggtgattcaccctgcaacacgggcgctttatctaacagacttaatcgatatgccattcacctggtccttgtttattccggttgcagaccagtgtgctgcgcagtcgatcattggtaaaacatcatattgttttatgcattattgatttcgtcataatggagaacggtgagaagtgaaagagggaaaacgggctctgaaacagggaatcaggcagatattttgcgtataacgctattcgttgcctgatattcaggtgagtaaaatcggcgaactggcaaaggtttgcagaaaatcgtcttacgtatggagagatgacagttgttgttagccacgactgcaggaatttcagacagcctgaattcatggcattgaaataccttcttcacaggatggtgaagcacaggtcgccagatagataaataagcatatgaagaatgtaattgagtcagagatactcattgcaactgccagatgatttacaggaccttatgcattatccggaattaagatcctctgctgtaataagaggtgtaaaccgggcatgaatctgtctgatagggtcatatccgggcacagcaaagcattgagcccagaaacaagattatttttctaaggccgttgcgagttttgtttcaacgggaaaaatcgggtgttgataagcgccacattcacttcacagggaacgccgtcgtcgagataaacggtttcattaagctgaatgacagcatccccttcagctaaattaagcagagtaagcgactgtgtatccgtaagattgacggccgttaaatgctggtcccttagctgcactttcttaccggtaacttcttcaatgtaggcatattttgacagttccagcttgctgaactccatgctgctaaacatattaaccggcaggtgaatatgttccagagctaccgggatgtcatcgaaacacatcaggcgtaaaattttatagatctgatcgctgtttttaatacgcagcgcctgagcgatatcagcagaaggaaccttgattatgctgaccgatatgatttttcttacacctttatggccatttctttgcgcctggtaatcaaaaggtgaaagcacatgatatcggttcgcctggctactcatctccgtggaaccgacaaaaatacccgaccctttaacccggtaaattctctgctgctccaccagaatgcgtgtggcttcacgcaccgttgcgcgagtaatgccgatgcttttggcaattgatatttcggtatccagtttctctccgggtcgaaggccatcatccttaattttattgaggatgtaatcaacaacctctttttgtttttcagtaatgccatcaaccattggctttcttcccgtttgagtgaaggacagactccctctaatccgtgtcagtacagttttctgcctgacattgccggatgagtaccacttccgctagctgaatatgtgatcaacttatcaaattggcactgatgttaagcctgataagcaatattttaactttacatgttgtgtccgtacacgtcgaaggacatcatcaggatgactagacacctttaacatgtacagatgtgatgaccgttgtgaaatataaccccatctgaacaatgagaaaatatttttttaataactccatgaaaatcatgacttttaaggatgttacctccttttactacattcgatttttgtctcgctctgctgacagaaagtttatctaaaaaagtgataacgggggttttgagggaaactgactgtacatactcaggaatttatgaaaaatcggaatgcataacaggccctgttccggttgagaaaattttatatgagatgggttatgcgcaaccgggagcaggcaaacgccacacggtttatgcgtttagttaaattttattgcgcatttaaacaggaggagtaagacgatgtcacacctggctaagtggttaaataacgagaaaatccagtacgtcgaaagcgtgactgactggcaggaagcgttagttattgcgggacgtcctctgctcagtgagggcgcaatatcgcaggattatattgatgcgattattcagcaaaaaaaggagatcggccccttttttgtcattgcgccgcagattgccatgccccacgcgcgcccggaacaaggcgcacacaaactggggttgtcgattgtgctgctgggtacagcagtgaaatttgactccgaagagaaacgacccggtgaaggctattttcatgtttgccgcaccggacagtaatagccatatcgaaatgatctcccaactggcggaagtgctgtccgatgaagagatcatggcgcagatattcaatgcgagcagcaaagaagcgctcatgacgattttatcaggcgtttagtctgcccgttgaaacgcgacttttaatcattagttaatgaggtttgatatgaaaattatggcggtgtgtggttcaggtttaggcagcagcttcatgatggaaatgaacatcaagaaagtgcttaaaacgatcggtgttgaagctgaagttgaacattcggatctcggctctgtcacccccgatgtggcggatgtttttgttatggccaaagacattgcttatagcgcaaaccttcctgaacagaaggtcatcatcattaataacatcattgacctgaaagaagtggagcagaaaatacgtgagtattttgagaaaaagtgacgctaataattagataaacaccttaccctcgaggttaatatgtttactcaaaatcttttgcagttcgtcgtcgacgtgctgaaagtgccctctatattagtcggactggtggcatttttcggactgattgcgcagaagaagccgtttcctgatgttatcaagggcacggtaaaaactattctgggcttcctggtgctggcaggcggtgcgaccgttctggtcggttcactgacgccactgggcgacattttcaaacatgcgtttgatgttcagggcatcattcctaataacgaagcaatggtctctatcgctctggcaaaatatggtgcacctaccacgatgatcatggccttcggcatggtcgccaacatcgttgtcgctcgcttcacccgactgaaatatatctacctctcagggcatgtgacgttctatatggcctgtatgatcgcgattattttatcggttgctggttttgaaggtattcagcttatttacaccgggtcactgctgttgggcattctgatggccaccttcccggcgatcgcccagccctatatgcgtaagatcattggtggcgaccatgtcgcgctggcgcataccgggacaattggctatgtcttatcaggctggatcggctctttggtaggcaaaggatctaaatccaccgaagagatgaacatgccaaaaaacctcagttttttgcgtgacagtaccatctcgatctctctgacgatgatgattatctacttaatcctgtcggtgtctgccggtaaagactatgtagaggctaatttcagcaatggtcagaactaccttgtttactcctttatccaggccattaccttcgcggcgggtgtctttatcattctgcagggtgtgcgcttaatcctggctgaaattgtccctgcctttaccggcttttcagaaaaactggtgccggaagccagaccggcgctggattgcccgattgttttcccctacgccccgaatgcggtgctggttggctttatctccagctttgtcggtggactggtggggctgtttgttctcggtcagctgcattgggtattgattctgccgggtgtggttcctcacttcttctgtggcgctacggctggcgtgtttggtaatgcgaccggcggcaagcgtggtgcgatttgcggtgcctttgctcatggcctgttaatcaccttcctgcctgtcgccctgctgccggtactcggacagatagggctgaccaacaccaccttctcggataccgacttcggcgtcaccggcatcctgcttggtaatatggctcactttatggataagggaaccattactatgattatcaccggcatttttggcttgttagtgatttataactttacggctaaaaagaaggtgcctgtagaaacgaatgcagggtaatagtaacgcttaatggcaaccagaaagggcaatgagcactttctggttgtttgcggaataccttcatcattcagtttccagaaaaaaaaccgcactcatataagttcaggctaagttattcagcgaatgcttcaaacggcaggttaaaacgcgctgccagtcgggctttatgtttatccgtcaaaggacgatcaccacgcaggatacgactgacataagagcgctgccctatttcatccgcaaaagaggattgagtcaggccgtgctgatccatgatgactcgcaaaagtgctactccgcgcggaatagcatcagtacgcgcgttaaacgcagcgaactcaggggcgctgttttcgtatcgggcgactttatcagacagtatctctactaacgggctgtccggctggtgctcaaccagatattcaaccagttccagcgcctgctcgtagtcccttttatcggtactgcctcccagaaagggaacaattctgaccaggtcattggtcgcctggattgcttcggtaatcattctttactctcccggtacttcttcaccagcttgtcatattccgcatgcgtcacgatgtgtttgataaaaattttgccgcgatcaaagtcagcataaaacatgattctcaggctgtttccgcccacatcgattacccaccacttttcccggtacttcatgcggtcaaggctctgaaagctaattttcagcgcatctggcgtggcaaagttttcgtcccttaggaccagataagccgcatccagtgcggaggcatgatttggataaattattgccgcttccctgaacggccctcttgagatgatatgcatttttctctcaaactttccatgttggaaacattctaacccacaaagctaatgtttccaacatggaacacacgcagatgagttctgaatgaattgctggcgctaaacctagtaaaaaaaggattattccgatccagaaaagtgatcaacatcacattttcaacattagacatactaataaataaaatttaacaacaaaacatttgaatgataatgattaacatttacactctcatccgcatataacaaagcgtttaacgctgccaaatccacaaataatatgcggtatttactctttttaaggtgaaaacactaatccatttaatggtcagggtttttatctggttagttagttttatgtttactggagttgttgagcggacatccaacgctgctgaccttacgtcggcagggtcactggtattaacgcacaggaactgaacatgcttttacgctcatccactcaggcggcacaggatctcgcgccagcatccaatgccagcggtgccgaaacggctatttttaacgatcagcaactggcggcctggtcacagcagactcaggaggtgctggcgctgatgacccgtaccgttaccgacgttgagaagcctttcagcggtatcctgccccatgaactggcggcggaattcagtgaggtcgatctcgatcgtccgctgggtaacaacgatgacgccctgacagagctgagtcagctctatctgcgtgacgccgtctggtttcaccaccctaaatatctggcgcacctgaactgcccggtcgtgctgccctctctgatggctgagcagattatggcggcagtgaatagctcggtcgacacctgggatcagagcgcaggcggtacgctgattgagcagaaggtgatcgactggacgcttggccgcatcggcctgcctgccggatctgatgggatcttcaccagcggcggcacccagtccaacctgatggcaatgctgctggcgcgtgatagctggtgcgcggcacatcatccggggcatctgattaaacatcgcggcctgcctgagaccgcgtcgaaatggcgagtgtttacctccaaactcagccacttcagcatccagaaatcgatggcgattttagggctgggctatgacgcagttatcgccgttgatcacgacgcccactaccgtatggacgcagcgtgcctggctaaggagatcgagaaatgtcgcagtgaagggctgatcccggttgctgtggttgccaccagcggcaccacggactttggcagcatcgatccgctaccggagattgcccgtctctgtgacgattatggtttgtggatgcacgttgacgccgcttacggctgtgggctgcttgtctctgagaatcatcgctcacgcctgaatggcattgaacgggctgattccgtcaccgtcgattatcacaaatctttcttccagaccgtcagctgcggtgcgttctttgtgcgggacagccacaacctgaagcatgtcacgcaccatgcagattacctgaatccgctcagtgcccagcaggaaggcacgccgaatctggtcaacaaaagcattcagaccacccgccgatttgatgcgctaaaaatgtggctgaccctgcgcgtgatgggtccggcggcgctgggtgacgctttcgatacgctgatagagctgacacaggcggctcatgagcggttaactgcgcatcctgctatcgaagtgctgcacgcgcctgagctgaccacccagattttccgctacgtgcccggcaaaaacgccagcgacgcacagatcgacgaaatcaacgccgctatccgtaaagcgctcttccgctccggcaacgcagtgattgccggaaccaaagtcgatgggcgtcagtacctgaaattcaccctgttaaatcccaccacgaccatcgccgacatcgaagatgtgctgagcctgatcgcgcactatggccgcgagcaggtacgtgcgtctgcgctgaacgcggcgaaacagtgagagctctgaaatgaataattccgtttacgattttattggtatcggtatcggccctttcaacctgagtctggcctgtctgagtgagccggttgagggactgaacggtcttttcctggatgagaacccgggctttgactggcacaccggcatgatgctggaaaatgcccatctgcagacgccgtttatggccgatctggtgacactcgccgatccgaccagcccttacagcctgcttaactacatgaaggaaaaggggaaattatactctttttatatccgtgaagacttcttcctgatgcgcaaagagtataatcagtactgccagtgggccagttcgcggctctctaatctgcgctggaacagccacgttgagtatgtcagctacgatgaggcggctggcgtctatcaactccaggtgaccgacacccggaatggtcagaaacagaactatctggcacgacatctgatcctcggcaccgggcctaaagcctggatgccggagtgcagccagccgcaccgccagcgcctgacgcactcaagccactatctggtcaacaaagcggaactgcagcagaagcgttccatcaccgtgctgggcagcggccagagcgcggcagaaatctactacgacctgctgaccgatatcgaccgctttggctatcagctcaactggatcacccgcgcgcctcgcttctatccgctggagtacactaagctcacgctggagatgacctcgccggagtgggtcgactatttccacgcgctgcccgccagcacccgcgacgaactgaatgcgcgccacaagaatctctacaaaggcatcaacagcagcctgattaacgacatttatgacctgatgtatgtaaaacagctcgatggcgatctgaacgttaacctgtttactcactcggcgctgaccgctatgcgctggctgccacagggagagttcgagctgacgctgcatcaggaggagcaggattgcaccttcacccgtcgcaccgaaggactggtgatggcgaccggctatcactaccagccaccgatgtttttagagggcatcaacgcccgcctgcgctgggatgacaaaggccgctacgacgtgcagcgcaactacagcatcgattatcacaatcagatcttcgtgcagaacgccgaactgcacacccacggttttgttacgccggatctcggcatggcctgctaccgcaactcggtgctgctgcgcgaactgaccggacgcgaggtctacccgatcgagcgtcagattgccttccagaccttcccggctaaatcggagcactgagatgagttcacaaacactgttcagcgccgcccgccccgcaggccagttcaccctgaggcccatgctcgccagcgatgcgccgctggttcatcgctgggtcacccgcgattacgcccgcttctggggcatgcagcagcagagcctgaatcaggtcgctgagttctatcagacgctgactgcagccgatccccatgctgcgctgattggttgctgcaacgaccagccggtctgcctgattgagtgctatcgcgccagcgacgatgaggtcggcaagttttatcctgccgcacccgatgattacggcatgcatattctgattgcccccgccagccagccgatcagagccttcagctggcaggtcttcacgctggtgatggactacatgttcagccgccccgaggtgcgccgcgtggtggtagagccagatgtgcgcaatgagaagattcacgtgctgaataagcgtgccgggttccgctatcagcacaccatcgacatgggtcataaaaccgcctggctggccttttgccagcgggaagattatcaacacgcgttactgcaggagtcgcagactatgaacaccccctcttcgctgatgaacggtacacatctgacgggcgaccactgggcgcaggcaaaccgcatgctgatccggaaagcgattgccgagttcgcgcatgagaaaatcattacgccacaggagtcgggcgacggcagctatcagcttgcggtgccaggcggtgaagcgagctaccatttccgggcgtcgcggctggcgctggatcactgggaaattgacgccggctcactgcgcaagcaggagaaacggtcgtgatctgccgctggatgcgctgaaatttatcgtggagtttaacggggagatcggtattacacaggcactgctggcgacctacatggaagagatcagcagcacgctgtgcagcagcgtttataagctgcagaagaataatcctgacagccaggcgctggtctcagccgatttccagacggtggaagcggcgatgaccgaaggccatccctgctttgttgccaacaacgggcgtattggcttcgatgcccatgattatctggcgtatgcgcccgaggccgccgcgcccgttcacctcatctgggtcgcggtccatcgccgcaacgcccatttctccagcctcagcgagctgagctatgagcagttgatgcgtgatgaactgggcgacaccaccctggagcagtttactgcgcagctggtgaataaagggctggcggttgaggagtatatcctgatgccggtgcatccgtggcagtggcagaacaagctgctgaccgtgtttgcggcagacatcgccagtcacgatattgtttatctcggcaccggagacgatgcttaccaggcgcagcagtcgatccgcaccttctttaaccgcagccagcccgcgaagcgctacgtgaaaaccgccctgtcggtgctgaacatgggctttatgcgcggactgtccccctactatatggcgacaacgcctgcgataaacggctggctggaacaactggttgctggcgatgcgtggctgaatcgctgtgatttccgcatcctgcgcgaagtcgcggcggtcggctatcacaaccgctactatgagcaggcgatcaaaggcgactccgcctataaaaagatgttcgctgcgctgtggcgggataatcctgcggccagcctgcagcccggccagcgtctgatgaccatggcctctttcctgcacgtcgatcaccatcagcaggcactgctgccagcactgatagcggattctggtttgcccgcgaagcagtggatagaacgctacctgacctgctatctcagcccgctgctgcactgcttctatcagcatgacctggtgtttatgccgcacggtgaaaacctcatcatgctgctggagaacaacgtgccggtcagtgcatacatgaaggatatcggcgaagagatcgccgtgatgaatccggattcggtgctgccggaaggcgtgcagcgtctggcggtggatgtgccggagaacctgaagctgctctcgatcttcaccgatgtgtttgactgcatcttccgctttatcagcgcgattctgcatcagtcaggaacgctgccggaggaagagttctggcaggcggtggcgcagtgcgtgaaggattaccagcaggcgcacccggagcatgccactaagttcgcgcgctatgacatgttcgcgccggagtttacccgctcctgtctgaaccgcctgcagctggcgaataaccagcagatgataaacctcgccgatcccgctgagaacctcaagttcgccggaacgctgaataacccgatcgcccgctggcgataagcgttacaccgtcacgctaaaattatgcggtcaccctggtggccgcttttttaatggctttatcgcaggtatccgtaatggtttctttcgaaccggtcgtgcaactgacccgacgacatctgatttttccgctgtcgctggtgttgtttgagttcgccacctatatcgctcacgacatgatccagcctggcatgctgctggtgactcaggaatttaaggtcgggccggagtgggtctctacttcgctcaccgcctatctggccggtggcattatgctgcaatggctgcttggccccctctctgaccgtatcgggcggcgtccggtgctgctcagcggcgtggccttttttatgctctcgtgtgtggcgacgcactgggtgcaaagcattgagcagttcgtcctgctgcgttttctgcagggcgtcagcctctgttttattggcgcggtaggctacgcggcggtgcaggaggcctttacggaatcgctcagtatcaaaatgatggcgctgatggccaacgtcgccctgctggccccgctggccggtccgctggcgggcgcggcttttcttactgtgggtgaatggcgcaccctgtttctggctgattggcgctattgcggcgctggcgctggcgggtctgtggtttgcgatgcccgaaaccgcaggcgaccggcagaaaccgctgtcgctgcgatcgattatcagcggttacgcggcgttgctgaaggatcgtcaggtgatgcgcggctcgctagccatcggactggtcactgtgccctgcatcgcatgggtcgcattgtcgccggtgattttaattcacgatgcgggactcagccgcatcggctatgcgttgttacagctgccggtcttcgccgccatgattgcgggcaacctgacgctgggacgcttatccagccgtctgcccattgaacagccgttacggctcggtgcctggccggtggtctgcgggctggcaatcgcagtaaccgctaccgtgctaaatccgcaaagctatctgtggctgactgccggaattagcctctacggtttcggtgccgggctggtcagtgccggactttatcgcatgacgcttttttccagcagcgccggaaaaggcagcgtggcagcgatgctcggcatggtgagtattctgatcatcgcgctgggcattgaagcagccaaaaccgcgtattttagttacggcaccggcggcttcagtgtggtgaacctgatctgcggtctgctgtggctggttctggtcagcgcttttctacgagcagaccagcggaaattgtgcacggaatagcggacccttatgaatccgctgtgtgccgttgataaaatataacccggcaggatggcagaaatttatttgccatcctgcaactgaaataaagagattacatcccgcccaatcccgcatttatttttttcagataagctttgaccaaatcgttactttatctgtgtgttgcgtcattcgatgatgattccgcctgctgaggcaattgataacaaaggaattcaccatgaagacgttatttccccttaaaccacgcgcacaaacgctggtttttactttacttgccgggacgctgacctttaacgcggtggctgcaccggtcaaaggcggtacgctgatttatcttgaacagcaggcacataccaacctctatccgcctgccggtggcttttaccctaatggcggcattctcaatcagatcaccgataaattaacctggcagaatcccgaaacgctgcaggttgaaccctggattgcggaaagctggactaccaacgcagacaaaactgaatacacctttaaattacggcctggcgtgactttttccgatggcacaccattagatgcgaacgcggtggcgaaaaactttgatacctacgggctgggaaataaagcgctgcgcctgccggtatcagaagtgattaataactatgaacgcagcgaagtgatcgacccgctgacggtgaaattctattttaaaaagccctcacccggatttttgcagggcaccgccaccattggctctggcctggtctcactgagtaccctggcgcgcagtttcgatcagctgggcgatgcccgtcacattatcggctccggtccgtttgtggtcagtgatgagaagctcggtcgggaggtggatctggtagcgcgtaaagattatcagtggggaccgaaaaacattcagcagcaaggtccggccaatctggatgcgataaaagtgatcgtgacgccagaagacagcgtgcgcatcggtgcactgctggcgggccaggcaggcctgatccgccaggtgcaggcctacgacgagaagcaagctaaagatcagaacttcccggtttatgccgcgccgacccgtggtgtaaacgacagcctcagcttccgtccggataatccgctggtcagcgatatccgggtgcgtcaggctctgctgcacgccaccaatgccaaacaggtggttgagacgctcttctcgccgaaactatccgcaggcaacctcggtcgtggccaccaccgccgccggctacgtcaatctggcggacaaactcacttttgatctgacaaaagcgaaggcattgctggaccaggcgggctggcaaccgggtgccgatggcatccgtgaaaaagcaggccagcgactggcgctaaccgtctatgaatcactgccgcagccgcaaaacaaagaggtgctgcaactggtggcacagcagtggcgccaggcgggcgtcgccctcagcgttaaagcgggcgatgccggcagcaaaacgctggataatctcgacccccttaagaccccgctgaacgtcaccgaagtcggccgcgccgatcccgacgtgatcaaaagcagcttctacccggctaaccgcgacaacctgctgcagaaaggcggctccagcgacaaagtgaaaaacttccgtgatgacaagctgaaccagctgctggtcgccatctccgctgaagttgacccggcaaaacgattacagctgaccggtgacgttcagcggtatctgctggaccaggcctatgtgattccgatcttcgaagagccgcaggtctatgccggtgcgccctggctgaaaggggtcagttttgaagcggtaggccgtccggcactctatggcgcctggctggaaaaacagtaaccggaggtgaggatgcgtcattatctgctgcaacgtgctggcctgggggtattggtgctgtgggccgcgtttaccctgtcgtttgtgctgctacaggtgctgccaggcgatgcggtcctgatcaagtttcagaatccggatctcggcctgagtccgcagcagattgctgagatgcgtcaggcctatggcgcggacagcccgctgtggcagcaatatctgcacacgctggcggcgatgctgcacggcgacttcggctattcggtgcaggcgggcgtgccggtcagtgaactgctgaccagcaatctgcctggcacgctgcgactggccctgtgcggctttttgctggcgacactgctggcattcgtgctggcgacactgtcgcggctgcctgccctgcgcggcctgcgtaatctgctgcagtcactgcccgcgctgtttatctcagtgccgaccttctggctcggcatagccctgattcagctcttctcattccagctgcgctggatcccggtaatcaatccctcaccgtggcagggactgattctgcccattattacggtcgccgtgccgatctcagcgccgctggctcagattctgttgcgcagcatcgatgaggttgcaacccggccttttgtggcggtggcgcgcgccaaaggggccagcgagcactatgtgctgtggcggcacatcctgcgcaacgccatgctgccggtgctcaccgtggcgggcctgctgctgggagaactgattgccggtgcgctgattaccgaaacggtgtttggcctgggcggtctgggacagctgacgcagcaggcggtgaacaatcaggatgtggcggtattgcaggcggtggtgatgatctccgcgctgggttttgtggtgatcaacctgctggtggatctgctgatgccgctgtttgacccgcgcttacagctgttacgaggtgcaacatgagtctggttgattacgctgccgcgcggcaacccgtggcggcaaagaggcgcactttacagttttcgccgggcctgtggcttgccgtttcagtcatgctgctggccgtactggcggccctgtttcccggccctctttacccaggccagcccgattgaaggcgttgcgggtgcacagcgactcgcaccgcaggccggacactggctcggcaccgatcagctcggccgcgatctctttgcccgcatcgtttacggcgcgtcccattcgctctccgccgccgtcatggcggtggcgatcggactgctggcaggtaccgcgctgggtctggtggcagggtctatcggtggcaaaactgaatcaattgtgatgcgcgcagtggatgtcctgctggcgattccggcgctgctgctctctctgagcgtgctgattttactcggcttcggcaccctgaatgccgcattagcagtgggcatcgcctccatcgccagcttcgcccgactggcacgcgccgaagtggtgcgcatccgtcacagcgagtatgtcgaagcggcttacggcagtggcggccgctttttcagcgtgctgtggcgtcacattctgcccaatgcgctgacgccggtgatcgcctatgccgccctgcaatttggtcaggcgattctggcgctgtcgactttgagcttcctcggctacggcaccccaccgccggtgccggaatggggtctgttaatcgctgaagggcgtaattatctggctaccgcctggtggctgaccacttttcctggtgtggtggtggtcgctgtggtgctcgcagccaaccgcatcagccagcaactttcaggaggacgccaatgagcgctcagccgttactcgcggtcaacaatctgacgctaagctatcgcagcggcaaccgttggcagccggtggtacataacgtcagcttcgagctgcagcccggtgagatggtggcgctggtcggggagtccggctccggtaaaaccaccaccgcacaggcgataatgggtctgatggcggaaaatggccgccgcgaaggaggtgaaatactgctcaacggcgtggatatcagtcagtggtcgcaaaagcgcttcgatacgctgcgcggggcgcgcatcagtctggtgccgcaggatcccggtaattccctgaacccggtcaaaacggtcggcgaacaggtggaagagatcctgcgactgcacctgaaattaccgtcagcgcagcgccagcagcgggtgattgacctgctgaatcgcgtcggcctcagccatccggaacagcgggttaagcagtatccgcatcagctgtcgggcggcatgaagcagcgggtattgatcgccattgccctcgccctgcagccggagatcattattgcggatgagccgaccagcgcgctggatgtcacggtgcaaaagcgcattctcgatctgctggacaacctgcggcaggaatcccgcaccgccgtgctgtttgtcacccacgacctggcgctggcggcgcaacgcgcagatcgtattatcgtgtttcgtcacggcgagattcaggaatcgggccgcactgaacaggttatcagcgcgcctgctcatccttatacccgtcagttactgaatgatgcggctccacagcgacccgccagagttaaatctgcggcctcccgtttttctgcgcccgccatccgggcaaccggcgtgatgaaaagcttttcgctgggcaaacagcagcgtttgcaggcgctgaaccaggtcagctttcaggttgcgcgcggcactacgcatgcactggtaggcgaatccggctcaggcaaaaccacgctggcgcgcatcgttatgggttttgaaaccgccgacagcggcgaggttacgctggatggcatcgtggtcaacggattacgcggcgaggcgctgcgtcagctgcggcggaagatccagtttgtctatcaaaacccgtttgcctcgctcgatccgcgtcagacgctgtatgcaattatcgaagagccactgcgtaattttgagcggctgagccgcagtcagcgccgtgagcgcgtagaagcgatgaccacgcgggtggcgctgccgctctctcttctgtcacgtcatcctcacgaactttccggcggtcagcggcagcgtgtggctcttgcccgggcactgatctgcaagccggagattctggtactggatgaggcaacctcggcgctggatgtcacggtgcaggcgcaaatcctcgacctgttacagcagctccaggccgaactgggtctgacctatctgtttatcacgcacgacctggcgacggtgcggcagattgccgacagcgtcacggtgttaaaagcgggcgaagtcgcagagcaaggtgacgttgtcacgattttcagtgcgccacagcatccttatacccgggaattaatggctgccattcctccgcttattcccttaacccacaaggagtcagcatgagccgacgtctcggattttttacccggctgctggataaggtgccggcgaaacagcgctatcagctggccaccgaacagatccagcatgccgaacgctgcggatttgataatgcgtggattgctcagcaccattttcatcaggatgaggggggtctgccgtcgccgctgctcttcctggcgcatgtcgccgcgcagacccgcaccatccggctcggcaccgccatcatcaccctgccgatggaaaatgcgctgcgggtggctgaagatgccgcagtactggatctgctggcagatgggcggctggagatcgggctgggctccggtggcacgccggattcgtttttgccgtttggtctgacctttaccgagcgcggtgccgcttttgccgaccatctgcatacgctgctcagcgcctggcgcggggattcactggggcatcctgataatcatctctatcccgccgcgccgcagcttgccggacgggtgtggatcgccaccttctcggttgagggcgcaatccgtgccgctcagggcggccatggcctgatgctgtcccgcacccagccgcgcccggcgggccagcctgagctgccgctggatgcattgcagaatccgctgatcgatgcctatcttgcggcacttcctgcgggaaccactccgcgcatcctcgcctcccgtaccgcattcgtggccgattctgaccgctatgcccgtcaggtagctgaaccgggaattcgtcagcaggctgcgcagtatcgtggtgaattacgcggtgaacgctttgatgacctgctggcgcagtttgatgcccatgttggcggcatcgatcaggtgcagcactcgctggcgcaggacagcgcactggcgcgcgtcactgacatctcatttcaggtgcattcggttgagccttcgcatgccgacacgctgcgctcgattgaactgattgcccaacatcttgcgcccgcgcttcgtgccgctggcgaacctcacaggagaatttcatgaatcaacctgacgatttgattgccacactggcagatatcgatcccgattccgaactggcccatgcgcgccagacacgtcacgccgccacacaacatgctcagggtagctacaccctgttgtttagccagggtgatgaagattttccgctggcggagcgccgtctgctggccgctcaggttgcaggctggcatgcacaacccggcctgcaggcgcactaccagccacaggagagtctggccgggagtgttcggatcaacgcggcacaggcttttgcccatcgcctgacctttgagccggttactgctgctcccgcgcatctggaggctttgaaacaggcgggctggaacctgcgcggcattgtcacactggcacagctggtggcatttgtcagttttcagagccggttgctggcaggtctgcgcagcttacagggcgatgaggcgtcgggtgaggttgccccggtagtcgccggtcactggcacgaggccttacataccgccagcggcaaatctgccctgaccgcgtttacgcaacaggaactcggctgggagccctggctgccggcaaaaccgctgacggaattcagcgaggaagagcaggcgacactggcaaaattcggtcacaccgactccgactattttcgcctgctggcgcgcaatctgccgttgctggaacagcgcaccctgaccgataaaggcattttttataccgcaggagggctgccacgcgccgagcgcgaactggctgccaccgtggtgagtaaggtcaacggctgcatttactgcgcctcagtccatgcgcgtaaagccagccagctctcaaagcaggatgaagcggtacagaagctgctgaatgtcgcacccggcgcggtgttatctcacggacacaccgcgcgctggcaggcgatcatcgcattctcagcagcactgtcgctgacccctgcccagccgacacagtcccagctctctgcactgcgtgaacagggtctggatacgctcgccctgctcgatctgattcaatcaaccgccttttttgcctgggctaatcgcctgatgctgacgctgggcgaaccttttctgccggaacaacagggataatcatgactttgcctttaaccgaccaactggtgcagtggcgtcgcgaaactgcatcagcatccggaactttcgaatcatgaatttgccaccacggaacgtattacccgctggctggagcaggccggaatccggctgttgccgctggggctgaaaaccggcgtcgtggctgaaatcggtcatggcgaacccctgatcgccctgcgcgcggatatcgatgcgttaccgattgaagaaaccaccgaacgcccgtggcgatcacagcagccgggcgtgatgcacgcctgtggtcacgacgttcacagcgccgtgatgctcggcgtggcgttgcagctgaaacagcaggaagacacgctgcaaggccgggtacggattctgtttcagcccgctgaagagacctttaatggcgcacgtcagctgattgataccggtgcgctggaaggcgttcaggcgatattcggcctgcacaacgcgcccgacctgccgctgggcacgctgcgtagtcgggcgggtgcgttttatgccaacgtagaccgctttgttatccgcattgagggcaaaggcgcccatgccgcacgaccgcaggagggcatcgattcgattgtgattgccagccatatcgtaacggctctgcagaccctgccgagccgggtgttcagctcgctggaaacggtggtgctgagcgtgacgcgctttaccgccggtaatacctggaacgtgctgccacaaagcgttgagctggagggcaccgtgcgcacccacaacggcgaaatccgggcgcagatcccgcaccgcatgcgatccctgattcagggtattgccgccgggtttggtgcgaccgccgaactggagtggactgaaggaccgccggccctgattaacacgccaggctgggtggatgttgcgctggacgttgcccaacagagtggctatctcgcggagcacgctgagtcgccgcagatgggcggagaagattttgccttctatctgcagcaggtgccgggggcgtttgtcagcatcggcagtgccagcgaatttggtctgcatcacgccgccttcgatcctgatgaagcgttgattggcccggcggtggactacttcacgcagctggtgccgcgcgcgttgcagattgtggcggcgcaatgacgaaaaaaaggagtgctgctatgtcagttcaggttccacaaccgattcttgatcatgctgtgattaacgtggccgaccagctcgacagcgccagcgcgcgcttccgaaggctcggctttcagctcactgaacggggtcatcactctctgggatcgagtaatcacctggctatttttggtgagaactacctggaactgctgggctatgagacgggcaaagggagccagcgcgccgatctctggcaatcgccgctgggattgagcggtctggtgtggaaaagcagcgatgcagagagtgagtttcagcatctgcaacggcaggatctggatggcgatccgccagcggcctttcaccgtccggtcaccctgcccgacggtttcggtgagtgaagcgcactttcggaccgtacggattcgcccttcgctgttacccaatggccgcagctttttttgccagcatctgacgcccgaagcggtatggcagccggcatggcagcgtcaccccaatggcgtgcgtaatatcagtgagtttgtgattgtcgcgcaggatccggcgctttcagcgctggtctatagccgcctgtttggggccgctaaggtgctcgcctgtcccgaaggcgcctttgtcctgcgcgcgggtgctgccacggttcgttttgcttcggcagactatgcgcagcagcgatttggcccgctgccggaagactatgatggcagcgcccgcatggttgcgctgggttttgagacggaagatctcgacctggtgaaacgcgcgctggtgaagggtgaaattgcctttcaggagcagcccgaggcgattgtggtggagtcggcagaaggttttaacctggcactgcgttttacctgagtgcagattcaggaggtgatgaaaaacgcctcaagtgaggcgtttttcacaggctttacaacgacacaaatcagaaagtgtagctggcggtcactgagaaattacgcggttcgccgtagactacggagctggccacgttagtgtcatactctttgtcgaagaggttattgaggttgccctgcagcgacagatttttgttcacctgataacgggcgaagagatcaaccagcgcatagctgccctgacgggcacgccaggtgccattgccttccgggccaccgacatcattccagatatgtgtctgccagttcacaccgccacccagcgtcagctgctgcaacgtcggcaggcgatagctgctgaacaggttaaagctggtctgcggcagttgcgggttaaaggtgctgccatcgcggttttccgcaatgtagcgcgtgccgcccagggtcatctgccagttgtcggttaatgcgccgttgacttcaaactccacgccacgactcaccacgcctttacggccaatgtacgcgacatcacctgacccctgaaccgtctgagtggttgcttcaccgacattattcagctcggtgcggaacaccgaaatcgaggttgtgaagcgactatccatccagtcagatttcaggcctgcctcgtagtttttgccgataacgggcgacaggaaagcgccgctggcatcgcgatagtcctgtggctggaacaccgaggtatagctggcgtaagccgaccagttttcagcgaagtcataaatcaatccgccgtaaggggtggtgttattttcttccatttcaccaccaggcgtttcacggttccagttggtgtaacgggcaccgataatcaggtgcagcggatcggcgagcgacagacgggtcgccatataagtcgatttctggcgaaccagttgggtatcgctggctggcagacgcggcgtccaggctgattccggatactgaccgttaaactcgttgtagttgcccagcgactccgatgagatattctcaaaggtactgaagtacttgttatcctggcgggtgtaattgacgccgaccatcagctcatgctgacgacccagcagttcataaggaccgctggcgaaggcatcaacggcatccactttgcgtttaccggtgttgtaaccagtcccgcctaccaccggatagttggcataggaagagacgcccgccccggtgttacgatcgaaatagccatcaagatagatctgcttactgtcgaggcgcatctcgttgtgcgcgccgttcagtgtgatgttccagccgttgtcgaagtcctgtttcaggttcacaaagactttacggttctctttatcgttgtaggcccagtcaggtgcggtgttgtagccgcgtcgggtatgtatctgcgtgccgtctgtgtaccagcgcggtgcgccaccccacatagtggaatccgtattgacctggctgaattcatagccgaccgaaagcgtggcagagtcggtcaggtcagcgtcaaccacgccatagataaactgttttttggcgccgtagcgctctatgaagctgttgttatcctgccagcccgcgatcagccggccacgaacattgccggagtcactgagcggagccgagagatcggccacgtaacgctgcttattccagctgccgtaactggcggagacagtgccgccgaaactctttgctgtcggcgtgtttgcgcaccatattgatggcagctgatggattgcccggtccggttaacagaccggtcgctccgcgcaccacttcaacgcgctcatacattgccatatcggtctgcgcatcgcccaggttccagcgagcggcaaaggcagtaggaataccatcgaccatgtagttgtcgatcataaagccgcgcgcatagtagttggtgcgatccatatcaccactgataccgcgaataccggtggtatttgcgagcacatcattcagcgactggagttgctgatcggccatacgctgcttactgacgatgctgactgactgcgggacatcacgtacggtgcccagcattttagtgcccgcacgggtaaccggtacgctgtaatcagtggcgggcgaagcggctacggcatcatcggctgacgcgctgaccgtcatagtctggttatcgctggcagcgggtgcgccggtctctgcggcatgagcagcgttatgcgccagcgacgaggcgacgatgacagccagcaaggagaagcggaatggacgttgcagagcagaagtgtccgttgccctggggtgttgaagatcgaaagcgttcattaattcctcaattatctttatgtttttatgctgccactgtcacgaccatgcttcctgcggacatcgctgccctgcttatggtttgaggaaccagaaacctttccctgagcgcctgcgcgcgggtgtgatgaacttataaaacaaatgagaaatatacgcattgcgattatcattgcaagattttgttagcaaacaatacgaattttttcagggaattgtctgcgtgtgaaagacggctggaagatgataaagacagggaggcgtttatagggtcagcacgcctgctgacttgtcagagcaacagggctgctgcatcattatttgttaaagataaaatcctgtaatggccgttcattgaactgtagttgtcactcctgatgccacaatatccgccttaaatcttttatcaccttatttaacaccagatattgcaggaattcgtacgtgcgcaaaatttcaatgcttaaagcgctgataacgaccaccgttttcagtgttttttcagcccactccgccacacttgtggagaccgtgagtgcgggctgggataatttcagtgataaagtcgccacaacctggcagcagcctgaaggttacgacttttatctgcccgcgattacctggcacaaccgtgccacttacgatcgtgaacatatcaataaatataatgaaagaccctggggcgcgggcggaggtatctcccgctacgatgaaaaagggaactggaacggcatctacttaatggcgtttaaggactcctttaataaatgggaaccctttggtggctatggctgggtggcaacctggcgtccgctggccgaccagaattttcactggggtgcgggttacacggcgggctttaccgcacggcacaactgggattatattccggtgcctgcgctactgccgctggcctctgtcggctatggcgatctcgatttccagatgacctatattcccggcacccataacaacggtaacgtctattttgcctggctgcgctaccacttctgacagttgccgatataagcgttagcgtgacatcgccatgagcgagagatcgtccagcgtgagggtttcgccatcatagcgatgacgcagcagatggtagctttcgcattcaataatctgctcaaccgcgtccgaaaagatagtcatggcgctgcgcatctggctcagatagtcatgggtgtcatagacccgatcgattccttccagcgcatggttcatgatttttcgggcgacgtcattaggcgtgtcgagcgctgagagttttgaacgtgcagtcctgcgcagatcgcgcggggtaaacgcctccagtcccagcccacggggagcgcggatcatccggcgaagtgcctgattcagcgcgccttttgacagcggctgttgcggatcgcgtggcgcgggcaccagccagggtgaggccggatcggcggcgcgcagcagtgcttcgatgcactgacgcatcagcggtgaaatgggcagcacatgctcccgctgcgatttattgcgcgtaccctgcatccacaatcctaattgcagatcgaactccgctttctgcgcctgcacaatttcatccggccgccgggcgctgaccaggcataaacgcagcgcccagcgcgcctgtttccgagagtgcccagttatccagcccgtgccagaacacccagatttctgcatcggtaagttgccgactgcgcggcggcgtagcgcgacccgcgacatcacgctttttcattgaagcgatgggtgaatgatcgagatagccctgcatctctgcccaggcgagaaattgtttggtcagcgcgaacacccgccgcgcctcctcttttttaccgtcggcgatcagaatgttatagagccggttaaggcgtaagcggttcagcgttttgagtggctgcgaaccgatgttcggcaggacatgtttcagcaatgaggagatggcgatctcaggacgccgccgactgatcagcagcgagagttttacccagaccttcatcacctgctctaccgagccttcatcgccaaaattatccagctcgctgagtgaagcctttttaacctgctccagccagatcagtacatggcggcctacgtgggctgaacgcgcagggatctgtgtcagatctggggtcacatttatacctgtttgtcactgcagagcgggccattctatccattgtttatctatgactccagacctaataagtctggagtcataaagacgcgttctgatgaaatctgaggaagttttcgggtgatggaccaacaagtaaaactaacgtcacttctctcttctggtcacggttatggcgaataaatagcccattgttatggaatgtaaaggtggcttaccgcgatatacaatgataactattatcattatcatacgcatttgcttacataccttaatacttcagggagattttctaagtgaatgtaaccatgcgtgtccataagcgccctgttgcgctactgctggccggtttattgagtacctctgctaacggcgctaatcaggaagagacagaaaagctggctgatgatgagacgatgctggtcaccgctgaacaggagcttaaacagcagcctggcgtttcggtgatcacgtcgcaggacattgagaaaaacccgccggtcaacgacctttccgacattatccgtaaaatgccaggcgttaaccttactggcaacagcgccaatggcgtacgtggcaacaatcgtcagatcgatattcgcggcatggggccggaaaatacgctgattctgattgatggtgtgccgaccacctcgcgcaattcggtgcgttatagctggcgtggcgagcgcgattcccgcggtgactcaaactgggtaccaccagagatggttgaacggattgaagtgattcgtggaccggcggcagcgcgttacggttccggcgcggccggtggcgtggttaatatcattaccaaacgcccgaccaatgactggagcggatcgctgtcgctctacactaaccagccggaagatgataaagaaggcgcaacccgccgcgctaactttaacctgagtggtccgctggcgggcgatgctctgaccatgcggctctatggcaacatcaacaaaaccgacagcgatgctttcgacattaaccagtcgcacaatggttctgccgccgccggtcgcgaaggtgttcgcaataaagacatcaacagcgtactgtcctggaagatcacgccattacaggtgctggatttcagctacggatatagccgtcagggcaacatctacgccggtgatacccagtacagtaacggtgccggtaatgctttaatcgaatctctcgatggttcagaaaccaaccgtctgtatcgtcagacctggggccttgcgcataatggcatctgggactggggacaatctaagctcacctttaactatgaaaaaaccaataacacccgcctgaatgaaggcacggcgggtgcgggtgaaggccggatcaacagcaacacgttctcaaccagtcgctttgaaagttaccgggccggaggtgaagtcagcttcccgctggaaactgctgcgtgagcagaccgttacgctgggagccgagtggaaccgtgatgagctgaacgatccaaattcaatgaacggcaccagtgcgcctggcgtatccatcgacggtgtcagtggtgatgcgggcagccgcaacagtaaaaacagcgcaacgctaagctcactctattttgaagataatattgctgcaaccgatagcactgaagtgatccccggtctgcgttttgattatcacgacacctttggtgcgaactggagtccgtcgctcaatatttctcaggctctgggagaaagttttaccctgaaagcgggtatcgcccgtgcgtttaaagcccctaacctttatcagtccagcgaaggctatttactggcgacgcggggaaatggctgtccgatcaacgttacccgtggcagttgctatctgctgggcaatgaaaatctcgatcctgaagtcagcgtaaataaagagctgggtatcgagttcagccaggatggctatgttgcgggtatcacctggttccgcaatgactataaaaacaaaatcgtctccgggacggaggtgctgggttacgcctctaatggtaacaatatcctgcaatggagtaacggcggcaaagcggtagtggaaggtctggaaggcaatttcactatcccgctggtcagtgacgagctggagtggcggactaacgcaacttatatgatcgagtcgaaggataaaaagaccggcaatccgctgtcgattattcctgaatacacgatcaatacgatgctggactggcaggtgacgcaggatttctccactaatctgaactggacgatgtatggccgtcagaaaccacgccagtatgcggaatcccgcacagaaagcaattcaatgtcgaatcgcgaagtcggcgcttattcagtatttggggtcaattttaattatgacatcaccaaaaatctgcgtgccaatgccgggattaataacctgctggataagcagctatatcgcgaagctgatggtgcatcaacctataacgaaccgggacgcgcttattatgccgggctgacaatgtccttctgatctgcagcagcgcttcccggtggaagcgctgttttttcgtcttcgtcgaaaaacctcctgtttacactccccccgatttatcttctcagtgctaatctctggctgccgcttaacgagctgggaagtatctggctcacgggtatggcattaaatactcacattccgtctggaaagcgtaacgacaggtaactaatgtcgtgattcctgtatcccggccagcgaaacaccccagagtgcggctatgctctgtcgggttcaacctgcaactataactaactatcaggatattaagtgatgaaaaaattatcagttatcgttattgctaccggactgtttttgtcggtgaatttacaggctaatgcccagggctgtcttaagggagccgcagtaggcggcgtcgcaggtcatgttgctcatcatggtgtggccggtgccgcagcgggctgcgcagtcggtcatcatatggcgaagaaaaaacagaaagaggctgagcaaaatcagcagtctcaaaaataagctgaggttgtagcaccgatgtaaatcaactgattaccgggcattgatgatgtccggtgatcgctgagtgatacccatcctgagtctgttgactcacaaaagcacggtgaattaagggcagccggttatgctaattatatttatttgaaccagatgtctttaaaggtgcaatgatttaggtgagtgaccagaaatttgaataaggcacgcctatttttaattcagacagtggaaaacgccttttgaaaaaacgtcctttatcgacccagccgcacaatgccatgccatctgaatattcaattaccaccattattcttcttcttttttttcgccgaacaatggtgcccacttcaatcatgcggatgccttaaccgcactattgccggttacgtcatgggtatctgaaagtatcgttctgacaatgaagtcattactttttctcagatctccaatctctggctggagttttccatatatccgcataccttccatcatcatgaaaatgctttgagccatgactcgcgcatcttcatcctggcgaaatacccgctgctcctggcctctttttaagatgttctctaactcgttaattaaatggttaaatttaaaggaaactttgcctttaacctcttcgtctccgggtaaaagctcgctggctgccgcaatagtaaagcaccctttctctccggcaggagcagatgataactgagccacaaattcgagcgtttctcgcaaggcagcttctggcgacatttctgcatttcgtttcactgtccttgaaatgccttcatccatgtatctctgcaaagcagccaggtagatagcacgcttatcgggataaagtttatagatgctggcacttgcaagacctgatgctttcataagatcagccatagatgttgcctgatatcccttctgccagaagcattcaagtgcggtgttgaggaacgtctctggatcgaattctctgggtctgcctgctgatgctttcataaggttctcctgtgctgacgatttattgtagatcgatcaatctacaattaaaaggctttatctaaaccttgtgttaaaagtcatgcttttcgcctggtaaaatttaatactgagtcagcggacaggttcaggtgagtcattggccgccttctggcggcggcaggcaaatacttataatgggattacagtctggacctgatgctgaaaaacgtagggatctgatagcaactcatattgttcatcatccggataggtaacggcaatctgatactgttcgcctgcaaaggcttttatagcttctaaatcttcccagtacgtcgcaaggaagaaatgctcccattcgccctgcgtttctctgcgtacataggctcccagattccctggcgtcgcttctgaatgttcaacaccggttttctgcaagtgagttgcaaaaccttcggcgtgcctgaccggtacgcatccgtgccatgttctgacaatcatgttgctatcctcatgttgttgaagtgtttttaccataacatgacaatgcagggacagcgattcattctctggggtggataatgggatgttatttaactacgcaccggccagttaaggattctcatgcaacaaaaaatgccggagctcagtggtaacttcttctggtgcttcttcagccatatggtgaccgctggctatcgctttaccccgaacatgcggtgcccaggatttccagatacccaatacatcaccgtaaatatcttccagatcatcatattttgaccataaacagagtgtcgggcattcaatcaatcgcccattctgacgatcataaagctcatgctctttgtctatagtaagaccggcacgataatcctcgatcatcccatgtacagtctccggatcgtgtatagctcgcctgaattcaatgtattcatcattccccattgtttcgggctggcctccataccatttgtccggatcggctaaaattgccagctcgggtttttcaggctgagcgaagaagaaccagtgataccactgtcgggcaaacttctcattacaccggttgagcgcttcaagtatgggtatacaatccagtacagcaagtcgtgtaattcgctcagggtaatcaagtgcagccctatatgctgtataactacctctgtcatgtcccaccagcgcgaattgatcgaaacctaactggctcatcaactcaatacaatctttcgctttagctcgcttagaagaaccagcatgattgggctcatctgcaggtttagatgagcggccaaatccccttaaatcgggacaaaccacggtaaaagattcggcaagttgcggagccacctttgaccaggttacgtgggtgcgggggtgtccatgcaacagcaaaaccggaggaccattacctccatagcgaacatttagcactgcttcagaaagtctgatttgtgtatgagtaaatccctcaaacattttttgatacccgcgccatgaatttataaaaattataggctgatgtcagctgatgtatctttattgcaacggcttaatactgtgaagactgaatcaattcaaccaactccgggatactcgtttgtgttaaaacaatgtttcaaggcaaccaggcctgaaacatgacggagcagaaatgagaacgcaaaagcgatgtatgggatatgtggccatcgtggttgatgactatgatcgggcaattgagtattacaccgaaaagctgggttttacccttgttgaggatacaccgcagccaggtaaacgctgggttgtagttacacctgaccctgaaagcgattgcaatcttcttctggctcgcgcttcaaataacagacaggaaggttttatcggcaatcagtgcggcggaagagtattcctttttctgcagacggatgacttctggcgagactataaagccatgaaatcgaaaggcgttacattctcccaggagcctcgtgaagaggagtacggaaccgtggtggtttttgaagatctgtacggcaaccgctgggacctttatcagaacaggcagaattaaaaaccaaagccagttgtgtatcaggcatccagatgaacagtcaaagcacgaaccctgccgggatatttcagattcagcggggagtgtttttgaagcatcccctgagcactctgctatcaattaagcgctcgcgagcaacagagcgccgtgtgatagcagacttactttcctcaccagctataaccttcagatccgccaatcagtttcgctaatccagcgatctatccgatatttttagctgcgccctggcattataaaaacgacgataggataaatagaccgcaatgatcgttgacagactggcggtccctattagcataaacgtgaccataatctgatacttaatcgccttgagcggatctattccggcgaaaatcagtccggacatcatccctggcaggctgaccagtccgacagttttggcagcgtccaccgtcggcatcatggctgtacgaatgctgtcggcaataatgcggcccgatgccagcttcaccgatgcgccaaggctcagcatctccataattttctgctggttgtcgctgaagcgctggttcaggttgctgtaacagagccctactgcgaccatagcattaccggcgatcatgcccgtgatggggatgacctgcatcggaacaaacgctatcgccccgctcagcaccagaatcgtcagcgtgataacggtgccactaaaaatagcaacaaacgatatcgtaaaagcgttatcaatatttcgaccgcgtttacgggcgttgatcgcggcattaacgcagataaacagcaccatcagtaccgtcagccagctgttattaacatcgaagatcgacttcaatacaaagccgacaatcaccagctgaattatcgcccggaatacactccagagaatatctttgctcatgccgagcttttctttctggctgataagcagcgctatagccaccagcgtcagtgacagcaatagagaggtgtcactgatattatgctgattcacgcttattctccttttctggcggctcaagccgaagcacctgctcagcctgctggatatcgttaacgtcatggctaatccgcaccacggctaccttttcttcagctgagatccggttaatcagtgaaagtactgatagtctgttctcttcatcaagtgcgctggtgacttcatccagtaacagtacctcaggcataaactgcagattgcgcagtagtccgacacgctgcttttctccgcctgatagttgttcaacaggtttattcagcatatccggagagagatttacgctttccagcgcagcaacaagtttgtcccgctgaggtttctgacgtcgaatctgccatggcagcgccaggttgtcatataccgtctgaccaaacagttgcggcgtctgaaaacagtacgagacctgctggcgataggcctctgctctcagcgtggtgatatcactgttcctgaagaaaagttgcccggaggtgggggtaatcagcgaagcaaggattttgaggaaggtactttttccgcttccggatgggccggtcagcaagacgcaatcaccctgatataactgcagggagaccggtttcagtagctgcctatccccgactgaaaaagcgacatcctgcacatccagcaggagtgaaactctgtccatatttgcgcctcaggacctgacaaattgagtgttggcagtatcaaaaaaagcaggagttacccttcacaggcagattaccggtactgcatgttgcagcgcactcacactgctggcgtgggcgctgcaaggcaaatgtacatcaggctatgaaatataaggcatttaattgcggctatgcatcttctgagtaaaaaatcagtgtgtggaggtgtccgccagccaaaactcaatatgatcctgcacgaggaacgtggcaggcatcgggtttaaatcagagtggcagacacgctgccacccgacaattatttgtttttccagctggtagagaccgggttggttacggtgtttttttcctgagtataggtgccgttctgctgcgcaatggcttcaccggtatccacaatggcattctgaataaagacgtttctgctcgtcacccctgataaaagttaactgatgaaaagccgttttattgccccagtcagcagaaggcagagagataaaacgcaccgtgaaagtttcatcatcaaacttgccctgcatgacgtaaacaccgtagtggttttcgccctgagaaatgattttataggtaccgttgtcgtaataataaatctccgcatccggaaacggctttttgtcatacatttttcggtagtgcagcacctgtttgatggtgggctggccgaagctgacggcgaggtttttaccatctgctgacgtcgtcagaccttcagcgtgaacactgctcatcagcattaacagacttgtagcggccattgcggttgctttcactctctttctcctcagcggattacggggacaacaagcgtatgagaccccagaacttacacggtggtgagtatctgttgaagaggcagataacatattattacacaatgttataatcacgccctgcaacctggcgacttgagccgtagttgaccgggttgcccgatatcgaaagcgctcggatgcagaaggaagcggttatcgcattgaaaataaaaaataaacgccaggctgacgtttaaagttcgccagtgacgcttaatgccgcaacgcggtggaaagctgtttaactgcttaaacgaatatcggtctgctgccggccgctataacaaaacggcgcagaccgatctttcgcgggtaaatccgggctgtatcctgctcttttacagaaaatcaggcactaagcgcagacagcccagggcaaggggaacgtttatttcagcggttccggcagcgttacgatccataactcgctgtccgtctccggtttcttcagcggcttcacgccgatcgtcgttgcaaccggcttaccctctacagtaagttcccccttttcattcagccgataatccttgcgcttcttaccttccaccggattttgcatgaccgttttcacgccgaagtcattgtcattggcgaccgccagggttttactgtcgataagcgccagtccttcggccttctcctgctgccagccgagttgacgtaaatcgaccaccagcgttttagctgcgagcttaatgcctcgctgcgccagcgctttctcgttgtcagcctccggatactcaccaggctgatcgaatgcggcaagatcggtagccgcactgagatccaccttatagataaggttgcgcatcgcgtcgtttttatcgctgccttgttcaatcaagagaatatgctgattatcgagcgccacgatatcgccaattttggcgtcgctgtttttactataagcctggctgtcgatagggtatccatacatcgcggttttcccggtcgccggatcgaagctcaccaggcgggtaaagcgcgcctgctttttacttttaccgttgatatccagcgtactctgcaccgcggcgatgatgcgcccgtccggcatacgggtaagcccttcaaaaccacgattaggctgacgccacttaagaatattaggcagtccgcccgcaatggatttttccccttcattagcctgcggcccgtgaatcgccagaatctttccgcgttgatcaacgttaatcagaaacgggccatattcgtcgcacaaccagtacccgcccttcccgtccggcgtaatgccttccgtatccagaccacggttatcgcccttcagcactttcagtgtgtcgcttaacgcgacttcattggttgagccgatgacaccatcctgtagcggcaatccgttaatgttgcccttgtcgtcatgcagcggtcgggcatccgtggcttctgctttgccgtttctgcacccgaatattcatcagcagcggagcgaagtctggcgtgacgaaaatttttgactcatgcttgcccacatcgggtgagtcggcattcggcccgcgatcggtgacggtcgcgaaggtgagcgcatccccctgcttaccggtaaacagcaaaccggagccgattcccaccggcaaaccatccggaaacgcactggcgaacgcgccgctgtagctgacgcgcgtaccttccggaaaactgacgatatagtgctcagcctgaggttgcgccgcaagaccagaaaacgagagcgcacaactgataatcaaagaaatcgtttttattttcataatattaaaatccatgagggaaagctgacagcgtaaagacgataaatgacaggaaaatgatatttgcggtaaaaacggactgctaacaggttgatttttccaccgttaaggcgccggctggtgaggtggtgaacgtagagtgaacgttgcctggtgcgcaatgctgtctgctcagtgccaggagctgacattggcagaaaaatgattgttattcatcaccatattgctatcgttatgcacttccggatgtgaaccacagatgagaaagcttgcgggctacttactattcagatatttgctctgaggtggtgagtaactcccagagcaagtttgcatacggaaatgtgtactcgctccgggagaatttacatagggtgaaactgagaactgaactgatgttctggttagagtaaatcagagacaggctgtcgtatctcatcaccagaacatccctgtatttacctgagataagcgttcatcaatatgtgatgtttattattcaggcgatttttctatgccgctagcagaattacttattcgcatctgaagacgagaaatgtgcccggtgatatctgcagtttctttctgctaatccccggatagcactggcgatgacagaaaacccacggccatgtacacctgctctcgcggcttcgatactggcgttcagtgaaatgagtttgatctgcgtagcaataatcccgttttcagagacgagttcggcaatttcttttgcggtttcggcggtctgaatgtttcgcctgacttcgctttcctcatgtctgccacggtctttacggccctgaatatcaataagcgcaccgacggcacgcaaaggggtaccatcaggtgcacgtttagtctgcccgcgggcctgaaaccaccggtattcaccacttcgcagtttaagacgatattcaatatcaaaaccggttttaccactgaagtccatcaggtggctgacgaaagcatcgagcgcattctgtttgtcatccgggtgaaggcgtgatgcccagctgtccatcacatcaggaaactcttcaatggtttcaaaacccaacagcttcctgaactgcggtgaccaccagaatacgttgtcgggattcaggggatttccgccaataatatccagatcccagaggccgtcattaagcatttcgcgcgacaggtcaaaacgggtggagacaatatcaaacttgcgggactgtgacgtttcttcttctgtattctctataacggcaaccaggcgcggcggcgtaaattcacgactgtatgatgcacggatgcaaaaccactgaaaggtatttgcgccagttttgatcaggcagcgtaacagcttttcatcaccgctatgtttgagtgtatgacttatcaaacctttgaacgcttcccggaaatccgcatggatcatctggatcagcgaagagagcccgacctccttctgcagaggcaatcccataagctggcgtgcttcaggtgaaacaaatgcaggcgcgtcacttttaagatcggtcgtctcaacataccaatagcctttctggctgaggttcataatacatttcagcagcgtggcatcactatgatccacatccatcgtttcatcgataaatttctcagcgatatccatcgttgtcggctctttggcggactgtttccggaataaattcagcattatttctcctggtgagcatatacaggcataaaaatatgcctgaaagggttatcggcagaactttctggatattaagttaaaggtcgctggtttgaattaataccgtaacaagatgctatagatagctcgccagcgacaactaccggagctgaggtgatggatgagcctcaccgccagcgggctaaatttatttttttgaaatcctgtggcgcaaaattatctttggtctatgatatctggaaaatttcaggccttataatcccgacgctccgattcccaacgaaatttacgttgaaatgttactcttagttttgacacgcgattgtggatttatactagctggctatcgcggatattaaatgagtggtttagctgtggcatgtcacttctgctgacaggcgaaaacccgcacattacttattgatatccataggtatacttcagcaattcataagagaaactggctgctgatcatattagatgtattaacagggtttaatatttaacttaagcgatatttttatagcttggtttcaatttgtttctggtttatgacatcagatatcatcagcctcatgcagatccgtgagttaaataagcatggcattttatgcacatgaactttctccgctcactgacatcatagctatgtgtctcgcacttaatagccatagataatttaaggcctccggaaaaatgacgtctgaaaaagatcaatttttccgccgcaaacaaaacagggttttaaaaaagggtttctattccgttcccgctcaggtcatcaatgccttacagaaatacgtttcaggatatttaaatgaatgaaaaattgaaagatgctgattctcgtgcagcttgtcagcagctaattaaatcgggcgagtttaaacctttttttcagccgatagtctcacttgaggatcagcgcgtagtgggttttgaattgctggcacggcgtattttgcccgaagggcttatcgtatctccggctgagttcattccggctatggaacatcatgggttactcaatgagctgatgacaagtctggccgctcagggattcatgacagcgagctcctggccagaacaccagtttctgtctataaacgtttctccttcgcaactgaacggtaagcaccttcccgaaattttaagaaaactggctgaacgttatcagttcagcctttcgcggctcaggatagaaatcaccgagacagcattgatcgatgatatagagacggctcatgcagaaactcgaagcattgtctgaaatgggttgtatgattgctatggatgactttggcaccggctgttcaagccttgcctggctaatccagcttcccgccagcacgattaagattgatggcagttttattcgttcaatgcttcagaaaaaggatagccggaaaattatctccagcgtagtcggtttgggccgcagcctggatatggacgtcattgctgagggtgttgaaacagaggaacaggctgagatgttgcggggtatcggctgcgcttatgcacaaggctacttattcagcaggccgatcccggctgaagaaacacataattttctcaccgctggctctggccgtaaatttcatagtcgtgtggcacgaatgtctcttgagcagcgcgcgcatcagatttcatcgatgtatgctgcgcctaacacctctatctgttttctaagccctgaactgatgattgttgacgcaagtgatacctttgcagcgcgggttggctggccaatgcaggacattacccatcgccatatttttgaagtgataccgtctcaagctgagaagctgctttggttgcaggatttcaggataaaaggtcttccttaccctccgtttgaagtaaagctgcccggcggtagcaccgatttggttatgattacgcgggtggaggatgaggcaaaagatttactggggttttgtgtgtttggctttaacattgaccgtcagaacagccttgttcagccttagtgccagttcacaacatcatctgatatttcccggccgccagcttaattttaacgaggcaggcttcggtttcaggttgttagctgaagatgaggaaaatgtccgcttagtgccagtgcggaagttgcgaacaacattctgtgtgaagcaatggtaagcaggtcacattttctttgacccatttaaacgttttaccctacagaatggaggaatttcctggccttttttcgattaaggctacctttttacttcaggcccagtttgactgccagccgatgaagattacccggatctaattccagctttctagccgccttagcccacacccgatcgcagctttcatagacctgtttgatgtaatcgtactgaaatttacgcgtcgcctcgctgaggttcatcgctggcgttgctagcaacgttttgatcggttctgcatgaacagccccgttattctccagttggaaatgttgcggaagcagaataacttcgccgttgcgtgattcggcctgcgcgataatcacggcgcggtatatggcatgttccagctcgcgcacatttcctggccagctcgcggcttgcagcatagcgcggcagccagaacttagcgcaacgcttaacagaccaaatttaacccgacacttttcacagaaatagcccgccaacagcacgatatcgtcccgacgctcattcagcgacgggacgaaacagcgggaagacgcttaggcgatgataaagatcagccctgaatttgccatcggtcaccgccttacgcatatcgaggttggttgcggcgataatgcgcacatcaacggtaagtggcttatcttcgcccacccgctgcagatcgccatactgcagcacacgtaaaagcttggcctgcagcgaaagcggaagctctccgatttcgtcaagaaatagcgtacctttgtccgccaactcgaatttgccgggccgatcgtgaatggcacccgtaaacgctcctttgacatgtccaaacagctcgctctccgccacgctttccggcagggctgcacagttcaaatataccagtggccgcgctgcgcgctgagattgttggtgaatagcctgagcaatcagctctttaccggtgccggtttcgcccatgatcagcacgctgagatcagaaggagcaaccactccaatctgctgtttgaggtgcgctaacgccgccgaatcaccgatgatttccacctcttcgttctcttcgggtcggtgtggtgacggtgtaaaggatgaggcgggtttttctaaacgctccatcagcaaggcattgttcagtgcgcccgccatcaggctcgccagcactcgtaactcttcatcgctgtattcatcaaactgagtggcattaatgccatccagcgtcagggcaccgatcaacgtttgtccgataaaaagtggcatgccgacacaggcatgaacgtgtaaatcgccttgatcgggaatcaatccatcatagggatcgggtaaatcgctgtcggcgggaaagcgcaccacatcgccagcgcgcgcgatggcctcaagccgtggatgaacatcaagattgaatcgccgtcccatcacatccggtgccagacctgcagtggccagcggacgaaactgctgattctcgtagcgtaacagcgcggtcgcatcacagtttagcgcgccatggatgctgttaatcatccgcataaaccgatcgcgtccgtgtacaccattttgaatatcgacagccagcgccgccagtgtttcaacagaaagcgtcatattgtcccctgcacatgaattgtctcaaagataactaaacgcattgtatttagcacaatcccgttttgcctgtttgatgcaaatcatcgtgtaaagtaatggcatggaatatgccttatcagattagataatgtagctagggagtatgaccatgccgcaagcgcttttgacacatcacaacacgaaaaaaggcgtatatggcaggcttccagttatgtacggtgcggtgaaatattatggtttctccggtgaacacgagacagaacacgaaatggaaaccaccattatcgccgggcagtttggcatcagcccgtcgctatcctggcaccgcattgagttgttaaatgatgacacttatttcaatcttgaattttttgctgacccagacgttgcattagaaggcgacggatttgaacgcgagcttcatattccggaatcatcgaaatgagccatatcactgacccgctgcggcggtttttttatatcacatgtattgtcattttaacaattagatgtcattaacacaaaatatgccagtgtaattttaacaatgaagttaatgtaaacacccaaatatcagtaacttaaaaactggcacatttgatgcaaagctggtgtgaaaccaacttacgctaacagggcatcaaatgaacattcttgtaaaaaacaatattttttgggtcggcaaacgtgactgggaagttgagcacttccacggcaaagagtacaagatgcagcggggcaccagctataacagctaccttattcgcgaagcaaagaacgtcctgatcgatactgttgatctgaaatttcgcactgattttgttaaaaatctggcagaagaaattgatctgaaaaaaatcgatgccatcgtaattaaccatgccgaagaagaccattctggcgcactcgccgaaactgctggcgctgatcccaggcacgccgatttactgcactgctaatggtgtcgattccattaatggtcatcaccaccatcctgaatggaattttaacgtggttaaaaccggtgattcgcttgatctcggcaacggcaaaaaactgatttttgttgaaaccccaatgttgcactggccggacagcatgatgacttacatgaccggggacgccgtgctcttcagtaatgacgccttcggccagcattattgcgatgaacatctgtttaacgatgaagttgaccaacacgaactgtttgaccaatgtcagcgctatttttccaacattctgacgccttttgcacgtctggttaccccaaaaatcaatgagatactcggatttaatttgccggtgagtatgattgcgacctcgcacggcgtggtgtggcgcgataatccaacgcagattatagagctgtacctgcaatgggctgcggattaccaggaagatcgcatcactctgttctacgacaccatgtctaacaatacccgcatgatggcggatgctatcgccgagggcatccgcgaaaccgatcctcgcgttgccgtgaaggtttacaacgtctccacccacgacaaaaacgaaatcattacctcctgcttccgttccaagggcattctggtcggttcctccaccatgaacaatgtgatgatgccgaaggtggcgggcatgctggaagagattaccggcctgaaattccgcaataaacgcgcctccgcgttcggttcttatggctggaccggcggagcagtggatcgcgtagccacccgcctgcaggatgccggttttgatatgacgattgcgctcaaaactaagtggcgtcccgacctctccgcgctggaagagtgccgcgagcatggccgcaaaatcgcccgtgaatgggcgctcatgccgctgccggtagccgtcgtcgcagcgaataatgccgctgcggttatggcagccgccgtgcccataaaccaggatggcgtcggcgtagtagaagcgggtgagaacatcggacagaaaatgatttgtacggtttgtcagtgggtttacgacccagccgagggcgaaccaaatcaggatgtcgcaccaggaaccgcatggaaagccgtaccagacgatttcttatgtcctggatgcgcgctgggcaaatccgtgttcgaaccttacgagggctgagtctatgtcagcagacattgtggtgattggctcaggtttcgccgcccgccatctggtcaaaaacatccggcatctggacaaaaatgtgccgattcgcatcattgctgccgacagctgtgatgaatataacaaacccgaactcagtcatgttttcagtatgggttatcgcgctgaggcactcactcgacaagcagcagcagactgggcggaaagccagaacatcatgctgcatccttttaccgtagtttcgtgcattgatacggctgcacacattatcacaaccagcgcgggcgattacgtctatggcaagctggtacttgccaccggtgccgaggctatcgtaccggagatagaaggcagtgatctgatcttcacgctgaacagtcagcaggaataccgacggtatgacaaagcgcttattgatgcgcatcaaatactgatagtcggcggtggcctaatcggcacagaaactcgcaatggattttaaccgtgctggtaaagcagtaacggtaatggatcgaagtaacagccttctttcaacgctgttaccaccggaaatcagtgctcggctgcaaaaccgtttaacgaacaacggggtagaatttatgttcaggcatgaactcatccaggtctcacggcataatgatttactggaggcaagtttcagtaacggacagagaaagacctttgacgccgtggtgtgtgccattggcttacgccctaatcttacgctggcgaagagtggtgggattaagacacgtcatgggattgtagttgatgacactcttgccacgtcggttgccgatgtctatgcactgggtgattgtgcagaaatacaggggaaaccgatgccctatctgcaaccagcagcccttgcggcaatgacgctggctaaaaaccttaccggccacaacgccaaactgatgctaccagccatgttgatcaagattaaaacgccggatatgccgcttcagctggcgggcgatccagcgaatgctgcttatcattgggaaatggcgctatccccggcaggcataattgctcaaggccgtgacgaagacggtgcactacgggcatttgttgtcagtgaagatcatatgaagcttgcattcagtatgttgaaggacattaagctaccgggcacatcttaatcgaagcattttattaacagatgatcagaggtatttattttcgcttaataaatcgtcgattttgcttacaccaaacaggccggttttctccggcctttgttttcaactcaataccaaaggatgtgacatgatgaatatgcctgaagccccggcagtaactaatattacccttcataacccctcgtcctgcacttgtggcagaattatttggttatcaatgcactgtgatttcttcgcaatgaatattggaacaagcggcaatgatgggcgaatcagtgcaaatatcgggacgttttcgcagagtaaaactttcccgcccgaaatgctcaaggacgccgttgcaacaatattttgggagatgtggaatctctgggaacccgcagaaggcataaaggttgtggctgaaggatagaaaaaatagaaatgatactgatgcgcccacatgcgctctttacagaaccatcactataattttaagaacaacattatttcccataaagaaaatagccagcgccacaacgtcaatgttaatttcctgtccataatttctcgaagctccggttaatgccagaagcggaagttaacaaggtgggatatttcgcagactcccatagagaaattaaaaatatgataacgcgtaaactcaagcgggatgtcaatcttcaatcaacatcccctcatggagaaccccggacaacactttacagcggctaacgaccatagttgccttattttttcagtttattcgtgtgtgcaccggcagcagcgtcacgtgtctggcctgccggggaattccactggaaacctgtctttgcctcgatacctgggcgtagccgttactcgtcgatgtaatcttcccggggatgaaagaacaatggcgcttcctgctcaatatgccgcagccgtgtagcccacttttccagacaggcctctctgatttcctgcgacgtattatctgccatccacgccataaaattgtctttacagccccgttaaacgactgcgattccgggtgggcaaaaacgattagaactttcagggatttctccctgttgaacgacgacgacgcgcagcagaccggtccagctgagtgataaaccacggccagccgctgacaataacgattccactcaggataagcagcgtgccccagatgaagcccggctgaggctgctcgtcgagaaacagcattcccgccaggacaccgaaaaccggcgtcatgaacgacaatacgccgagctgtgaggccagataggttttcatcaggctgaaccaggtcaggtagctggcaaacccgacaataaaaatctggaaaagcaagctcaggcttccggtgactcccggcctgaaatgaagctgtccgctgagcagtgcgtacataaagagtaaaatgcaggcacctgtgagctgataaaacagtgtatgtgttgccggtgcctggttcagcgcagtacagcgcaccacgacagtggtagctccccatgccagtccagccagcaggcccatcacatctccagtcagcattctcactgtgtcgccggtgctgctgctcccggacaggaatgccaccgcaatcccaatgaacgcgacaacgatgcctccccattgtgcaggcatgagccgctcatcaggatgaaaaagctgcagaccgacagcggcaaaggcaggcgcagtgtagagaaaaaccgccatatgggaggcagaggtatagcggagcccctcagcaacaaacaggaactccagtgcaaacagcagcccgaccacacatccagccatcagataagggcgggactgacgcagcgactcttttttgcaggtcattacgaccagcacaagcagagcggcaatgccggagcggagagctacctgtaacacgggcgaaatttcttctgccacgcctttgatagcgacctgctgtactccccatatgatgcagagcaccgtcattattgcgcttgcgcgcagatccgcattttttcgcctgaacgtcatctctgcctcctgaaaaaattcagtatggcagtgacgtggatagagcatatagtgtgaaaaggacatcctgtagtgtaaaacagcaggaaaatacaggaatcaatcgggttcagtcatgctaaacaaaaagcttatttctccccccttcacacatgaactacccggcccggcatggttcagggtggctgacatgcccgccggggctacctatcccgtgcactcgcacccctggggtgagtttgtcttttccttcagcggagttatggaagtcaggctggaaggcgatcacctcactgccccggctaactatggtatctggctgccgccgggcgtcgtacatgaagggctgaaccgctactctgctacccactgttcactttacctgatgcctgaactctgcctgggcatgcctgaagtgccctgcacactgcaggtaaatcctcttacgattgccctgcttgaacatctccggctgcatcctcttctgtcgccgctttctgaggaaaaccatcggctcctcgacgtgctccgtgaccagttgaaaagagcacagcgttataaaaattttctgccctacactgatgatccactgctcaaggggattctggaaaaactcgaaaaaaatctggcggatgatacgccgctggcagaactggcttcttcatcaggcacgacaataagaacgcttaaccggaaatgtcaggaggcgctgggtatgccgctgaacgagtggcgtcagcggatgcgcgtagtaaaagccatgcacctgctggaaaaaggtggaaaagtggaaagtgtagccttcgaagttggctataacagcgcgtcgtcgtttattgccatgtttcaaaggcagacggggatcacacccgggcaggcgatatgttcacgatcgtcattttgaatgcagcgttgttgcctgtgagaaaatagcggatcctgattcgggtgatgtaatgatatgggtgcttctatttgcgctcacaccagatgcaacatccttgttgtttgtctgcttagtgccagacgcggatatttattacaacgcgttgtattcatcaactaattgcagccacttcactttcaatctttatgcatcagcctggtcagcatctcgcagaaggcctcgcttgctggattaacgcggtgtttattcaggcgtagcaggcaatcgaccgacggcagaggcatcaatttctcaagttcaggcacgctacaaatcgctttatcaacgctatattgattgagtattcccacccccagccccgtggttatcgccgcaagcatacctgctactgaaggacactccagcatcacatcaaatggtatgtttgcctggcgaagtttctcctcagccaggttacggtaatagcaatccggtccccaggtaataagcttcaggctcttatccgagtcatgtcgccaggcaagcgttgcataccagtataatttttcactccacaataccttatcttccatcgatgccgtgcccgtgaaatcctgatgtaaaatgatctccagacttccttcagaaaaatgctgacgcaggagatgactttgctccaccaccagttgtatatccacctctggatggtggtgagtgaaggttgaaatcaccccgcatatttcagtcattgagatgtgttcagtcaccccgattcgcagcttgccacgcagcgccgaaggcgaaaaataggctacggcttgatcgtgttcagtgagtattttttccgcatgttgcagcagaacgctgcccttttctgtcggaacggcttttccggcgatgcgcgttaatagctggcattgaagttgatcttcaagccgtctgagcttccagcttacagcggactggctcaggttgaggagtaatgcggccttactcatattgcccgtttgcagcacggtccggaacactctgagtgagtcaacggagagtcgtttattcatttttgtatgacaaaagtaggattacagcgggaaagaatgtcactggtgtcatattcagtcaacggatagcctgactgaaacaaacacaacggagaaagcagatgcccgctaataacccattactgaatgacgacgttctgataaacggttgtcgcattgcgaccggagtccatggttcaggaagacctctggtgctggttcatggcacgcccgcacactcaataatctggcagtcactggtgccggtatttgtcgatgcgggttttcatgttcatctgtatgacctggctgggtttggcgcgtcagagcgccctttgactgctgatacctcggttgctggacaagtgggttatctgataaggctgcttgaacactggcagatcgaaaaaacagatctttttggtcacgatatcggtggggccatttcactcagactggcgttcgacaacccatcccttctgaagacgcttacgattgccgatattcccagctacgattcctggccttcgcccacatggagagatatgcgggataactatgcggattatgcgctgattcccgccactgagcattaccgcgcgatgagtcgccagttaaagatggctgtttttaataagcatcttatgacagagcagcggctggaaaattatcttgcaccgctttgtggtgtggtagggcagccttcattttatcagcatcaggttgcgcactataatgaatgttacaccagtgactttgcagaaaaattgccgcaactccggctgccagtacagattttatggggcgccgaagatgaatggcaacccgttgagtatgcaaggcgtttgcagcgcgacatcgtctcttccacgctgcatatctttgaacaggccggacactttttaatggaagatgcccccttgccagtcgccgcacaggtaattgattttgttaatcaacataatatgaggtagagccatgatccttatcggaatgctggattcaccctatgtcagacgggttgctatttacatgaaagtattgggtattcaattcgagcatcgcccgctttcggtattcggcgattttgatgccttaacgaaaattaacccggccgttaaagttccaacgcttatcacagatgataatcaggtgctgatcgattccacactaatcattcattaccttgagaaatattgcggtcattcgcctgcacctacatcagcgtccggcgtggaagagttccgggatctgcatcttaccggcttcgccctggcagcctgcgaaaaagcggtgcagattgtgtacgaacagcgtctcaggccggaagaaaaacagcaccagccctgggtggatcgcgtaactcaacaactgcatggtgcctggcagacgctggagaaacgggctgcgggaaagtcatcctgacatgctgtccgtggccggtatcagcatcgcagtggcctggagttttacagaattgatgctgccggataccgtcagccgtgcgctgtatccggaattggccgggtttacattgctagccgaacagcgaccggaatttctggcaacgcctttgatttaatgaggatgggttttgtatataagagcccaatgatgccttacctaatgtataaagaacttatagctttagaattagtcgatagcaaaaggtgactcaatgagcaccaattgaatatcttcatacaatataaataactcttaataatctaataaaggcaaataaacgtaacatccgctttttgcatataacgggcaatgctctgctctatgccagaaacggacgtttatgattttgaattaagcataaaagtgcatacgatttcagaaagcattaacttcccgatacggattacagagacaggcctgactcagcaataaaaacgataaagcagcgtattctcgatgagagatatcggctggccggccagagtgccgagaaatacccctgcctggtacagtaaccgggcaatacctctttcagttgccccgaatccaaagattcacgtacgacaaaatcgggcacatagctgatacccatactgactggtctgctacacggataacaacaatatatgagtcagcacctgatgtcatactgatggcttacggttaaacgtgacggccggattgagaaatgagcgattgaagagcgcgaaaaatcttaaacttaatctgatgttcatcctgttaagtggctgaaacacacagctaacgcgttgcgcatatagataaatacattccccactggaacgattaacctgccacctgctggcctttccttaagtcaaatccgcaccccaccgccttgatcgggttacacgtcagttattgatagtaccagcgaaaactggagtgaaaataacgcgcgttatcgtaaccttagaactctacatttttcattcaaaaacagtaacttctcctctgattacagttcgcctatgctggctgctcattaaatttcacttcagaaggatctgttatgtttgttgtgcccgcatcctacagtgcagaggctgttgagtgcctttatgaagtcatcggcatactcaacctgaacggcgtacgctgccacgttatctttgacagtcaggcatcccgcgccgcagtgatccaggcggacgcaacagaggaacatggcgaaatgcgccatcctgtgctggccgtactggaaatggaacgcgtaacgagtatcaacaccatactgcgcatcaaatcgttctggaccgattccgagggcgctcaatcaggtgtggaaccaggcacgctggcaaaagcgttgtataaagcgctgacaataaagaaacatatcacgctggtgggattgtaggcattctgaagcccgtgaagtacgggctgtaacagtcaggtattgagagagatacacgccggggatgagcatgataattccacaggtgcacaagagtgcttaatgctgatccgcgcatcctgcccgatcgggcgttcgatggcagtgtgaagattccgctttattattgacgtgttgatactgctctgtgtgaagacacagagaatgccttgctgaagtcccggatgcgttcctcacgtcccacggcaagggcaaacagcacgccacccacaatagagaacatccccagaacaccccatgccagcgtcatatcactaccaccacccagatgcttgaggtatccggcaacaagggggccgccagactgtccaatgaagttactgcatgcgccgacaaaagccaccgcagggacggctttctttgtcgggagaatttcagtcagcctgacgtaaaccagtggcaccagcatcttcattgtcaggccgacaaacatgaacaaacctatctgagcccagtaatatgacagcggcacaaaagcggcagccagtaatgccacaccacagaggacggtgggaatagcggcatgcagtcgtcgctcctggttgtacttatctgaacgccgggtgatataccagatgcccagcatcgtcatcaggaaaggcatcccgctgatgagaccaaccataaattcactgagcgtgccataccctttgagagctgtcggcagccagagcgtaaaaccgtaagcgagcatgctatgcagggagtagccgatcagcatcagccagagggccggtattttgagaatggtccaccagggatcggatttctcattcctgtagtttgactgctcagcggccaggtctttctggatataatcccgatcttcggcactcagccagctagcggcctgaatacttttgggtaccagataaaaccagatgatgcagaacagccaggccggtgcaccttcaatcaccatcatcatgcgccagttatgatgtgcaaggatccagccagatatcggaccggccagaaacgcgcccgcacccaggctaagattccagattccgaatgcccgccccctttcaggcttcataaaccactgggccaggaacatggccgtggcggcctgaattggaccttcagcgatgcccagtaagaaacggatcgctaccagttcaccgaagttacgcgtcaggccggtaagcattgcgcaggccccaaacagaaacaggctgatgcctattattttccgtgatccaaaacggagagccagccatcctgcggtaaattgcgtggcgacgtaaccccaggcaaaggcaccgccaagccagccggcttcaacaggactcaggcccatttcagcttttatatggggcagcgccatacctatatttacccgatcaaaaaatgaaatggtatacatgatgaatacggcaggtaatataattgtccagcgtttatttccgataagcgcatgacccttgagagttttctcactcatgataacttcctcatttaacactgtggcagggggaggaaatgctgatttcagattcttttaaatatcagtcaaaattttttattcattacccgtaggatgtaacggagaaatgagcgatctgaaagcaaaaggcgcggataaacaggccgggcgccagggttaatgagtggttcgaaatgcctgatatttctcaaaatttccagtgcatatctaatccaaaaataatatctgaatgccgataattcaatggatggctgatatacctacaagaagatgttgtgcctgaatcaaagccagcccttcaaccagaaattattaacaatgctaccctttgccagttcaataacgccctctcctctcagattcagataaacttattctcgctgaggcgtcaggttaattaagagattgatattttcccgcagcccctcaacttaacgaggggcgcagtgacattaaacatgccgtaatgtaagcggaaacttattcagccagcgcccgcatttctttaatgaggtctgatttgccttcgaaaccgatacccggcagttccggcataataatatggccatcttcaacttttaccaagtccgggaaaccgccgtaaggctggaacagatcgggatagctttcgttaccgcccagaccgaggcctgcggcgatattcagggacatctgatggccgccatgaggtatgcagcgtgacggtgaccagccaaactgctccagcacatccagtgtgcgcagatactcaaccagcccataggagagcgcgcagtcaaattgcagatagtcgcgatccggacgcatgccgccatatcgcagcaggtttcgcgcgtcctgatgtgaaaagaggttttcgcccgttgccattgcgcctggatagaactccgacagggctgcctgcagagaataatcgagcggatcgccaacctcttcgtaccaaaagagtggatattcacgcagcatttttgcgtaggcaataccagtttccagatcaaagcgaccattagcatcaacggcgaggcgcgcttcgctgccgatttcttccagtacggcctcaatacggcggcggtcttcgtccagagaggcaccaccgattttcattttcacaacgttatagccgcggttcaggtagccgcgcatttcctgtcgcagtgcgccaaggtctttacccggatagtagtaacccccagccgcatagacgaagacgcgcggattagcctcaacgcccttcatttcggccagcaggcggaacagcggcttgtttgcaatttttgccgttgcatcccagatggccatgtccagggttcccactgcaactgaacgctcgccatgaccgccaggcttttcgttgctcatcatcacggcccagactttgtgcggatccagattgttacctttggcattcagcaggctttcgggatcggcttcaaggatgcgatcgcggaagcgtttcccggatcaggccaccctggccataacggccgttagagttaaagccgtatcccactacacggcgcccgtcgacttcaacatctgtcacaacggcgaccaggcttgtcgtcatcttgctgaaatcgatgtacgcgttacgaataggggaagcaatgggtttggtaatttctacaacatcaaggatgcgcatgatctctccggtagttctcagtcaaagactgttttactaaaattcctacgcaatcagttatgtcatgccatctgtttatcggcattcatcggcacaatgaagtagcgtagtgttaacggacctgattgttctgtctgctattatcctaagcagtacatgggttccgttctaatgccaaagaggcagcctgtaatgcaaaatcggcatcaccttgagttaacctggcttgaagactgtattgcgctggcgcaatcactcaatttttcccgtgcggcagcttcacgatatgtgacacagcctgcattcagccgcagaatcgtctcgctagaagagtggcttggcacgccaatttttgaaagaaatcgtcggggcgtcagcctgacccgcgccggagaggttttcgtcaggcaggtgccggaacttattcgtgcgctttataccctgaggagtgaatctatcgaggccgcaggagaggcccggccggatgttattttttccgctacgcatgccctgtcattttcttttttcccggcactgatgcgtaacaacgaaaaaattgcccgcttcggatcttttcgactgttatcagactcattaagtgcctgcgaacgcatgattgagaaaggtgacgcgcaatttctgctttcttattaccatcctcatatgcacatccatctcgatcagtcgaaatatctcagcgtccggcttggacgggaagttttacagccgtattcacgatgcgatccgacaacgcgtgagcctctattccatgcgtcaggcggtaaaaagtttcctttcctctcctattctgctgaatccggcctgggccgcatcctgtctaatacctcacaggttaaccgggccagacgcggaatggatattgccttcacggccgatcttgctgccaccttactcgccatggtcaaagccggagacggcatcgcatggctgccggaaacactggcagcgccggatgttgatgctggctcgattgccgtagcagctaataaggagagcgcactctggatacccatagagatccggctgttcagacccgcagcgaggatgtcccgggcggtagaagcgttgtgggaaattttcttagatggccaaatctgagcggaaaaccattttgcgctaatcgctacgacatctgaaatgaataaagcgagaacacatcagaaccacaagctgacgctctaagtggcctgacaagcagagtagcacaaactacccatatcaatataaacaccgcttgccttcatgcgaccgaccggagattaactagcttgcgctgcggtttcccggttttcacgcatgacatcgactgggtaagacgtcccaggcactataagcaggtaatcgggataaccgatgatgggaatgaaatcgggtattaaatcaagtgggttaaacagtataggctgcgacagtcaacgccagcacttcagcgagcatcggcgtgcggagatcgcgggcggcaagccataccgcgtgcagtcccgtttgatgtctcacacccattgtctggtgtcagcaataagtttgatagtcactaacaggcattaacttattgagacgtgcttactttacgcttccgcatagttgctctctgacaggcacaagcttcgtgctgaaactaagcgccgttctctgtcactcaacaacgttcagtgcattagcatcccaggctttcatcgcggttgataccgccgaatcgagttcattgccggttgcgccatcacgggcttcagtcgacaggccgatctcaaaactgtgaagggtcgtggccagcgcccgcacgtcggtatcggaagccaggagtcccgcctctttcgctcttgtgacacatcgcaaaaatcccgccctggtccgatcgcgctgcgctgccagaatctcacggatgtgctcattcgctggcgaacaggtattaacggatagcgcaatcaggcaaccactgggatgcccctgttctgtctgcatttttgcagaacgacgcaacgccagttcaatagcgtcacggggttcaagcgtgtcatcccataggcaatcgttaacctgaccaaaagtcgtcatataacaatcgacaacctcctcaaacagcgcttcttttgaaccaaacgcggcgtaaaaacttggggcggtgatgccgttgccgaggtttgacttgagcatggcaagcgaagtggactcgtaaccatgctgccagaaaagggtcatcgcctgacgaattgcctcttcccggtcaaatgtccgtgggcgtcccatctgagccatatccgctcctttttcgcttatcgtatataaatactaatcgatacatatatacttgacaagcctcagtgtgccctatactttctgatatataccgatcggtatatatattgtaaaacccgttatccggagggtttcgcaatttttagtcgttacaaactaaaaaaggggccaacgtgcacgccaatacagtattcagtgagaccacaacacaacggggtctgccactggcttccctgctggcatttgccatgacaggctttattgccatcctgaccgagacccttccggcgggtttacttccggaaattggaatgggtcttgacgtatctcaggtgatggcgggtcagctggtcagcatttatgcgctgggttcgctactcgcggcaatccctctgacggttctgaccagtggctggcgtcgtaaaaaggtactattactcgccgtaggtaccttcctgattttcaacactattaccaccctttcgttcagttactggctgacgatggcagcccgattcatgtcgggtgtggctgcaggacttgcatggggaattctggcgggctatgcgcgacgcctcgttcctgctgaaatgcagggccgcgctctcgctattgctatggttggaataccggttgccctgtcccttggaaccccggctggcgcatggcttggcagcatgatgggatggagagtcccctttggtatcatggcagcattggcagtcattctgttcatctggacatgggtggcggttcctgacctgccgggacagcaggccgaccgccgactaccggtatggcaagttttccagatgcccggagtcagacctgttctggcggttatctttctatggatgacggcacacaatattctttatacattcatcggaccgttcctgcagttgtcggggctgaccggaaatgtcgggcttatcttgctgatttttggcattgcggcacttataggcatctggataaccgggatgctggtggatcgccatctgcgcaatctggttctgctcagtctggtggcactggcggcggtttctgtggcactcgccgcaggcatgcgggaacagattgtggtctttgtggccgtcatcgtatggggatggtcgtttggcggcgcgtcaactcagatgcagacggctgccgctgatgcggcaggcaatcatgtcgatgtcgttcaggcaatggttacaactgcctggaatctggctatcgcaagcggcggcgtcattggtggtctgcttctcaataatgccggtgcggtatctttcccatgggcgctactgatctttatggctgttgcgttgattatcgcctggtgcgcgaaaaagcatgctttcaggcccggtgcaagagaacctttagtaaaatagtgacttccagggacgtccggaacggacgccctgttttggcaccaaccgcctgctttgaatatctaaaagagacctcagttatttaagtcgtccatttgggcattctttaaatagaactatcggattcgttgcttcccgaaatattcttttgttttttgtctggaagacaagccattgagataatgctagtgagtacgatgagagaactcatgcctgcaaaaacaaccatcagactcgcagcggcggccagtccggaaaggagaccagaaagtgcttcagcagtattagccagggtagaaaacgtgccgaatgtcttgcctgtgttctctgcaaaagaccaggactgtatgagtgtcaccagagaaatatcaacgaatgcaccactcataccaaggacgaatgctaccggcagcagagcctcgagcgaatagagggcaataaatgacattaaaatcagtaaaattccgtaaaagaaccaattgcgcataacattcaatggtgaaatatttatggcaaaccgtccgtaaatgagccccccggtaattgtgcctgcagccattagagaaaatatccagctggtaaatatctccccattcccctgactgacagctacagcgggaataataaaacgaagtaatgatccggtaaagagaatgcaaacagatgaaccaaaaatagcaataaataagccaggagcttcctgaaataaacttttaatgcaggataggttctcctgatatacttgtttcaatctgaacgccgacgttttattctgtgaattttctgaaaacgtacaaagtataacaattgaaattgcatacgttaatgtattgaacatcagcacccagggcttgtctgccaatgagagtataactgaacatttgatgcgccaattgtctgccatccagccaccagcggggccgaaaaatagaaaaggaataaaacgaaaaaaatagacgcagccggcaagaagataattattatgcgtgttctcgagcacaataaacacaaaaacgacctcatatacataatcgcccaacttcgagatgaaaagagaagcgagtaacgtgcggaaatatttaattttcagccagttcattgaagtctattccaatattaaaatctgaagcacctggcgcagacacaccctctgcaaattcgattatgctaacgtccctgagcatgtaatgtgagtttatgtggccaataaacgacgaagcaaagctgagtgctatgcccataccaatacacatatgcatgcccgtgccgaatgatagtggcttttcttttcgccccgcaataaaacggaatgggttatcgaaaactttttcatcgaagttagccagcgccgtgtaaaacatgaccctgtcaccttctttaaggttctggcctcggaaaatcaggtcctgcgctattactctacctacagaaagaacgggactgtataagcgagaagcttctacaacgatatcccgaacattgactgtattcaccttcaggttgaagtgagaaatggcccagagcgcagcgacaatgagtggcataacgctgtcgactttatcagccccataacctcattgattactaatctgtacggcaacgctctggcccctcttacagagaagcctctaaactaaaagacattattcaatttgttaatattgaagcgccacctgttaacttacatcaaaatttttctccctgatattattacattttttagttaacaacctactgtcggagctgcgtggtgtaattagcgggcacccagcgataagcgttaccttcatgctgaacatggcccaggccagggaaggcgatatgcgccgcagccacccagtagccctgatctgcagcctgtttcagtaccctttcacgtgtagtgatagcctgcttctgattgacatcaaaatggatggccacttcaggatcgggcatttgcaccgctttggcatggatgatatctccccacagcaccagggtctggccttcactctctacgcgataaagtacgctacccggcgtgtggccggctgtcgactctgcacggattccccccggtaatgtggctggtgccataaacgttttaagcaggccagcattgatgaccgggcgaagcgtccgttcagattctgcaaaggtatgggcctgactggtctctaccctgctgacgttagccggattaagccagaaatcgacatcccgtttatccacgaacacttcggcctttggaaaagcaggcttgcccgcgcgtgaaacaccgcctgaatgatcggcatgaatatgggttaaaagtacggcatcgatcgactctgccggatagccagcggcggccagattagtcagcagatgtccgccattgtgtccaaaaagctcaccggccccggtgtcgattaaaatgcgctttttaccatcatcgataacgaaggcattgattgatgtttcggcctgcggcgtcatcgaatctctggccattgcatggtttagtttttcaggcgaaatgttagtcagtaatttattcaggggaacggttaccgtgccgtcggaaaccgcggtaatgcgtaatttccccaatgtcatccggtaataacccggagcttgctgatcccccgcagaggtctgttcggcagcatagaccggactgaaacgcgatgagagaagccaccagcatcagtaaaattttcataaatatctctccagaaagtttcatcacaacgtggtgggcagtatccttactcaacctgtatcactcaaattgattaaactgatgctcactatcagagaaaatgattttcatcgaatcgacctgaatttactgacggtgctgttagttctgaagcgggaaggcagcgtgtcgcgtgcggcagaaaagctgcatctgggtcagccagcggtcagtaatgcactggcccggttgcgggtaatgttcagcgatccactgtttgtgcgcacggcgaaaggcatggagcctaccccgcgtgctgaagcgctgatcactgagctgggcccgttaatggcacagatgcagagcgtattgtttcagccagcatccttcacgccttctgaggcgacacatgtttttcggctggggatgagcgactgggttgaacgctggctgatgccgggactgtatgcgcacatcacgcgcaccgctcccggcgtgacgcttcaggttacggccagcgatcccttccgggatgcggaactggtcgcgcgtggagagatcgatcttgccatttcggttggagagagcacgcccgccacgctccagcgcgagaaaattgtgtcacacaacttttgtacgttgtggcacccggaacagctttcgttgcgtgcaccgctgacgctggaggattatgtggcgcatgaccatctgctggtttcctatcgaggggcgaactggagcgctatcgatgaccagcttgcggcatcaggaaaggcacgttcaattcgctacgtgacgccgcatttttcttctctgcctccgctgctggcgcgcgcacccgcgttagccaccgtttcccgccgggctgtcggatgagtggatgacgcattacggcttatgctgtagcccggtacccattgaaacaccggaaatagccctgtcactgctctggcataagcgatgtgataacgatttgtcactgcgctggctcagggaggaactgcgtagcgtgatgacagaacgaacctgaatagctgctctcatgtgaagctaagacctgtaatgataccttcgttcgatgaggaccttaacctcatgttattgagcgcaaactcaaagagctcatgaataagcaggtaaaattttacctgccctgctctctatccgcgtgatgctgtttgacgtccacaccatcccttttaaatcgccgttttaacctataaaactcagtacctcgcccggctactgctcaggtgcggaaaaaaggcaggcgacggcaaggcttccggggtggctggctcagcgttcagtatgcgcaaaaaagactcagcccagtgatggctgttgtgcatatgcagtcccttcatcagacgggcatgcagagaccgccgttcgtgtaacggcatctgcaatgcacgatgtaccgcactggccattgcatcaggatcataaggattgacgatgatggaaccctccatctgcccggctgcaccggcaaactgcgagaggataagcaccccgggatttttcgggtcctgtaaggcgatatacattttggccatcagactcatgcccgccatcaacggcgtcaccagcgcaacgcgtgaggcacgatagatgccggcctgctcttcgcggctgtagccatgagtcagatagttcaccggataccagttcattgtgccatgcacgccgttaagttccccgcacagtgcttccagagcgtgaccgagttctgacgcatcatgtgcgtgtccggctgccggaggcgccagctgcaacagcgtgatatttttctggtagcaatcatgttttcgcagcagcacctccagggtgctaattcggtagggcagccctgagctctcatcaagatggccgccgcttagcacggtattttcgggcaggctttcgcggcactgcatctccatgtaagcacagctgttgctatcacgcagagactggacatcgtcaaggtcaattccgacaggaaacacacccaccctgataatccggccatgaacacgaaagctttgcgcctccagccgttcaatacggaattcgctctccagccagaccaggaagttattcatatcctgcacggtctgaaagccaatcagatcacaacataacagagagtcagtgaaccagcgccattcgggtatggtttcaaacattctgccagccgggaaaggttgatgcagaaaaatacccactaagttggtcagcccttcttcacggatataggtggcacagcctagcagatggtaatcctgaatccagataacatcgtcgggtgcggcgttttcgcagatggcgcgcgcataggctttattgatgtttttatattcctgatagccgctggcggaaaaacgagccatgtccggacgctgatgaaaaacaggccacagccctttgtgaatataattatggtacccctcattaagctcgcccggcgtatacgggaaggtcacggtttcatactggcccatctgctgcacggcgtagggtcttgacgcatccggaggcatcaccctgctttcaccatcccagctaatccagacgcctccctggcgggaaagtatgccgtcataaattgcagtaagcgtcgaacgttgacattgattatgcgaaacaagaataaggcctgacatgctgtattccttaagaacccgctgcggagaggcaccagtgcctggcagcgagccgctattaataggaggtcggagaataaactggagaaaaccactcatgaatgtgcaccctgtccacttaatgcctgcaaacgctttttgcaaaatcgggttgtgactgccatcgtgtaacgttgtcacgtaaacgcccgctgccgttaattaaaccgaacggcctgtaaaaaaggcgtaaaaagagtctgatgaagtgtaaaaacgctgcaaatcacgcgcccgatatagcattagcggacagcgatggcgcaaaaagtcagtgagttgaagacagggaatatacgcgggtataaataaggcgggttggcccggttccgctctccctcaaagctggtttgataaatgcgtggccgggccgttttattgcggaaacagagaacctaacaatctctttgttaattcagagctgagcgatcattgtctggaatgatacgccgttaaaaaatttgacctccccgacttttttaaatccccttttctcataaaaagggacggcaaggagtgaagaacgtacgctaatttctgcacgcagttcgggaatcgcctgctgccagagtgccttcgctacccctttacgctgacatttcggatgtacaaaaaggtatttaactaaattgccttcgaaaagggtgagtacgcctgtcacctcacctctttccacggcaatcagccagagatagtcatctgaaacaatcaacggtttaagcgcatcgggttttatgctgtcgataaaccattgcggacagggttccgtctctgaaaaattacattgcatcgacacaatatgtatcagctcactgatgcctgccgcatcagactccaacgccgttctgatttccattcttttgtcattcccccctgatttggttaaggcaaggggatgaggtttgccatttgaaaagccatccactccccttttccgctgaatcccggtccgtggacccgcgtcctgatgattaaagcaccgtgactttgccctggaaaatcaccggaccggacggcccgctgagcttagatccccccaccggctccagacttaccgccagtaccgtctgattatctaactcgccaggcggtaaccggaaaacattactgtcgcggtgattgatcagccccagagattgtggcgcagcactgcccctgatcagccagagctgcaggtttttattctctggcagcgtgatgttcagcgccgaaacctgaaggagtgaagctgacttatccagattcaccacaaactgtgcatcgggctgtgcgccgctgagtaccgcaatcggctgcagggattgtggggcatcaggcttgcttaaatgggtgaaaatgaggatgccagccattgccgccgccaggccccagccgagccagaagccaggatgcttgcggattgatgtcgtgccagagacgcctgcattccggccaagatcctgctcaatctgctgccagaccgtagaaggcgggataacggcgtgagtgagcagatcaatgccgctgaacgctttctgccagtgcagcacctccgcggcgaatactgaatcgtcattgaggcgtttatccagccgatgacgtgtcacatcgtcggtaaggccaagcacatattccgccgcagtgagatcatgttgttcctgcccagtcataagcctatgcactcccgaagatgggttaacgcgcgacggatccagcttttcaccgttccttcaggctgactcattgagagcgcaatctcactctgtgagaggccacgataataggcgagcgaaatgctttgtcgctgctcagagggtaagtgcgccatgcagtgctgaaggcgacgcgcctccgcatgactcgcatcggcaggaagtggcgtctggaaacccgcttccgcttcgcttatctcatccacggaacagcttctgttttcatgtttacggaggaaatcaatcgcccgatttctggcgatgtgactgagccagatatgcggctcactgcgcttatcgtcgtaatagttagccgactgccagatttgaataaacgtatcgtgcaggatctcttctgcccagtcccggcgtctcaccatccgcaggatgatcccatagagtcggggcgacagaaacgcggtaaagctgctcaagagcagctttatcaccgacggctatctgattcattaaaccggcctgaatatggggcacattttttgtcatcggcttccctgtgaaagatgtagccacgtgataagtggctacacacagtataggtaacgctttacggcatcagcacggtatcaataacgtcaatcacaccgttactctgattcacatcatacgtggtgatactggcaatattgccctgagcatccttaagctgaatattgtgcgggccatttgccatcacccacagtgattcgccattcaccgttttcagctcggctttaccgccacccgctttgatttttttctccagcgctttcatgtccagttttcctgcaaccacgtgataggtcaggatgctggtgagtttttgtttattttctggcttaagcagggagtcgacggtgcccttaggcagtttttcaaatgcggcattggtgggcgcgaaaacggtaaacggccccttcccttcaagtgtcgggaccagaccggcggctttaacagccgccaccagcgtggtgtggtctttcgagttaacagcattctcaacaatatttttcgatgggtacatggcggcaccgccgaccatcaccgtgtcgctgtccatgctcgccgcataagtggcgccgctgaagactaatgcagaaaaaatcagagttggcaggaatggtttcattttcacttccctcattgagttaacggacagggcgagagcgcccttatatgttaatacgaatgagcagcgaaaacggatgcaaaaaattttaatttttttagctgggggggttcaggctgatgcgatatgcaataagcccaccagaggtgggcttatcataacgagtccatactgcgtcaacgtctgcttttcacgcacagcagacagccgtcattactggcaagaaatagctcccggtcatacaaatcagcaatgtaaaaaaggcattgccccggacagctcagatgctctcaacccacgtctttcgccgtgagttatgcgcatgaacttaaatgcgaaaagcattcactgcttcacgtaaagcgtgtgcctgggctgaaagcgactgtgatgccgaagaggactcctcaaccagcgcggcgttattctgcgtgacgccatccatctcgttcactgcgatgctgacctgtgaaatgccctgcatctgttcagctgaggcgagtgagatgttatccatcgcgacggcgagttttccaaccatcgcattgatatcaagaatgctcttgccggtcccggttgccacgacaacaccactttcaacctgtgccacagcctcttctatcagatgtttaatatctctggctgccgttgcactgcgctgagccagcgtcctgacttcacccgcgacgacggcgaaacctcgaccctgttcgcccgctcgcgcggcttcgactgccgcgttaagcgccagaatgttggtctgaaatgcaattccttcgataacggacgtgatatcccggactttcaccgcgctttttgaaatatcattcatcgtctctgacatgcgctgcatatcgtgttcacccgaaacgcgccagcgcagcggtttcgcgggccgaatccgcagtctgctgcgcgcccgctgcattgcttttcactgtaaccgtgagctgttcaatactggcggcggtttcctgcaaagcggcggcctgctgctctgtacgggaagagagttcggtattgccctgagaaatttcatcagccgccatggcgaccgaagcggaagaatctttaatctgcgagaccaggtcacgcagattgctctgcatgctatccagagaagccatcatgctgacggtatccccctgacgaagggtgacctttgtcgtcagatcgcccgccgcaatcgcagcggccaggccctgcgcatgcgaaggttcgccacccagctgagtcttgatccagcgggtgatcagcccactcatcacaaatcccatcacaacaaacagggtggtcaggccagccagcgtcatataaacaccggagagcgcctgcgtggacgtttccgccgttttactcgttacccgcgcctgataatcaaccatcccatctaccgcactgcggtagtgcgaaagcgcagggatcagttcaccacggagtttttccgggaacggagtggcgttctgcataaacaggttttgctctgcctgatgaagcggacccgctgccacttcgattttatttaattgcgtggaagcctcttctacttcagcaagattgatccccggaatgcttttggcaccgttgatcagttcgcgaaaatgcgcggtggtattatcactgttggtctgcaacgcagagaactgggtttttatagtggcctctgcctgaggctgagtgtctgaagccacggacagtaaaaggacagtttgctgagttaaattatcttttagcgtctgcagggcctggagatcgcccagccgcgcgcgcgtcaattcctgctgatcgctggccgtattgagtttaaacccggcaaatcctgtcacaaaaacgcccgttaagatgactgtgaggaatgccgcagtgagcatgacgcttaattttatttttttgttccgatacataggagaccccgatgtttgaattaataggttatcaccgacgttccgcttctatggctcgctggtactggatctgttatcggcagcggggaaagaaattacagtaatgaaaggggtaagaagcgatgattcctgggctgagtaaaagggtaaatccctgacggatgccattaaggcagtgagtgttattctcgtaacttgtcgcctgaatgcggataaaactattccagcttcgcttgtggcaccacggatttaacagactcttcagcgtcatttgagatgactgacaatagaagtgtcctcgtggtgagaacggaatctcaggccgcagatattttattaagggtggagaaaggcgtagccatcaggtgcatgcgtttgcagctggagacgaacagataataaggcaccttgctttccgtgattacctcagagaaaacagagatatcgcagcaacctatgctgagataaagcgtgaagcagcatcactctgtaacaacgatgctcaacgctacagcgcgctcaaagcgaactttatagcgcatcatctacagctcgcactgattgacctgaaacgataggtactgacaggacaggatatatcctcctcacccccgtttttgattccattcatcctgactcagggtaaacagcatgcttgcgggcgcattttccacatcataaatatcccgggtatgacggagtccggccttaatcagaaccttttgtgaagccagatgattcgctcttacgactgcagaaatttcagccagttttatctcttcgaacccataactaactgcatagttcgcaaattccgtcgccagtcctttcccccaggcttccggagagaaacgatatcccagattattgatcgtgatatcggcaaagcttctgatgctcaatcccccaaaaccgatgattctttctggattatcctgaagcgagatagcccaactgccgaagccattcaattcccagtgacggatagagcgcgatagcacttcccgtgaatgatggatatccggatgtgggcccgcgggattaaacgtattcgtcgcagggtcgccgtagatcctgtaaagatcatcggcatctgatggggtgactggccgaagaaacaaccgcatagtgtcttgctgcaaaataaacgctctcagattaagaaacgagtgatcctgtttttataacgggaaacggtgcgggaaactatgtaaatctctcacctcatcagtctgttcagtcaggcttgatctctttaataagcgcttcaccctgattgtggatgttgccgactttggctgtaacaggatgccaggtaaagtccttttccggcaatgcggcttcatgtgcaatttcctgagcacggtccgacgtggtttcggcactgagccattcgcgtacagcatccgcacttaaaaccagcgggcgtcggtcatggatatcaaccatgcctttattgctcgctgccgttacgataacaaaaccctcatgcccatgatccttaccataaggagctttgccgatagcggcgaagaacagcggttctttctctttgtggtagataaagtaaggctgttttttgtcgccctctcgcttccattcataccagccattggcaggaacaatggcgcgaccatgctcccacagcggtttgaacatgcgtcccgtcgcagcggtttcaccacgcgcattgataagcggttgtttgttccaccactccggaccgtaaccccagtaaaccggatcaaagtgcagttcattatcccgctcattgagcaagagcactttggtgcctggcgctacgttaaagcggcctatcggctccggatcataaataatttcatcgggcttcagccccagggatgcaaagtaatcatctctgctgctgtactgcgcaaaccgtccacacatggggacctcctctcataaggatagcgcagcgttgaacgagttaaataaatctaaaaaaattgttcttctggctgaagatatcgtgatttttgacgagaacataattaatgaatatgaataaactggagtagtaatgaagggaattattttaagtctggctatggcatcactgatggctgcctcgtttacagctgatgcgcgcggccatcgtggtgggggtgggcatagaagctacagccatagttttagttcagcttactcatcacaaacaacgacacccataatcaagaagagatattccagcagcaagcgaacggccagatatgctactgcgggcgtggcgggttatggcgcataccaggcccataactacacgtcatcctacgtgcgtgagaagggccgtcaggccgcaagaaaaccctcaacgaacagctatgacaaccagtatccaaatcagccccaggctcagccagttagccagaatatggcaccgacatgttcacccttatctatggtaagccagccgggctatacaaacctgcctgtatgcctgggcagtgttaattgatttcaagccttgtagcgatgaaacgacgatgaattgatatttttcaggaagacacattttacagaatgccacttaccgcaccccggagaggtcatattttagtgacttcgtagggacacgaacctttaataatatgagatataactcatgaccatagtttttatacctgccctcatcccattactgatgagaattgagaatgagaaaggaagcccgcttactgagcaggaagtcagtagcatccgtgataatgccacaactatcgaagtgccgcgtgatgttgctctcgccatggctgaatgccgcggttacttcgatatcaaccctgaaagttgctgggctgaatggagcttgtaccggagtaagagtttgctgtctgttgctgacaacggataactgcatcgcggtgcacatctgcacctcatgttttagcagccggtatctgacggcatagcttcagagatcgacatactgttagcatcagtttctggctggctcatgggctactacatatagccataccgtgtaaaagtagtcaggaaaatattttttaactgtgtttgttgtcatgagccgcagagaggaaattcctgaagctgcagaacgttgcatgcaacagaaagggttttatcagacaccggtttagcttattgtcggtctgacttgaaaattttatgaaaattaagaagcaattattttcttcatgattacatccctgatgtttgcccggattttatatcatctattctacagtcttaatatccacagccaccagaacaacccagtacttcatctgctcagtcatcagctacgttttcaaaaaaagacagtgtttcggcgctttttttcggcggggctgccctactgttacctggcaatacacacctctctattatctataaatttttctgttccgatcgaaatgtgtggccgtgggtcatcattctgtaccctgcttcagacgcgcaacaatctcccccctcttttcaaatcacgccgataacgttaagctatacgaaacatatacgtttcatataaggcttgcatgggtatcgtaaaaatctccgacctgatgcatgagaatctgcgcatcgccagtcaggcgatgagccgctcaattaatgcacaggcagaacactggctaaaactcggtatgctggcagaactctatccgcagcagacccaacatcaactggcgcagatgctaatccggcttgaactggaaggcagcgctgatatacgcaatatgctccctaaagagagcctcaccacacaaggagacgtgtcatgaacagcgttaaaattcataccacagcggaaatcgaaatggcacgggcagccggacaggctgcggctcaggtgctggcgatgattacacctcacgtccgtcccggcatcaccacggaagaactggatgatatctgtcacgacttcatcgtgaatgagcttaaagtgacgccagcaaacatcggttaccacggttatacccgcaccacctgcacgtcggttaatcatgtggtctgccacggcattccggccagcaaaaaactcaaggatggcgatatcgttaatatcgatgtagcgatcattaaagatggctggtatggcgataccagccggatgtactttgtcggcacaccgtcagtccgtgcaaaacgtctggtcgagatcacctatcagtcgatggtcgccggtatcaaaaccgtccgtcctggcgcgacgctgggcgatgtgggcgcggctatccagcgtgtcgctgaatcggctggcttctcggtggtgcgtgaatattgcggtcacggtgtcggcgaaatttaccacaccgatccacaggtgctgcactacggcacgccgggcgaagggatgccactgaaatcaggcatgattttcactatcgaacctatgattaatgccggtaaagccggaaccagcgtgctgtcagatggctggacggtggtcaccaaagatcgctcgctctcggcgcaatgggaacataccgtcgccgtcaccgatgagggttttgatttgctcacgccctggcctgaaggcaccggcgactacccggcgatttaatctctcagcctgagaccgggtctcaggctgcattgttaactgcccctgacttcactcagcgtttccagcgtgccggaatgccacacctgcacatcgttacgtccggcgcgcttgacctgatacagcgcctcatcggcgcatctcagccattcatgaattgtcgccgcatcgcatgccggtgcaatcccgatactcaccgagcactgaaaggtagatgaagccggtagccgcagcagggcaatcccctgtctgatctgctctgccagcaacatgatgctggtttcatccgcatcccgcacaatcacacacagctcatcgccgccaaagcgggcaggtatatctttcaggccgacgctgtcacgcagtagtgccgagatttctgccagcagaaagtcgccggcttcatgcccgaaggtgtcgttaacctgtttgaagtgatcgacatccagcagcatcagccaggctttaccctcacctcgctgtgtacgtaaaaactcactttcaagccgccgctcaaacagacgtcggttaggtattttcagaccaggatccatcagcgcaatgcgttccagctcctgattcttctttcgcagactcagggtcagattgtgtgaaaccacgctgagcgccagcagatagccgctggcgagcggcagagtcagccagacggtgcgggtagagaaggtcagttgcaaaggcgccttttcggctaaccaggccagtaaaaaggtcaacagaaaggcctgcagagcagacttcagctgaccccaaccgcccgccgagtaacgatcagagatcagtaccgccataataataattgagggaagcggactcagcgccatggttgccacccagaagccgccgaaagcggcatccagcgtcagattcttacgttcaaaacccgtgggatcgcgcgatcgcaatgccagtctgaaggcggcatagggccagacaaacgcattagtaaatagcagtgcgcagagttccaggctttttcccatctccatcaatactgacagaatgggcaggaaacagagaaagttgccgagctggcgcatcatgaacatgcggcgcacaaatcgcgtcgatcggcgcttcagctgaatatcgtcaggagtgtagtaattcatatgcagactgaagcagcaacaggttatggcagtttatcggcaattaatgaattaaggtaaactatttacagaatattcttattgcgggtcgcgaagggaatctaatcaggctttgacttgtgtgctggggacgatggcagtcagggaacaatggcagtaatgtgaaaagataccgcgcgccatgaatacgcgcggaagctttttatcggcggcctttaaccactgaggcagaccagttgaaatcgctgacttcgctggcggtcattgaagaaggttttttcttacgcagcggttttttcttctccttctcagcctgcgccctctccttctccagtttgctggtcatgatgatctgacgagcttcactattaaattctttctcttttttgctatcaggctctttaccggttcgttgacggtacttctcggccaggcccttataggtttgctcgacggccagtcgttcatcagcgttgaactgatcaatggaaatcatctttttatcgttcatagcggcgtgtcctgtggcgagttattccggcaagtgtaccgcatttgcggtccgttaacgcagggaatgacattaatccggtgagctgctgattccgtcagcacacgccgcccggtaatttctctgaaacctgcgcttagccctgtaaaaaatagggttatctcttaatataaaactaatgttcatcaggtttactggcagtgaccacgtactgccgaggagctgaaggaatgataaaagagaccgatcgcctgtcacaggcactattacggcggcatgggattggcgttaaacagaaacgtatacacttccgtggcagggatttactgtttcagctgcataatgcccgctatgaggtgttcaatggcgatcgctgtattgcaaccgtcgataccaacaatatcaatgaagccattaagcagtttaaagcgctggaccatccaggggagtaatagccatgccagactatcgtctgtttcagaaagagcaaacagtcagagccgtgaacactgagcggcaggatcagcaggacgcgttaatggctgatggctataagatggtgtgggacgtggtgcatgccgataacgccgatgccgcgctgctgcgctatcagcaactgcgtcacgaagaggataatgctgagcagagtttcgcaaacgattcagttttaagtagtctgatgaacctgatatcccgctgagtcagtgcggggctgaaggtataaagccaaagttactgttaattcatgctgtgctgattagaataaagaaaatttcccgaatacaggtttctgatgaaaatcaccattcataaagaagatgagctgtttatgcacaacttctttgctgcgccatgccacaccgttgaaacagactcaccacaggcacaacagattcagcaatcgcttcagctggccatccagcaaaaaggtgcagaggctgatggcgactggaaacgtagtctgacttttctgattctgtttctctttttatatgctgcgctgggtgcctcgctgacgcttgatctcagcaccactggcacgcctcataagagtattgaatatgcgctggaagcgattccggtactcatcgccttctccggcttcttcatctctattctctatctgttcctgacccgcgccagcgcgcgtaaacagcgtaactgggaaaggactatcctggtgctggagaaatactccatcggaaatctgtttaaagcgacgcatacccagggcggtggtaccagcaactactccgtgcccaacctttctatttcgctcgcgctgtttatctgcctgacctggttggtgatttataactatctgacgtttaccaccagcggggtgtttggcagtgtcatctccctgtttatcaacaccatggtttatgtgattctggatattcagctgcttaagccttttacccatgctgtggagaaagcagaagcggaaaagagtgacgcggataaagagcaggattaactgcgcctggtaagcggcaaaagagatacccggtcaatgagccgggtattttttgtttaatcagaacgatcttgctgcaagacccctgctgcacggagttcaatgagaacggtcgatactaaagtatataagtatgttgtaactataggcagggcttaatcctttgggttcagcccgtgtaaaagtcagacggcccgctttcacagcgggccgtattcatcaccagtgggttttctgcatatcaatgacaaaacgatatttcacatcgctggtcagcatacgttcaaaggcagtttcgacctcttcacctgtgatcatctcaacatcagccgtgatgttgtgctgaccacagaagtcgagcatctgctgcgtttcctgaatgctgccaattgaggtgccagtgatgctcaggcgacgaaacaccatcggtgtcacattcggtgatggatgaggttgatcgggtatgcccaccagcaccagctgaccattggttttcagcgcaccgagataaggatcaaggtcgtgtggtgcagcgacacagtccagaatgatatccagtgacgcctggcagtcagccatttgtgcggcgtctcgtgagatcaccacgtttcttagcgccgagccggcgtgcatcttcccctttcgctggagaagtcgtaaacagggtgacttctgcgcccagtgcactggccagtttaaccgccatatggcccaatcccccgagcccgaccacacccacacgatcacctgctttgactttaaaatgctgcaacggtgaccagacggtcacgccagcgcacagcagcggtgccaccgcattcagtgccagattgtcgggcaccgtgaccacaaaatgctggtcggcgatgacatgctgcgcatagccaccaaatgtcgtattgccggtgtatttatccgtgccgttgtaggtcggcgtgaaacccgcctcacaatattgctcttcctgctgctgacagaaatggcattcaccgcacgagtcgaccatcacgccaacgccaaccgtatccccggcggaaaatttagtgacgttgccgcccactgccactacgcgtccgacaatttcgtgaccgggaactagcggatagcagctgactccccattcattacgggccatatgcagatcggagtgacagacaccgcagtaaagaatttcgattttcacatcgtcagcctgcagctcgcgtaactctacctggcctgcccgcagcggctggtctgcctgggacgctatcagcgcgttaattttcatctgttgcctcttatcacctggtggtcgtaaagaaagcggcccactatagacatacggaaccccatttggtagtagttaccttttggttaccatcatgtctgggaagtcactatgccggtctgggttgaaggaaaactttgcttttatgcggattcaccgccacgccgcctgatggaactcttttcggtgaagtggagcacgatggtgctgcatgcgctctatcactggccggaaaatcgggcacgcacgggtgaactggagcgtagcctgcagggtatttcgaagaagatgctgattcagacgctgcgtgagctggagcagcgcggactggtgtcgcgtcaggtgtggcaggtggtgccaccaaaagtggaatacagcctcacgccgttggggcatacctttgccaagccgattgagcagatgtatcagtggggactggagaatcaggctgcgctggatgaaatggaacatcacgcgcgcagccatcaggagagtggcggatagaaggccgccagttctcacgcagtgcaggcttaatcgaacgggaattcgcgcgccagcacgcgggaaatgacattcagcgcgccttcatcattgttgctctgagtctgatagcgcgccacggcagcgaccgaatcagcggcattggccattgagaaactgaagcaggcctgacgcagcatctcaatatcattggcgctgtcaccaattgccagcacttcgcaatcgctgatgccccacttttcctgcagcagcgcaatgccgtgtgccttatggcagccgggaataatgagatcaataaagccaaaaccgctggataccggatgcatgatgttttccagctcgcccagacgggaatgcagtctttgcagcagtgcatccaccccttcgtgctccagcttcagcgagaatttgaaaatggtgtcgtcgatggcatagaggtcatcgcgtttttccagccggtgatagtggtttgcaagcattgccatcacctcatcagaggtggatgaatgcatataggcgccgttgcgtccacagaccacgaccgcgatgtcaggttcatgcgccaggatatcgaggatcttatgcactttctcctgagctaactctccgcagaagatctcttcattacagtcagaaacccatgcgccattttccgccacgaaagcgatctcatctttgatgtcgggaaaatagcgctgcagctggtaatactgattaccactggccaccacaaaacggatgcccttctgcttcagcagcgcatactgacgtgaaaaccgctgaacgttgtactgcttattgtcgtccagaaaggtgccgtccatatccaccgcaatcatcttaaccgccatctcgcctgcccctatacgttcgccgtttctgtcctttcggctgattgatttgattcataaagcttactcgctgtgtggattaatgagaatgcaaatagtgactttgctaacggctttcagagcgttccggttccggagttgtgttatcacgcacgttttttttcgttaaaaggatgttaacctcagccgaatattacgaatgaaggttatttcaattacattcgtaactcaacccccagatattcaggagcacgagatgcgtgaagattcccgatcaacccctttacctgacgacgtcaaaaccgctattcgcgagatgaaacagcatttacgtcaacagattggtgatgtcgatgcccttttccgtcaggtttgcgacaacatcactgctgcgattgctgaagcaaaagcagatgaaaagcgcacgggcagtgcctggccggtagtgcccatgcaggacattgcagcgggaaaggtttcggatgaaacccgggcgctgattaaacgtcgcggctgtgtggtaattaagcagcacttcgcgcgtgagcaggcgctggcatgggataagtcgatgctcgactatctggatcacaaccggtttgacgaacactatcgcggccccggcgatgacttttttggatcgctggccgcctcccgccccgaaatctatccgatttactggtcacaggcgcaaatgcaggcgcggcagagcgcggcaatggctgacgcgcaatcttttctgaaccggttatggaagtctgaatcacagggcaagcagtggtttgacccggatgtcagcgttatctatcccgatcgcatccgtcgccgcttgccgggcaccacctcgaagggattaggcgcccataccgattccggcgcgctggaacgctggttactccccgcgtatcagcaggttttcagtaagctgtttcacggtgattttgccgcttacgacccctgggatgcagctcaccgcaccgaagtggatgagtatgatctgccgggtaccaccaaatgttccgtgttccggacctttcagggctggaccgcactctccgatatgatccccggtcagggcctgctacacgttgtaccagttccgcaggcgatggcctatgttctgctgcgcccgttgctttcagacgtacctgaagatgaactgtgcggcgtcgcgccgggccgggtgttgcccgttaatgaacagtggcatccgcacctgattgcaggactctgttcgatacctgccttagaggcgggcgattcggtatggtggcactgtgatgtgatccacgccgttgcaccggttgaagatcaacagggctggggcaatgtgatgtatatccccgctgcacctatgtgtgacaaaaaccgcgcctatgcccggcgggttgcacaggcgctggagcagggacgtttcgccgggagattttccgccggaagattatgaaacagagtgggaccagcgttttacgctgcaggatctcaatcttaacggacgccggtcgctggatttgtcctgatcccaatcccgcgttgtacaccagcgcgggatatccctgttacactggagcttctttttttctgcgaaacgcaattatgaacccgcgacatcatcagattattcaactggttaatagccggggcagcgtaacggtcagcgaactggcgcagcttaccggggtttctgaagtgacggtgcggcaggatctcacgctgctggaacgcgaccggttgctgcggcgggttcacggttccgcgctggcgctggacagcgataacgtcggcacccgcatgaatacccgctatctcactaagcaggcgctggcacgacatgcggccagcctggttcaggcgggtgaatcggtcttcatcgaaggcggcagcaccaatgcgctgctggcgcgtgcgctggctgaccgcgccgatcttacgctgattaccgtcagtcactatattgcccagcttcttcgggaagccgcctgtgaggtgattgtgctcggtggcctgctgcagaaaagcagtgagtcggtagtcggcccgctgacgcggtattccatccagcaggttcattttcaccgggcatttgttggcgtggatggctggcatcccgaaactggttttactggccgcaacatgctgcgctgtgatgtggtggatgccgtgctggcgaaaggcgctgagagctatgccctgaccgacgcctccaagtttggtcagattcacccctatccgctttcatccggttttcaggtcgggcacgtgattaccgatgagacgctggatgcggcgacggtagcgcagctcagggaacaggcgatagaggtgatacagatcgccgcaggttaagcagaacggccggggcctttagtaacggagtcccgcagcatcaggctggccgtgaaaggtgcctgagtatgccagtctccgccatccagcatggtcagcaggcggttaatcgtctcatcgatcatctcggtgaccggcagtttcatgctggataacgacggcgtgatgaagggcgccagcggaatatcatcgaagccaatcaccgaaacctgcccgggtaccgcgatgttgcattcagtcagacgtttgatagcaccaatcgccatctcatcattactcgccaccagcgcgctgaatgtcaccctgcgtttccagcagctggtccacggccgccataccgctctgcgccgtccatttaccggtcacgattcgccgggaatcggcttcaatgccctgtgcggtcagcgcagcgtgatagccggaaagccgctccacgccggtcggcgaatcgagcgaaccggtgataaacgcgatctcgcgatgcccctgattcagcagatggctcaccgccgcagcgctgctggcatgctgatcgctgtaaatgcagtagctatggttgacgcgcagccgccggttgatcaccagtatcggctgtttgtgccgggagataatcgcatccagcgcgtcaatgctcaggaagcgcggatagataatgatgccgtcacagcgcagatcgagcagaaactgaatcgccgcctcttcctgctcagcggtgtgtttgccgtccgccagaatcagctggcggccctgctgctccagtatgcgcgcggagtgtgccattagttcagtgaagtagctgccgctgtagagcgtattggtgatcaccagtccaatggtctgagacgtttttgtcgccaggttgcgcgccagcagattgggccggtatccggtttcggcaatcgccttcagtactttttcgcgcttttccttcccgacatagccattgcccgagagcacacgtgacactgtcgcttttgagacgcccgccctgtttgccacttcctgaatcgttgccatgctgatgctcctttgctgcgtcgtcctgcagtctacctaagcctctcaatgttggaaatatttaccccgccttagtatgaggttacctgacagcatcaggtgatggagttcacaaaaaagagatctggatgattttggcgcttgtcggcgcagtgaaagcacttcatgattttgtgaaaccggtttcctatttgcctgcccgcaggcgcaaaaacataaaaactttgaccgatttaccctacagagaagagcgatcatgcccagaaattatgccgaggtgtcacgcgccatcgttgatgcgctaggcggcctcaccaatatcgaagccgtaacccactgcatgacccgcctgcggtttgtgttgaaagatgaagctcaggtcgactatccccggctcaaggcgatcaatggtgttatgggcgtggtgcacaacgacactcagtgccaggtgatcattggtaacaacgtttcacaggcttatcaggcggtgctggagctgggctcgcccgcagcgacatcggctgcacccatgaaacgtaaaatcacgctgcgaggcatcggtgcagggattcttgatgcgctggtgggcaccatgtcgccgctgattccggccattattggcgggtcaatggttaagctgctggcgatgatcctggatatggcgggcgtgtttgagaaaggctcatcaacgctggtcatcctcaacgtgattggcgatggcgcattcttcttcctgccgatcatggtggccgcctctgcggcgctgaaattcaaaacgaacatgtcgctggcgatcgccattgccggtgtactggttcatcccaactttgttgaactgatggcgaaagcggcacagggtcaggcggtggaatttgcttacatcccggtgaccgcggtgaaatatacctacaccgtaatcccggcgctggtgatgacctggatcctgtcgcacatcgagcgcggcgtggatcgtattacccctgccgtagctaaaaacttcctgaaaccgatgctgattgtgctgattgcggcacccatcgcgattgtgctgatcggtccgattggtatctggatcggcagcggcatctccgcgctggtctacaccgtgcatggctatcttggctggctttccgttgcgattatgggcgcaatctggccgctgctggtgatgaccgggatgcatcgggtgttcacccccaccattatccagaccattgccgaaacaggcaaagagggcatggtgatgccgtcagagattggtgccaacctctcgctgggaggatcgtcgctggcggtggcgttccggaccaaaaaccgtgaactgcgccagaccgcgctggcagcggcggcatcagcgattattgccggcatttcagaaaccggcgctctatggcgttgcggtccgcttaaaacgaccgctgatcgcctgtctgatcagtggttttatctgcggcgcggtagcaggcattggcgggctggccagccactccatggcctctcctggcctgtttaccagcgtacagttcttcgatcccaccaatcccatgagtattgtctgggtcggtgcggtcatggtgttgtctgtggtgctgtcatttgtgctgacgctgctgttaggttttgaagatattcctgaaaccgaacccgaaaccaaaaccgcacccgaaagcgcaacgcaacctgcgcccgttaccgaacgcgctaacgcgattaatagccactaaaggaaagggtcacgctgacccggaaaagaggattgcatgtctgattcaaggtttccgcaaggatttttatggggcggcgcactggccgccaaccagagtgaaggcggctttcgtgaaggcggaaagggcttaaccaccgtcgacatgattccacatggcccgcaccgtatgccggtcaaactcggtctggaaaagcgttttaccctgcgtgacgatgaattttatcccagccatgaagccatcgatttttatcaccgctatccggaagacattgcgctgatggcggagatggggttcagcgtgttccgcacgtcgattgcgtggagccgtctctatcccaatggcgatgaactgacgcccaatccgcaaggcatcgccttttaccgcgcggtctttgaggagtgccggaaatataatatcgaaccgctggtcacgctctgtcactttgatgtgccgatgcatctggtgactgaatatggctcgtggcgcaatcgcaaaatggtcgacttttttgcccgctatgcccgcagctgctttgaggcgtttgatggcctggtgaaatactggctgaccttcaatgagattaatatcctgctgcacagcccgttttccggcgccggtctggtgttcgaacccggtgagaacaaggatcaggtaaagtatcaggcggcccatcatgaactggtcgccagcgcgctggtgacgcgcatcgcgcatgaagtgaatccgatgaaccaggtcggctgcatgctggcaggcggcaacttctatccctggtcgagcaagccggaagatgtctgggctgcgctggaaaaggatcgggaaaacctgttctttattgatgtgcaggcgcgcggggcctatccggcctacgccgcccgcgtgttccgtgaaaaaggggtaacgcttgagatcgctgacggtgatgccgacattctgaaaaacagcgtcgattttgtctcgttcagctactacgcctcacgttgcgcctcggcagagatgaacgagcagaacagcagcgccgccaatgtggtgaaatccctgaccaatccgcatgtaacgcgcagtgaatggggctggggtatcgatccgctcggcttacgcatcactatgaatatgatgtatgaccgctatcagaagccgctgtttctggtggagaatggcctgggcgcgcgcgatgagatcgaatcaaatggcgagatcaacgacgattaccgtatcagctatctgcgcgaacatatccgcgccatgggcgacgcaattgaggatggcgtgctagtgatgggttacaccagctggggctgtatcgatctggttgccgcctcaacgggtgaaatgagcaagcgctatggatttgtctatgttgaccgcgacgacctgggtaacggcacgctggcgcgcacgcggaagaaatccttctggtggtacaaaaaagtcatcgccagtaatggcgcggatcttgagtgacaacgtcacttaaattctatcgtcatgctgttactggcgcgacaacaacgccggaacagaactcttatttctgccgttgtactccggcagtaattatcgtataaccaatgtctccgaggggtgtcctgtaatgggctgagatggcgtaagccgaaccctttgaacctgatctgggtcatgccagcgaagggacgggtcggcagattttctgcgtcatctcctgcaacattccctgttccagaccgtatgcccggatctccctgttactggagatcctatgtcacatccgcttttcgacaccggcttttatggtcgtctgcgccagcaggcgggcagtcaatggcacgcctatatcgggcacgattttgtgcggcaactcggtcagggcaccctgccacccgccgccttccgccactatctcacccaggattatctgtttctgttgcacttcgcccgtgcctggggcctgctgatcagcaaactttccgagccagcagccttacgcagcgcaacggcatcgcttaacgctatcgtcagcgaaactgccacttcaccaggcttactgccagcaatggggcatcagcgaggcggctatggcgagtgaacccgaagccgtggaaacgctcaactacacccgctacgtgctggacgtgggtcacaccggggatgcgctggagctgctgaccgcgctgatgccgtgcgttgccggttacgctgaaattggcctgacactactgcatgatcccgcaacccgctttgaggggaatccttacgcggcatggatagaaaattacggcgacgaagcctatctggctggcgttcgctcctcactttcactgtttgaaaccctggcccggcagcgcgccggtgaacaccggtttaacccgctggcggagatttttaccactgcaacccggctggaagccgctttctggcagatgggtctcaaccatgctgccgcccagcggatcagctcatgaacctgccgtgccatccggtgccgccaggcatttcaattcgccagctcagcctgaattatggccagcagccactcttcagccagcttgatctggagatcgcgggcggtgcttttaccgctttactgggtgccagcggcgtcggaaaaagcagcctgatgcgggtcattgctggtctgacgccacccaccgccgggcaggtcagcggcagcgacggcctgccactgaccggacgcatcgcctggatggggcaacaggatctgctctatccgtggctgacggttgaacaaaatgtctgtctcgccagccgcctgaaaggtgaaagggtcgatcgcgactgggcgcagcatttgctgatgcgggtaggtctgagccactctgcgaacgcacgacccgcgacactttccggcgggatgcgtcagcgcgccgcgctagcccgcaccctctacacccgtcagcccgttgtgctgatggatgagcccttctccgcactggatgcactcacccgcgctcagatccagacgctggccgcagaagtgctggtcggacacaccgtgctgctgattacccatgacgccgctgaagcctgtcggctcagtcaccacatgctggtgatcggttctgcgggaattgaaacctgcccgcccctggcgggccagccaccgcgggctgcagacgacatacaggtattgcagagtcaggccggattgctgaagcagctgagcaggatagcgggatgagattacacaaaggttttgccggtcttcaccgtggagtgatgctgtttgccggactgattgcgctgtggtggctcgccacactgacttcggttccggcctttctgctgccctcacccgctgcggtcgccatcgcactgtggcaaaacgcaggttatctcggccatcacactttgattaccctgaccgagatcgtcagcggcatggccctcggcgtgctgcttgggagcgtgctggcgctgggcatgaccttttcgccatggctgcagcgctggatgatgccgctggtgatcaccagccaggcgattccggtttttgccctggcgccgctgctggtgctctggtttggtttcggcatgggcgccaaagtcgcgatggccgtcctggtgatcttcttcccggtgacctccgccttttttgatggcctgcgtcgcgtcacccccggctatctcgatctggctcgcacgctgggcgcatcacctgcagcgcaactgcgccatgtccggctgttagccgcgctgccagccctgggctcaggattgcggatggcggcagccgtcgcgccaataggcgcaatcatcggtgaatgggtcggctcggccgaggggctgggctacgtgatgctgaatgccaacgcccggatgcagagcgacctctgtttcgccgccttgtttattctggtgctgatgacactggccctgtggctgaccctcgacatcctgctacgccgcctgattacctgggcacccgagacacattaatgaccataccaatgagaaaacccatgacaaaaatgcctctgtttaccctgctgttcagcgccaccttagccacacaggctcaggcgatggagaaactgacactggtgctcgactggtatatcaaccccgatcacgcacccattatggtggcccagcagaccggcgcgtttgcggcagaagggctggaggttaacattgtgccgccttccgatccggcgctgccgccgcgtctggtggcagcaaagcaggcggacttagcgattacctatcagcctcagctgcatttcttcgccgatcagggattgcccttgatgcgggtggggacgttgattaacagtccgctgaatacgctgatgacgttagacgaaacggtaaaaaaaccagccgatttaaaagggaaacgtatcggctattcggtcagcggcattgaacaggcgacactggcgaccatgctgaaccatgatggcgttaaagccgatcaggttaagctggttaacgtcaacttccagctcaccagcgccctgatgaccgggcaggtggatgccgttatcggcggctatcgcaatatcgaagcgcttgagatgaaacagcacggtaaaaacccggtagtcttcaacgtcgaagattatggtgttccggcctatgacgaactgatcatcgtcgccaaccgtgatgaggcacactcggagaaaatcaaaaagtttttgcgggcactaaagaaaggtaatgcgcagttgcaggcgcacccggaggagagctggcaggcctttgcccgcgcgcatccggagctgaacacgccgctaaatcatcaggcatggcgtgccaccctgccgctgtttcgctgccgatccggcaaaactggatcgcgcacgctatcaggcttacgagcaatttctgtttgataacaaactgattaaaagcatcacgccggttgagcgctacgctaccggcagtgagtaatatgagagcccgcaacgatcgctgcgggccattttcctggcatcacttctgataaagccagtgttcaatatcgctggctggcagcggttttgaaaagaagtagccctggatttgatcgcaaccgtaagttttcagcaacgtcagggtggcttccgtctcaacgccctcggccagcacggtgtaattgagctctttcagcatctgaataatgcatctgacgatgatttttgatgcatcatcttcacccatacgcgagatcagggatcggtcgatcttgatcacatccagcgggatatcctgcagatagctgatgttgctgtagccagtaccgaaatcatccagcgagatcacaaagccgtgtgatttcagcgcttccagcccgctgatcgccacattggttttggtgatcagttcattctccaggcactcaatgcccagaatagaattgggtaactgagccgccgctaattttgccaccagccgatcggcaaaatcgggctttgcgaagtcgcgttcgctgacgttgatcgaaaccggaatcagatcgtattcgcgatcccagcgcgcaagctgctcaatggtgtgatcgataacccagttggtcagatcggaaatcaggttggttttacccgctaacggaatgaattctgaagggaaaagctcgccccgctcaggatgattccagcggataagcgcctccagcccgaccgttttaccgcttttgagacacactttaggctgccaggccaggtaaagctcttcgtctttattcagcgcctgagccagatcgttcatgatcataaagtcatcggtgcgccgcgagtcgtaactctcttcaaaacacattgcactgatgttctcatccaccgcctcatgcagcgcgctcacggcctgacgcaccgtttcattggcatccatctggcccggtacaaactctgtttcaccggtaaagacatccaggtcgagcgtgatattttccgccagatcggccttcatgcccttaaacaggtcgatcatgttatgtgctgtataacgacccgagtagggctgaacaatagcaaaacggcctggggcgaaagtatagagcgtctcattctccggaagattgagccggtgagcgacatcctgcgccatctgctttagcagtttctccatcggcgcaatgcccaccgcacgggaaagctcataggcgcgaatgatgtcgaggcagtcgataagaatcaggcggaagcggctctctggtgcgacaagggtcagttgctgaatatcacgaatcagacgtgggcgattcggcaggtgcgtaatgacgtcggcaaaacccgcattgttccaggcatccagaaatgaggtgaccagcgtagccagtgagcgcagcgtagcgagtttctcatcactaaagggatgtggctgggtgtcggtgacgcagagcgtgcccagcaccgcgccgtcgaggtttctgcagcgagacaccggcgtagaaacgaatatgcggatcgcctttcacaaatgggtgcgtgacaaagcgctcatccagtaaggtgtcatacaccaccagatgtccctcaccatcaatgacgtggcggcaaagagattcatcacgggtcgattgcttaagatcgaagttccgtgacgctttaatatattggttatgatcgtcaataattgaaatgaagctgccagaaatacccagcacctggctggcgagattaacgaatctttccagcaccttatcccgggcttcatccggggacaaaagtgccttgatcgcactcagacgttttacgtcgctgccattttgctcgttatgcactgaaacctctcctatgcaggcgcaaaaatcgaaaataatttagctcaggaatgctcaattagcgcccaattatcagataaatagcggctcaatctgacagtactttcacagtgaaacagtgtcgcatgatatctgatcgctgtcgaaatcatttaacgctcttctttcatgcgcgcaacctgcggcgactccgtcctgaagcccagaccgatcaggcgtcccagtacaaaacgcagaaatggcaggcgctggataatcgcgggaaccttgctgcttcccgtaggttttcttctggctttgctgcggctcatcttgatctgcaaaaactgcgtggcgacggtagggaactgacggcgcttctgcactttttccaggtcacgcagctgcagttctccccgcttcagaggatcggtcaaaaaattcgccgtcgctaccgcatcctgaatcgccagatttacgccaaccccaccaatcggcgacatggcatgcgccgcatcaccaatgcagagcacaccaggtttcgcccacttgtccaggcggtcgatacgtatcgacaacagtttgaacgcctcccagctctcgatttccgccatgcgcgcaggcccgaacggcgacagtgcggcaacttccgctttaaacgcgtcgagtccggcggcctgtttcgcttcaaaatcccctttcggaatagtcagtccgcactgccagtagtcgccgcgatcgataacaataaagttctggcgtggccc

SEQ ID NO: 16 - DNA, 211411 bp, Pantoea agglomerans NY60
actggcagaaatggaggtggcgctggaagtattactgacgcgattgccagagatgcggcccgtggccgctggcgttcgccgcaaccacagagctaatctgcgcggcgtcagcgccctgccggtcgaatggtaacgccctgccctgcagcgcccggcggttaaccgcgcagccgcagcgtggcgggcaggataagctgactgtcagcgggatcctcaccagcgatcatggtagtcagcatataaaagcaggactgcgccagtgccgggacattctgctcaaccgtgtcgatcggaatggagagtgaatcatagagatagtgatcgtcgaaactggcaatacggatgtcgctggtcagcaggttatgttcgctcatgtagcgcagtactccctccagcagaccgcaggcggcggtgaacatcgctttaggggggcgtcccagccggcgacagagcgcggcaaacatctcatagccactgccgggatggtagttaccctgaattatccactccggccgcagcgtcacacccgcccgcatcagtccctctttgaatcccgccagacgatcctgggtcggggagaggtcagactgtccgccaagaaagtagatctcctccggacaggtgcgcgccagcttttcgaccagctcagcggtgggcgtcacagagtcggtgatgacccagggcagcctggtattgttcatgtggcggtcaaacagcagcaccggcagctgttcgctgaggctgacatagtcgctgtcgctcagcatactggaggcgacaatcaacccgtcgacctgacgcgccaccaggttattgaccacggccatctcctgaccggcattttcatcggtgcaggagatcaacagttgcagaccggcggcgcgacagagattttccagcgcatgggaaaaggccgcaaagccgtggttggtgatctccggcaccaccagccccagcgtatgactgcgggcgtcatgtagcatacgggcgtgtatgctgggctgataatggtgttcccgggccagtgtcagaacccgctcacgcgtctccttcgccacccgtaactcttcgccacggccgttgagcaccaggctggcagtggctttagaaaccccagccagcccggcgatgtcactgatggtaacgcgtttggtttttctcacggcaaggcatcggttagtgaaacaagggcttattctaccatgcagcgacgtaacgaccagtagcgggcctgcagttttctgcgcgaccgcgcagggttagcatcgccggatggtccggaaaataacggctgctcatcaccccttccccgtcgttgatgaagatctcaacgctggagtggtcacacaggatctgcaaccggcgtgcagcccctgtccagtaacgataggtccattgacccgataccaggctgcgacgggcaagccgcagttcattctgctgccacgtcaggatcagcgtatcggcgaaattgagttctatatcgcccaggctctccagctcaagctccagccgctgcgcggcgatcggcggcgcgtcatcggcgcggccctgataatgcagctccctctcccgcagcgcctgcagttctgcaatcggctgctgacagagccggccattgcgggaactcagctcgcgcagacaggtcatctgatggatccagtgatgcgccacggttggctgggccatctcttcaccgtctggcgttcccatccagcccaccagcagacgccggccgtcagcggtcagcgtggtttgtggtgcatagaattcaaacccggcatccatttcgttcagcgggccatgcaggtaggcagcctgctgataatccagcgagccactgagccaggcgcaggcgtgactgttcaggtagcgtttctcttcaggcataacaccctgcggacagcagatcagataggtgctgtcgccgagcatgaacatatccgggcactcccacatgtagccagcggcgtccagcccgcccagttcgctgcccgcaatctcgccgagattctgccattcgcgcagattatcagaacgcaacagcagcaccctgccctgcagctgggtattctgcgcggccagcaccatgtaccagtaatcttcatgacgccacactttgggatcgcgaacgtggccggtgtagccctccggtacggcgataaccggaccgagtttgtcaaaaccgccggcgctgttctgctgcgccagacactgccacgcggtgcgcgaaccatcatcaaacttcacattgccggtgtagatcagcgtcagtacaccgttatcctctaccgcactgcccgagtaacaaccgctgcggtcatactcctcgtccggcatcagggcgatgggctgatgctgccagtgcagcagatcggctgagcgccagtgtccccagcatttttgctgatgcgcgcactccagcgcgttccactgatagaagagatgatattcaccgtcgaaatggataaagccattgggatcgtttagcaggccggttaccggtgccagatgccagccaggatagtggctgtcgctgagcgcctttggcataccctgcatcaccgcctgcagaatggcggcaagacgtgttgatgaggccattattcagaatccgttttgtatttaagcaggtaagagatcacaaacgcagtggtaaacgcgattgcgataccgatgacatagttgagcagagagcccgcctggacaatcgccatgcccggcagaccggtcagcccgaccgcagtcatataaacatggaccgacaccacccaggcaccaccgagcgcgccacccaccagacccgctataaagggtttcataaagcgcaggttaataccaaagatagccgcctcggtaatccccagcagcgcggaaaacgctgaaggcagcgaaatcgctttgatcttcgcatcgcgggttttaaaccatacggccagacaggcaccgccctgagccacgtttcgccatcgcccagataggcagcaggaagttcacgccgatggaaggattgcccagcagtccggcttcgatagcgtgaaagctgtgatggacgccggtaatcacaatcacggaatagagtccaccaaacaccagtcccgccagccagccggcgtgcgcaatcagcgtgctgagaataaaggagatgccatcacccagcatacgacctgccggcccgataatcagcagcgcaataaagccggagataattaccgtcaggaacggggtcaggatcagatccagcgcatccgggataacccgacgcagctgcttttccagcatgctcataaaccagaccgccagcagcaccgggaacaccgtgccctgatagccaatcatcgccacttcaatgccgaagaagttcatggtgtggaaaccggcggcgacgccccaggcgttggtcagcgccggatgagtgagaatgccgcccagtgtcgcaccaagaaacgggttaccaccaaactcgcgggcagccgtaaagccaatcaggatcggcaggataataaaggccgccgagctgcacatatccagcatgatatagagcgcattttccggattgacccagccgtaagttttgaccatccccagcaggcccatcagcagacctgatgccacaatcgccggaatgatcggcacaaagatgttcgacaacaggcgggcgatgcgctggaaagggttgagcttacgtgcggctatatcagcggcctcagatttgctcgattcactgatgcccgcctcggcgataaaggcagcgtagaccttgttcaccacgccggtgccgaagataacctgaagctggcccgcattgcggaagcagcctttaacgccttcaatccggccaatcgcggtcgtatccgctttttcatcatccgccagcaccagccgcagccgggtggcacagtgagcagcgctggcgatgttctctttaccacccagcaggggcagcaatgcccgcgatatttttacatagtccatacacacctcaatcttgttatgtttttatccatcctgatctctggccccggcatccggggccgcccggtcagaaccaggtttccatctgtacgccgaagttccattcgccaccggcatcgaatcctttactgccgaaagcgtcgtcactggcatagttatccagccggtgatcccagttcatccaggttgcaaagagacgaatttccggacgtttgaggaagtcaccgacatcaccggctttcagggttggcgcaacggtgagtttggtaaagctgccgctgaccgcattacggttgttgtagccttcgggacgcagatccatgtactgataagagccttcatactgcatctcaaagttctgggtgatttcctgaatcagccgcaggttgactgtcgcccagtcatagctgtcacctttgacgtaacgatcctcactacgctgagccagtaaagcaggtgcaatgtgccagccaccgcccagcggggtaataccgtaactcgccagacgccaggtgtccgcttccggcaacagtgcgccatcagaaccaatcgacttcacctctgcgcccagtccatgaccataaagcagtgcagttttcgacgtgccttctctcagcccataaaagctgtcgttatgcaggccaagcagcgcatgtacgccggtttctgccgcatcgcttttgactctgaggccgtcgatgtcacggcgatcgtcgttatcctttgcccgcataccgctgaccatcagctgtaccggcccgataaagttattcagcgacaggatgtagttctgcgcagtgttttcattgttttcaatgtcgccaaaggtacgaccataaagggaaatgttactgcgcgcctgatcgctccatttcatgtcgtaaataccggcaccggtaccggcaaggaacaccacatcggagtcgatccagtgaatatcaaagttatcgcgatcaaaacgcttaccggcccagaccgtggcgttatcgaatgcgccgctgaaggtgggaagctgcccgagctcgacaaacgcctgacgcaggttgagatcgctgctggcggctgtccagtcgttgtaggtgcgttgaccatcggccagcatcgctttgaaacgggtggtggcgccgttgtccagcgtctgtttatgttcgaggttgagctcaacgtaggtatccggttcattaccaaggcgaccaacgtgaccgccggtttccccggcaggggtaacggtcgggccaccctgagttttggcggccgagctgttcatcagcaatcctgaacgggcataaccgtggaactcgaagccaccttcatcggctgatttctgttccagtttcgcggtgcgctgcgcgacctcagcggtggagttttgggtctgttgttgcacggcagccagttgctgtgcctgtttctcagccatctgtgcctgtttctccgcgacctgtgcgcgggtttccgctgcattcgctcgctgctcggctgcctgcagtcgctgctccatggccgcaaggcgtgcttcaatgctgctcatactggagtcggcccagactgatgtggaaagtaatatcgttgagagactcactgctaacgtgctttttttcatttttttatgtccctgaagagaggctatcatcaccggattttttgctaaaccggtttaggcgcaaatcatagccacgggtaatttccctgcgcaatgaaaattgctaaaccggtttagtgattgtgagatagctcccaaaacaggggcaataagataatcagcctggcaggtcgtccagctggtggagccgcggaagtgctgtcatggcccctttagccgtggttgccagtgcaccgcagcgttgtgcactggtaaggcagattgccagctgcgattcatcggcaggaagacccgacttagccagcccccagagtaatccggccacgaaggcatcacctgcgcccgtggtgtcgatgctggccacgggcgaagtagcatagtggtatagctggccctgatagcaggcgatcacaccttccctgccccgcgtgaccagcaataattttatgctgaatcgcactgccagctgcggcatggtgatagccggttcctgatccggacagagaaaattgagttcctcgtcggacagtttaaccacgtccgcatggctcagcgcctcgttcaccaccgcatgcagcagttccggatcgggccagaggtcatgacgcagatttaaatcgaaactgacatgcccgcctgctgcccggatctgctccatggcagtcagggtcgccgtgcgtgaaggttcagctgataaggcaatcgaacagcagtgcagccactccccgtgccggaatacgggcaggtcttgcacctcaagaaacaggtcagcactcggcctcaccataaaggtaaaggaacgttcgccatggttatccaatccgaccaccacggttgaagtgcggtgctgcgtatcagcgatcatgtagcgggtatcaaccttctcttcaatgagcgtttgccgcataaactcaccaaagggatcatcccctacccgcccgataaaagcgctgtttccctgcagacgggcaactccaacggcgacattggcgggcgccccacccggacactgcatcaggcgacccggcatttcgggaagcaaatcaaccacggcatccccgaggcaccatacgcgtacagacataaaaaactcctctgattaaacctgatagctaaaccgttttagctatagcgataaaccgtgctgagttcaagtattaccctgcggaaatgatgcgtaattaacagaagtcgttatcaggcgaagcgataagatgcggattgcactgtcgggaggccggtggaggaaagaattaaaaaaccggcacagaggccggttctggtatcaaaaacgtaaagaggattattttaatgtggagagtatctgtctgattgacgcgtcgatctgttcagcaatctcttttggcagacggctgaattcatactgcacagtccgcttctcatcattagttttacgacgcgcataggtattagctgtggtaaaggtagccagcttttccgtcaccgtcttgctgacgggtgcaggtttttttaactgacgacgggcgcttttaaagccgttaagaatcgcgctcttcttctcatccgcattggcgcttagcagggaatcatcagctttcagcgtttgcttaatatcgctgaccagcgcggtgacatcaaccgcttccgctttcgcctcttcccagacatcgagcagtagctggtaatcctgaagtgtcagctctgatacgaccggaaagagttcaataaattcagcgggtacggctgcggcctggaacgctcgtgagacctttgcgtttgagatgccttcggctttagcaatctctgttttactcatgccattttcgttcatcagcataaagcgcaggcctaattcacgcaggttatgctcttttgctgtctgaatgtccgcagccagctgacgcgcatcactaaggctcagttcatcagcggtgaccagtacttccagactggcaccggaaaggatgcatgcggcgcggcggcgcgaaccatccatgatttcaatccggtcaccgttgacacgaccaatagccggaaaaaattgctgcagcgtaatagtacgggtgatctcctgaagcgattccggcgtcagcgtgctctggtcacgtccgttaatttttgggtcaacgctggttctggtttcaatatcatcatgcaggattagctggcgcacaaaggtggccttcgcgcccgacttcagcgtaaatgtgcgcgactggctgctgctgtcgatcatgtttgcgatagcagaatcaccaaacttgcgcccgatgcgctgtataggtttgctcacagggtactcctgatatattcaatgcggtcaaacacagcccttgagaactgctcggcttcatatttagctttgcgcagagcgtccgcactgcccggataagaggagggattggcactgatcaccgtatcaaaggattcgccgcagcgttcaaatccatccagtcgcggcaggctgcagtccagcatcgatttagtaaacacttcccgggcatagctttgcgaagtcaggtgatcgtgtttagaggtcattttggacataaagccgatattggctttaagccgtggctcaatgccttcggactcaatacgctccagcatttccggcagacgcgtcagatacttcatggtggagtggaaatcgacctgtgccgggggcgtcggcgtcagcagtacatcactggccgcaattgcattcagcatgaatgaatcaaggtgaggtccggtatcaaggaagataaaatcgtagtcacccgccagacgatcaatcacgttgcggcgtagtacttccgaaggcgcaacgcctggcagatgctcagcaacgagctcttcccagtcgcttgcaacaaaaccatcgtcgatagaggctgggatcacatcaacgccgggcatgacagtaggtttaatgaattgcttacgaagctggtctgcatccagatcgttcagcatcgcctgcgctgccgtctccagaaactgaaccgacactgttggtatggctcaggaacatcgtgcttgatgcctgtggatccaggtcgataaccagaatacgcaggtcattatgtaacatagaaggatgtgcacgcataccgtgggccagcgtgactgtgctcactgtttttgagacaccacctttaaggctgacaacgaatacgacaaaggggccatcgtgccgatcgcgatatttcggtactttacgatgctgatagatgtcgaccacattctggatagtcagggcatattgtgaggtgctgccggtctgttttttcccaaactgataacctgctgcttccatatcaccaattgcggcgacaacagcatgcttactcagcaatggcatgttggcgacagcattccgggagaaggtctggtaaaaaccggtctggttaaattcctgacgctgctgctcaatatggttactcagtccatgtaacatggaattggcacgtgtggccatttccagcactccaccataatcacgcttcataagcccctctgcgttaatgttttttgcatactacacaaaaagcacatatctgccaattttttagaaaaatgccaaaaacctggattttttctccgcgatggtgagatgcaagcagcattacttttgtgaatcactggaaagtgaatcgctctgcttttttgtcttacaggctggttgagacagataacttaaaatggcgacattaaacgaatattttaaggactaatgattcggagcggtgcattccgattctgataaatcatctgcaagtctgcaggttgctcgttaaattgttttcgtgtttttttaatggtgttttcagcatgaaaattcaataaaagttattataaatcatttaattaagcgtgaaatggcctggtgaaaaatttccaggattaatgcactttcactcaacatttactgctgacgtagagttttactcagaagctattacagtgcttttgaacctgaaggagtaggcataacggtaaagtgcgcaagtaatcgttaccgttatcattgctaacttaagatcactgcttccaaatctataccttttatgccttgtcattatgtatcgttcataatctgtgttgctgcctgtcaacataatgtcaggcgttttccgcatagggtttttattgcaaggcttaatccagaaaagagagggatttaattcccttcatcattatgtgatgtcacgaatcaaaatcatcgaagagttaagactgccgatttaagagcatgagtaggagtaggagtagagaacaggcttaatgcggcaaggcttagagcaatattaattggggcaagtcaccataatgtagctatgccggacagtcagaattaacgctctactgtgcttgattcagctcccgatacaatcttttcatcttcatatcattcttacattcctgaaattacttcattcacgctaagcctatttattagtttaagttattatgccgaacgcatttttcttactgtcgttcttcctgttcttcctgttcttcctgttgttccttcactggtgccttattaacttcttccgggaaagttattttaagtgcctttttagtatgtctgacagattctgagtactgacaaaacaaagatattacgttaagtaagaatcttatggtgttttcatcatgaaaataaaaaataatccattatttatcaaatagataggcgattaacatcatggtgagttttctgtattttcactgaccgattttctgaggcctgatttaaacttataaccctaaagatttaatggttataggtgtatgcaacattccagtcttacctatgctcagcgttagatcgttttagcagtaaaagaccttctcagtcgtgcttctgataaaccgcacattcagaaactgaaggtgaaaatcacttctgactgggactctcagctaattctttgttttgtgtgttttatccccgttatccacaggccagatccaattggtcgatcctcaatagatcaaagtgagatccttaacagatccctgcagcgtctgaagccttgtgacacaaggcctggaagggggtcagtaaccactgtagcgagaagaataaccactataacgagtataacaaccactatagcgagaaaagcaaccgcgctggcgagtactcaacaaccactatagcgagtaagtggtctgaatcggtgtgcataaccctgattatgtgtagatgacggctttttccagagtgcttgcgatgaaagagggagatccagtaaagggggagggcggtggctcgactctttttcagttagttttctcaggttatccactgaatagatccaataacagatccatttaagatccttattaagttccttaaagatcccagcaccgcctcaggccacggtatgactacgttaaagccgggtcgctaaccactataacgagtaaaacaaccactatatcgagagaaataaccactatggtaagtagattaaccgctgtagtgagtgatagtatccactgtatcgagtaacagcggctctcgcctgttcacatcacggatcttcctaatgccaagaaaagaaccagatatcctgaacatagctgatgcgtttagcgaaacagataaacgtacaggtgaagttgttactcttacccccaacagtaacaacaccgtccagccggtagcattgatgcgactcggtttatttgttccgacgttaaaatccacagcgcgcagtcagaaaaaccagatgaacgccatggatgtgacccaggatcttaaacagttatccctggtcaggtcagaaggctatgacaacattaagattctgggtgcccgcctggatatggataatgatttcaaaacctgggtcgggatcattcgtgcattcgctacgcatgagtgtctgggagacacggtaacgctctctttcgttgaatttgccaaactatgcggcataccctcagtgcgtctctcctcgaagctcaggagccgtctggatgcttcgctgacgcgtattgcctctaacaccctgacttttaccagcaagggcggagagaactacacgacgcacctggtgcagtctgcgaaatacagcatcaagaaggacacggtaacgctgcaggccgatcccaagatctttgagctgtatcagttcgacagaaaggttctgctgcagcttaaagccatcaatgagctggcacgcaaagagtctgctcaagcgctctacaccttcattgaaagccttccgccgaagcctgcgccgatatctatggcgcgtctgcgcgcaagacttaacctgacatcgcgtgtgattacccagaatgccaccgtcagaaaggccatggagcagttaaaagagatcggctatctcgactacaccgaaacccgacgtggctcatcagtctacttctgggttcattatcgtcatcctaagctgcgcccggccgaaactgccgctcagtaagtcaggcctgatcgatgatgagatggatgagtttgacgatcttgatatcgattccgacgtaattgacgtcagcctgcctgaaccggtgattgaagaggatagcagtgagctggtgatggtctcgcgtgaagaaaaagagctactgaacaaaatcaggaagcagaagaagcaatgacacgctttctgctagcatgctactccgctttcaatctcttatcgggaacgccgggctgaaacgcaataaccactgtagcgagtaacgttactcactatagtggttaccagcacgacagcaacatacgtaacgcctgtctgaacagggctaatcgcgctattcatcactctccatcggcaggacctgaattgagcccggtgctgtgtttactctctatagtggttagtctctcccggaagagcggcctcaaaagcgtaatagccagaatgagacccaatattcactcgctatagtggttactcacctgatcacagcacagaaagtacgcccgtcatgaagtattcacgcaggctgtgcaggggaatcggtgtcattactctactcgctatagtggttatctcctccgttaccgcgctttttcatctccgttttgtccatccagggtgagtaaactactcgctacagtggttatcaggttgttttatcgctaaagcgttcagttaatgatcagatactggcgctgatgaatgagatattctcgctacagtggttgttaattgggagcagaaatgaggagcttactcgctatagtggttgttattgtcactggcctatgctcgatatagtggttaccttaaatagagtaagcactcactatcatttattgcactgtcagtaaaagacttcctgttaaattgccaaattcccacacctaaaaatggttactcgccacagccgttaaataatgtgccgtgcttcaggtttttgcagttatagagcttagctgcatccttaaaagcacctttgcgaggccccacgcagggcgcattgtgcaatcaagggtcaaaattcattgttgagagagaaatcggttttttactcgctatagtggttatgactgaatgaaaccgtacctggcgtacctgaaacaaagggtaatgcgccttcgcgctgcaatttagagggacggatgacgatttacttgctctgcttactcgctacagtggtttccgaaccctgaatatcgttactttactcgctacagtggataggcgatgaagtttgatcctaaagaaggatccgccactgatttgcttactggaagagttaaacaggtaactttgctcgctacagtggttatcaaatagcgctaagccagaatgagtacagagattaaggtatggccggaaccatcaggaaggcgttgtcgttatccctgtcacaagaaacgggtccgatggaggcgcgggggaggggaggtgtttagcggggccgctgcggctttgatactgctctgcaggacatcggtgaagaaagcggcctcgcgctgacgtaccgctttatcaccgttgggacagagagtgttacatcgcctcccggtattccggccaggcaacggattgtgcttcatagcgtcctgcggctgcgaacagcgtgccctggaagttgatcacgcctgcagcctccagccacatccactcttctgcctgtacgatccctgccgcgatgacagtaatttccagcgctgaacagcatttaataatcgcctgaaccaccgcctgctttggcccactgcgatgaacgtcgcgggtgataccggcatcaatacgaatgcggtcgggctgaatgtgagtcagcaaggacaatcccgcggagccgtcaccaaagttgtcgatcgacagactgattccgaccgcttttagcgcgcgtacggcttcagagaacgcttccagctgcgagatcactgcggtttcactcacgccaacaacaacctgttcaggaaccaatcccgcctgctgaatagcggccacaatatgatcgacggcattgggtatcaccaccagcgtcataggcagcaggctgacgtacagtgtcataccgtccgggcagaccaggccagcatgggcaaacgtctttttcacggtttccagatcgttaacataaagctgatctcctgaggtgtcgtcggcgggagcaggtcgcagagtggtcgcctcaatcgctgtgacctgacgagcgaggggatccaccaccgggcgaaagctgacgccttctgtctccggacgggagtccggcacatcattgtgctcagaaataaactcccagtaacccggcgggaggacctcgtaatagttctctttctcacgagactctacaaacgtgcgcaggaattgcagtgcccgatcatcataggtcagacgatattttgacgtccctttatccagcacggcctgcaggagcgatgagcgatcgtgttcacgcaggtcaaagagtgccatgcccgcattaccaaagcggcggtaaggcgcatagtcgcgcatcagctccaccacattgtggtgccgtcgatctgcacaaatcctctgatagactgcctgaatgcccgcttccggaccctcaagcaattgaaaaaaatgggtaccgttaaataataagatgccggtcacgtcgtgagtcgcatttattttgctggcgttgtcgaccatcgcgggcagggttctgatgggaaagtcatctgaaatatggctgcggtatattatggtagtcagcatgtgcagctccgttttataagattgttgcgcacacgctagcattgttcaaaaaatgtttcatctctccttattcactgtcgcacagactgcaccacggcaggtggcaataagcgaaacggcaaattacggggcacggttccaacaatcgtaatgggatcagagacgctgaacctgagcagacgaaacttatgcttcctgcataataaaaaaggccgccgtaatggcagcctcatcgtattgaaggggtaaatgttatttgatcagttcagcagagacataagctcgattatcaacgcgtgcgccggtaattttataggatgcacctgcatctttggcctgtgccgcgactttagcttcagcagcatccagggtagacgcggtagcggtaatagtctgggcaaaactaccgaatgaaatcagagagagtgcagtaacagcaacgaaaattttgatggggttcatggtcaattccttagcgtatttcagtcagggagaggcgttttgcctcgatggaatgaatgataggcgcgatctcgccagactgatatagctaacttttgctgatattgatcaaatattttgaattattaccatgggggatatcagagatcgttcagatcgctgaaaacgcaatctgatatcagattgcgccagctccagattaatgacactcgccacgcagcttccagtgcagccagtgatccaatgcttcttcgttcaacggcttcgaatagaaatagccctgagcctgatcgcagccatactcggtcagggatgttactgcatccggacactcaaccccttctgccaccacggtatagtccagctctttaagcatggcgatgatgctgcgtgcaatgatgcgtgaagccgtgtcagaggaaagctcactgatcagggaacgatccagcttaatcacatcaagcggcatgcgacgcagataactgatattgctgtagccggaaccgaaatcatcgagtgaaatagtgaatcctcgtgctctgagcatctccagcccgcgcagggcggtcgggctttcaaggatacgttcggtttccagacattcgattcccagcagagaggtcgggagcttagatttgaccatcttactttccagcgctgaagcgaacccctcgcgcgcaaagtcacgtacgctgacgtttatcgttagcggcagctggatgcagttgttcctcagccggctgaggcgctcaaccgcccgatcgataatccaggctgtcagcacagagagcagatcggtctgctcagccagcgggataaaggcggcaggtgaaagctcgccccggctgggatgttgccagcggataagcgcttccagacccacgggtttaccactttgcaggcaaattttcggctgatagaccatatatagcccggtgttctcgcgtaatgccgttttaagatcggtcatcagcaggaaatcttctgaacgctgcgtttcagcctcagcgtcaaagcgctgagagggcagtccgcggccgaccgcttcatgcaacgcactgaccgcacggcctaatatttcagatgctggcatgctgccagcgacaaagtcagcctcaccggtatggggagtcagcgcgaccgacagaccttcatccatgtccgcactgataccttccagacgaccagctacccacgcggcactgagtcggctatccgctcgggtcaggatagcaaagcggccggtggccaccgtatagatcatctccccaaccgccggacgcaggcgcagcggcagcagagtggccatatctttcagcaggctctcaaccgggctcattcccatggtgcgggccagttcataagcacgcgacatatcgatgcaatcaatcagaaccagacggcgtggcgtggtatcgccggcaacggcaagatattgcaaatcacgtatcaggcgctgacggttaggtagcccggtcaccggatcggtaaaacccgccgagtgccaggcttcaagaaaagacattaccagcgtagagagcagcgttaaggtcgtcacctgttcactgggaaacgcatgcggttcggtgtcggtcacacatagtgtgcccagaataataccatcgcgtgttttcagtggcacaccgacataaaagcggataaagggtgagccagtgatcaggggatgcgtgacaaaacgcgcatcgtaataagtatcagggacgatcaccgcactgtcgctatcaaccacgtgacgacaaagtgaatccgcacgcgttgagcgttgcagttcaaaattgtgtgatgcccgaacggtctggaactcatcatccagcaccgatataaagctgcccgggatacccagggcctgactggctaaccggacaaacttccggagaacttcatcgcggctttcatcagggtcgcgcaacgcctgtaaggcgcggctgcggcgctcattgtcgccgtttaaattgtttaacatgtgtgtagaacccccgcaccggctgattacggagcgaaaaaagaaaactgtccggagcgaaatgtgattcgggcggcaggaattatggcgtgattttttattttcaactggataataagggactatgcagcgggtgtctcttaatattttctttaacgcattaaaggggttgttacgattcgaaaatttaatcgaagatgcgcctgattatttacatttgtacattttatatagccaggagagggtttttacggttgttaatgtttattttccgtcaggagatgaataagcattcagggtggttaatgttatttctaagtcagttttacaattaaacaggtctgcagccagagacggatcgctatccgctggttgctcaggaagataacctattaaaaatacaggtaaaagcctgaaaaaatgaagaccggcagatatgacctgtcagtgtactcctgactgctataggtcaatccaccgcaagactgccagtaacgtgtcgcttcagacagtaatcaatttaacctttcatgccgtgtgtgaattgtgtcggacgacgtggcggcgggttttgctccagccagtcacgaacctgtttcggtccgcggccctcgctcgcggatcgcgcgtgtcagcctttcctgtgttgtcctcagttcctgggtccagtaggtgatttgccactgttcacgaatttccacctgcgacagatcgtcgggcgagcgacgctggataggatttttcattcattatcctcctctttttcaatgatgctgcctgaacatgaccctcaggctatacctctatcctgatgaagaaagggcgcttgaggtagcggattaatccctgaatggcccttaaggcaaataacaggataattcctggcaggaggaataaagcactctatggaaatagaaaagtctccgtcagggcgaaatatgccgcttcgcttataaaaaagcatgcatgatttttaaacctgaaatttgacatttatttaaaatagtcaattattctgtggtcttttcgttatggccgctctcaggttgcttcgcttttattgatggtgaagcgctgtgcctttgcggtttaatcatgttgaaggagtctttgtttggtgaatcgtccccccaggccgcctgtggtcgtccagagtaatgtgcgtgaacttcgtcttgccgccgggctctcacagcagagcgccgctgagcgttttgaccttagcctgcgcgtctggcaaaccaaagaagccgcaggtaacccgacactattaagtcagggagaatatgagttgctgttattactggctggctgtcatccccattttgctcttgcacctcagagcaaaaagtaacggctgcgttaataccctgaaatttatttctgtggtaaccggctgtctgataacggtaaaaaaattatatttaccaacttgaaaactgactactgatccctatttatggagatgatcggaaatatgagcccgatcagatgaacttttggatgaacctgttcaggagattatcaccatgtcagtacaacaattttcagtgttcccttcgctgtctgattcagtcttttcagaccgctttaaccgcatcgataaattgttcagtcagcttactggcgacagcccggtaacgtcggtttcccgcttacgatctgcagcgggtagaggataatcgctatgcgttaaccgtcagtgtacctggctggaaagagcatgaactggagatcgagttacgaggcggacggctttcagtggccggtcacagagagaaaccgtcacaggaagcgtctggcgaggcccgggaagagaacaccagctggatccaccgcggcatttcccgacacgatttccagctgagcttttccattccagagcacatgaaggtcaccggagccagcctggcggaaggtctgcttagcattgatctgatccaggaaataccggagagcgagaaaccgcgccgtatcccgattgcgatcggcggtcagcgtactcttgaacatcagtaacatgaacagggcggaaacggcacaggctgtttccgcctttttattcactggcaggtaagaaagtcaaaagagttcaggcgctggctgccataaggctgatttgcgacggtaagccggtattcgttccggtcagcatgatcggttcacccgcctcaagactggagtgaaatgcagccttcatcgatgcactgataccatcaccacaccacatcagatgatgctcaaagcggcgttgcgccacggcggggatacctgacgcatctgctgcaacttcaacccgaaagccttgtccgttaagccgtatcgcttccatccagatctcggtttcatctgtgacgctgactgcttcaagaaacagcggtacggtgctgcgtcgttgtgaggccagcgccaggcgctcccactgactgactaccgctgaatgaaagcgctgctggcgccgcgccgcaccttcgctgaggtcagtgcgcagccagaggttgagcggccgcaggtagcgattaacataatcatcaccacaatagtcggtattcatcatctgtagttcgcgatcaacatctgcgtccgtattatgcgccagcagatgcaacatatcctcttcccggcaggcccagccgccaggcagcgcaacgctgggccagttaaatgcagtatggatatcaaagagcgtatgaccccctgaggtcatttcacgcacacagagcgcacgcgtaagctgattatctgagtaaccagcagggccaggcggcgttatcagcccggcacggcgccagcggcgcagagtttcaggaagaacaccgacgagaccacatacggtgtcggtagagtgctggggcataattgatatccgaaaggcattgagatcccatgaacagggaagatgacgcagtatgcgcgtcaggaataaataaagaaacaatcatttccaaaatctgctggtgtatcgggtgcagagagggcagtgggtgagggggattaaacaggggtacagggcagatgccggacgcagagacgcccggcgattaagcacacgttaccagtggtacttgttggaatcttcccactctttcacttctttttcggcacgatctttctcgtagccgtagcgttcctgaattttaccgaccagctgctcgcgcttcccttctacaacggtcatatcgtcatccgtaagatcaccccatttttccttaactttacctttgaactgcttccagttaccgccaatgcgatcttcgttcatggtgactctcccatttccggttgttatccagtgacctgatgaatatctgtattgcctgaaggctgtcagatgaatcaagcatggcacagcttttgccttttgcagcgaagcggtgtgagccgcatcaaattatgggcaaaagggaaggaaaggggattatcacggcggggtctattccgggcgtcgtgctggccagcttactgcaggcagggcattgagggctggacgggcaaacagaaagccctggtaatagcgtaccccggcaccttccagccagagccactcttcaattttttcaaccccttccgcaatgaccgtaatttccagcgcctgacagcatttaatgatggccatcacaatcgcctgacgcgggccactgcggtggatatcggtgatcagcttgcgatcgattttaactttgtcgggctggaaatcggctaacagcgacaggccggcgaaaccggcgccaaaatcgtcgagcgccaggctgatcccggccgctttcagctgctggacagcaaactggaatgcgtcgaagcgcgagatgatctcatcttcggtcacctcaaccaccacctgctctggtcgcaatccctgctgcctgatctgctggataagatgttcaacagcgtcgtcaatgaccaccagcgacatgggcagcaggttgacggagagcgtttgctcgcgcaaccccagatgtctggccagctggaaagcgtaggttttagagtgcagatcgccctgataacgctcgctttctggcaactgtgaaaagtaatcagcgggtgatgcgccgtgctgaccacgtatcaaggcttcacaggagacaatccggcgatttgctgtatccacgataggctgtagcgcaaattcacaacgctgacccggtgccggttgccaggctggctgagattcggaggtgacgggtgttgtcagcgtccactgactggcaggatcaattttgataaacgtctctttatcccgcccctcgacgaaagaacgcaggaacttcaccacccggtcatctctgatccgttcatcactcagggtaacccgcttaagcagggcatccactacggtgtgtttctgataatcacgtaaatcaaataaggccataccggcatgaccgaagcgacgcgcaggggcgtaatcccgcatcagctcaatcaggttaaaatgccgctcatcctgactgatacgctggaaaaccgtgtgaacgttgtcgacgctaccctccagcacctgaaaaaagtgctgtccgtcatagagcagtatcccggtgacttcagcctcagcatttttgatactggcgcgctccaccagcgctttcaatctctctggcgagacagaaacccgcaagctggctacggtaaataagggtggagagcataatcagactcacgtggcagaaagttactgattaaacatatcacagaaatattgctggttaagggcacaactacgaccattatgccgttatatttgcagcattaatttaatcgtagattcaggtagtactaaaggattcgacaatcaggacatcagatcgcagtgcggcaataaccgggcatagaaatgaagggaaaagaaaaacccccataaaatcgggggcgaacagcagatatagcgcattattataacgttacagcatccctggtgaggcgctggtcaatctgatattgccagattattacgcactttttattctccttaccacgtcattctggcgaggcttttaagcgggtaaaaaatccgtttatttgctatttcggaaaattgttttgagattcaatccactgtttcaggcttcaggcgatgtcagcacaaccaatgaaatatcaggttacaaatcaaccacttttccagacactcccttaacgtcatcagcacagtagtcagcaacgcatgaacgttgtcggtctgcagagacaatcagatgttgatatctgccttatctgaaaaaagtgccccctgtaaaagggggcaagggtaggagtcagatcgctctgtaaaagaagtggatttcattacagagccattcaaagatagggcaaaaacgaagtttatgccgctacggttaactctttttttaattagatatcaaacaattaaaaagctaacaatattcaatggctatttaaatcaataccttaatcagatatgaaaacgatttctaagattaggattaaagtcctgtttcggctgctgcttctgctataaatggccacaattaagccattgcttagcgatctgagactggtaaacagagcagacttgacccttaaagcgaataattgtactgtttatatatacagcatattatcgattgagagccggtgtggggtagagatgtcacaggatgatgaggtctggtcagcattcaaagaggcggtgaggcgggatgataccggtcagtgcacagtgagtacccgggattttgtggctgaactggaacaacgcaaatcacctcacacgcttcgggccgcgaatacctggatcgagatgcatatcacgactttcagtgatatctcaattgagcccggagaatgtcgattgttccgtgtgcctgcggcgcgtgattaaaacgtgccgcagcgcagacaggataagaaaggctttcagcctgactgctgtaacagatacaggctgaagcaggcatcagagcctggatgtgttccgacgcatgtcagaccgatcctggaatttaggattcgcggggaagctcttctcgcacgccatgcgcgccagattcaatgcggctttgcgttttttaagctttaacttcggcaaccactctttgaaactgtgccgttagcgacgctgcctgctgctcgttggtgacacgacagataaatagcttgctcttggtctgacgactgacatcaatggcatagatctctacacctgcgctgcacacttcatattcaacatccgtaaactgcatgtgtggccaaagaccggttctggtttcaaatgtggctaaatccatgacgactacctttttttattttaagcgttattgctacccaacagactaaagcctggtcgggccagtgagcatagaccagattcagcattccgccagcgatttcactgatttaatctggccctgacacaaaaggctaaaatctcccaccgtcgcctgttatctgacaggtagccagtcatcctcttatcagaaaatctgatgacagactgtcatgctggtttttcaccccttcagctcttcagctttacaagccctgcctttgctgcgtctgcgacggtatcccacgaatttaaatcgccttctccttaacaattatcgtcagcatcgctgttgaattagcgggctaattatcagatccaaatgaatgcctgcttccgcttcattgtgaccatccggcagtggaaatcttctgacaggagatgtggcaaatttatctcagatgatgagatgtaaaaaggtgtgtcaaaataaaaatgaataaatggcagagtagtgttctggctagttcactctgtaccattcgcaaggaaaaataaaaaaatatattcgccatgcttaattaaagccctgcagacaaaagccgataagaacgatccaactttgaattatgtccagattattcttttttgccgggggcaagtatgactattacacaacgtctggtattgattttctcactgcttgcaatgtcactgattgcgctggtgattatctctttatcagtgatttcgggctttcaatcccgctttgaatatgtacagatgaacgcaatacccagcattcgcgatctcaataaatcgatcagcgtgaccaatcagttgggtattgcgctttatcgccaccacagcaccagcgatgcggcaaaattccctgctgcggaagagcgcattgagaatctgcttacgcagattaagtcgctcaatgattactacatggctaacgacatctccagcgatgaagataaggcgatgacggaacaggcctataaaaatctggatgcggtccgcagcgcattgccggcatttcttgccgcgtcacgcgcccatgatgatgcggtcacgctgccgttattacagagtgagaacggagtaggtgctgcagcccgtaagatggaagcggatttcacccgtcagattcagctgaacattgatattggtgaacagctaagggtggagaaacaagcgcgtttatagtcagaccctgtgggcgatgtctggcgggtcgctgctgcttattctgatactggccggtttctccgctaaggtgattctcggcatcaaaaagagcctctcaggcatggtcaataccatgacgcaggtgagtcataccctcgacctgactcatatcgcggaggtccgcagtaaggatgagatcggcaaaacggcgatggcatttaatcagctgctggcgcgcgtctccggcacgctgctctccgtcagtcacgccgcgcaatcggtgagtaccggatcaacgcagatagcggcgggcaatgaagatctctctgcacgcacggaagaacaggcggcttcactggagcaaacctcagccagcatggcgacactgagcgaaacggtgcgacagaactcagaaggtgcgcaacaggccagcagcctggcaaataacgcgaatcacatgtcaatccagaatgggacggcggtgaagcagatgctcagtaccatggatgaaatccgcgccagctctgccaaaatctctgaaattaccggactgattgaaggcatcgcgtttcagaccaatattctggcgctgaatgcggcagtcgaggcagcgcgtgcgggcgagcatggtcgcggcttcgctgttgttgcctctgaagtgcgtaatctggcgcagcgctcctcttctgccgcccgtgaaattaaggatcttatctcaacatcggtttcacaggtcgaacacggtttagagcaggccagcggcgttggatctaacagtgaaaatgtccgtcaggcgattcagcaggtggccgatctggtcaatgagattgcggcggctacctctgagcagagtaaaggcattgaacaggttcatcaggccattggtcagatggatgaagtgacgcaacagaacgcctcactggtggaagaggcctcatccgcctctaagtcgctgcaggagcaggcagaaacgctgtcgggactggtggcgacctttaagctggaaagcaatcaccgtgcagtgcagtcgcagcagaccgctgcagtacggcgtccggtattacacgcaaagcagcctgagcagcagaccatcgacctgactaaggcgaactgggaaagtttttaatggttgagcagtaacttaagggcctccacaatgtgggggcttttttttatcattaatcagaataaataaacgactttttctgaaataaatataaaatgaaatcgatttcattataaaagtgcaggtaactctttagggttataaggtttaaattagaatttgccgggcgtagatatttgttttgatagtctggtgataatgagtcagatacaggcaggatgtcagttatcggctattcatgacgcaacttgaatttctttatcttcaaaacaataacgctgaagtcaggcttgtggcttaatgatttttgccaggtgtttttgtttcaattttatgatttttaagggtatttttcaagtttggcttaggtgaatattgaagtaaatattgtcattttattcactgtaaaataacgcagcgcaatctatactcccttccgtgttatatgtacttctgatttttatacgaaactcctttcttcatagcgacattgtgctgcatgaggcatctctggctatgtcaaagaaacggtaaaaataatattacgaaagctatttcgtgcgctacacacctgcacgtctcacacatcagagcggaaaagaatgaaaaaaatactcgaccggattaatttgccagcgaaattcctgttactcggatcctttgcgctggtgctgtttattttacccacctttctgtttattcagacgggcaaccagcttattgatacaaagaatgtggaactgaccggtataccggtcgaaagaaaggtgctcaagttgctgaacctgctgcagcggcaccgtgcggaaagtgcgatcgctatctcgctgaacaaaccagataacgcgccacgtatggcgttggtcagtgaggttaatcgcttatctcagacgattgctgacgaattacgtcagaataatgagcaggcgcagccgctgaaacggctggagcgggttaatcaggagtggagccagctgcagaacgatattaacgcgggcaaactgaccctggcaaccagcctgacgcgacatgctcagctgattcaggtgctactcgatacgaaccaggatgtacttgatttctatcagctatcgctggatgccgatctgaatacctaccagctgattgtcagtatctttagtcgcctgccgcaactgactgaaacgctgggacagattcgtgctagcggcacgtcgctgattgcgggtgggaatgtgtcggatgccgatcgcagccgcatggcatttcagcttgattatggcaaaacggcgctgagacagtttagcggcaacatggataaagtattttccattgagccagatcttaaaaccacctttggcaatctggcacaggatgcgaaccagcaggcgctgagtgcactgaatctggctgatagtgtctttgtcagcggtcacgccagcgtgacgccggttgactatgtgcgggtctttacccaggcgattaaccgttacggcgagctgggtgaacaaaccagccatcgtctggaaggaatgatgcagacgcagatccaggaacgccgctatgcgcagtatctgttactggcaggtctgtttgctgtcgcgctgctggccattctgctggccgtcatgattacccgttcagtgacccgtccggttaaagaagcagttgaagttgccagccgcgtcgcggcgggcgatctgacggcacagctgaacgtttccggcagcaatgagatggctgagcttctgaatgcactgatgcggatgcagcagcgtcttgctcagctggtgtcggatatcaaaggtaacgcggctaccatcgccaactcctcagaagagattgcccgtggcaatggcgatctgtcgtcgcgcaccgagcaacaggcggcttcactggctgaaacggctgccagcatggagcagctggcggcaatcattcagcagaaacgcggataacacgcgctttgcctctgcccgtgcagaatctgccacgcaggctgcactctccagtggtgcagcaatggattcggtgatggagaccatgcacaaaattcgtggcagctcaggtaaaattgaagagattacatcggtgatcgacagtatcgccttccagaccaacattctggcactgaatgcggccgttgaagcggcacgcgctggtgagcagggtaaaggttttgcggtcgtcgcgtcggaagtgcgggcactggcacaacgttcagccagtgcagctaaagagatcaagggtctgattgagcagtcggtcggccacgcccaggaagggatcgccatggcgcagaacgcaggcgataaggtgaaacagagcgtcagcgccattgaacagacctctcagctgatgcgcgacatcacttcttcatccgaagagcagagcagtggcatctcgcaggtcaatattgcggtgaaccagatggatcaggtgacgcagcagaacgccgtgctggttgaagagtcggcctcctcagctgatgaactcgccgcgcgcgcagggcagttacgtacgatggttgcggtgttccagaccgcataatggtgttaaacagccgcctgtgggcggctgttctcttctcagcatttattccgcgctatgcctgatgatcctgcagacaggccagatacttctctcccgaccgcatcaccttctcttttgcctgctgatggatatcctgcccttcaaacgcgccatacagttgcccgaatgtcacgccggagagccgatgcagtatgtcgcctaccgtagcggctgacagcggcagcatattcgggtagctccacataaacgacacgccatgcgcacccggcgtgacctggataatatcacccgccagaatcatcccatcaccttcgtcccagtgcagcacgctgccgccgggaaaatgaccgcccagccgtaacagcgtcacagagggcatcagcgtcagcgactcgccctgccataactggatatgcggactcttccgcacaatccattggcgatcgcgggcgtgcagatgaatgggcgcattaaacgcttcagcccactcctgcatggtggtgtagtagtgcggatgtgaaatcgcgatagcatcaatgccacccagcgccgcgatcaacgtgtaggtggcatcatcaaggttggcaatgcagtcccacagtacgttgccgtgcggcgtgcgcagcagaaaagcgcgctggttaatggcaaactcaggcacggttttaagacttaacagcgcatcgctgtgagccgtccacttattggcgtggctggcgcgcagttcatcaaacgcgagccagcgctgaccggcggccggaacgtactggcgttcatcatcacagattttacagtgctgatgagtggaatgagcgggataagccgttccgcaggcggtacataacatcgtcatggtgatctcctttgtctcactcaatcttatgcacacctgcgaaaaccgcactttcctgaggccatttcgttacgcgattacggctggcggcgaagggtaatccgggtgagttctgagggacgacccagcctcaccgccatgcctggccagagtgccgtgccgttattcacatagagctgcattccgccgacctgataaagcccggaaacaaacccggcgttgggtttagcaaacagcctgtccagcccgataatcaggccgccatgtgtatgtcctgagagctgcacatccacgccctgcgctgcgttctggcgtgcattgcgtggctggtgatccagcaggattatcggcgcgttttcaggtgcctgttccagcgcgcgggccagatccgggccgaccgcgtttctgccgggtgcggaggcgtccggcaggccggcaatcaccagctttgcggttccgcgctggatcacggtatggctgttgagcagaggttgcagacccagtgaggccagatgcgccgtccagattgcctgatggaagaaatattcatggttgccggtgatagcccatacgccgtcaggcgctgccagcccgcgcagcggcgcaacgtcctgccgccgatgcgccaggctgccatcgatcacatcgcccgtgaccacaatcagatcggctttgagagacattgcccgttcaaccattgcggcggtccaggccgcattaaacaaccgggtgatatgcagatcggtcagctgcagcagctgatagccatcgaattcagcgggcagattgggcagcgtaagggtcacctctttgactggcggcacgcgtatcgcctgctgaaacgccaaaggcagccagccccatcgccagcactacggccagatagcgaacaccgggaaccagctccagcggatgacgcaacagcagggcaatcagcatgaccgcatccatcagcatctgaagcagcgccagcagcagcacggtgctgtacgcccagttaaacagaatgatgatgatgcggggcatttcagcggagaagatcccgcccgaggtaaaacggctcaccagaagatattgtgacgccagcagcaccagagcggagagcaggatctttacgacaagtggcagggacaaaggaataattacgcgcgcaattacataccagctgggtaagctgaaaatcaggtgaaacatggcatttttccggtagggcgctgaacatctgcgcaggcaaaaaagagtcgatcgtttatagagccgttttcaggactgtagtgtatatgatgttaccgtcaggcttgcttcacgtcgggtgctttacaggcggtaaagcaggcagagaggatcgataaaacttcagggcgcaataatgaaaacagcgtgaccggagcaccggccacgctggcaacattcacgtattgagccgcctgactagcgtaaaacgcctgaggtcgtccgggtctcgtcagttacacgagtcatggatatcggaatgcttttataggcgggaatgccgcttttggtatcgtggctgtcaagcggaaccatcacattggcctccggatagtaagcgccgaccgaacctggggccatatcaataatcacgatggtcaggtttttcatctggcgcgaagtgggattgccatccgggtccagcgccatcagatcgacacggtcaccgacccgtaactgtcgcttctccgcctcttctgcattgataaacagcacatcgcggcggcctgtcacgccacgatagcggtcattcagcccgtaaagcgtggtgttgtactgatcgtgactgcgcagggtagtgagcaccagatcatggcacttcagcgagcggggatcttcattgatgccctgcatcactttaaactgcgcacggccagatggcgtcagccagacccgttctgatgcggcgttatagagccggaaaccgcccggatgcttaatcctctcattgaagttttcaaacgccgggaacaccgcttcaatggcatcgcggatgcggctgtaatcggctgccatggctgaccagtcaaccacgctgtccggcagcgttgccttcgccagtgaggcgaccagcgccggttcagacttaagatggggtgaggcgggatccagcgaaccgcgtgaggcatgcaccatcgacatcgaatcttccacggtgacgctctgcgcgccggttgcctgaacatcggtctctgttcggcccagcaccggcagcagataattatgtttacccagtaacaggtgcgagcggttcagtttggtcgccatatgcaccaccagatcaagattgcgcatcgccgggaatgtgacctggggatcggaaatcgcttccgccaggttgccgcccagacaaagcaacgctttggctttgccgtcgcgcatcgcctttattgcctcaatggcgccgtgaccatgcttctgcggcgggcggaaaccaaacaccctctctatgccatccagcagcgactgcggcgggatctctgtgatgcccactgtgcgatcgccctgcacattggagtgaccgcgtaacggacaaatacctgcacccggcttgccgatattgccgcgcatcagcagcaggttagcgatttgctgcacgttctgagtgccgtactggtgctgggtaattcccatgccataacagatgatggtacgttcagcgctggcgtagagccgggcgatatgctggatttcctcacgcgccatgcccgagactttcaggatatgctcccagtctgtgctttccaggtcggctttcagggcgtcaaagccttcagtgtgctcagtaataaatgcttcatcaatgacgccgggtttcgcctttgctcagcgcctcctcgtgcatagtgagcaggatcttcatcacccctttcaacatcgctgcgtcaccgcccaccctgaccttgtagtaggtcgatgccagctcagtggagctcattgacagcatctcaatcgggctctgcggcgaagtaaagcgctccaggccacgttcacgcagcgggttgatcgccacaatagtggcaccgcgtttcgacacttcccgcagcgtgcccagcatgcgcggatggttggtacctggattgtgaccgatacaaagcaccaggtcgcagtgatcaaaatcttccagctctaccgtccctttgccgacgccaattgactccggcagcccgacactggtcggttcatggcacatatttgagcagtcggggaagttattagtgccatattcgcgggcgaaaagttgccacagaaacgccgcttcattggaggcgcgtcccgaggtataaaactctacgctgtccggatcgtcgtagctgcgcagatgctctccaatttcccggaacgccgtctcccattcgatgggctgataggtatccgtagcggcatcatacttcatcggatgggtcaggcggccttcgccctccagatgcagtgcgctgcgctcccacagttcagtcacggtatgagcggcgaaaaattccggtgtggtgcgcttactggtcgcttcccaggagacggcttttgcgccgttttcgcagaactcaaaagatgaggcatgttgcgggtccggccaggcgcagcccggacagtcaaagccctgtggctggttgactttaaacagggcgatcacatcctgcttcacagacatctggccgcggatagcatcggcaaccgccttcaatgcgccccagcctccggcggcacccccataaggagcgatgccatttgtgcgattttgctctttcataatgctccacattgtctctgttgttatttgttaagcctggtacagaaatagttgcaacaacgtggaaaccggctgttattcagggaaaatatttctcaaaatgtttcgactgcccgaaacgtaagccgcaaatcagttcagcacatcagatgaagcgcagcgcatccgggctgttgcagaataagcggcgcgcgagttccgccgacagggtgatggtgcagcgaaagggtgaaggataaatctttaccatcagataacggcgggtaagtgagccagtttattcagggctggacggcgatcgcagtaacgcactccatgtctgaacagatgcgccataatccggagagcaaccttatgaaaagagccttacttttgctggttttactttccacctatagtctgatgcccgttaaagccagtggcccggttcgggcaggagagctgcgtcccatgaagattattatgacgatcaaccatcagtcgtatgagattgcgctggctgataacgccaccgcgaaagcatttgtacagcaactcccgctgaccatgacgatggaggagctgaacggcaatgagaagtttgcagacctgcctgctgctcttaatagcgatccgcagaaacccggcacgatccagcagggcgatgtgatgctgtatggcaataagacgctggttcttttttacgagacattccagagctcctatagctacacgccaataggaaaggtgctgtcgacagatagcctcaaaaagcgtgtcggtgagggggggattaacgtacggttcacccggccatgactgatatcaaaaactgaaataaccggctggtaaaagattcatatcgcgctgagtctggccaaggtggcatctggcacgacggactacactgcgttctggccgcggccagacattgtgattctcttcggcaagcgagactgtcaggcaggtcggccagcctgacagttcagtcattacttcttcttattcagcatcgacttcaggtcagcaaagggattgtaggtagcctcgccgacatctttttgtgcgtcctcgccagccactacacgggtgccatactggtcagcctcggtgtactttgagtgttcgtggtcatgacaatagagacacaacaactcccagttactgccatcttccgggttgttggtgtggtcgtgatcgatatggtgaaccgtcagtttcgcgcaggtttgaataaacaaactcgcgtgagcagcgtccacacacccacggatagattttaagtgctttctcacggtagccgctttccagccgcgtgtagtttttagggatcaaagccattgccgggataacctgttatgcagagaaaatttcacgatagtgatgccaatatatcccataacggaacagaagaagaaatcatcgtgttccgagggacgggaggctttaaaatccagagggttagctgaaaatccgcgtagccgccttatatgatttttccagcacgtctcgcaatcctgaataactgccgggcctgtgagaaggcacaaaatcctgtcgctgtgatgaaaactcaaaaatgatatatctctaagctcccgctcacgctaacccaattaatcagcaggatagcacccaaaacatccctgtttaccgctttgcttaaaaaatgacatcaaatgtaatgcatgacaccataaacggcccagaaaatggcgttagcacccagataagtccagcatccccagtaggctatgggttcacgacgggtgcggagtttaggcaggaaggccagtaaatagagggcagaggcgataagcgaaacgaagtagaaaaatttcatggttttctcctgatcaatatcctttatttgagaatagtcagggctcaccattttgcttaatgcatcagcagattcgttatggatcggctttctctttgatgcccacatcggatgtcagcacagttaaatccgcgataaatcgaaaatgcagcgtcacggtacgatcagccagccttaagaaaagatcacgtcaggatgttcagcctgaggttacaccctataatcaacgctgtttgttagcctgcaggaatgcaggttttgcacccgcccaaaaggaagagatcccgctgatgttttctcgtttttttatttatcgtcccgttttcgcatgggttgttgccattttaatcatgctgcttggcgcgctctccattaccctgttgccggttgaacaatatcccgatgttgcgccgccttcggtgaatatcagcgcaacgtacaccggtgcttctgcagagacgctggagaaacagcgtcacgcaggtgatcgagcagcagcttaccgggctggataatctgctctattttacctccagcagcagttcacaggggaatgtgtcggttaccgtcaccttcagtcagggcaccgatccggacacggctcaggtgcaggtgcagaacaaggtgcagcaggcgctctcccgtctgcccagcgaagtgcagcagcttggtgttaccgtgaccaaatcgcagtcaaacttcctgctggtgatggggttgtatgacaccacgggcaaaagcaacagcacggatatcggtgactggctggtcagtaatatgcaggagccgctggccaggaccgaaggcgtcggtgacatccaggtgttcggcggtcagtacgcgatgcgcatctggctcgatcctttcaaactaaactcctttgcgttgcagccctccgatgtgtcggcggcgatacgctcgcagaacattcaggtttcagccggtaaaatcggcggcctgccatcgcctgataatcagcagctcaccgccacggtcagagcgcagtcgcgactgcagacgccgaatcagttccgaaacatcatcgttaaaagtgacaaaagcggtgccatcgtacgcgtgggtgatgtggcgcgggtggagctgggcggcgaatcctatgacatgaccacccgactcaacgggcatcctgcggcgggtgtcggtgtgatgctggcgccgggcgcgaatgcgctggccaccgcgacgctggtgaaaaacaaagttgaagagtatcgccactcaatgccggaaggttatgaggtggcttatgcgctcgacagcactgacttcatcaaaatctccgttgaggatgtggtgatcaccctgatcgaagcgattgcgctggtggtagtggtgatgtacctgttcctgcagaatatccgtgcgacgctgatcccggcgctggcggtgccggtggtactgctcggcacctttggcgtactggcgctgtgcggctacaccatcaataccctgacgctgtttgctatggtgctggccatcgggctgctggtggatgatgccatcgtggtcgtcgaaaacgtcgaacgcattatgcatgacgaaggtctgccggcgcgtgaggcaacggaaaagtcgatgaaagagatctccggcgcgctggtggctatcgcgctggtgctctccgcagtatttctgcctatggcctttttcgccgggtcgaccggtgtgatttaccggcagtttctccatcaccatcatcgccgccatgaccttctccgtggtggtggcactgaccctgacgcctgcactgtgtggcatgttgctgcggccgacctcaccccatcgtaaaggcttctttggcggttttaaccgcttttatgccgccaccgagcgccagtatcgtcacaaagtggtgagcactctgcgccgtccgctgatcatggtatcgctttatgcggcaatgggcgttgtgctgtttgtaatgtttacccgcttgccgggcagcttccttccgactgaagatcagggcagcatcatgcttcaggcaacattgccagcgggtgccacggccagccgcactgaggcagtcaatcagcagattgttgactggttcctgactgaagagaaacagaatattgatgtggtcttcaccatcaacggttttaacttcagcggtgctgcgcagaatgccggtatggcgtttatcaagcttaagaactgggatcagcgaccgggtagtgaaaactctgccgaagcgattgccgggcgcgccacctacgcgctggcgtcgattcgggacgcgcagatctttgcgctgacgccgccgtcggtgccgggtctgggacagaacaacggctttacctatgagctgctggccagcggtggcaccacgcgtgagcaactgggcaacctgcgcgatcagctgctacaaagcgcagcgcaaagtccggaactgctcggcgtgcgggccaatatcctgccgcaaacgccgcagttgcaggtcgatattgataccagcaaagcggtggcactgggactgcagctggatgacgttaccgatacgctgaccagcgcctggggcggtgcctatatcaatgacttcatcgaccggggtcgggtaaagcgggtctatgtgcagggcgacggtcagtatcgctcatcaccttcggatctggataaatggtacatccgtaacagtgaaggcaccatgacgcctttctcggcgtttgcctcgacccgatggaccatgggacccgaaagccttaaccgctacaacggctctgcctcctacgaaatacaggggcagaacgccgaagggttcagctccggcgatgctatgaacaccattgagcgactggccaatgaactcccggcagggaccacaggggcatggagcggtctttcgctgcaggagaagcaggcgggcgggcagtcaaccacgctgtatgcgatctcgattctggtggttttcctctgtcttgctgcgctgtatgagagctggtcggtgcctttctccgtgctgttagcggtgccgctcggcgtgctgggtaccgtgctggcggtggcactgcgcggattaagcaatgatatctacttccaggtggctttgctgaccacagttggactcacctccaaaaacgcgatactgatcatcgaatttgcggaggatgcggttcgtcggggaagttcgctgagtgcggctgcgttgcaggcagcgcgaacccgtctgcggccgattatgatgacgtcgctggcctttatcgccggggtgatcccgctggcggtggcgacgggcgccggtgctaacagccgcatcgccatcggcaccggtatcatcggcggtacgctggcaggcacggtactggcgctgttctttgttccgctcttctttgtgctggtgaagcactacctgacccgccatcgcaaaggccaataacgcagaaagcccgtctgcaggcggctgcagacgggctgggatcaatgattagcggaagattacaaatgctgtttaaagaaggcggtcagcttcgcaaacgggatcaggtcagtgcggtcataaaggtccacatggcctgcatcaggcacgatatagagctctttgggctgtgccgcacgctggaacgcatcttcgctgaactcgcgtgaatgcgctttatcacccgtgatgaagagcatcgggcgcggtgagatggtctcaatgtcattaaacggatagaagttcatgaatttcacgttgctggtgagcgtcgggtgcgtggtcagcgcagctgaactgtttttcggggtgaactcaccgcgaggcgtccggtaaaaatcatagaactctttggctatcggaggcgaatcagcatcgattttatgtggtgtaccactggtgtactcagttttacccccggtgaactctacatagcgttgctgtgccgccgcttcaatgatttgcttacgctgcgccagtgtctggcttttattcagcgcattacggttggctgaccccatgtcatacatgctgacggtagcaatggctttcatgcggggatcaatcttcgctgcgctgatgacaaaactgccactgccacagatgcccagcacaccaatcctgtcgcgatcgacaaattcgcgggtacccaggtaatccacggcggcgctgaagtcttcggcatagatatccggagagaccgcgttgcgcggctggccttcactttcgccccagaaagaaagatcaattgccagggtaacaaatccctgctcagccattttctgcgcatagaggctggcgctctgctctttgactgcgcccatcggatgacctaccacaatcgccggaaggcgcgccgttttaccggcctcttttggtctgtacagcgtgccggtcacacccatctgatactggtttttaaaggtgactttctcgcgggtgactttctcgctttgataaaagttatcggcgccgcgtgacatatcggcagcgctggccgcaagtgaactgatcaacagtccaaacatcagggttaatgctctcataagaagatccttatcggggttgacgacatgagggcaacgggttgcccggttaaacaacacatctgctatcaggcagcgctttccttacgggcggtgatcatcgccagtccggcggcagtgaccagtaatatggcgctgatggcaaaggtggtctgccagcctgcatggtcaaaggccaggccacccagcgtcgaccccaaagcaatcgacagctgtacgatggccaccattaatccgccaccggtctcggcattatccggaaaggttctggcgatccaggcccaccatccggttggtgccgctgttgccaccagtccccagatgccaagcagtggcgccaccagcaacaggtgatgaccgaacaccatgagcagcagcgcaaccagcgccataatcaacgggatgatcatcagggtcagatagaatccgcgctgcaaaacagcactgataatcagcgtgccgataaagccggcgacaccaatggtcagcagcaccagcgacagcgcagaaacgtcaacctgtgtcacggtttccagaaacgggcggagataggtaaacagggtgaactggcccataaagagcaggccgcaggcggtcatacccaccgtaaccagtggcgaacgcagcagctgcagaatttttcctctgcgctgccgggccgagttgaccggcatcgatggcagcgtgaacgcctgccagatcagggcgatcaaggctaccggcaccaggctgaaaaaagccccgcgccagccaatgacagaaccgagatagctgcccagcggtgcagcgataaccgtcgccagcgcattgccgccgttgaaaatggccagcgcgcgcggcacctgcccggtggggaccagccggatagcgaccgccgctgacatcgaccagaaaccgccaatcaccacgccaatcaatgcccggccagtcatgtaagtcagatagttgggtgccatcgccaccatcaatccggatagtgacattaccagcgtgagcgccagcaacagaattttgcggtcgaggttccctgcgatgcgggttattgagaggctggtgatcactgccagtgcgccggagatagcgatgccctgtccgaccagaccttcgctgaccgccagatcttgtgataacggcgataacaggctgaccggcatgaattcagaggcgatgagcgcgaatacacacagcgtcattgcccaaacaccaccccagtgtgcttctttatgccggggggaacagtcagttgtttccgtggaagtcatgttgtgtcctgtttcattgtttgcggtgctgatgaactcaggaaattttactgtttcgctttatattgactagctaatgaatccttaatggggttataaccagaacttataaatctatcggcgggagtgcagtatgaagcgcaacatgaacgacctgcaggcttttattaccgtggcgcgtgagggcagctttacccgcgcggcagcgctgctgggcgtgacgcagcccgcgttgagtcagaccattaccgcgctggaaaaccggatggagattcggctgcttacccgcacgacccgtaacgtttcaccgactgcggcgggtgaacggttaatccaggcgattggcaaccggttcgatgaaattgaggcggaactggatatgctgaccgcgatgcgggacaagccagccggcacggtacggatcacctgcgggccgcatattctgagctcactcctgatgccaaagctgacgccattgctggcggcttatcctgatatccggcttgagttcgatgctaatcatggcttacgcaatatcgtggccgatcgatttgatgcaggggtcaggatgggagacaccattgataaagacatggtggcgatgccgataagcccgccattacggatggctgcggtggccacgcccgactactttcgtcgtcatgttgcgccgcaggtttccgcaggatctgctgcatcacaactgcattaatatgcggcaggcgacagcgggtgggttgtacgtctgggagtttgacggtgaagaggggccgttaaatgtacgggtggatggacagctaacgttcaacacttcggcacacattgcagaagcggctctcgccgggctggggatcgctttcctgcctgagcaggaagtcgcagaagggctggagcagggcaccttgatccgcgtgctggagcgctggtgcgagccgtttcccggctattacctctactatcccagccgcaagcaacattcacccgcttttaccctggtcagagaggcattaaggctaaaagagggggcatgatgaacctgattggaatagatgccattccatggcgtaatacgtcctaaagcgctttattcagaattacttagaaggacggcgactaattttgcctcctttccgaccggcttccctggctttttcaggatcgtttttgaaattgcccccactggccttgcctcctgcactgccagcttcactcgcccgttctggatcgttggcaaaattgccggcaccacctctgtatttctgttgtgtcataggaagacctcatatcaatgttccattagataaaaaggactagctagtcacacctgcaagcatagtcgcccgcttcgtttatgcaaatgcatggaattaacttattgatatatataattttaattttcgcaggggatagtgtcggcagggccgtaggtgatgaactacgcttacagacctgacgaaaaaggagagtgctatgagtaatgcgaccttaatcgacacgcttgagctgggctctgacgagcagaagcagaaatatgaaatttacggcgatgatgcacagacgcccacttttgctgtgatctaccggcagcagggcgatagctggcagcagctggatgagaaaatcacgttcgccgcgcaggatgaacagcaggaagcgagggaatcaatgggctacggttccggcgacacgctgccagatttacgcgacctgcctgccgaagctcgggagcgctgcgaaacagcactggaaccagcagagtgacaggtaaacaggaatagcgccgctttgtttgttagcggtgaagtctcctgtttaagagagacgcctggaagcggcagaataaacctctgagcgctctcttttcccgacagccaccacaaaaaccaccacccggtcgtcaataacctggtatacaagtcgataaccggatgactttagcttgatcttatagcagtcaggcatcccgctgagtttgttcgcttcaattctgggtgactcaagacactcagccagcttctttttaagctgttcacgtactgtcgggcccagcttgcgccactctttcagtgccctctgatcgaactccagttgccaggtcattaaaggtcatccagtgtgacccggacaggctcagggtttcgcaggcgttctttaactatgtctactaacgccgcatcttcgtcactgagtaacgtttgcttaaagggaagacgttcattatctgcaatatattcaagcatcaggcgcagcgcatcagaaggagtcacacccattttttcgagcgcagcataggatcgtgtcttcaggtcatcatcgattcgaatgttaattgtgcccatagcgagttcctttgtatttacacttgacattacaattgtcgcactgatgagtctgtatcgcaaacagtaaacatcagtcacccgcacagccttatatcttcccggtaaaatcacgctaaagcttattttatgctacgaaaatataacatcttcatccattaaaccaactgcagcaatcgttaaaggttttcccgctactggcgataaccaacaggcgttgagcgcgccgatcattgatgaacccggcactccgcgacgagttctgaacgcgaacggacctgcttttagccctccttttatacacaccagaaagcgctgatttaagcgcaaattactcaaataaaagcgaaaataataatatgtcgatcattaagacgatcaaaagacacctgcctgttgcccgtcttaggcgtagcagtcagcctgccaatggcacctacgattgtcgtgcgttgccagattcactggcctccgtgggtttaagctcgcgggcgggcggcatcctgatgaccttcgttccgcctgaagccgattttcagcgggtcagtcaggcctggcagcgattcaattccgccgacctgacggtgttgacgctctcttccaacggcgcgctgagcagcagcagatcgcaaagcacctactgtgatggcaatggcccggagggaagctacctctggctgccggacacactgatcgcacgccatgagacgcatattgttgatctgcatgtcgccgacacgcagactgccagccagcgcatcaccgccatccagcaggagctggcgcgcttgcaggtgcggatgccgctctcggccgatcgtactttcgccatgatttactgtgacggattgtctgcatccgaaggctttctgatgcaggcctggtataacagcgggcgctttccctgcctggcgattggcggttctgccgggggtaaaatcacctttgatggcacctggattggtacaggtggcaaggtgttgcagggcaaggcggttattgtgttctgccagatggcgccaggaaaatcatttgctccttttaaaagccagaactttacgccacgcgatcagagctggctgattgctgaagccgatccgatagcgcgtactgtgacgtcagtatttaaccgtcaggggcagcagcagccgtttgttgcggcgctgtgtgaacatctcaactgcaacgaagcgcaactgagcgaaacggctgaagggactcactttcggcgttaaagttggcggcgagtactttattcgctcaatcgccaaaattgaatcgggcggcgtacactttttctgcgatcttgagtttggcgatcgactgttcctgatggaagagaaagactttaaacagacgacgcagcaggagtggcaggcatttaccgctcagcatggcaaacccgcggcgatcctgatgaacgactgtatcctgcgccgtgtcggtaatgccgataagctgcataatgcccatttcttcaaaggcattgccgccgccggtttttccagcttcggcgaaatcctgggtgtgcccatcaatcagacgctctccgcgctggtgttctttaatcatgacgtcaaagcgatgagccagttcccggtagagtacgccggctatgcggcacactacgcgcagcgagcgttgcgccgctgggaagcgctgaacagcatccacacgcgggtgctggatcgggttatcacttatcagcaggcgctgacgccgctgatggaggcgctgccggtgctggaaacagccactcagagccagggagaaaccctgagcctggcagagagcagtatccgtaacatcagtaacatcgccaccgagagtcagcaggcgcagggccggctggatgatggtctggacgatctggagaaaatttccaacggcatcaatgagattacgcatggcatcagcaatattgctttccagaccaatatcctggcgctgaatgccgcagtagaagcggctcgtgcaggcgaggctgggcggggatttgctgtggtcgcgggcgaagttcgtcgtctggcgcactcctcaaaagagcaggctgaagctacggccagtaacatcggtgaggcagtcagcaccatctcacgtatccggctggtggccagtgattcggcgcagaccgccgcccagatggcagagcgcagtatcagtgcagccgatacgctggcggccatgaatcaacagacgcgacatgagcgcgctgatattgcgaagcatcttggcagcctgcgtgaactgacgcaggggatggatgcaatgcaggaggccgtcgcgcagctcaaggtgttacaaactctttccggtgcgcaggttaaggcctgatttatcagcataaaagacaaaaaagtgcggtgtaagcgtaacgaccaggcagggcgggctttcagttgttacacttgtcggtgattaaccacgcagaggtatgaatgaaaattaaaagttatgcagccatgcaggctggccaggcccttgaactctatgagtacgatgccgccgaactggcagccgaagaagtcgaagtccaggtcgaatattgtggcgtctgccactcagatctgtcgatgatcgacaacgagtggggcatctctcagttcccggtgattgcaggacatgaagtgattggccgggtttcagccctgggcgaagcggctaagaacaaaggtctttcagtcggccagcgtgtaggaatcggctggacagcaaaaagctgtcagcactgcgatgcctgtattaacggcgagcaggttaactgtcagcagggcagcatcccgaccatcatgaacaaaggtggttttgccgagaagctgcgtgctgactggcaatgggttattccgctgccggaaaaactggatgtggcgagcgccggtccgctgctgtgtggcggtatcaccgtgtttaaaccgctgctgatgagcaacatcacggcaaccagccgtgtgggtgtgattggtatcggcggactgggccatatcgcaatcaagatcctgcacgcgatgggtgccgaagtggtggcattcagctcaacgccagataagaagcagtcgatcctggatatgggcgcggatgaagtggttaacagccgtgatccagaagctctgaaaaagcaggcaggccgttttgacctgatcctgagtactgtggcggtcgacctggactggaaaccttatttcgctgcgctggcacctcagggtaaattccacaccgtgggtgccgtgatgaagccgattgaagtgagtgcttttgatctgatcctgggcgataaagcggtgaccggttcatcaaccggctcaccaggccagctgcgttcgctgctgcgactcgcctcgcgtgcggatattgcgccacaggttgagttcttcccgatgtctgacatcaataaagcgctggatcacgtccgcgccggtaaagccaattatcgtgtggttctgaaagccgatttctgatgcgaatctgaaatgaaatgccgcagcctgctgcggcatttttttatcctcaatttgtcagcagtcccttagccagccctgcggcaatcacctcatcggctgtcacgctgaaccatttctctgtagcgcattccgcgttatcacggcgccatgcggcaaccatctggtagcccagcgtatagccataccatcggcgaaagtcacccgtgccgaagaaccaggcagaatgatcataatgaggactttgcagcgtggtcagcggcactggactagcctgtaattcgcttagctctatggctcgttcccagggctctgctgccgttttaagcagccagcagacgaactgacccgccagaccttcgctgaccagcgcttcacccagcgtccagccatatcccggcccgcgcattcgcaaacagtgatgaacttcatgcacgatatgccgcaccagcgtgccattttccagcatcccgggcagattcggatttgccgggtcaatggccaggccgaacagggtgggcccgtaagcccggcctgcaaaaccggtttcaggtattactgcctccggcatgcactgaaccagaatatccagacgagggacacgtgtcacggaggagaggtgctcgcaggcgagctcagcggccctgactattgccgatttatagggcccaacatcacccgatgcctccagccagtgcaatttccataagtcgttcacagactctcctgtcaaaggttgataatcagaacacaggtccgggacccgccagggctactaataccttaaccggcaatgctttaaacagacatcggcagagagcgttatcgttgtcggtaaagagttaaaagcaacttcgggaactcctgccattactgaacattcagggctgtttcgtcgcgacgccagcaccgataaataccctgccacaagaaaatagtgcagtttggcccgattccatcgaacactgtcctttgagcctgttacgcgcaggtaaacagtgccgtaaattaacctgatggtagccagtaagcctggctgatttcactgagactgtttacggagccaaaatgaagctgacccagattcgtaatgccaccctgctactggactatgcaggcaaaaaattcctgatcgacccgatgctggccgaaaaagaggcctggcccggatttgccggaaatgcccgtccccatctgagaaatccgatggttgagctgcctgtcccggtcgctgcactgctggcagtcgatgcggttattatcacccacacgcatatggatcactgggatgaggctgcgcagcagctagtgcagaagacgatgatgatctacagccaggatgaaacggatgcagcgctgattcgttcgcaggggtttgaaaatgttcgcgtgctgcaggatgagaatccgtttgttgatggcctgacaatctataaaaccgacggtcagcacggcagcaatgcgttatatgccgacaaagtgatgggcgatattctgggtgacgcctgtggcctggtctttacccatccggaagaaaaaaccctctatatagctggcgataccgtatgggtcaaaccctatgtcagagcgctgcaacgttttcagccgcaggtggtggtaatgaatatcggcaatgcaaccaacgatctctatgggccgattatcatgggaaaagaggatacccagcgcacgctgaatatcctgcctgacgcaacgctggttgcctcacacatggaggcgatcaaccactgtttgctgacgcgcgcagagctgcgagcctggactaccgaacagggtattgctgaccaggtgctgatcccggaagatggtgaaacaatgacgttctgagcgtcgtggcactaaaccggcacaattgtgccgtgagttctcaacactacgctttcacacaataagggggagaggatggctgctctgagggtcgcggtgctggcaacggccggttttagtccgtttcatttttcagttccctgtattctgttcggctcagccctgccgcagcaggatctgtttcatgttgatatctgcgcactggaaccaggcccggtcatctcagagatggggttgtcaattacggtggaacagggtcttgacccgcttgatcaggcggtcattattatcgtgccctactggcataatccggctgaaaaacctgcgcagacgctgcttgataagctggtggcagcctggcagcgcggcgcagagatcgttggactatgtctgggcacttacgtactggcttatgcaggcttgctcgataagcatcgtgctgccactcactgggaatttgagcgtgacttctgcgagcgctttccgcaggttcacctcgacagtaatgctctttatacccgggacactcgtctgatcacttctgccggcaccgcggcgggcatcgactgctgcctggatatcatccgtcaccactatggcagcgccatggctaatcgggtagccagacgcatggtggtgccgccttaccgtgaaggcggtcaggcgcagttcattgagcggccggttccggaaacaacgcgagacagtaagatcaacgcgttgctggcgtccctgcgacagaatctgcatcagccgcaggatcttgactcactttcgcggacgcttggcatgagcaggcgaacgctgacgcgtcattttcacaaggcgacaggcatgtccctgggagagtggctgacagcagagcgtctgcaacgcagccagctattactcgaaaccaccggcatcagcattgaatgtgtggcagaaaaggcgggttttgattcgcccgtgtcatttcgtcagcgttttaaatcccggtttggcgtctctcccagcgagtggcgccggacatttcgggggccgcatccggtgatgagtgatgagacattacgacaggacgatgagtgaccaggcccggatgaatttctgcgtctgtgactttgcctgccggaatattcccgcgtaatgacggtcactattccggcagaaataaatgcgactacagcaggaaatcatccagcgactggccgttttcaatggccgccttaattacggagggcgttcggccctgacccgtccagtaacgaacctgaccattttcgtcattgtaacggtatttcgccggacgctttgcgcgtttctttttgccggttaccgagggggatgcgctcttcaccagctccgccgggttaatcccttcttccattaacagctcctggtagaaaacgccagtttttctgctttctcacgcgcttccgctgctcgcgcgttttcctcttcacgacgttcatttaccacggtctctaatttctggcgcaactcttccagcatatccaaagccatattgcgcgcctctgcacgaagcgtgcggatattgttcaggctgctcaggttcttactcataacaaatcctcaaatactcaacttaatcaatgaagtgcaaattattcagctggcaagggtaacatttacccacgtgatatttgaagcgctagtgtagtcttattcgctattaatcctctattaatggtgctggttgaaccaataaagaagaaattttaagcggaatctgctggttaattgcggattatcattgttgaaacaggattgtgggatttgcatttttgcttttgattaactgtgcttaaatcagtcaacagggtttattaaggacaggcatgaagtttcgccggaaaaatgagggtccagcgccaaaaatctcgccgctgctaagaagtattatcctttcaggcgtattgctcagcgtggcggtgattggcttaaatgtgtggacgctgcgggaagactggaatgaaaccgtcgataaagctgaagatacggcggttaatctgtcgctgtcacaggcgcgccaggcggacgatacatttttgcagaccgagctctctttgcgcgaggtgcaacgcgagctcgaaaagcagattgccacaaccggtgtagatggcgaggcgctgagccagacgatgcgcctgttgcagagccacctgccacaactacacggcttgttctactatgatgcgcaggggaaatggatagcgacttctatgagccggataccgcctgacatcaataattccgatcgtgaatatttcgattatcaccgcaccagcccgcgcgataccctgcacgtcggcccggtgcttcgcagccgcaccactcacgagctggtgatcccggttacgctgcgtgtgaacgatgcctttaacggctttcggggcgtcttactcgccaccgtcaaagtggactatttccgccgtttctacagctattatgaacttagcgaaggcgatgtactggtactgatgctggcagacagtaccgtgctttacgcccgtccgatgccggatagctacatcggcaaaaacctctcagtaagtccgcttttcctcaggatgcttgcccatgcggataaaggcagcggtcagtggaccgctgcgcttgatggtaaaaaacgcatctttggctttgtccgctcacagcgatacccgctggtggtggccgcgggatatgacaagcgcgcgctgtttaaccactggctcaagagctgggtacatgatctgattctgagcctggcgctgctgattgttattcttttactgggtgcatttgtactgcgtcaggcacggcatacactgcgttatcagcttgagctgacccgattacgcgatgatctgaccgcggctaatcgcgcactggaaaatctggctcagagtgacgggctgacgggtgttgccaaccggcgccattttgatcacatcctgactgaatgcctgcagaaacgcggagcgcagtggccagccggtgtcattaatcctgctcgatatcgattattttaaacgtttcaacgatacctacggccatgtgtcgggtgacgactgtctgaaaaaagtggctactgttctgaagaacgccgcccgccgcaaaaacgaacttacggcccgatatggcggcgaagagtttgccatcattctgcccggacagccgttgtcagccgcgttgaacttcgctgaatcgatcatcgacgccgttaacaggctcgatattccgcatctcaccacggaactgccgcaaaagcacgtcaccctgagtgcaggctgcgccgtctatcttgcttcagactcacaacaggaaaaagaatcgctgatagcgcgcgcggatgaggctttgtatcacgcgaaacgggcagggcgtaaccaggccatgtgtgaagaacgtagcggctgagcatccgtgatcaaatcctgaatcctgcctgtggcatggtgactgctcaacttaaacagggagcggccatgtcaaacgataccggtttcactcatcttgctttacaggtacgggatttagagaagagcgtagatttttatcagcgttatgccgggatgcaggtgatacatcagcgtgaacctggcattcctgaagcacagaaagtggcgtggctgtcggatttaacccgaccttttgcgctggtgctggtgcaatctgacaacaatgaagatacgccgctgggtccatttggtcatataggcgtggcctgtagcagccgtgaagagatagatgaaaaagtggcactcgctcggctcgaaggtgtgttgcgacgcgacgtgcagcaatctggtgtgccagtcggctactgggcattttttgccgatcctgatggcaatacgcttgagctctcttatggtcagcagatcggactggaaattatcacagcccgcaacacgcaatcgctgaataaataaagcggttgagagaacagaatgaatcccattacttgttgcgtgactgcgtaaagcttttcagttattgagttcagggtaacgcctgagcaggattatggatggagagacaataacaagatgagaaaggaaagggtacaggctggccggtaattgagatgcttgagcctgacgatttatggcgaaaaaaccgcctgcctgatgcaggcggtgtttcattatgcatactggattaaatcaggaaatcatccagcgatttacctgcatcaatagcagatttaatagcagatggggtacggccctggccagtccactgcttaacctcaccattttcgtcggtgtactgatatttagccggacgaggagcgcgttttttcttcacggctggtgcagtcggcataccatttaacagtttcgttaggatcgataccttcctgcaacagtaattcacggtattttgccagtttctcagctttttcacgattagctgcttcagaagcctgtgcttcttcacgtcgctcactcaccacaaccgacagtttttccagcatttcttccagggcagcaaggtcaagctcgcgagcgtttgcgcgaagggtacggatattattcaagctgttgagagtgtcactcatcaaagtcaccatagtcatgttcagataataaaatacagagcgggttcacgctgatgcttttcgtcagacctgcttttttaagatgcttgccttcgaagaatcaaaatacagaaccgatagttcaacgccaacatattaatcgctttctcaaagagtttaaactgtaattaacgtaagacccttaaacaaaagtaaagttactcttttttttacactcttcgctcaaaatgtcaaaaaggtgcctcatctgatgatgcccaataatttagttacgttatggataaaccgggctttcacgccgcttttccagcggaatcgcttcgctaatcgcggacctgctttgttctgagaggcagtcaccgtgcatacttctccagataaggctggatatgtccatgaggccaccataatagggttgtaaaggacgcatagcaaaattactaaaaaataaccatcaggtggctgatttattcagacaatatgtaaggccatgaaatcagattaatttatcacttaaataacgttctggttaaggcgatcatcaccagacgggttatggctttgttttaaaagcctggagagacaaaccccagtaaagggggataaaacagtcagaatcacgcgtgacctgtatgaccctggattgattatttacgggtgtaatgactttttagccgccgtatggggccagagaggctgtccgctaatcaaggcaacctgagccacatcatccgggtaccatattgccttatgcgccgatgaagcggtaaacagtgcgttctcaattgccctcaatacttactcacaagcaagctaaactgtataagagacgctattgtcagcgttataaggggttatcaggagagactggcgtgttcaaaggcaataaaaagtcattaccggttcgctactgtaaaacgtgtaataaaccgatgtcatggcgaaaaaagtgggaacgatgctgggacgaggtgttgtattgctcggaaacggtgccggcggcagcgtactgatcggcaagaggatgatacagaaataaaacctgaacctgacctctgacaagactagagctggccagggattaacctggcctcagtcaggggaatggggctattgctgtacctcgatctgttgccagcctcttttaaacatacaatctttaaccagtatctctcgctggctttcattggcgtcgctggtggagtaatcggtgtcagtggttttatatttactgtcttttgaggtgtatttaccgctaacgacattgtcagggggtaaatcccgcagtgcctgggcccgacaggctgtttccgttattgtttcctgctgttcagatgcatctggcttgacccatttatactgcacacatccggtcagacagagagtaaataacatcagcataagaggtttcataatctgtttctcagtgctccccgcctgagttgagacgagtgattgagtaaggaaaccgatcggcagggtttcctcaccacaaaaaaagggaagagtcatccgacgttaaaatgtcaggccgccaccgatatagggaccatcgatcagggtatgacccggacgtccatctttgccatcaacacccgcatagcgatagcccacttttaaaaccagtggatccacaggtgaccagctgacaccgccattggcctcaacgaaattcttaacgctgttggtcagctgttccggggcggaataaccttctccatacaacgcaaaattagcgggcagattgattttcacaccgccgccaacaggaaacgcaacgccgttatctccttttttgccgccgatgtaagcggctttaacgccagccgtcagcatcaccggtccaatttcaaggttataaccggtacccgcctgaccaatctgaacaccatccgctgtatttttgatccactggccatcaacataaagcccgccggatgaacggccgatttctgcgtccagtactgaggtgtttttactttgttcggcattcaggccaatggccatggcagaggaggatgcacacaataataagccaaagccaattacagaaattttcattgctcagttttcccacagaatcagattttcaggataatgattaagagtgctattaaagcaggtttacttttgcacaatctctttaacatcgtgctgttgtaactgatgcatgtttccatccgtgtctttataagagatcatgcctgtttctttatcttttgcgggtttgccatgagtcgtaatcatgtgcccatcgttggtggagatcacataattgcttgagcaggcggaaagggacataacagaagttatcatcgcaatagcaaaagcgaatttcttgccagtattaaaagatgtcattttactttcctgtcgtttctttttaagaagatgcggcattattcgctgtgattgttaaacgacatgctaacaatccggctgtttgcctctttatcaggatgataatgatctggatcaatatcatgggttgctcaggagtatgcaaccatggcgggtattgattgttttgcgaccagtacttgcggaagcgaaggcagaaggttgtactgagagaatcaggaagaaaaccagcaaggtagaggaaaagaaacttaagctcgaatccgcaaaaatgaatctgaaagaagaacaggctaatgctcaaagactgaattaaactgatttactcgtaggctcacgctggcgaatctccgaacatcggtaaattccgcatatccctttatctcttgtcagtttgggtgggcatcaggctatcaccactctcctcttctttttatgcattttcagacagtatcaggcaacattcttacccttttaatgccagaaagggctgcattccgaatgggagccgttgtcgatacactgcatactcagcgttactgggtttctgttactatcatcgggaaccaggcataaaaaaaaccactcagttgagtggttgtaaaaagaaaaaaatagttaatgagcaaaactgcgatacataatgttttaatactgggatatatctatgccaggaaataatatccgttaacagacatgttagctatggaatttatatgaaatgatgcaaagtgaaagcgtaacaatgaccataatacagtgaatgttaaaagttcaccactcacgtaactgtttatctattaatttatttttttaacaacatggatttaactttgattgtttttctgatgcggatttatcgtgctcatcatgctcattacatttttaaaacacatggaggtaatcacttttcttaagatcccgttaagatctgcatcgtaaattagcccgacaattttaacggagataaatttgaaaaagattcttttagcagcattgtttgccggtatgagttttggagtttctgcacaggaaggttttgttaatccagcagggcaggggtattctcagggcggatttaaaggtccgacacccggcgtctcttctgtcgctcaggttaagacgctgcgtgatgacgcatgggtcgttctggaaggtaacatcatcagacaagtcgggcatgaactttatgagttcaaagatgctaccggaacgattaatgtcgatattgatgacaagcgctggatgggacaatcgttatcaccgagtgataaagtccgtcttgaaggtgaagttgataaagactggaacagtgttgagattgatgtaaaaacggttcgggttcttaagtaatccttattcgctcatcacctggcggtggcctgaaaatcagggcactgccattgtgaaaatgatccttccaggacgcctttctttcattacagcggccgccaattagttacaacaccctatttgagcagattacgttaccggcgctatcctggcagattggtttttttgattaaacctgaacggagccgttctgttaatccgagtgctcattgaccagccgccccgcacggcccgaagggccgtaatagttatttacggcatattgaatgatgtaactaaatggaagctctctgctagagtgcttctccacatccgcctttaactgttgaacccgcgcctggaagaacccccatttaatgcgctgttgacctgctgttgaccctgacggcagttttcttctgcctgcccgatgccagatcaaaaaccgaaacgagtatcatttatagaatgagtgcttcttacttttaggcagggcgtgatatggcaatgaatatgggcagtacctaccgaatccttggctatcagccatcggtaaattccgccttgcgccagaaattactgacaatgggcatgcttcccggcgcagttattgaggtcattcgcgtggcgccaatgggcgatccggtgcagatctctacccgccgtgtcagcctggcggtgcggcagcgtgacctggatgacatcatcctggaggaaatcgtctgatgaagaagataaccatcgggctgattggtaaccctaataccggcaaaaccacgctgtttaaccagctcaccggtgcccgacagcgggtcgggaactgggctggcgtcacggttgagcgcaaagagggtcaattttttaccgcgcagtcagatgtcaggcttattgatctgccaggcacccgatcgctgacaacgctatctgctgaaagctcgatagatgagagcatcgcctgccagtatctctatcaggatcacgccgatgtggtgattaacgtcgtcgatgcctccagtctggaaagtaatctgttcctgacctttcagctgctggaactgggcgtaccctgcattgtcgccctgaacatgcaggatattgccgccagccagaacatcactattgatgtcgcagcactgtcagctcatctgggatgtccggtcatttcactgacctcaaccaaaggtgatggcattgcccagctcaaagcgctgattgaccagccccatatttaccgcgcacctgaacgggtacgttatccggccgcgattgaaacggccattgagaagctctgccaacagatgcccgccgccatagccccacaaaaacgctactggctggccttgcaactgctggaaggggatatcaacagtcagaaactttgtccggcgctggttccgcatttgcccgagattatgcagcaggccggtggagagaccggtgtacagattgccgattaccgctatcgcaccatcaatgcactttgcgcggcagtgagtaacattcatcacgcaatgcccgccggtctgacccgcaggatcgataaaattgtgctgaaccgctggctgggcattccgatattcctggcagtgatgtatgtgatgtttgttctttcaattaacattggtgccgcgctacagccattgttcgacagcagtttcggtggcgatattcattcatggtgcgcaatggctgggctatgtctgccacttccctgactggctgacggttttcctggcgcagggtatcggtgccggtatcaataccgtgctgccgatcattccgcagattggcctgatgttcctgttcctcgctttccttgaagactccggctacatggcgcgcgccgcttttgtgatggatcgtctgatgcagtcactgggcctgccgggaaaatcctttgtgccgctgattgtcggctttggctgtaatgtcccgtcggtcatggggacacggacgctggatacaccgcgtgagcgtctgctgacggtgttgattgcgccttttatgtcatgtggcgcacggctggcgatttttgcggttttcgctgcggcattctttaacacccacagttccagcctggttttctccctctatctgctgggcattgtggtggccatcgcgaccgggctggtgcttaagcataccctgctgggcggagaagcctcgccgtttatcatggaattgccggtctatcaccggcctcacctcaaaagcctgctgttgcagacctggcaacggctgaaaatgtttgtggtgcgagccggacaggtgattatcctggtgagcatgctgattggcgtactgagcagttttgcctttaatggccagatggttaatgacattaaccactctgcgctggcggcgaccagcaaagcgatcacgcccgtgctgttgccgattggtgtcactcaggataactggcaggcaacagtggggctggtgagcggcatcatggcgaaagaggtcgtggtcggcacgctcaacagcctttacaccacagaggcaatccagagcagtccatttgatccgcaggcttttgacctgcctggtgagcttaaagaggcgctgacagagacctgggcggggttaacggctgccttcagaattgatgcgctggcccatcccatcgatgccagtaaaggcgatggtgagatggcgactggttcgatgggcgtgatgtcagccaaatttggcagtggctttgccgcttacagttacttaatttttgtcctgctttatgttccctgcgtctcggtcatgggggctattgcgcgggaagccggtaaaaaatggatgatgttctccttcttctggggactcaatattgcctacgccaccgccacgctgttttaccagaccgtcacttttgccgaccatcctgcatttagtgcgacctgcctgataattgtgctggtgctgaacggaatcatcctgctggcattgcgaaaagcgggaagccgggtgcagtcaataccggtcatgctcagggaggaaaaggggagttgcagcggctgccacggcggctgtgataagcagaaaggctttgcccggtaaaaataagtactgatgacattcactctttccgctgccggcgattcctggccgcagcggacaggtgaggattgtcctgttgattgttcttacgaatttgaagccagaatggtgggatgattagcgtatgagcagtgacaaaggctgcatgacaattaacccggccagaagcattatcctgcccgttgaaggcagatgtttaccaaagcagatctgaccatgcactgcagcatgcccttattatggatagcggctcctgttttgcagacagatttgcagcatgcggtatgacagtaagaataaatcaactaaatcagccggatgagctctgtggatggccaacacagtgataatccgtaccggcttacacacaggctgtccactttttctgtggataacttcagcctgaataagggctttattctcttttcaggaggccatcagtcaggataatcagggtcaccgtattgttccataaactccaccatggcacctttgtgtgcatccacatggcggatatagcgcatcagtgtttctggttttttccacgtgccttcttgcatgatcctggcaatcggatagcctttatctgccatatcctgcgcagctcctaccctggcgctgtggccactccagccggtgtagcgatttttgttggccttcactgcgccctcttttccggcagtacgccatgcacggctaaatatctgttccagtgcccttgtgctcatcggcttttcgccaatcagtggccggccagaccgatgtactgcagtaaacagccaggcatcaggctggctggatagccctgacgcttcaatccactcttccagtcgctgagttgaacgggcgctgagcgccttaatcaatccgccggtctgcacaatagtttttgtccatgccacatccagaatgatgcgaccatcgccggcacgcatcacatcccgcacccgcaaacgcgacagtttcactgatacgcagtagcgttgcataagccacatgtaaaaaagccagatcgcgaagcgcctgaaggttatcagaacctgaccattcttcatccagcgccagcagatcagtcagcctgaagggcacggcctggcctgcccgctctccgttgatcaccgccacacgatttatcttcttcatcgtacggaaaaccagcggagagacattgggcaccggcagcccggcgttacggtgtaacatcgaaattaacgccgcgtgtgaagtgacggttgaggaggcccggccgctttcagccagaaaagagagatagtcacgcaaatcgtctgcgctcatcggcaggaagctgcgctggttatcttccgaccagcgattgcagattcgcattacgctaagcagctgtcgccaggtgttaggtgagaaagcctctttatcctgaacgaaactgccggagccgctcggtgatatcgctattccggtcaaccgtcagaggggttaacggcactaactcactcatatttgctcacttatcaaccaaagacgccggtgatcgcgctacgttaattctgagaactaagcagggggataaccggtcagaatttacgtagcgttgtcattttcagggcgaactttactgctatccatcttaacccggcaccatcccaatgtcatgacttcgtataagaacaattatacgaagttagtatggcgtaaccgatcccgtctggcttttaacggattgacgctcatcgcagtcagtcagggtaggtataggtcacacgctttatcgatagctgaacgtaactcactgcgagttgttcaagtgaaaccacgatgcaaaaaaaatgtctcaaactaaggcgcgtttaaaccagggtatgaacggtttaatcattatttaattaaatcagcgcatcacgatgctttattttcccagcgcaataatgagcaggagcatcaaaatagagatgttgaaaaatggcagacgactttaattagttagtcagttaaattaataactcataaaaaggttccatataacactgctcaaaggaaatatccttttaaaatttttatagagtacataaattaaacacaacttcccgatattacgttcatagttctgaacaggcgacatgtcatttacgctaccacaagagatccaggcattaaccctcagaacaaaaaactaaataacagcttatcgccgatttaaataccagacagcacttcctttcatctatcttgttcccctgcatatcaaaagcgtcgataagtatatgcatcagctttttaatcgaataaagcggctaatgtatttatcgcagcagtattattctggctcatcagccggattaagacgtattaacgagttatacacattttatggcggcgtctggaagaacgcacagaaacgctggcttcacccagggtaaatatgaggatattttcatgaaaaaaacgttattatcgctgtgtcttttaggtctttcctgcgccccagttgttacgcaggcacaacagtcagtgacctgtgtcagagcctcagagcaggatgtggccaacctgtttgacgcctggaatgactctctggcaaccggtgatgcaaccaaagtctctgaattatatgtcagcgatgccgttttgctgccgaccatttcaaatcaggtacgtctgaccgatcaggaacgtatcgattattttaaagatttcctgaaaaaagggccgagcggtaaaattgattcccggactatcagaattggttgtaataaagcgattgataccggcgtttatacatttacttttaaagataacacgcacgtcacagcacgttacaccttcacttatgtctgggatggtaagggctggaaaatctcaacccatcactcttcagctatgccagagcctgtaagcaagccttaacagacgcgctgatgaaaaaagagccagcgtcatgatgtgatgctggctcttttccctttacgcgaaaataaattttcgggcttgaatataataatgtctgactcatacttaataaatggcaattaatattcttcgcatttagcgtgtctgtttcctgtatcacggacagtataagtgctattaaatgaccagcgtcagtttcccatccgaataaaatgaaatctgtcggtttggtgcttccattgcaggctgatcaattcccaaacgtaaatatctgcccatgaaacagcggttttatacgccatttccattgcctatctgccagataaaggtcggatcggtgccgttcacctcccagtctcccacgttacgtagcttgtagatcaccggattgtgcgacgacaccgttcgtgcattacgccagtgccggtcgagtgccttgctgactcgggtatcagatgcacccagcgcattgaagaattctgttgccgcacgcgtcaccagctcaacggccaccgcctgtgcctgagcggactctacttcggccagcacgtttgccgcatgaagctgtgcctcatctgcgccactaagttgcagctcaaatgcccgctgcaacgagtgggtcgcccggtcgacggcggcttcggctgcccatgcccagctgcttatctgaccgaccacctgcaacacctgcacatcctgcttcacctgcgaagcattaccatgactgtaaatgcgtttacgctgcgccacaccccgagcagcatcgcgcaccaccgcccgcccgatgcccgccagcgtggccagtaagacatgctgatagaatgccgtctgatagcggaaacgctcactgaaatcatagacatggggcagttcaacccgggcctgatgaaagcgcgtcgtaccactgccggtcagtcgctgcccgaagccatcccagtcatcatcgcgctccacctcattctggtgggtgttcaccagtgcaatcacgtcacgaccgttatctgcgcgctgagcatagacatcaatccagtctgcatagagcgtgccggtgctgtagaacttctcaccgctgatccgccatcccccctcatcgggagaaacctgagtgttgacctcacccagcttaaccgcgccgatctcgctccagccgctgcccaccagctcaccgtccacaaagcggcggaaccagcgacgccgatcctcactggctggctggttcaggcgatcctcaataaatgcgaagtgcgcacgcagcgcctgtggcaggttcgaatctgcctcagccagttcggtcagcagagcaaatagctgcggcagcgaaaccccaaagccgccttcttctttagggatacgcagggtgccgaagcgcgccgctttcagccagcgaatcggttcatgcaacagtgtgcgttcggtttcacgggcacttgccccctcagcgatgcgggcgaacagcggcctgaaatgctgaaccagttcggcaaattcggtacgatttaattcagacatgatcctctcctgagtcgggttgttcatcgatgtcctgtcgggtcggttcaaaacgaatgattaacaggaaaataatcgggataagggcggccagcgagacaatccagaacatattggtgccgtaacgcgcctgcaaaattggcagaataaacagcgccagcgcgctgcccacaccggagagcgaacgactaaagccgacaccggtggcgcgtatgtgggtcgggtaggagagcgccggatagatcatcaactgcgcgccgggtccgaatccctctgcaaagagccacaaacccagcatcagcaccgcaaacaccacgccagctgtcgcctggggatgaccaatcaatgccagcgaaatcagcgcgataaactgcagcgcaaatccggcgattgcgacatgccgtgagggaaatttccacgccagtcgcatccccaacagcccgccggtaaaggcgaacaacgcattcagtcccagcgaggcagagatagtttcaaatacgcccgcgccgagaaattgcgccaggatagagggcaggaagaaagcgatggcggtgtattcaaatgaaatacagacgttcatcaccgcactgacgaccgtgcgctccagataaggcttctgaaacagtacgcggaaacgcactttcggcttcgctttcaccgcatcggttttagcgggcggctcctcatgcgcaacaatgccgtaagagtcacgcagaatacgcaccgcaccgctcaggtcgccctgattcgccgcccacagcggtgactcattcataaacttactgcgcaccgcaataatcagtagcgccggtacggcgccaaacagcagcgaggcgcgccacagccagtcgatatgttcggcgggcagcaggaaatagagtgcaaaaataataaagaagcaggcagacgaagcggcataccacatcgggcaccaggctgcgaggcgcgatgctttattgcccttgccggagaacttagagaattctgccagataggccatggcaaccggcagatcgatcccgacgccgatgcccatcagaaaacgggcaccaatcaacacccagacgttgggggccagacctgccgcaatggcggagacgacaaaaaacaacatgtccgccataaacactgagtaacggccatatttatcggtcagccagccgccgaccagattacccacaatggtgccgatcatgattgacgacgtcaccaggcccgtgagtaccggggttaaaccaaactccttcaccacatcatcaatgccgtaggagagggtagtgagatcgtaggcatcaagaaacacgccgcccagcgccaggaaaacaatccagcgcgcatagctgtttttctcggtgttactgttgatcagccgggccacatcactcaccgatcgaaccggttgagagtgaggcggtggagcagttaaggtgttgtcaatttctaatgtactcatcgtatcctcgttattatattcagcaggtaacgagggttttatatgaattactggcatagttaacaaccaacaaaatcagataactattataattaattcaataagataggattatatttcacccacgccagaccccgcatgaaatattaaaattcatccggtagtgttcagcgaaatgttgttttttatactgctgaaacggttgaagtttcagcagtatatggcagacctgtttagcaacggttaacagcaatgaccggtccggtaatgcctgtccattaaccggcgacaagacgtactcttgtctccttgcaccttgctatgcgccggttattcatgccgggcagccagccgtctctgttatgaaacttccaccctggctgctcgctgttccacatccgcactccggcgataaccggcacccggatgcggcgacgccagccgcggcccctggccaaataacttttcacgcagcgtaccgggctgatactcctgcttgtagacgccacgcttttgcagtttccggcaccagcagttccaccacgtcagtaaaggtttcgtgcgttacggcgtaggcaaggttaaaaccatcgacgtctgtctcttcgacccagctttgcagctcatcggccaccgtttcggcgctgcccaccagcagcggaccaaatccgccaatgcccacccagtctgccaggccctgcaccgtccattggcggttgggatcggcagtggagaatgtctcaaccgccgactgaatcgcattggtgtgcagatgtttcagtacctgatccggctgatactgcccgaaatcaatgccggtccagcctgagatcagcgccagcgcgccttcgtaactgacatagcgtttgtactcctgccatttggcctgcgccgccaggtcggtttcacccacaatgactgtctgcaggttgaagatcagtatggagcggggatcgcgtcccgcttcagcggctctccggcgaatatccgtcacggttttcttcagcagaactttcgaaggtgccgccacgaacacgcattcggcatgctccgccgcaaacgctttaccgcggctggaggcgcccgcctgatatagtaccggcgtgcgctgcggcgaaggttcacacagatggatgccgggcacctggaagaatttaccctgatgatttatcggatggattttattcgggtcgctgaaaatatgacgttcacgatcgcgcaggaccgcgccatcttcccagcttccctccagcagcttatagataacctgcagatattcatcggcatagtcgtagcgcgcatcgtgatcggtctgggcctgatgtccgatattacgcgcaccgctttccagataggaggttacaatattccagccaatgcggcctttggtcagatgatccagcgtcgagatccgccgcgcaaacgggtaggggtgttcaaacgacagtgaggcggtcaggccaaagcccagatgttccgtcaccagcgccatcggcgtgattaacgccagcggatcgtttaccggcacctgcgtggcgtgccgaatcgcggcctggttattaccgttgagcacgtcgtagacaccaagcacgtcagcaataaacagtccatcaaacctgccgcgctccagcaggcgtgctaagtcggtccagtactccagatctttgtactgccaggaacgatcccggggatgcgcccataagccgggcgattgatgaccgacacagttcatatcgaaagcattcaggcgaatttcacgttgcgatgacatagcgactcctgggcggatgcggcaatcgcttgccgcccaccttttagtgattgttccggaagggtgattcagtagatgagtgagccgggacatcgctcgctgatgggcagcggcgtggtggagagtagctgccgtgctacggactcagcgtgttctgcaacctgcggtaatcccatgagttcgccaaagcgaccacgcgcggcaggcccggccacatagagatgaggattagcatcaccctgcgcattcagtgtctgtgacagcgcgttaacctgaatgcccagcgccagcgggtcgggctgaatcacgccgtcgccgtggagctggcgcagcagcgcgttgcttttaagcagtgcgttgtgcgctggcccggtggtgacaatcactttatccaccccccggatttctgattgcgctccacgccggcgcagcgtcagctgaagattgtttcccatcgcttccgcgcccatcagccgcgccgccagcagtgacaactgaccgctcgcctgctgctggttgagaatctgacttacctgcggggcaatccggtagcggtgaacatcccaccaggggcgaagatggtgcagaaaacgctgctgctcatgcagtgaaaggctctgccagatacgctggccgttacggcggatatcatccagcaccagctgccaggggagatttaacgcggctgcctgttttacctcctgacgcacccgatgtaaccagccacgtgcgctggcgggctgcggctgactgtaatccagggtgtagctctcatcgctgccgctcaggttggctcgcggcagctgtccacggcgtgagaaggcggtaatctctccgcgatgctgctggcgatgcagcgatgccaccacatcggacatggtcagccctgaaccgataatcgctacccgatcgtcaggtgcgacctgtgccagcgcgccattctgccagggattggcaatcaaccccggatgcccctgtaagggcttcagcagcgcaggcaggtccggcggtggatggctgatggccagcaccacctgatcggcccggatcttctgccttgaggctgtggtgactacgccatcctgcagcgcaactgcgctgtcacgcagatgactaagttttaccggcgaatgctgctgctgatgcacaaactgcgcattgacccagcgactaaactccccgcgttgcgggtagacattgccgtcacgccacaacgcgtccgggtcggcctgaaaggcgggcgatgcgcgatagtcgcggtcaaatatgccctcctcatccccagcgagctgcattctggcggctggcacattgatgcggtgggccggatcggtggtgccgtatgccacaccctgagcaagctgcgctcgtggttcaatcaccgtcacgtgcaaccctgcctggccagcccgggccagatgaatcgccagcgcggtgccggtaaaaccaccgccgataatgactatctgctgctgtgacataagcgaaccttctcttctgttaactggcgctggcctgtttatcaggacgacggtcgccgccaatggtttcaccaaaaggaccggtgttcacgctgcgctgtttcttttcggcgttggcagccagcggtaacagcggcatcaccagttcagcgaagcggtgcgcctcttcaaggtgcggatagccggagaaaataaagttctcgatccccagcgcctgatactcccggatgcgatcggctacctgctgcggactccccaccagcgcagtacctgcgccgccccgcaccaggccgacgcctgcccagagattgggaccaatgcgcaggctgtctcgcgagccctgatgcagcgcgctcatccgcgcctgtccggctgagtccatgcgggcaaagatcttctgcgcggcggcaatagtctcttcatccagatgagaaatcagccgatcggccgccgcccaggcttcctcttcggtttcacggacaatgacatgcagccggatgccgtaggagaggctacggccactctcctgcgcccgctgacgaaccaccgccagtttttccgctacctgttcaaccggctcgccccacgtcagataagtgtcgatctgattcgccgcaacgtcgatagcggcatcagacgagccaccaaaatagagtggtgggccattttcctgcaccggcgggaagaggatttcagcgccttccacgcggatatgatcacccgaaaaatcgaccttctcgcctttcagcaggcgggagtagacctcaagaaactctctggtcacctgatagcgctcttcatgactcagaaagatgccgtcacctttgttctccaccggatcgccgcccgtgaccacgttaatcagtaaacgtccgccagaaagccgatccagcgtagccgccatacgcgccgccaggcttggcggttggaggccaggacgtacggccactaaatagcgcagctttttggtgatcggagccagtgcagaggcgaccagccaggaatcctcgcagctcttaccggtcgggattaatacaccgtagtagcccagattatctgccgccagcgcaacctgctgtaaatagggtaaatcgactgctctgccgccttcggtggtgccaagatagcgcccatcgccatgggtgggcagaaaccagaagaggttgaggttttcctgtgtcgcatgactcattagcagattcctttataacgatatttgaatttaatacataggcataaattctttagttatatagctgttagcaggatgcgtgccagtctgctacttaatatttatctcattaattcaacgatatattcataatttcgcttgatgcatattgctgcatttgcgacaggtaaagttacagcctgctgcattggcaacaatccggtccggttagcctctcgtttccgcgttagccacgcggtatggtcatggctttcctgttaacccggtaaatgagatgcagattaccagccctgagttgattgaccccgcatcgcgcgcctttaaaagcgtgctggatcagcttgcgcctaccgacgcgacggtgctgatcattggtgaaaccggcaccggcaaagaggtgatggcgcgctatctgcatcatcacagcgcccgcagcagacagccatttctggcggtcaactgtggtgccctcactgagagtctggcggagtcggagctctttggtcatgagaaaggggcatttaccggcgcacaggatcggcatcgcggctggtttgaggcggcagagggcgggacgctgctgctggatgaagtcggtgaactgagcgcatcgctgcaggtgaagctgctgcgcgtgctgcaggaacgcgagattacccgtgtgggttcctcccgggctgtaaaggtcaatgtgcgggtcattgcggccaccaaccgcgacctggcggtggcgattcgtgaacggcgcttccgggaagacctttactaccggctgaatgtggccagcgtcacgctgccgccgctgcgccagcgatgcgaagatatcccggtgctggccactcacttcctgcagctctatgcgcgccgtctgggccgacctcagttacgtctcagtgaagatgctgtcgccacgctgatgaactacagctggccgggcaacatccgcgagctggagaacaccctgcataatgccgtcctgctcagcaaaacctcgctggtcacgccgcagcagctgcggctgaataatctgacgggtagcgagctgccaccgggagaggaggcgctggatcagtttttacggcagcagatgcagcagagcgaaacaccgctctatccccgggtgattgaggcgctgataaagaatgcgctggaactcactcagggcaatcaactgcaggccgccgcgctgcttggcatcagtcgtcatacgctgcgcacccaactgggccatctgggggtgattaaaccgcgccgcacttcactgcgtcagcgcgacacttctctgaatcagcagcccgaacgggagcgggaactgcgcatcggttatcagaaatttggcaacctcggcatcctgaaagcgcgccagtcactggaacagcagttggccgatagaggcgtcagcgtgctgtggagtgagtttcctgcgggtccgcagcttctgcatgcgctgagccaacaggagatcgatttcggcacgaccggtgaagttccccccttgtttgctcaggccagcaacagcccgatggtttatgtcgcctgggaacccgccgcgccgcagagcgtggcactgctggtaccgaacagcagcccggttcagcagattggcgatctcagaggaaaacgcatcgccgtgaatcgtggttccaacgttcactatctgctgctgcagattctggatgaagcgggtttagggctggatgatgtgcgcatcgtctatgcaccgcccaaatatccgctgacgcccagcgatctcaacgcagtggatgcctggatgatgtgggatccgctgctcagcgatgcagagaacagcggacagttcagggtgatcgctgatggcaccggccgggtcaataatcatcagttttaccttgccgaacgcgggttcgccgcgcagtcgggcgatctgctgcaggttctgctcaccgcgctggagcagactggccgctacatcgatgcacaccgtgctgaagccgctgcgttgctctccaccgaactcgggatatcagcgccttcactgatgcatgccttagcgcggcgcagccaccagacccagcgcatgaacttggccatcatccgggaacagcagaccatcgctgaccgcttctatgcactggggctattgagtcgcgccattcgggtacgtgagtcggtctggcatccatagcgtttttttcgctaagcatcgaacatttgatcgctaagcgcttcaacccgcgtttgttatgttgcgctgacaacaaccagactcaggaatgagagatgaaaagagttttgcttagcgcattgattattgccgcccaggcgggattagcgttcaacacccaggcagcagcagagaaacccgaaacagttaacattggttttcagaaagccaatatcttcgccctgctgaaatatcgcggcacgctggatcaggaatttaagaaacaggggattgcggttcactggattgagttcccggccgggccgcagatgctggaaggcctgaacatcggcagtatcgatctggccgcaaccggcgacgcgccaccgacttttgctcaggccgcccaggccgatctggtttatctggcacattctcccgccaaccccaaaactgaggcgattgtggtgcccgccgactcccccattaaaagcgtggcggatctcaaaggcaaacgcgtggcgctgaataaaggctctgacgttaactatctgctggtcactgcgctggaacaggcggggctgagctataaagacattacaccggtctatctgccacccgcggatgcgcgtgccgctttccagcgcggtgcagtggatgcctgggtaatctgggatccttactacgcagaagttgaaaccaacgcccacgcgcggctgattaaaaatgccgaaggcctggtgccacactacaccttctatcttgccagccgtaagtttgcggaaacctggccgcaaatcgccagccaggtggtggatgagcttgggtcgctaagtacctgggccaatcaacatcaggaagaggcggcaaaaatcatgtccacctcaaccggtctgccgcagccgatctggcaacgggcgctggcaaggatgccgttcggggctgagcggatgacacctgaagtcttcacgcagcagcaggctctggccgataagtttacccagattggtctgttaccagtgaaggtcgatatccgcagtgcaacctggtcgctggataagcagtaaggtagggccaggcggagtgtgttatgacaaactctgcctgtttccgtgtgttcatccggcattattgacagccatgaaaagagaaatcgggggctcgataatctctatcaggcaggaaaagtagtgcgctgtttaaggtgctgatgcctggataaacagaggatctaaatgaggatttaacgaagcggcgccgatatttcaaagagttacagcatgtttgtttcacccgaccgcttcataaactgttctacactcacatattccatcaagcagtttgatggaaaaagcagcatcacgatgagggtcgcgacagcaaaaagtcatgcagtcgccgccatcaaaactgatcatgcatgagaggagaacaccatgaaagcagttgtctataacggaccttttgacgtttcagtcaaagacgttccggatcccaaaatcgttcgtcccaccgatgttattgtccgtattaccaccaccaatatctgcggttccgacctgcatatgtacgaagggcgaaccagcttcgagcaggggcgcatctttggccatgagaatctgggacaggttattgaaatcggcagcggagttgagcgaattaaagtcggtgactatgtctgcctgccctttaatgtcggctgcggattctgcgaaaattgcgagaaaggattaaccggttactgtctgacggcaaatccgggtacggccggtgccgcctatggctttgcggagatgggtgaatgggagggtggacaggctgagttacttcgcgttccctttgctgattttaactgtctggtactgcctccggatgcgtcagaaaaggaggaagactacgttatgctttcggacattttccctaccggctggcatgccactgaactggcaggattacgcccgggagagagtgttgccatttacggcgctggccctgtcggcttaatggcagcgcattcggcgatgattaaaggcgcatcgcaggtgtttgtggtcgatacccatccagacagactggcattagccgaacaaatgggcgctgtggcaatcaatggtgtgggtgatgatgcggtaaataaaatccttgaattaaccaatggccgcggcacggattgtggttgcgaatgcgtaggttatcaatgctgcaataaacatggccacgaggataactccgccacactaaatagccttgtcgcttcaaccaaagccacgggcggcattggtacggtaggcgtttttgttccacaggatcccggaggagcaaccgatctggctaaagaaggtaaagtgcctttcgattttggtactttctggtttaaaggtcagtcaatgaagaccggccagtgtaatgtgaaagcctataaccgtcagctcgcaaggcttatccatcagggcagagccaatccggcacagattatctcgcatcgtcttgcactggcagatgctcccgaaggctataagcatttcgatgatcgtgataatggctggacaaaagtcatcctgaagccctgaatggtgagccacaggacataaaccacattcaggccgtggtgagaaggagaactaaaagcctgtctgtggtttggtgcttttcatcgtttgtcatgctgctcttgggaaagaggagaggtgaaagcggcagggggttgcgaaaattgtactcaacagtttttactgttaacagaattagcgtttacttttttttgaagcgagtaagtgtttacactaacgaattctgtaaatgggaaatgactggttaactggtctccaccctgataatattaaaacctgttaagcagtcctggaggccctatgccaaacatgattttaagcgatatcagtgccagcgtaagcgaactgaaaaaaaatccaatggctactgttaatgccggggacggttatccggtcgccattctcaaccgcaaccagcctgcattctattgcgtgccagctgagctttatgagcagatgcttgatgcccttgacgatcaggaaactggttaagctggtcagtgagcgcagcggccagcgtctgcttgatgtcgatttggatgcgcttttgtgagttataccgtcaaattcagggaagaggcatttaaagaatggcagaagctggacaaatctctccagcagcagtttgccaaaaaactgaagaaatgttgtgacaatccccatattccttctgccagactacgtgggattaaagactgctataaaatcaaactcagagcgtccgggtttcgcctggtttatcaggtaatagacgaccagctggtgattgccgttgttgctctgggtaaacgcgagcgcagcgatgtttatcatcttgccagtgaaaggatgcggtagggagggcggatttggccgtacacacctatttttgacagggctacaaatcttatcaggatttactactaataagggtcaggaggatgttggcatcaaaaacgtatattgtgttggcagagatgaaaacgttagctacggtctgttttgatacgccgtaaaacccgaaaaagctggaacacatgacaaattccttcctggctgtgcgatgacttaggtgtaatattatcaataatttgtaggggaatctcacgtatgacatctaatagtagtcgggtcaatgtggggaaaaccgggatcgataaccggaccactttttgttatatcttgtggtgttccctggagcattttaaggatgaaaagcaatgatagtaagtgaagatgccctgctgcgctcaggctttagctccgcagacctgcgaaaagtcaaaaacaacctggaaagttatggcggttccctgggggatgccattcaggatctgtccagacgcttcacaatagcgctgaccgttgtgctgtgttgtcttgctatctttatttttttgctctttgctggctccagcgagaccgttttttccggcggaattgcgctgctctgcggttgtgcggttgccatttttgtacaaccgcctgtgttgtcttataagtcctggcgataccagagagcgaacagaaattagcgactctgctgatcggtcgtgagaaggtcaaaaaccactttcgctttgacgccatagtccacgattttcatcgttaattttggtctgctcatggtgtcaactttccggtaataatcacggggcaaccaccggaacagacgccacgcgccgggttttcttgccagaccaaaaacactgtaaacactggcgctcagtgtagccgcattgtaaagtgccattcctgtattcgggctgaatcccatgaactgcgcagcctctattaccccatctgcaaaaattccttcagagtgcgactctttgccgtaacggagatgactgacttccttcgatatgccatttacgccgtcaatgaacagcgtggcaccggctagcataccgatggggatcatggaagagatcatgatcatcccgccaaacatggcaaccccggataaaacgatatgtaccgcagatatgacgtacccgacaatttcgttattgtcccggacaaactccactttagcgatgagttttgcggtctgcatccgtagcaggcgatcctgttcacgaaggttctcagtctcttcccgtaggttttttatacaggctatacagtcttcgtcggtcctggcctgacgtgctgcggcaaactgtttctcaacgacatccctgatctcctgaacaaactgaagtcgcgtgaggctgtcgcgcagatgaaagcctgaaattacgttagcggcttctaccagctttctcgcttccagattaaccattgtttcggcccatgcccggttgcggccacctgaacgcatcattgaaagtagtgcagcatccattttcactctccctgtgtagattttaccgttccagagataataaattattctctcaatgtgtaaaccgtacgacagggagggaacgagaagaagtgataatggagtatatacaaatactgtttaagaaaagaagagagagcaacaacccttcacactatcgcaaatcattaatattttacatatttattattatgcgcatattgcttatgcaggcaaagctaacctggccgcttcgggctacctgctgagtatcctgatatgacggcttcttgtgcggagtttttcacgatgaacgaagttaaccggcttagagttattcaggacgtcgtcgaccggcggctgacaacccatctcgctgctgagcgtccaggtatttcagacaggcactgtcgtcgcctgcttcagcgctattatacagacggtccgctgggtatggctgaccgccgccgtggcaagcaaggcaactatcagctgcctgcaagccttgctgaacgcgaggttcagatagaagcgggaagccccgtggaggtcatgtgtgatgaagcgggactgtcgcaacggcgtgcctgcaggctggcaggtctgtctctttcaacctgccgttattcggttcagcgtcccgctgctgacgcacagctgtctttacgcatcacagagctggcacctgaacgccgtcgctttgtttaccggcgcatctggctgttattgcgccggaagggccttcacgtcaaccactagcgggtataccgcatctatcaccttaacggcctgggtgtaaagcgcaggcgacgccgtaaggggctggcgactgagcggcttccgattcttagcttggatgcgccgaacctgacatggtcgatggattttgtcatgaatgcacttgccagcggccgccggattaagtgcctgatctgcgtggatgatctcacaaaagagtgtctgacgatcaccgccgctttcgggatgaatgtctgaatgagcactggttcagcgatgttcttcatgcccggaaaattattaatgactggcggcaggactataaagagtcaagacctcattcatcgctgaattaccagactccagctgaatttgcagtaggctggagaaatggaaaatcagaaggtaaacaaaccgacattagtaactgatcgttgtatctaatactgggggcaaatcagttctgaaactccgagtgcccattaacaggccgcccccgccccggcccggaacaggagtggctgtaatggatggtgtaactaatcctctaagttttactgttcataatgaacagtaaaacttagaccccggaaatcacgccctgtacgtcgctctgcgccgtccagcccgctcaccggggttcgggattagataaacgttatcgtcgctttgaggccgtctggcttagcaggaaggggttgggtagcgccatatatcaggccgtaaccggctgcgccgggcgtacggcaccgtttgaccactgtaccctgcactgacatcatctggcgccttcatgaggctagcgcgtcattcataaggccagctgcgcactgctcgctggcctttaaaaaaagaagctgaattggattatcatcaaacaccagtatttgaaaatatctcatattcttaacagttattctgcttttagcaaaaatgtcataattggtataacggaggctcactgagtgattacggaaggagtcattacatgggaattaaccacaaaggtactttattaattgattctaaagatattatcttaagaccttttacaaaaaatgattcagccaaggtctacgagaattgggcgtcagatcctgaagtagcgaagtatcttacctggaaagcacataaagatattaatgaaactaatgcaatagtaagtggatgggttgagaattacagtaataaagaattctatctctgggcattagaacttcgcaattcaggagaggttgtgggctctgtgaccctaagtcatgtcgataatttcagagaaagcgccgaactcggcatcgctttgtcacagaaggtatggagaaactggagtaggaacgcgggcggccggacttgtcataagtcatgcttttaatgtgcttaatttcaaacgcatctctgcgaatcatcagccagataatcacgcatctgaaaaactgctcactaaactcggtttcaaacttgaaggtgttgcacgtagttatacaaaaaacaaagatggtgaactaactgatgtagtacagtatggattgctaaaagagccaaaggtaaaagaaacgagccgtttcagaacagatcaaacctggaaagatacgcgcaaccattatctgaaagtgctgggtaagccatggtatcaattgttggcggaacttcagaatacactatcttttgctacttttgatttttacaatctgcgaaaaataaaaacacttcatctgcctattacaactggatctatttccagcccgatgggtaaaggcagtgactcgcttccggttaaagtaaaaatgtttgagcaggatgtttatctcgccgactcaatgcagtttatgcttgaatacggtacaagattattcggaaatggtgcatggtacattatgccatctttccgtggtgaagataacgataaacgccacctctctcagttttaccatagtgaagctgaaataccgggtacgataaatgatgtgatagtacttgttgaagattatcttgttcatctcgcaagacatatattgcttcgacatggtgacttattgaatgaaaagttaggtgacatttctcatttaatttctcttgcggagaagaatactcctttcataaaaataacattagatgaagctgatgacctacttaaacagctatcccctgataattacactagctacattgaagacgtaggtgaattcaggaatttaactcatgcgggagaacggcgtctcatagaacattttggtgggtttgtatgggtaactaactatgacattctgagtgttccattctatcaatgcagggatcccaacaaaccacattctgcactgaatgcagatttattatttggtattggcgaggtggtgggagcaggtgaacgtcatagtgatggcgccggggtgagaaaagcactcgaagaacatcaggttgcacctgatgattatgagtggtacatcagaatgaaagaggaatatccagtaagaaaccgcaggctttgggatggggattgaaagatttttaatgtgggtaacaagagaaaatgatattcaggatttccagttgcttccacgcgttaatggtgaaaatattgtaccttgaatgaacgataacgctaccggatggtagcgttagtttttgtgattatgtagggagaataattgtgcttaaaagcagtgcagccgtcagattcactggcataatgtactccggtgtaaggatgttgattggtgcatattctgttatatatatgctccagaatggtctttccgttagccaggtaggcctgctaaagacatttcagggaatcattatcgtctttttggatatacccctttcttatttttctgaccgctatagcagaaagttttcaatcagcgtcagtatacttttctcttctgcatggctgcttactatggcagtggcagataatttttggtttttcatgctggccgaacttttcaacgccttatctttgggaatgatgagtggtacatttgatagttatctttatgatcatagtaaaaatgagaacaataacatctcttcccaaaaaatattttccttatattataaataccagtttatgtttatgggggtaacatctcttataggagcgactgcttatttttatatagggaagtcctctatttttatatcatctttattaatgtttatgatttttttaatgtcagccttcttaccttccgatcgtcaatttaaaagtgaggaaaaatcaaagttttttaccttcaccatgctgtgtaatggtatccggcaggttttcgtaggtcgtacaggattgttaacgttattaaccgtcattatatcttcattcttcctccagtctctcattcaatactggcaggttatagcaggacaagatctaccggaagacggtcaggctataattttgggtatcgttttctttttaattatgcttgcacagtccgcaacgggctttgtgacagagaatttaccttcatcttctaatgctagatttcattttatattcttccttttggttataatttcgtcagtgtcttctctttattttaacaatatctacatgtcagcgtttttcctctgtattatcttcttttatatcaattttgttcaaattatttcttatgccaggatggtgtcgcatactgatagcagtctgcgatctgtcacattgtctactattgctacagtaaataagatagtgatgtttgtcatgattgcaccttttggtttcttactgcaaacgtacgattggttattcataattcctgcttttttaataattacccctctgtttttcttatattttagaagtggcaggtgaggtttatgtagatcctaattaatttttccctgccctttagacagaagaatataaagaaaaagatgaaagcgtcaggcaaaacgctttcttatctcagaggataaataatcaggtacagacatggtgactgctgattttcccctgatcataccggtgaatcatcagcatggggttttctctgactggcggaacattcgctgacccgaaccataatggattggctggacagaccgaaccacagatatttgccgggatccccgcaaagttgccagcaacaggtcggtggacatgtcctgaagaaacagcgagtatcctgtcaggatatcttcttatcaggtcttcaaactcactcagtcctctacacatcgtttcatcaagagtgggtatgccggaagggaaaatgtgatggtgaagaaacagcagaaaccggagcaccatcagcctcgccaagttgcttttccagccatcccatacgtcccgaaagtgatccatagctctgtccgctgacggttgagtccacgcccgccaggcttattacgcccgcgttataactgaagtgcagcaactctcccggtgagtcaggcaaccagagtttattaccccacgtttgtcgcatatagtttcgatcgtctgaatttccgggcagcagcaggtaggggtaagcctgtttttccagttgagcagctatctgctcgtatccctcatcccagccttcatccgtcaggtcaccactaagaaccattatgtccggccccacctgttcaagccacgacagcgcctgcccgaagcgctgaagatgatcattatcgggagcggcgtggatatctgttatctgtgctatcagcatgaatacctcacgaagagccgatgccggcagtcatttcagaatcagacctgggttggtcagcgaaaattatgacccggcctcatgcagcgacaaagcaaggcgttcgtggtaaacgcccatcgccgccatattcaggtaaacgtcaccgggtccgctgtgctgcaggggcagccagcagaatatactggctaacgcgctgcggtcattttttatcttttttccccgtatgcgttcttttatgtcgtaatacagtatgcagagaacaagagtgtctttacttacgtctatgcctacaggaaacatcgtatttctcctctcacaatggccgtcacgcctgttagccttgtacatacggagtcgggcacccggtaaccgctcaacaaaatgtgctggcgtgaaaagtgaaaaagggggccataagctgccagacgggatcgataattaaatcgtgcgctgggaggggactggctcactctgcttcgtgtgatggtagctaatcaccacataatgttagatacaaggatggggttgggtcgcgctacatatcagtccgtaatcggctacgccgggcgtacggcgccgtatgaccaatgtcctgctctgacatcatctggcgcctccatgccactaagcggcatacagagcacaatatttattgttttaccaattattaagtaaattttccgtacatgatttattaggaggacagactacagtgacgctgacacataaatctggtcatctggcctggtgcgctctggcagcccttgcattagcacgtcaggacggtaccgtttgctctgctgctcaggaaaatctctttctgacacgctggctggcaaccgccctgaagcagcgtcgcttttcccgtgaggtggctcccgacattgagtggctgctaacgcaggggcgccagtatggcgttgccgcaaagcttgccggcaagctcgactatctctggcgctcctgtactggcgagctatctcagcagaatgacctgttccgtctgacatatgccctggagatggcgaaagatatgtgctgggcttaccggctgttcagcgacagggagtggtcgggaaggtatgccgcggtcctgaacactggcgtaaacggaatttatctgtcccgaagcagcctggatgctgcatttgacgatgggggccaacaggtcgcaccggtgatggcgcgactaaccggatccgtgcaggggctggaaacgcttcttaatcgctgcggatggcagatggctattgatgggcattccgggctttatgtgctgacgtcagaaaaatatgaactaacgatggtgccgtgagccctaggcgtttgtacctggcggatcagcggtgcggccggagaggccgctaaataagtcagtggcggatctgcgccaggtcgtcttcagtcagtccggtcattttcatgacggtattacggtcaagaccgttctgcagcattgtacgggcaacttccagcttgccttcatttcggccttcctgcctgcctagctggatacctttctggatgcctttctgttcgagctgttgtgcgatggtcataagtgcgtctccgtgttgcggcacacgctgtgccagttcgcgtacaaaaccttcggcgtcggctgtttcgcctgcctgtacaatatagtgtaccagcgatatcacctgtgatgatgaaatcgccggccagcagaatgggcgccagccggtcagtcagtttctgccaggtcccgctgatgaatatgtttctgcagcagggtcagggcggccatgctgcgatggccggcgatttcatcatcaggaatgacggtaacgtcaaccagcgggaaagcgctgctgtagagtttgcctgccagcgccggatcttcaaactcattcagccaccgggtggagtaaggatacgggctgcgtttacccgtatagaacagcacgggtatcaccagtggcaacttcttatggcccgcctcaaggtggcgctgcatggcagccaccgcataacgcatcaggcgaaaagccatgtgtttatcgggtgaagactggtgctcgatgagcacgtggacataaccctcaccggctgtggttttcagactatagagcacgtcgctaaagtactgcctcaggtcatcctcgacgaacgagccggattccagctttagcgtacggaggtcacagatagcacgcagctctgcgggcaagtggagttccatgaaatcacgggcgacatccgggtgggtcagaaactgccggaacgtggcatcgtgaggagttggtgtgcggtttttcttcttcttcatcagtcccggctctgaaaaataaccgctgtatgttaccacaggcagaaaaccgtctatattgatggcgaagagttctgcaatgcctgcaggtagccgttcggattatttttaattttttcggatacactgcttcatcgtacaatctctaataatcgaagcataatcattcttcgtcgcagttcgcacagccagatgagtgatggaatcataaaacagcgtcaatacggctgggagatgtgactatatcagctacaatttaacataaattacattatgcgaaacaaaatttggatcttattgagacgggttttcttgagcatggattgcatctgaaagcgctttctctagtgatgaaacgtagattttaaccattgcgtagttatgctcaccacctcttgtcgtttgccatgcatcacgttcacgacgagctttttcaagttcatactcaatttgttcaattgttcgtgccatttaataaacctcatgcaagttaactggtttttcgcatcgctgtgccttcctttcgtctccgaccatcatacctttccgtttctgaaataccgatgctaaagacgttaatcagggggcgcgtgcgctgtaccgttatctatgaaagccgtttcgttagcggcgtcggcgcggttcgagttcagaatcccataaaaatgtatttcgcgccctaaaatgcctccggcatcaacctgttctgccgccgacagataccactgcgcaagcaaaaatgagtcaattcgtagcaacaaagacgcttcgctgaattaccaggtcgcgctgccgcaccacctggcaatttcacagctcgcgaataacgtgagcggtcagcagaacgaacatagtgcgatcgctgacagaatctgaatggctgcggaaaagccagccgatgacgtgaatactctcgaaccagggaactgaacgattgctgtcagtgctgtttgagtccgagagcccgccgagaagcaacgtctgcccgtctttaatctgaactgtggtctgaatctgacgctgatttgtgatgatgtcactggcgttgttatcgttgctaagtgagtctgctttactgtcgattgtcaggacaagtaacgaaaaggttgacctaaaccttaacgtgaacgataagcaaaacctgaccattgaagaagcagggatcaaaatgcgcgtgctgacggctatcagtgaaatgcaggatgaagatatattttttattaaacttttcattgacttaattaacattgatcgcacaataaacaaagttaaaagtaagcgtcatcttacaaaagacgagcacctcaagatgctgaaactgaaaaaaactaaatgaaaaaccgtgggaaactacggtaaagttcgggtgtcacagaaccccgaaccgcttcgcggtgaagatttaagcaacagagtgtcataatggaggatcatcgtcagtgaagaaaaaatttcttggatttgtagttgctcgcggaagaacacgaatctggtgttatgacgaagcggctggcgaatggaataatgatgccgaaaaggcaagcttatacgaaaaagtcggtgatgctcaggagacgttaaaagcgcttgagaactacagaaaaacagcaactatcagagagttacacaaaatagacgatcattgcctgagcgtcgacgagatgacatgggataacatgataaaaggccttgactaaaatatcctttgtctaaaaagggtacgtataaacggaatacataaaaattgatgcatggagaagggatttaaatgtcgattaaacttgccttaaaaccaaaaacaccaatcaaaataaactcagctataaaaggcttaatgaagtatcttcagcttaccacctcgcctagttatttaaaccttactaaggttgaaaatacacgagctggctactgttttaataactgtgaagactatgcttcaaaaaataactgtgaggttgtgtatggttggatgatatgggaagacagaagaaataactttattgaggctgaattccacgcgatcataaatgaaggtgggttatataaagatataagccctagatttaatatggaggataaggtactgttcgtaaaggatggttctagaaactgcggtagaaaagaacccaactcttggtactcatggagtaacataaaaatcattgatggagttgtgagagaaagcccaatgcctattgaaatcatcgagttagatgatattcatagtgagattgtgtacctataacgatatgatttcaaggagaaatttaaatgttagtgttaagctcatcagtaattccagatatttacaagaccgttaaggttcatggttttgtggaatacactcatagaattgaaatatcgaacaaaggtttgataagaaatataagtgagcgaaataggaatgaacaccaagaggcttatgaaggatttataaattctgcatcagctgaaggtaatgttatatatggagtagggatatctacgagcacagcacaattcaaagaggccacatacatgtatatgacatactatggaacattggcaacaatagaaaacaaataaaatggtacgcataatgacattatgctaaagaggccgctgcggttttttattttcgcagcggccttttcaacataacgttttgacatttcacgcatctatcatcatcgaaaaccagacaggttaaaaacccataattatcgactgccattaattcccgtaatgtcatacgtcagctgaagcctgcaatgtagaagagtaattctatcatcagcacagatatatttgagtcaggaaaaatcagtattggatctctgaagcagagcgttttgtcagctattcatcatcgctttccatcaggatgaccattgcacaccggtgagcttcgaccatccggatgtagcgcatgacagtctgagtctgcgtccaggtaccttcctgcatgatctgcgcaatggatatgccttttctggccatatcctgtgcggcgccgacgcgggcactgtggccgctccagcttgcatagcgccctttattggtttcaagaggcttcgtctcacccgcagcctgacgtgcacgacgataaatatcttctaggcagggtgcgctcatggggacttccgacaccctgacgatacggttagatcgatgaacaggacagaagataacagcgtcaggtttcgccggcaagacccgccgcagtgatccattcgcttaacctgccggatgacttcgcactgagggccttaacaatgcctcctgactgcaggatggttttggtccagccaacgtccagaatgatacgcccgtctgctgctcgggagatatccctgatccgcagacgggaaagctcgctcatgcgcagaagtgtgctgtaagcaacatgcataaacgccaggtcgcgcagctgctgcaggcgggggggaatgactccatgctgcatccagacggttcaggtccggccggcagaatggcgctgcctgccctgtgcgctcacctgacatgaccgcggtgcggtttatcttcttcctggcgcgcacgacgtcagtcgcaacagtgggcggtaccagcccagcgttacggtgtaacattgatataagcgccgcgtgcactgaaatggtggaggtcgaacgcccagtggcctgcagatgaaacaggtagtcctgcatgtcatccggtgtcattggcagaaaggaccggcgattctcctgcgaccagcgccagcagatccgcatcacgctcagcagctgacgccacgtgttggccgaaaaggcctcccgatggcggacgaacgcggccagtttcgcggtgagatcatcaccggtgctgccgctgagagccatacctttaaaaccggagatatcgttcatttttgctccgtttgcacctgttaactgaatggcagcgctacgtgaattctgaaaaagaagcaggagcaatacccgtcagattttacgtagcggcgcctgctttttaaccacctatgaaaaggtgtcgttcagccgctcgccatccagaaacgccgccgtttcttataaatggccgtaaagttcaggatccagccccgatccgcatgatacaggctttctgaggccctgtctggccttatataagcataattatgtaagtctaggattcagattactcgccgggacaatagatgaggcgagctccgcaaatttcataaaactcttattatatgaagttaggattgtaaaaattagctagtagtaaagtgtgttgattaggcgctatgccacttaaacattggctatttatgattgtaactccacaagtatgtagttagactgaagtatgctaaggatttaataagggcatttaattaaagttgtagatttgaaatcaagcattagttatggaaatttataaataattgaataaaaatataattaaaaactaattcctagcccttaacaataaaccattaagggctataagaaaccacagcatggtttacttactaggctttgattttatataatcaaaagctattttcataccatttaaaactgctgttgaatcattcttattctgtaaaatatcaacagtagactgacctttttccagtatgaagtttctttcagttttagacagagcgtctaatattttaaatttaaatttatcaggcaactctgctgacattatcaatgatacctttttagcctcaatgttagttatttcattttgaatatattttatttcttgcaaatttcttttatataaattgagaaagaaaaaagataacaactcgatagccaaactaacacaagctttagatgacaactcaacgaatattagtgtgccttcttgtttaagataactcatattaaagacaaaatacaacaagatacttataccaattgtcgcaatactgataccaataaataaattaatcctggaagtgacattcaatgaattagacctttgaacaagcctgtctttaatgtcaacaaagtaatcttccaccctagctaatgaattattcttcttaattcgtgaagttaaatcttcaatgtaatcatcaacgacattagattttatcgactcgtgaatcatgtcgtataaatctttcttatgttctttattgaggtatttcgacaaatccccctgcaaattgtcattgtgctctttataagaagctaattcctcttcaagaaggctcaatcttttacgagcactagcaatgaatgaatttgatgttttactagtatctctatttgaaagcacgccaatcaatccagcaaacaccaccaacagaacgggtaatataaaaaataaagaagaatctcctgtaggtaataaatcgaaaattactgatgctagtccaacagcattattgtttaagaagtgagttgatgaccaaagcaaaaatataaaaaccaaaatagttttaacaatccttggaatataagaatatagttttatcaattttcttctattaagttcttttttataagcttgagcttctaggtaactctctctaaaagcattcgcggttttatgattcaacttcacacctcaatagtttaacgaaaaaagcgcactcatcattaattatcggcaaagttactaaaatatttagctccatactaaaaaaaattgaagtcatgtctgtcatggattttattgaagaattattggttttgaaaaaatttttccaggaattaattagggaaggcagaatgttacagcaacgcagaatgtaccgcttgcaccatcaaacataaataatattttgcgatttaacgaatagtctcgatttgataatatcactttttggctaatttataatttcacccgtttacttcgttttcgccaccttttatgggatgctgatgctgatgctgatgaacatgtcgaacgaataacttcaccatattcccagcattctggttgttattgaaaaacgtctgaatcgccgtaatacggtctctcaactggctcttacagagcaccaagtccatcagatgatgaaccgttatcgcgaatctggttcagccggactgatcaacgcccgacgcggtctgcctggcacgcatcggattgacgagactcttcgttaccgaatactgacgctgctagacgaatattatgccagtttcgggtccatatctacttgccacagaaaattactggagcgttatgagattaatatctccacagagacgcaacgatgctggatgactacttacgggctctggaaacctacacatatgccatcagacccatatctaccaccctcggtgaaatcatccagattataggagcgcgtcatgtctggtttgaagctcgcacgtcaaaatacagcctgctgattcacgttgacgatgacatcgcatctgcccctctgtcagagtgaattagcctttgattacatgattgccactcaatttctcgataaatatggccagccggccgcattttacagtattaaaaacgaggtgtttttgtccgtcactcagagatacgaggcacctgcaagacgctgttcaggcgcgcgctaaataatctgaacatcgttcaacactatactaacagttgttaagaatagggttatcaaaacgcagtaatcagatggtacggaattaattgattattatactatacggctgcgataactcatggtcagcgctaggccatggcccttcacttccaaggaataccgtcagccgtattgttcagtaccaattagcttttaatcttactccgcattccttcattaaaaaatcagaaaaaaaatcaaatatgaagcaaggagcgacagatgaacatttaggaaaggttaataaacccagccactactacccccagaatgataagtaaaaagtgagtaatcattaactcactctgctttatgtaataggcgaaccataaaccgacgaaacttaaggaaaaacccattgttataaatacagccagaccataattaccccattcaataaatgattcaatcccggcagggctgaatgcctcacgaaatatattggacacagcaattaaaaggagcagcgcgcaggaaaaattaaacaataccagcactgccgcacctgatttatgccagaaaggatgaccaacgcggcgggttattaaatttgtaggaaccgcaggcggtgcctcaatcatttccatattcataattctgccaaccattttttgcgcgccagtgaaatcttttaccagccctaagccttccagtaaattccataaggcaagaccggagataacaattactttgataacattaatcccactaagtgttagcattaattattactcctttctggtttatagcttacattatccttacttatagcggtttcataccggaaaagggatgctccccatttcatgccggtagaaatagtactcatgacaatctctgaaccaggactgattatcccacgctgcatcatcaatcgaaatgacaacagcgggtcggcgcaacctacatgtcctaactccgataacaagctaatattacttctctcaatcggaataccaattcggttacataaattttctatgctctgttttccttcgagagtatgtagtagaaaaggaggagtatctcggcttacagatttctccaatacacgacgaatgacattgatactgttattttcgcgtaaaattaaaaaattcattaaatcctgagatgagaaacaataattatccataattcgctctcgacctaatttatcttttttgctatctcttccttcaggtaggaaaggtaaatgtccaccaccatattctatgcgcatcatatctacataacggcagtcagaaatatcttctgtagatatataacgcaatccgggctgatctgcatatgtgattgcctttcctaccacgcaagcaactgctccatcacttaacgcagcattcataagtccgaatctgtcctgatgagtatcgctcatgcgctgcgccagtactaccagcccaaatttaccttctggcatctcagtacaaagtgaagatgcatgcttccaaacactgacagccgtagcacaaccctcaactaagttgagtgtacgaatctgattacaatttagttctgctccaacctgacaggctaagtcgataccaataaaatcgggaactcccgaaaacccagcgacaataaaccctacatcttcggaagataaatggaattgttccagtgcatttcgtgcagctgaggcagccatttcccgaacgctctgagattcagtccagaattgcttataacccgcacgtttgatcgcttctagctgtaactgattaggatgatcaacttcgtcaagatgtgcggctcgcgataatgtatgccctgtacttaatattttcatttacttgcccagaggtttcagttcaatttcaccaatcttactacccagcagttgggctaactctatattaatagaatattttttctgcaaattatccgtaattatcatagccatgattgagttccctcctaaatcggtaaaattgtcatccatcctgacgtccatttctttcaacatatatttaatttcttcaactataacttgatgacctttctgcttacactccataaaacttcctttttatctctgcgcgatcagattttccacgtgaatttattggccactcattttgggatataattaaatattgtgcaggccttagccaaggagacattgtcatgcaagcgcgtctaagatcacgagtacttagattatttcctctcgaaacgttaacacaagcttttaatagtgccggcgctgtggaagattcctccatccatactacagcctcaaatacacccggtatagattgaagaaactcctctatctccagaggatcaactcggaagccatttattttataatagccttcattgcgacctatatagtgccatacaccatcgttatcgctgcggcaaatatctcccgtcatgtaaccagcaactatagggtcgcggccttcataaccggaaaaaacctgccccccttgtaatactagattcccactcccttctttcctgcattcctctaaagaaaataccatacccggaaatggcttgccaattggtataatatcgtaggttaagtcgtcctgactcaccttccaggcagaacaaaaaacagttgcttctgaagggccgtaagtattcagcaattgaaccttaagctcattaaagatgggaaaaaatacacgaagagtttcagctgtcagtttctcgccgcaaaacaccatctgcttaagacataattttttaaaaatcgccggagactggctaccaaatatgtagcgaaattctgagggcgtgacagatagcaagtgaacattagatttttccaatatctcacgagttttggtcggatcaagttttatctgttcactaataactactaggcatccaccataactcagtgctccaaacaattcccagatagaaaagtcaaaagttagatcgtgaatccacgaccagttaatttttttctttaccgggatttcgctatgggtattctgcaaaaatgcattaacctgagcgatgtgaattggtacaagtttaggtttctccagtggtaccagatgtccttacacaatacacctcattgctatatgaagctctacattctcgggttgttacaccaagacaccactcgccaatgtaagtgctttgtaattcctcaaatttgcataatgacgagcagattcctgagcaacctatgcttatagcaaactggtatttttgctgcttattcatatttcttggtacagaaataaatgaaatcccggatagcaggcatgctaaaaccatcagatataattctatagacctaggcgcatcaagagcaagtctctggccaggcaacatgcccgctttatcaaaatatcttatgatttctactgcacgctcatacatttgcttccacgttaagctagtttcaccatcatttaccgccatagcttccgaattatctctcagcatatgatttattgaatcatttatagtctttaactttgtgcggacttgcctgggggttaatttctgcatcatattcctgctcgcctataattgtttgtgtagtggcgctgtcgcagtaacaacgccctacagagccaatatgtcaatacatttgtgtcagtgaagaaagctctcccttcaatgcacttatcccttctagctcctctggcacaagtttggcgaagccaccgtgtcgtgccccgacatttacgtcacgccagattttttccagagggctatttttttctaaggcagatgaacctcgcagccacaacaaggcctgaacaatatcaacacaacctcgcattatctgagtagcccggccgcgaatcgctactcgttcttcactttcaagcatcctgccttcttgcgctgcgctatcaataattgaggcgttgtattcggctgcccgcacaagcaaatcgaaggttgaacagagccgtccgatctcataacgtgcagcaccagaatcactcatagcgttataagaactgccagcaatgggagcgttaaattcattaagtactaatctgatgccgctttctgttgctcccaagagtgtggcgggaagacagttcatcaatacgccggtaaagtagcgtgcgtaagagccctttccgctatacgaaagcgcatttcctgaaagaattggtgaatatgcaacagtaaaggctttaggaatgttgatgtcccttgcctcaacggtcacgctttgtgttcctctcaggccggttgattgccaatcagccacagcaatcaattgatttgacggaacaatgacaacacgcacttctccagatggagttgcagcgaggcaaaagaaatgtgaagaaacaggggtagcctgatgcatatttccagctaccgttcagataccacccttgaccatcggctgcagcgttaagctttccgggacggcctaataccattgatagcatggcgttttcacgcatgtcttcactcaccccctcaggaagagaaaaattggcgcgcatcgaccaagcggaattcgcaacacctacaagccagccaagagaagcatctgtttttccgagctcacgacatacagcgaccacctcacgtagcgtaccagtctcatacagatcgctttcgtccaggatgcgcaacagtggtgaaccctttaatacttcctgagcaccttgctttaaagaatcctgctgttctttttctgaccaagacgacttcaaaatatcgacagctttttgccagcgtctgagcacatcattattcttaagcaagagaagctctccattttttaactttctcttctgcctgcgcgcaaatcaggtcaacaaactctgctgacgttgcaagcatttcaggcatctcaggtgtgttaaacatcctccagaagtaaggcaagctagctttaggatcttcgatgttaaaaccacaagtggctcgtttttttaatgcctcaccatcatattcagaaccaataggctggcgttgcgcagaagtcgttgcccagccagtacgataaggtccaggctgaattacgccaacctgtatagacgttccttcaagttcatgacggagggtttgtcccatcgcttcgatcgcatgcttgctcatctgataagctcccagaagaggccagcacgccacgccactcatacttgacaccagtagaatgcgagcttcatccagctgacgcatcagcggtagcactggtttaataacatttagagtcccctctacattggtagcgaactgctgtcgcaactgttctgtagaaaggtcctcaagtgtgccaaactgagcatagccggcggacgttactacccgactcggtataccgaaatccttagccagttgaggtagtatacgggccagatactcttcatctcgtacatcagcgatacaaggaataaaatgttctggataaagagctgtcatctcttgtgcagcctctactgaacgggtaattccaatcacacgatcaccatactcatgaataacagactccgtccagcatcgacctagtccgtttgaacatccactgataagccaggtattcattatttggtttccttaataactgattgaacgacaggataagtccgtgataaccaggcacctaaacccagcagtccggtaataatcaggaagcagccgaatgaagcaaaggcaacagatggagagccagatgaaaataaggaattttcattcgtgaaacttcttttttcagagttatgaagcagataatcgaaaaatatggctattgctacactacccaatgcgctcatcatctgacgcaccacgttaaaaaaagcggctgcacggccaaaattgttaaacgttgcacggctgaaagcctgattagctaagggggcaaatgccaggcccgtcccgatacctgcaagagccatagcggtaataataataataaaagctacagatccaccataagtcatcaatccggtaataccaataatcatggtggcagctgcgaagcagcacatcccccaacgaatcagtgtttctggagccgccttatccgagaagtgtccggcaaatggacccaccagtgcgtttgccagagcgattgtcaccatgatgacactaatcgctactggtccaaaacccatacgcagctcaatcaaataagctagcggcaggtagaaacgctgtcaggccaaagccgagtaaaccggaaatcaaacatgtacgcaggaaagctcgatccttccagagcgaagatggtaaaagatactgcttatgatttttcaattcaccgtgcagcatgaaagcgaagagcaaaataccaggtaataataaaagcagccctgtggtcattccctgcatgccaccgttaagaagctctaatcccagaattattgcagcgagcgcaatgcccgctatagcattacttagcaattctttgcttttagcaccgttacccggtgtgccgggaagacaaataacagcaaatattagtgcgatcagcgccacgggtatgttaatccacataatccatcgccaaccgattgtttgcagaaatatctgggtaacaacggggccggttgccgttgctatgccagcaacggccccccagatacccagagcagtaccgcgtcctccttgtgtaaaaatgatggaaataaaggccatgctttgcggcgtcaaaagtccagcccctacccccataagcgcacgccccagaatgacctgtatcagggtttgaccagaaccactgagtaatgcaccaatagcaagaataatgagagcatagtaaagcaccgttttacgatttattgcatcaccaagtcgaccgccaaacaacaagaagcctgcataggtaattaaataactattattaacccacgctgccatggcaggcgtcacctgatattcatttattatcgaggtataaatcaagggcactgtcgtggtatccatcataataataaaaaaaccaagacagagaccaaagaaggccattttatttctcaacattaatccacctgaataaagagattttatctaatgttaaacactacatgccagcaaggtagacgagtgaatcccacttcatcagtcagtatggttaaatttttctttttgcaaaaatcggcaattgcctgagcatttcctttatattcaacacgatcaacggaaatgacatcccatccggcattttcggcattgctacagatttctgagagatgaatggccaatggtactggcatgccatttttggcgggtaaaaatgttatgatatgcattctggtattttcatgcgctaagcgacgcatctctttcaaatatgtcaaccgttcatcataaggaagcgcgtgatagagcgcagaatcaagtatgatatcgaatgtttcatccagtcctgtattactggcactggcaattagaaaacgaacatcactcattccttcatttttgcatttttgaatcgccgcagacgaaactgtctaacgctgtaacctgaaaacctcttttcacagctgcatgagcattaagtcccaggccacatccaacatcaagaagcctgccagcattttctttatcaaaaatatcacacactgctggttgcgcttgaccaatatcccaaggaaccacacttatttcagcactaccgataagtgttttaccctgatatacgccctggaaatcagctttatcatattcgctatgatcactacttttcatatttaacacctgaataaaattggaagtaaatttaaatgtaaaaattacgttactttactatgttcatcttcagaattatttacgcaatatccccgagtctgcattagaaattcggccagataaccatcgtggggtacatcaggatgcatccaaacagttggcacctgaccgatgtaaaaatttttaacaccaggcacatttgcgattgcattaattaaattcttgttacccgatgccacagtcaccacaagcgcaggggcaagaaaatccaaattatccccttctttaaaggataagaaagtcactgccgccacaggtaactccagctggaccagaggatcattgattgctgatgcctgcataactagtggcatcacttgatatgtgttttgggtagatttgaaaacctctggagtttcaactaaagccgaggcgtaattatctacctgaccacaccaccagctataacgctgtggtgaaaaatgagtaagccattcttcacgctgctttggatctttcattttattggacagaaaagcgcagaatttccgagctaaagcttccgcatccccttctacaagaacactgcttgcacaaacacaggctgcgccacccaaaccgacaaccgaagtaaatatcagctccaaagccttttctagggggtaatcagcaccaataacaactttcgatcgcccaggtccctgaaccagaatatttctgcgatcagcatagcgggcagttatttcatcagcgccgtaaataagacttaaatcagcagcatcaattagtgtttcgaccacatcataattacagggcaataatgtcacataatcctgcaaccccaccgccaccattgccgctaccacacgctgagcagtaaacggttcccgttccgacggtcgaattacaactcgatagcccagcgctattgcctgcggccatagagcatgaacaccagtcccgttaccaggggctattacagtaagcacatcaccacgcctcacgctttgtgcgcaaaagtaacggtctgtcgcttgattttcctgtagagggactccataggggatcccctttaaagcaaatgtcagtgcatgagaaattgactgtgcaattttatcgctggcattctccacaaccgtttcgcggtaaccccgtaagagagctaactttcgtgttatattctgtaagattcatgccacaaagcaccgaacctgcgaataattcacctgcttgttgcaatgctttttgtcgtgaggcgcgatccagtacaggactttttctcagatgcgcaattacgtaatctgcaaatacgccgggagactgctgcagtaaagctatgggcttttcatatatgtttaccacctctcgctgacgcaaaaactgcggtgagcataacggcgttatagcagagataacaggcagttcattggcgtttacgtgaggacagctttgcgcaatgtttggcatcaataaactccttcaataaccttacgtccttcgctgattttcaaaggttcaatatcagccaaccggtcccccgcaaaaccggatacacctggtagtctgatagctgtgtctcgttcagccactcgtggataaaaagcccaaggtgaaaggtgggtaacaatcacgtttcctcgttcaccatattcgacagtttgagcagtgatactgtcgacaacgtcataggttataaaaggagagaaactgtcataaatgacttgttggctttcagaagtaatcagtaaggaccgagatacgcccaatgctgaggtgctcccataactggcactgaattcacagtcgggcagaatttcactcgctataaatttaatctcatcaaggttgagctcagttccaccaagtgtgatttgagcgagagactgtttcatttgcaacacaacttctggtcgtttaagcaactcacgtagcacaggtggagtggtaaccagaaaccggatatcctgattcataagggtattctggacctggtccacaagatgatgtgtgtacttgcgaacagttgccgtatcaccttcactcaaagaacgttttacccagcgaggatctatatcgattgaaaaaaacatcccacccaaacgcagcgctcgttctttattaatggcacccacaatgtgaggcccggtgggaatagctgcgagtgtattacctgacggacgccccggcctatgctgataacctgacattcgccaggaaatgagtgcctctatccaagcatcgtaagccacgacatatttaggagcgcctgttgtacccccactttcatatacctgagggtgcgagtccgcaggcaggccttgcggcactaaattagctacgggctcctggcgcaggcagtgcgagatatcactaaactgcctcagatcgttaatcgttttaacgtctttgattgggtcaaagttcagttgttcacgcattcccaaccaaaaaggactgccagtttcctttgaaaagtgccagcgcattaatgcctgaacaaaattattagtgtcatttatctgggctgccttcatgacagcatctatttcaaggctgtaatctttcatgcttccaccccagttcattacgtgtatataacagacgtttatggattcgagaggacgatgctgaccagaaactcataggtgtcaaaagccagcccccatactacaaaacgctcaggacgttccagctttccgcaacccattccagctatcttcgcttgcaaagtagtaagatcgtttaatggctcactttgatgagatgctactgagacaggatcatatgcagaagcacggctgtgccagatttgatcggcgatatcatctgacagcagttttgcattaccagttaagctcacctgtcgccccagctcacgccagtaaatatggcaggagaccgctttgttggcacacatatcgagactctttcgactgccaagatgagtagcgcaccatagatcttctccattcattcgaactggaaatatggtgcgcattgaaatcataccagcgtcacttctggtcgcgagggtccatgcatcaggttcacgtacattttcatgatgcgccagttgcatccagttatgtaaaatttcataaggcaccacaggcggcgcgtcatattgcggaaacggaagatccgttattccggttagcgattcgagtcttttcacttttcatacctaaaacagcacattcaaattaagcgaatcattttccgctattactcagcaaggccctgcaatcagaaaacaaggtaacctgcccggagagttcaatatgagaagcaatttcattttcctgtttgatttcgccatacatcacgcagcggcgattgagcaaaatcccctgctcaatcatgattttttcgttagcttttaactgtccgtgtttcatcaggtgaagtgcaattggcccgacaactgaaccggtaccagcatcttcttttaccccataagctggtgagaacatccggttttccgcctgaaatccacaccaggcgaaacagttaactgcaagattttcaaattcagcgaggacctgatggtctggccttagctcacgtaaggtttcaatactgtcgacggaaaccagtacatgcctggctcctgcatcgtacatttccacaggaagcacactttgttccagccccagcgccttaagcagacgcttctcttccttaaaagggacagttcttgctagaggcacttcgattttcaccgtactgagtgtttcggtgtggtgttcaaccgaaatgctgacggcgccaagagctgtatgaaatacaaattgatccagaccatggcgccgtgaatatgcactggcggtttcccattagtggatgaccagcaaaaggcaattcattgacgggcgtgaaaattcgcactcgagcctgaccatcaacagtcttttcactgataaaagtactttctgaaagctgcagctgacgtgcaatcgcctgcatgacagcttcagagagtttttctgtatcatgaaaaacggcaaccggatttccttcaagaggagaatgtgtgaaggcatttaataccgtgtaatcaacctgatatccttccattaagaagccattcctgaataatttttttggaaaagaggagcgacaaatctttcgagcagcgcttgaccatttaaagtgagtaccgattcgagatgaaactgaactgatgaaaatgagtgagcccgaagcgcatgaacgtttccattatctggatcgctgtaaacctctatacctctttgccgcatttgagagtgcgttacagcattaatactggcacagaaagtgttataaaaacctgctgtttcaaggttcctatccaggaggatttctttttgtactccctggttgggtggagagaggcgggcgactggtaagccgagctgcagacaaagcaattggtggctcaggcatacagcaaagaaaggctggccagtcgctctcatttttataatggcttcgcgcattgcattaactctgaaatcattaacatcaagtggattccccgggcccggcccagctactactaaatcccaaccctggaggtcaatgccgctacagattttttccacatgagcaagtgcgcccagtgaagagaaaagtgttttaaacatggcagtaaaagcatcattaccgtccagtattaatattttcttgtcagcgaaagaatatatacgattgtgacgcttttcaggatcacttaaccagaatttcgaaatcctgttattacgttcgttcagcaaagggcgaaccttaggattatcaccaagctttaattttttaaggctggcaggtgtcactttctttttggccggcaaactatcttgcgtcaatgcagcataaagtgattgcgctttactgcgcgtttcttccgcttcatccaaaggcacagagtcacgaactatagttgccccaacgccaatctctacttttccatcagcagtcacttcagccgtacgaatacaaatagctgagtccagacggggattatcatgtgtaccgtcaaccagagctactacgccgctataatatctgcgcccttctggctcgtaacgggcaatgacctggcaggcattttgcactggactaccaatgatcgttggtgctggtaacgtttcagtcaatatatccgcaatactggctttcgtttttccttttaagacatattcagtgtgaataacctgacttagttgtttgagtcgcaagtcgctcacctgcgctccacgttcacacagcctggacattacttttagttcctcatccaccaccatgtaaagctcattggtttctttctgattggtgaggaattcaagcagagcttcgattgtttcgccctgttctggataacgtaaagttccgctgattgggttcatgcacatctcaccattatctagtgatgcatgtaactctggagatacaccaataaaagcctcatcaccagtgttaattaaaaaacaccaatatgcggaggattcagtctgcaaaaggcgtcgaaaaaggctaagaagttgtacaggatgataatctacaagcgaggtacgtagcttacgatgaagcacgaaattcgaacctgctccctgcccaatttcatgttcgattaactgactgatacgttgcccaaactgtatatcgtcaaggttaaagttagtgtttcgtgaccgaaataggcaaatccggtagcctgctaattacttctgataatggcaagctttgacgcgcagtgattggcatcgtcagaatcggtgtttcatcattgatagcgtgatagccacgtttggctacctggcaaaatggaacaactaaaagcttaccgtgatggctatctgcgctaagagctttatccagggagtgtgtttttccgcaagtaaggtgcaaaatttcaacactatccatcgagactgcgggccgatacagtaaagcataaggtttatggggctgtgacagaatgtgtgtcagggaatcagacattgtttaccaccccatcagttgagattattttggcgcaattatcagcaaggtaattgattgcctgctgatgtccggctagtgagaaatcagcaattccatcggctgtgacaaagggtttaatatcttgcgtaaaagcgtcaatagcggtcgcagatatacctactgacgcataaatgcctgtaataattaaggagtcacgctgatcgttctttagcatttcggctaatggagaccgataaaaagcactgtagcgccatttagtcaaaactgtatcacccggagaaggtgtaagctcagtgataatcttccgctcatcctcagtcgtcctcattcctgggccccataaatcattcagcaagccgcgctgttccggagtcattccacctggctgcgcactataaaataccggtatctcatttattcttgcccactttagtatcagtgaaattgaatgaataacagtgtcgacaggttcacatggaagcgcatcaacaaaataacgttgcatatcgtgaactaatagcgcactacgttgtggttctatattccacgccaaaggctgttcatcaggtataatgatattagataaactataggactcagactttaaggttctgtacatcagataactcggccttttctgaaaaagtttattacgcgtgccaaatgaattaatagaaaatttaatttcgtataaatgtaaatatcgcgaaaaaaaattcagtattaatactggcgatagaattcttacagaagttagctggctataccctcacgcttgatacgtggaacatctatacctaaacatttcaattgagtaacaggattcataaattctcgattacgaacgataagaccattacgcaattcaaatgaatgaataaaatgattttcataataactttcaggatatcccgggaagcgaattaaccctcggccgtcacattcaacccaaacatggtcagggttgtcggtggtgaagattttaatattataccactcccagtcaggaaaacactcaagagaccatttagcatgcttttctaagttctcaataccgcgtataattataggctcaccagtttcagtggtccataaaccgccttcgccatcttcagcaaaaagctcatgccttttaagacgagcaatgccgcgagtcgatgacaaatactgagatactacttgacggttaatttcacgaatacggattgcatcttcatcagtcagatacatatataaacctcatttaattagatcaacgcgaaaccccacaattgatgatgtttcaattaggttaatgggatgttgaatgtgtcgattttttaacattcaaaatcgtttgagtcaacttcactaatatatttttctttaaaaaataagttggtcactaaataatctaataactataaaattccaaaaaaggaaattttccggaaataataaatactttttaaaccggaaaaatcgcctttgaagcaagtttattgattattgctagctaaaaaactgtcaataataaccagaaaatcctttgcagaagtatatttgctgcaaaaatattgcttaaatactgtcaaaccattaaggttaagtaatggattaaaatgttaatggaaaatcctgtttcgtttgttatacaaaaggaggaatcatgactgatctagctggccctacaataaccccaaacttgcaattggtttacgtttcaaatgttgagcgttcaactgatttctacaggtttatctttaagaaagaacctgtattcgttaccccccgctatgttgctttcccgtcatctggcgatgctctttttgctatctggtcaggcggagaggaaccggtagcggaaattccacgtttttctgaaatcggcattatgctgccaacaggagaagatgttgacaaactcttcaatgaatggacaaagcaaaaatcacatcaaatcaatgtgataaaagagccttatactgacgtattcggtcgcacttttttgattagtgatccagatggtcatattattcgggtctgcccgcttgattgagattattcttaacctctaaaagatagaatatctcccttatctttgtgagtgtatactttcaaatatgaccgttattataggtaaatgatggcggtcatatttataatgcaaaaagcagatgttgaatcagtaccgttattgggttaagaaaaatcacttattttaccggagcaatttacttactaccctgtacgtaaatgccggttctttatgcggagcacatgtgttgtctgtcccagagcagacataataaaaaatttatgaagccagataattttggcctgattcaaccgagatcaactgctgtatttcatacttcaatcgtttcacggtgtgacccgatatatgcttaagagtgcctggtacgcaccctcccccacccattttccattctttccttttctgtcagtggtttacgagtaaattgccacccggatcgcctgcaaacgctctgctgtttatttgaggctgaccaggttattctccgtatgcggggaaaaagcccgaaaaccgatccggaccgaatcctttatggatcgatttattcccgtggttttcgctggacagacatggaaaatacgttccacaccgccagacaacggagattgaaagtttgggctctttaccccgcgaactgacgcagatttcgcgtagcgacgtcactggtcagaacgtaaccggatccggcgccgcgcgctactttgactacgaaagcgccgtagcgctgcgcaacctggccgccgcttacggcaccgacatgccgcgctacctgctcgctcctgaggtggccgtgctgctgtcaaaggtccctgatcttaagaagcggctgttcatcgataccctgtggaataccggcgggcgtctcaacgaaatcctgccgctgacgggggggggattttgtgctggacgatccgctcaccggcgccccgctgagttcaccgttcgtggtgctgcgcaccctcaagcagcggaagctggaagaggcggcccgcagccgccggcgcgggcgtccgacaaaggaagagcagctggccgaacgtgaaaccgaggcggagatccgggagaacccccgccgcgggcggtgccactgaccaccgatccgggttttgtgcagcggctcagggaatggtttgcgactgcgcagctgccggcaggcagccggctctgggatatcaggagtgaagacacggcgcgcagctggataagccaggctgtggcgtcggctgcgcgtgacggtgtgacgttctccatccggccggtcacacccaagacgttccgggattcgtttgcgatgcatctggtgcagcactaggtgccgcagaaggttattaagaccctgatgggccacaaggacgcaaagtcaaccgagtggcacacgcgggtgttcgcgctggacgtcacccgccagcttggtgtgcggttcacgatggatccgcaggaagccgggcggctgctcctgccgcgttagtatgaagcttcatttccagtcaggtccggaatgatcgcagcaaggcttcggggataaaagtgatgtttccgcgtgcccgtgagcaggcgacataaagtttattatgcgcacttctgcagatggccaatttggtagtgtcacttgatagcagaaatggcaagctatcaacttcagatgggaagggatgaagacggtcaggtgaaagggtatagccggtgcatcagcaccgggtttatcctgccccgaaggggctaccgtcctggcagttcgcgcgatgcaaaaaggcagctcaagcttcctctggttcgcttatctcaatactggttatgtgcagtccggcatgtgacatcatgctgaccagcttatcaattgaaaagcagttgatccgacctcctgccagctcggacactctgggctgtgaaacgcccagcgcagcagcagcagtggcctgattcaggccattacgtttaatccagctattcaggcggcctactaactcggcgcggagtttcatattttccgcctgctctggcgtttcgctaagagcgtcccacacattatcaaaagtctgaatattcattttttacgctcctcaaccaatcggcgataacgatttcgggcaagttctacgtcactctggctggtcttttgtgtctttttctggaaacagtgcagcacatacacggcttcttcaaatttggcgacatacatgatccggaaaatgccgtcattaccccggattcggatttcacgtgctccctgacctaccgtagcaaaatgcttccagtcgtccggctccagtccctgctggatcaggtcaagctgataccctgatgcggtccgggcctcttccgggaaagcccgtagatcctcaagactgctgtcaataaaactgattttcttacgcatcatcacctcattatacgaaatttcgtatattgtgcaatttctgcattactcatgcaccccatacaaacccgtaaccactgcttccctaccatgtagtttcctgctgttttgtccatggcctacattgccctgataaaatccagcatcgccttgatccggcgctggcttttgagacattcttcaaaatcgttgagatagtaagccggtgtatagcgcacccggttaaactccagcgtcagcgtattaccggtgacaacctcagttgcaatgcccagcagggaaagctgtataaacgccatatccaccgtgataggatcaatatcaaatcaactgacggacatctgaactgatggattaaatccggcttcaatcaggcaatctgcataaggtagcatcggtcatgtgggtgtaattaagcaggcggaagtaacgcacaccgatacgggcataaatgtccgttatcccgccgcagtacatttctgcaaacatgaacgtttcacagtccccgtttctcattgcatgcctgtttcagcggatagagtctccccagcgcatcagtaagcgatgaaggagatgggcatgcccgtctcagagtgcatgatggtggctgcgcatggctgggatgtgggtggagcaaaacatgcaggcatgaaaactgcatttgttacccgcaaagggcaggcactctacccactagcacctgcacccgatctgatggtcagcgatataggtgcgttagccactaagataaaaccgctctgctaaccagccgttacctgttaatccctgtacgcgtttagccttaatcgctgcccgaaaaggctaagaaaaagcatagttgatgcgaaaacactaacaatattcttaaatcagggcttaaccacgatacacagcaggccgatgacaataatcactacgcccgccaggctgtgccagctgaacgcctcatggaataccggcaaacagacagccaccagccacaccagcacataactgaggctgagcagcggatagacgcggttcagcggaaaatagcgtagcgccctaatccagcagagcatcgaaattccataagcacccagcccggccagcagcagcaatgcgggcagcagggcaacagcaggcagcgatgttatgctgctgacatcgggcagtcgcggcatcgcccagcgcatcatcagctgtgccgctgagaccagcagcacgctgcatgcgacccatccataccctttcatagctggctcgccatcagcgccacacccgtcaccaccaatagcgtgccgaagatctggcgcagcgtcaggcgctcgcgccagaggatgcgtcctgccagcgcaacgaaaatgaagttaaggctcagcatcggataggcctggctgacaggcacccgctgcagcaccagcagccagagaagcatcgcgacacccagcaacagcacgctcaccccaatccagcttaagcggacccggcgcgatgccgcgtgagtcgcctgtttctggcacagttgcgcgctgcaactgagcagactgaccagtactatcagcagcagcatcacttcatctgactgtaatagaggcagaccagcctgccctggcgatagacggcgtccggcaccggaacatcctcgccgatatcactgtgtactgaatcaaccagcaacagcagtgatacgcttcccgtacggcgatgatcggcaagccagccgccgaagtccgcctgagagacaaagcgggattgcgcatccgggtaactcagcccatattccagctcgcctttagtgtcatagaagccgatatcgctacgttgcagatgccaggctgcagcagatgccacgccgggattgtccgccaggataaagtgacttgaggccagacgctggctgatcgtcgagacaaaactctgcggctgtttggcgtcgcggattttatccgggattgccgtaccaataaacagggcgacgcccagcgggcaaagcgcggccgccagccagcggcgctgtgcagagcggcagctatatgcgcccaccagcccccagatgaaaaatgccagtgcccccagcgcaagcttcagcatctcgtgcgtggcgaacagcggatgatgcgtcacactccagggagcgagcaccagcacgaccgttgccagggtaatgatgccgaaaatcaggttgagccagccattgactgttaatgcgcgccctgcccgctgtgcggcgttcaggccatagtgcgccatcagcagcgacagcggcacaaaacagggaaggatataggttggcagcttgccttttgccaggctgaaaaacagcagcggcatcaccgtccagatcagcagatagagcgcaccgggatgctgctgacgctcgcgccagccggtcatcaatgcgcccggtaacagcgccagccacggcagcgtttcccagcagcagaaccggcaggtaataccagaaaggcgctttgtgctgggcattgtcctcagcaaagcgctggatatgctcaacccagaagaagtagtgccagaaatccggtgcctgatgatagatcgccagcgcccagggtgcgctgatcgccgcggctgagagcagcgccagcggaccgaagcagagcagttcgcgcagtcgctgccgccagatcgcccaaggcagaatcgccagcacaggcactgccagcgccagaaagcctttggtcataaaccccatgccgcaggcgagacccagcagcagatagccgcccgcccgcccgtcgcgtccgctggcctccgtcgccagccagaagctgcacatcgcggccgccagccagagcatcagcatcggatcgagcaccgcataggtgccaacgccatagaccagcagcgaactaaggaaaataatcgtgccgacggcagccgtgcgtaccgaaccaaacaaccgcctgccgagccagtagatcagcacggcggtcatcgccgtggagaatatcgatcccgcccgcacgccaaagttgttgtggccaaacagccactgacccagcgagttgatccagtagccggcaattggtttttcaaaatagcgcagcccgaagaagtgtggcgtcacccagttaccggttgccagcatctcccggctgatctccgcataacgggtctcatccggctgccagaggtcgcggaacatcggcggaagcaggtaatagagaataaaaaagctgaaaaaaagtagccacttcgtgttgttatgtatccgcactagttcgcctcttcagtcagtttctggcagcccagccacccttcgcgtccggggatttcgcctctgactactttgcccaccggcaaggtgctcagatcgtcgggcagcagctcgctcaacggacagaactgaatgccttgacggtccgcagcagccagcagctggtgaaagtccgggtagccgataatcccttcgacttcggcatgcacggtgtagaccgccccatcgtcagaagagagcattttccccagaatatagtcgttatagccttctgcgctgacctcgcggccaaccacttcatcccatgtgggcaacgtcaccggaatctgtacggtaccgatctgtccatccggcagcatgggccggaacgggccgctgccgcgacaatcgctgttgtagtgaaagccaaaatcctgtttggcggcgatcacccggccatcggctcgccagcccgcgacggccgaacagctgacaggatgaccaagtatctcactcagcgtttcggtgccgcgtgctatctgctcaaccagcttatcctgcggccagacgccggcccaggtctgccaggcaaaatggtcccaggcgtgcagaccgacttcgtgctgacgagtggcgtcctgcatgatgtgccgcaatcttcgtcccatctgctttcccggccaggccgttccggcgagcaggatgtcccagccatagagcgacgcggcacgggagcgcagcatcttcataagaaacgccggtttcaccagccgccagagatggcggcccatgttgtctggtcccacgctgaagaaaaagctgccccgcaccgcatgacgccggaacagctcaagcagcgccggcacgccctgcttcgtgccgcgccaggtatctacgtcaatccgcagaccgatcttcttcatcacttatcagcctgtggctcaacggtgcgcaggaagaagtcgagcgtgttgtcgatagtgacatccatcgtcacggtcggtgtccagccgagcaggcgacgcgcattgcggatagccggtttacggtgttccacatcctgatagcctttgccgtagtagctgctgctttctacttcgcggaaaccggcaaacggcgggaaactgactgcgcagcggatgacgttcaaagctggccagcagctgctcggccagctctttgatactggcttcgttgtccggattaccgatattgatgatctgaccatcacaattcagctgtttgttttcgataatgcggaatagcgcctcaacgccatccttaatatcggtaaagcagcgcttctgtttgccgccgtcaatcagcttaatgggcgagccttctaccaggttaagaatgagctgggttatcgcgcgggaactgccgatgcgcgctgcattaaggttatccagacgcggtcccatccagttgaacggacggaacagggtaaaacgcagcccctctttttcgccgtaggcccagataacgcggtccagcagctgtttggataccgagtagatccagcgctgtttgttgatcggcccgacgaccagattagagcaatcctcatcgaagctggcatcggtacacatgccgtaaacttctgaagtggatgggaaaatgatgcgcttctgatacttcacacagtcgcgaatgattttcaggttctcttcgaaatcgagctcaaacacgcgcagtggattgcgggtgtactcaattggcgtggcgatggctaccagcggcaggatgacgtcgcattttttgatgtgatactcaatccattcggaatggatagcgatatccccttcgacgaaatggaagcgcggatgatccaggaagcggctgatcgcgtctgaactgatatccaggccatagacctcgaaatgctcatcctgtaacaaacgctcagtgagatgattaccgataaagccgttaacgccaaggatcagcacgcgggtacgacgttgcagcgctgactgcggttttgaatagagcagtgcgccagggacgatgcccagactctgcgccagctggctgccattcatgtaaacgccatgctcggactggccggtctggatttccagcgcgccttcgccacaggcgatcaggaatggctgcttagaaagtaccgtccctggctttgcctgatgctgctgcggatgaacccggctcttccagacgataaatttaaccgaaccggcaaaggcgaatgcgccaggccagggatcggtaaccgctctgaccagattgtgaatcgtctgagcaggctgattccagtcaatgcggccatcctcggccgtgcggcggtcaacccgggtcgcctgacgctcatcctgtggccattcactcacctcaccctcgcgcagacgaggtaaaacgtcgccgagcaactgctctgcagcctgggtcagtttacgatgcagcgtcagcgcgttatcctgatcctcaatagcgaccttctgctgcgccagaatattaccggcatccgcgcgctttaccatgcgatgtagcgtaacgcccgtttcagtttcgccgttgaccagcgcccagttcagcggtgcccggccgcgatattttggcagcagcgagccgtgcaggttaaaagcacccttttgagcgcattgcaggatctcatcactcagcagatggcgatagtagaaggagaagatcatctctggtgccatggtacggatgcggtcaagccagatcgggtgattcgcctcgtcgggtgcatagaccggaatgccatgctctgccgccagacgggctactgagccgaaaaagtggttttcggtcgccacatcgttgtgagtaaaaatggcggtgatttcatagcctgcactcagcagcgcattgatgccgacacagcccatgtcgtgataggcgaaaacaacggtcttcatgattgaatatcctgtactgaaggctcttctggagcgtgaacaatgcgttgaacgaaatagcgcggacgtgcccgaacgtcgttgtaaatgcgcccgatgtactccccgagcagtcccatacccacaaactgggcgccgataaacatgaacagcacggcgaacaacacgaagacgccgtcacccgcccaggctgcaccaaaaaagagtcgcaacacgatcaacaccaaagagaaggcgaagccggagagcgctatcaggctgccgaccacgctgagcaatcgcagcggcgtggtggtcagacaggtcaccaggtcatacatgagattaatcaggcgcataaagctgtatttcgaatcgccaaaagcgcgctcggcatggatcaccggcagctcaatggtgtgtcgggcaaaggtgttggccaggatcggaataaaagtgctgcgttcgtgacagttgagcatcgcctcgacgatgtggcgacggtaggcgcgcagcatgcagccgtaatcgcccatcgccttgccggtgacccgctgaatcagccggtttagcgtgcgtgaggctttacgacggaaccagctgtcctgccgctgctgacggacagtacccaccacgtcataaccctgacgcgcggcgtcaaccagccgcgggatctcttccggcgggttctgcagatcggcatccagcgtaataatcagatcgccacgaacctggctgaatccggccatgatggcggaatgctggccgtagttgcggttgagcagcacacccgttatccggctgccgggaaacggtggcggcctgttcaatcagttcggcagaacgatcgctgctgccgtcatccaccagcagaatttcatactcaatcttaattgagtcacaggcggcacaggtgcgctgaagcagctccggcagactctcctgctcgttatagaccgggatgaccacggagagcatattgatcggtttaatatcgcgcatctcaggctccggcaatgtcatgtaaagcctgaatcacacgttcgacatcctgatccgtcattgacggaaacagtggaatcgaacacatctgctggctgttaagttcactggcgggaagacgtaaatcgggatagtgctcgcgataatatttatgggtatgcgccgcacggaaatgcaatccgctgccgatatcccgcgtcttcagtgcctgcataaaggcatcgcgcgacagaccgcagcgctgttcatcaatgcgaataataaacaggtgccacgcatgctgatgtggccaggcgggcagtgacagcggcgtgaacggcagcgtgcgcagcgcttcaagatagcgttcagcaatctcacggcggcgggcaataaagcccggcagtttctgtaactgcaccagcgcaatcgccgcgctgatatcgggcagattgtatttaaagcccggcatcatgacttccgcctgcggcagacgcccctgggtatgacgatcaaacgcatctactgccaggccatgaaacttcaggctgcgtatacgatcggcgagagtggcgtcatcggtcaccaccaggcccccttccgcgcaggtgatattcttgatggcgtggaaagagaaaatcgccgtgccgcgatgcccgaccggtttttggcaataagtggtgcccaccgcgtgagccgcatcttcaatgatggcgatgccattctgttgagccagttgatagattggcgcgagatcggcaggtgcaccagcgtaatgcaccggaataatggcgcgggtgcggggcgtaatcgcctgcgctatccggtccggcgtgaccatcaggttgtcgggatccacatcaatcatcaccggcgtggcacccagaagcgtgatcaggttcagggtagagacccaggtcatggacggcgtgatcacctcatcgccaggcccgatccccatcgccatcagcgtgacatgcattccggcagtggcagagcttactgcaatggcgtgctggttgccggtcatctgaacaaaggcctgctccagttcggcgcattttgccccggtcgttatccagccagagtcaaataccgctttaacagcagccagctcttcatcaccgaatgaaggccgggaaaatggcaaaaaatccatgctaaaactcctgcagatcaaacccataagctgtcgcgcgttgttaatcaggcacaacgccagaaaataattgaaatagcgaatgactcacagtcggccagggtgttatcgacaccacgctttcccgttctggaattaaggttaccggactgctaatacaaactaccgtatgaaagttaactgaacattaaatgaagagtgtgaatttaaataaaatcaagggagagcaagttaaggatttcagaaaaagttcactattaaatggctaataatagctctggcctcaactctttttgatttattgatattttgtttaaaatcagcaggctctgttagtcaccagagcagggttcagctcatccggatgaagtcacttctggagagaaaaattaacacgctgatattgctgggctaaattcagcctgctactcacagtatcacatcgaaaaaaatagcgctccgctcatctcaggatgaatcacagattaataaagccgtcttaatgtattcttaatatttttcgttattaatgttctgcccttgcaataatcattacactttggtgattctcaggtgacagtcagttaatatctgtcagattatctgtgcctgtaaggtaaaaacagtgctaaaaaaagtgaataggatcgcggtttcaggcgttaacgttgggtctgcctaaaaaagagaaaatagtgatgatgcgtgccgcctgtttatgcactctgttagccctgctcagcccggtactttacgccgcgccggtaacctatgccattacccccgataaaacgtcgataggcctttcatggcgcgcctttggtcaccaattttcgcaggccagactgcagggtgtgaccggtacggtgacactcaatcctgatgaagaccgtgacgatcatattgaagtgactattccggtagggacgctggtggcctcgaacagcctgttaacctggcaactgaaaagtaacctgttttttgatgcagagcgttacccaaacattcactttgtcagtagtcgcgtggcctcactgggtggcggcaattatcgtatttttggtgtgctgacggttaaaaatgtcagccggccagtcgtgatgctggcctcgctggacagcggaaagacaattgatccggcttcaggtttcgctggcgctacatgcctccaccgccatctcccgctcagccttcggaatggatcggctggtcggggtggttgatgatcgcgtcaacattgcgctggccattgccgcgcagggcagaaagccgctgtagcggtaaccgctgaagggtccgattaactgagtgctgtctgcaatgtttccgctgtggcagccagttgagccggtgggttgcggccaatcagcacatactgatagccgtcacgcttccaccaggccagttgcatgccatggcgcttttcatgggcgatgggattcgcgctgtccggctcaggcgagatacagagcgccatcgggccataatcagcatgcagccaggcgatttgtgcaatcgacgtccgttcgtagcgcaggatccgcaccattttcagttcagcccctggcaggctgagttgctgaggatgcagctgcaatcctaaatcgagtcgggtacggtccagccccctttgcagcatggcggcgtcatcaggcgtatcggccagcgtttcagcactgtagagcgacatataacgcgcctccagatcgcggatattctggctttcatctttctcatcatcttccggtcttgccaggaaaccgatgccactgcccaccagcaaaaagctgacagacgcagcaatcagtgcccgacggctgtagccttttgctggcattgactctggtgccgtgatggctgccagttgctgtgccattctggcctgcggtgcctgttccagcagcggcgcaaaagcctgttcaaaatcgagattactgtgctgtaaatgctcaacccgtgccgccagttcgggatcccctgccatcgcctgctcaaactgcacggcttcctgtggcgtcatctcaccatccagccaggcaacgattgcctcatcgcgccacggtggcgtaaaagtttccctgttcatctccgtttctcctgcggtgcgggcgaggtcgccggctgtctggccagcgtggcacgtgcggcggccagacggctcataatagtgccaatgggaaccgagagcgtctctgccgcctcctgataggtcagaccttcgacatacaccagaaacagtgcattacgctgcgcctcgggtaaggcgttaacctgtagcataatgcgctggaaatggcggttgtcgtcgctgttggtgtggttgtctgcggccagcagcgcatcgggatccacgaatccctgtccctgccggacctttcgcgcccgtaaatcactggcccagatggagtgaaggatcgaaaaaagccatcgatcaatgcgtgtgcccggcgtgaactgcgcgctgcgttccagcgcgcgtacgcaggttgactgcaccagctcttctgccatgtcacggttgtgtgacagcacatagccgtaacgccagagccgcgtcagatgttccgcaaggtgctgacggatgtcactgtgagtgatttttcgctcctccctgccgcatcagacctcggggtgaccattgattgcggcctgcagatcgcggtactcctcgcagtctgtgccacaaatcccggcaatggtttttaactgttcacgcgccagatccggacgccctttgatcatccaggcttcgcccagatattcacgcactttagcgtaacggggatcaagtgcaatggcgcgctgataatagccaatgccctcgtccgtgcggcccagtttacgggtggcgtaaccacgatagttccaggcttcacgggtatcctgatttttcagcgtatccagcaggttcagcgccgcctgatattcgccctttttcaccagatgccaggcatagcgggttttatcgtcgtcactcagcttgctggtcttctcaggcacacaacttttagtgtgactgtcatagacctgacctttggggcagtcaggcgtcttttatcactgtcattgtcgcccatcgccatactcagcggagagtgcagcatcagcagcagtgccggaacggcaagcagagaaaaaccagaacgcgttgtcataatttatccttatcgggtctatgagacaggcgataaagcccgccggatgcagtccgctagcgcggcgctgtacggtaaacagctccgcgccggtttctattcgataaaaataaaattattttttgccagggtgccacgctgaatcagaacggtagtttttccaccgcacagaaacgccgttccgccagggagatcaccgcagcttccgcaatcgcctgggctttcagtccatcctcaaggccaggaagatcgtcaacctgctcaccgttcagcgatcggataaacgcatccagatgagcatagtaagttggctgcacccggctgaaccagtcgggcaacaagcctggctgctgaatctgcgcaccctgatagcagctgacgccgcgctgtggctgagaggctgattccagcatcccgtgcggtcccatcacactgatgcgttcatcgtagccatagccggtgcggcggacattatcgagctgtgccagcgccccgccctgcagccgcaatagcagcgtgctggtgtccacgtcgtcaaattcgctgatcgagggcagagccagcgctgcacccatcgctgccacctcggtcacctcctcttcagtcagccagcgcaacaggtcaaaaaagtggatagcctgatcgcgcatctgtcctccggacgcctgaagataggccagcggcggcatggctgaggagcggcagaccatctgaatcagttccgccgggccgatccgcccctggcggagttgttgcttcagctgctgatggctgacatcaaaacgccgattaaaccctactgtgaccggcacgttgtaggggagaacattagccacggcagagcgggcccgctcaagagagagatcgaccggtttttcacagtagatggctttaccggcgcgggctgcggcttccagtaagtcagcatgggtcggcgtcgcgctggcgatcagcaccatatcaatctgctcatcatttatcgcctcggtgacagacgcggcccgggcaccaaagcgggtcgcaaaggcggcggcgcgcgcgggatccgcatccgcaacccataccaactcaactccggggtgcgcctgaagattcgcggcatgaacttcaccaataaagccacaccccagcagggcaacacgttgctttttattcatttttttgaactccatcatagtccggcagaaagatgcatctgcaggataacgctgcgttttacactggcggcacggtgttttgaggtgtttacctcacaggagatcggcatgtcgctgaaagaggtcgcccgacgggcaggtgtgggactggcaaccgtggatcgggtgctcaatgaacgtggcggcgtcgcgccggagacggttcacagggtgctgcaggcagcacgtgaagtcgggctgaagcggatcctgccggaggagcatcgtcatccttggcagatagaactgctgctgagcagcaacgattcgtttttctttaagcagctggcacaggattttactgaggttgcctcgcatctgggctatcgccggttaacgctgcgccgcacttttgtccccgaggctcagccagaaacgtctggcaaagcttatcaggcagggcggtgagacaagggatggtttgatcgtttttgcccatgaacatccggcgatctatgaggcgctggaccattgccaggcgcgtggcgtaccggtgatctcgctggtcaccgatttacccggtgccgcccgactctgtcatgtggggatcaatcagttgcaggccggacgtacagccgctcagctgatgggcaaaatgctgcatcaacccggtgaggtgttgatggtcagtgggcaccgggattacagcgcgcatcgtcagcgtattgaagggtttcgtgacctgataaccagtcggtttccccatcttcagttacgtgaagttctggccgcccaggaaaatcgcgacaccctcagtaagttgctggagaagcagctggttcagagctgtcatctccagggcatttataacaccgggctggggaataccgagatcgggcaggcgctggcacgacatcgtcggctgaatcagtgcatctggattactcatgagctttacgccaccacccgcacgctgatggcgcagcagagcgttgcgctgacactggatcaaaacacccggcagcatgcccagctcgcgctgcagctgatgctgaattatctggagcagggagagaaacccgatatctacattaacggaaaagtggatttcatcatttatacggcagaaaactgtctctaaagattgcccgttgtgtcatatccaccggtaaagaaatatgctttacctgccgtcgatcattgcattcagcactatttcccgcgcgagacagtgcccgggaaagtggctcactggctcagaagtgcatagaaaatagcctgccacagataatctgatcgcagtgacaagctgaaaccgcccctttatgtcagataaaaaatctaactatcatctaaatattaaaatataaatctaaatacgcattttttatggttttaatattcagatgcagagtgatgacgttaatatcgtatccgactgaacaaacagcgaagtgaaacgggtgaattaatgtacgacagaggtgcggaaacagagcaggaataacactcgctgtcctgaacggttaaccattaaaagcgtactttgcagaattgatcaatatcaaaacttaatgggtttttatcgtcatatttctattgggtttcactttctgccaggttgatgctaagttctcgtcggtttaaaacagggcagtatgaagaaccgtttcactgatattacggccaccctgaatttttcctgcgccagtacggtgcctgactaattaatgagcgtctgatttggaaaagtgtttatatccggtgcgtaccagaactgagagagtgctgcacgcggtggtattcgaagttgtcgctaatgtgctggttttctttatcctgattatttttacctccgcagcaccatcgcagtcgttgttgcttacattggtctcatcgactctggctatgggatggaactacctgttcaacctgatgtttgacagtgttcagctaagaataggatttaaaaagaacttgcgaatgagatgcctccatgccgtttctgtttgaggcgggtctgttattagtgttaatcccctttgcagcatggtggctggatattacgctattctcagcgttgagacttgaatccggactggtgctattttttctgacctatgcttttctgttcaatttgttatgggattggggaagatcagcaaaatcaatgaagatattaaattaatgtatcatgccattaaaatttactttcagaaattaacctttcgcttagccggctaatggaacttcgcgtgcgagtgatcgcgcccgaatgtatccgatgcgtaaggaaacaagtatatccggtgtcaggagccgcttactctcgcctggcagcattgatataacggcgcgtctgcataacttaagttcagactgcgtataagctcatttcacaggttaaatcagcaagaatattatggacaaagtctactatctgaataagttaaggaactgcccgtcaaccgatattctggatatcgtaacaagctatatgcggaaaaaactgcctggtgacgacctctcttcatttgaaggcgcttacgatcatcgtaaagccgaactaataatgaatgaaacctacagtgaagttccttcagaagtatggagactggtgtgctgaggcgaaaaaaggagggcaggatcactcataacctattatctgctgagggctgatcaccctgcagatcatcaattcctgataatcctggcgcgatgcattttgatctccgtcgggcagaatcggtgaacagataaatcagagcatcacctttagtgctgtgatgctctgtcattctcaacaaacgcacgacataaagcgctgtaagaaatagtaagacaaacctgccagaccactgtaaaccgttttaaatatgacgccaaaactggcttcatctgttgtattcagaaaagctcgtacaaataatgccttccggactcacacgactacgataatgattatctgttcaggcgatatgctgccaatttagctcatgctccaccagcaccgatcacggaacggcaaatcgtgtcagggtgataaaaaaggctgctcagtcgttaagcaagggtgtattaagctgattcagatgatgcaataccattaaatttaaatgttgttcgcccgaacagggagcatgcaggcgaacaaaacgggaattcatttcagatggtcacgatgatacagagcccactgctcaatcctttctccagagggtagcaggcaatatgccgaagatttttcctggacctgctgaccaccgcgattaacgcaatattcactggctggattacgcattgttaaacgctgcggttccttgctgtttcggtgtgcaggcgataagtagtgaagccagtaacatcagtgaaactcctgctaacctgtttgtgacggtcataaaacctctcttaaccttatttttgtgaattaagcatttaccctccagtggtgtgattaagtctgatagcacaacaacgactttatcaggaatcctcctttctccggccacatgttaacctcaggggtgacaatcatcatgtttccattctgccgtccactctgcactcaccactgcgggtagcgatacataattatagcgtgctgccactaaaccctcgcttaacaaccttacgcgacacataagcagatagacctttaatgcagtgattaaaaaatgaataaagccaaaattagaatgcatgtgaagataattaacaaaaaccccattattacaatcgatgcattatcttaattttaatggaaattcctcgcgaatagggcatcgcctttaacgtttacttaaaacaggcacacttgcgatgcctttacataaatccttttcccgctgcataattccgcaacatttgtatgcgcactgccattaatgggatcagtaaaacctacaacttattggtatcgcttaaatatcgctgctgcttaacacctgaataacaactcacgattcaggtgccatttaacgatcacactatcaataaaatcttaaggaagagtgactgagatgaataataaattcccgcgaaataaaatcgcaaaagcattaatgctggcaagtgggatgggggttgtgcctctgattagctatgctgcagtcatcggaagccagacagacaatgagatcatcttaactgatggcaccacgctgattgccgaccagtcatctggcgacggttattatggcatcctggttaatggcgctactgccgcaacggttaccatcggcagcggcagcacagtttcgcgtgacagatgctgaacgttatgcaaaagggatttttattgaagcggcaaacagtgaatttactgcagataagttaaccctcaacgtttccggtaaaacagcggtcggcattgagttcggcggaaaaaatgtaaccgccagtttaggatcaggttcctcggtcaccacggtagcatcaggtgattctttcgcagagggcgtcgttgtcagcaatagttcctcgctgcaggcaaacaacctgcaaataagcacccagggcactggcggaacggctctgcgcgtcagcggttacggaagtcacgccagtctgggcgacgacagtaatttacagacgaatggtcttaacagtaatgccgttcaggttgataacctgaccggtgagtcgattaatggcgtggccacgttgaaagcaaatgcattgacgatcaacacccttggcaataattcgcagggtattaatatccaggataatggttcggttgatctgggcagcaactcgaccattattaccactggggatctttctgctggcatctggagctggggtgagctgaaggccgatcatctgacaatcagtactgcgggtgagacctctgcaggtctgtcaggccgtgacaacagcctgtcaaacattggtgccggtagcgtgatctcctctgatcagactggcggcattgtggctatgggcgacaatgccatcgttaacttcattggcagtgaagaagaacgcaatacggtctattcagcaggtttttatggcgtatccgcacagtcaaccggcgcaaccattaatctgcagaacaccgatattatgatgaaaaatgtggataccatgaccctgggtatttggtccacaagcggtggcacagttaacggtgatgcagtgaccattaccggcccggagaatgctacaggtgtctacgccatggctggtggtaaagcgaatcttacgggtgatttgaccattgatatgagctccccggatgggatagccatggctacgcaatatgatgaaggttatacagcaggtgtcatcaccaccgacggaaaagcgcagatcgttggtagcgttttatcccgggccggactcatcgacctcaatctgacatcgggttcactctggtctggcagcgccagcagcgataacgtcaataatggccatctgaacgttaatctgaccgacagcacctggaatgtatcgcgaacatccaatgtcgataatctgacattgagtaactcgctggttgacctctctgcagcctcggatgacgcaacctattcaacattgactatcgccaacctcagcggcagaggcgacttcgccttgcgcaccaatctggcaggcgatggtgctggcgtgaataacattggcgataaagttgtggtgacagagagtagttccggtgattacggtctgaccatacagaaccgcggcagtgccgtcaccactggcaacgaagtactgactgtggttgaaacgactgatggcatcgccacctttaaaggtaacgccgacgtggaacttggtggctatgtttactcggtcaataagcaaggcaacaactgggtactctcctcacctaaagcaccagaaacccctgaagcagatgatccggccgttatccctgcggatgagcctgccgcgactccagccgataacggtggcacggcgcctgccgggcaagacaacgcaacttcccctattaccagcacggccaacgcaggggctaacttcctcaacactggctatctgatgaactatgccgaaatgcagacgctgatgcagcgtatgggtgatgttcgtcagggtaagacagccgggaatgtctggctgcgcgctatagatggacggttcagcggctttgataatggcaagctgagccgtttcagcctgaactacaccggttatcagtttggggtcgataaacgtttgtccgatgaaattccgatctatctgggcctgttcatgggggtaactgaaggatcgcctcattaccaaaatggtaacggcaacatccgtttctgagcattatggcttctacaccacctgggtaaatgatgccggtttctatgttgatggcgttgtgaaagtcaaccggctaaggaatcagttcaatgttcacgatacacagaataaccaggtatccggtaacggtgtctcttcaggtctgagcggatcgcttgaggcgggcaaaaagttcagcttctctgatcggctggcaggtttttatcttgaaccacaactacagctgacagcaggtcatcaggatggtgcttccgtaggtgcgtctaatggtctcaatatcacactttcaagctacaaatcactgatgagccgggcaagcgtgctggcagggtatgaaatcaatcagagcaattacaaactcaacacctatgtaaaaacgggtgtaatacgcgagtatgccggggatgctgcttatgctctgaacggatcaaatgaacgtctttcctttaaaggaaatggctggaataacggcgtcggcctgagtgcccaaatcagcagccatacgctcttcctggaggccgatatggtagacggaaaacgttttaaccaacgtcaggttaatgctggctaccgttttagtttttagaatcaacgtgcagcaagcgctcgtataacaggaggtgttaatgaaaaaaacattatggatgctgctggccttgatctgctcaggatccgctttcgcacggcaggagtccaccatcgcagaagcaaaaaacatgcgagacgaacgtcatgttacccttaccggtacgattagtggacgggctgacgatgaccactactggttacaggactcaacgggtcgtatccgtattgatgtcaacgaggatgacgaagacgacaacggcttccttattggtaaaaaggtacggataacgggtgaggtagatcgcgatgacggccatagcgaaatcgatgttgatcggctcttcattctgaaataattccggacttctgtgtaaaaaagccagctatagcgctggcttttttacattcagggcaggttttacttttcgcgaaacgcttcctgtacgcgcaacagaggacgcaagagatattgcagcaggctcttctcgcccgtacgaatatcaacggtggccgtcataccgggaatcacccgtagttcctgactgccgcttttcgtcagcgtattattttccgttaataccatcacccggtaataagtatcatcgacgcctggcctgcgggcagccttactttcctcatcttttagcgcgcccgaactgatactttgaacatgtccggtcaggccgccataaatcgaatagtcataggcagaaatttttaccacagcttcctgaccgggcgccagaaaagccacatcagagggccggatacgggtttccaccagcagttggtcatccaatggtgtcacctccattattgcggcaccaggctggatcacaccgccaagcgtattgattttaatactgttaacaatgcctcgtactggcgtgcgaacttcagtacgctcaagcgtatcatggcggccatgggcagtttcctgcaggcttgtcatctcaacatcgactttggacagttcatcgttagcctcgttacggtagcggttttttcgctcggtaatttgcaattcggcatcattcatctgacgctcaagtttcagaacctcagtttttgacagcagcgatctggctgagagctgtcgcgccatttcaagctctttctgcagcaatgtttttgacttcagatagccttcaattgactcatttaccgcccttttgcgtagtttccaggcatcggtttcacgggtaaccagttcaggtactttcatgacctctggcgggaacacaagctcgctgccggtcgcttctgcttcaagacgcgcggcctgggctttcagtgccagcaggcggttagcgctttcgcggaaggaggcttcggcgcgcgtgggatcgattttggccacaacctgacctttttcaaccgtatcgccttcatgcaccattaactcctgcaaaataccgccctcaaggctttgcaaaacctgttcgcgggaactgggaacaattttggctgacccggttgtcacctcttcgatgttgaaattggcggcccagacgattaccagcaccattaacgccacgctgccccaggcaataaatagccagccttcccagcgatcctgacgggcggccctcaccatgtcactggctgtatgttcggtcaggcgcttttgatcaacgtttttatcaggggacaggctgctcatactgttacctcgccagattgtggctgacgctctgtgcttatctcaacgccagcatgtttcgctgcgttacgcagcaccgatgcggccgggatcttcccgctgtttaataaaccgataatctcttcacgcggcccatcagctactttgatgccttcatccatcacaatcacccgatcaacgtatttcagcactgccggacggtgggtcacgataatcacggttcggccttccattgccgggatgagcgcctgcaggatagtgcgttccgaccccatatccatccccgatgtaggttcgtccagtagcagaacatccggattcgacagaatggcgcgagccagggctatcgcctgcttttgtccaccggaaaagttttcaccacgctcactgacaggcataccaaagcccatgggatgggccgcgacaatatcactcaccccggtcattttggcagcggccatcagttcttcgtcgctggcatagggtgctcccatcaccaggttgtcacgcagcgaaccatacataaaacgtggttcctgattgaccagcgcgatacgagtccgtaattccaccggctcgacctggcctatatctacgccagcaatggtgatcgtgcctgttgtgggtggatatagcccaaccagcatgcgcagcagcgaagatttaccgctgcccattttgcccagtatggcaacccgctcgccctgacagaaccggacatctagctgctcaacgatggccggtaaatcgtctttataacgtaatgaaacgccctgacagacaatcccggtctggctgccctggggaagctgcacataaaccttctcattatcgcgttcagcaggggcctgcatcactttattgaggatggccagcgaggtttttgcctgctgaatacgcaatcccagcgcggcaagcgttgctatgggcattatggcgcgccccatcagggtcatagtggcaatgatgcctcccattgagatatcaccatcaccgaccagataagcaccccagaccagcagaataacggtaccaaactgctgggtcgtctgaatgacgcttgagcccatagtggcaaggaaccgcgatttcatattcactgcagagagttttacgctggcaacatcgtgtttagaggcgaccaggttttcagcacgcagaactttgatggtttcaagattatccagtgattcaataaccagaccgtaacggttactgcctattttcattgactcttcagcgtggcgtttcaaagggatctgcatcagcagcaccatcgccacgatgaccactaatatcaggatcacacaccagaccagtggcccggcaaccagatggattacaaccaggaagagtaaaacaaagggtaagtcagcaaccgtcgttaaagcggctgacgtagtaagctcgcggacgctgtcaaagctttgcatgacattgccaaatgcaccgctggattgggctcgacccgacattttgccgttcagcacgtgacgaaaaagttgtgcgcccaacaccagatcgatctttttaccggcgcgatcggtaatccaggcccgacccagccgtgcagccagttcaaacaacaacgccagactcacgccgatagccatcgtccagagtgttacgtaggtctggttgggcagtacccggttataaaccgtcatggtgaatacggacatcgccagaacgagcaggttaataacgactgacaatgcggcggcttcaaagatataacgtttgaatccccacaaagtattccagaaccagtgccctttaccgacatggacaatgtcatcggcacgatgatcaagataagacttaggtcgcagcagcagcaactcgccgctatagtgctgagccaggcgagcgaaatcgacctcaacaggctggctgcccagtgcgggatcgataatggcgcacttcttttcgctacactgtgtcagcacgcaatagcccgtttccagacgcatgatggcggggagaacaaagcttttcacatccgtcaggtcaatcttctgccaggcagcactcatgccgcggctctgcagcgtgcgcaatgcccagtcattctgggcgctgatatcagcgtctggtggaaatgcaggcatacccacacgtaaagcatttagcgtaagccggacgtcaaacaggcgcagtgcgctttgcagtgcaaccagcaaagtctcctgcgtatctgatggcgatctggataacactctgttttcagcattcagttcagagccagcaggctcaaattgtatatcagtcacaatggcgtcccctggacaactaattcattctggtctggcggcaaagcatgacagcggccagaaatactcgttttttacgtcagcgtgattagtgcaccgcttcgatggtattcgctggtaaagcgttaaccttctgcaccagttggctggttttacccagtgccgcaacgatgttccattgcgcagccagatactgcatctgctgctcctgataacttgcgagactggagtaatagtcggtagcaaacgagattaaatccgttaacgggcgctgccccgcgaagaactgcacttcccccgctttccaggttttcaacgcggtttctaactgtctctgtaatgcattgagctggcgtttcacgaagcggtaaggagacccacagctgatccagctgctgtttcaatgtccggagtgttgcatcctgatccgcctctgcagcaatgagtcgctgagtttcagctttggcatttgccctgccagccccaccatcccaaagattgatatcgctgctcacctgtaacgtcaccgctttaaacggttccatttcaccattgcgctttggactgtccatactcagttgcacactccatttcggcctgttccacttagaggccagatccactgcggctctcgcttcctctttacgctcgcgtgagaccgcccagttgggattttctttcagtacctgttgtgcctgtgccagtgacgcgggcaacagacccgcttttttcagatcgggcaggcctctggtgataacaatctcgtggttcagcagcgagctgagttgctgctgcgcctgtatataggtggtgtagctcatttcacgactggcaatcaccgaattgaggcgagtcgcaacctgattgatctcagaagctctgccgctatcaatactggcaatattctttacccgattaagcagatcctgcagtgctttaatttctttatccagcacagcgaccactgtggcattagtggctgcagaggtaaaaagagaaagcacctgctcgttgagattttcgcgcgtgacatttacctgagcctgctgcatggaataagcagcctgctttccggcaacgctcgcatcagtacgtccgtgatcgtaaagtaatttacttacagtgatatgcggggagaccggattattctcataaccgggttgacctgaatatcctgatgcgctgatacccgtgctgacctgaaaaccatcagcggcttttgcctgatcgatatcatacatagcaccggtgctgtttgataaagcagactttaccgatggatggtcggctgtcatacgaatcatttcaataaagtccgttgcatgggcatttaacaggggattaaaaaatagcaatcccgcaattaaaccatgcagcgaacatctggattttgtagtaaacaagtttttttccatagttaactcaaaataacaaataaagtgggatggctaattttctctgtcgctaattcaatcctgcgaccggaactgttttaaccgcccgacatgtcatatggcaacgttaattctgctaaaaagaaatatttagattttacatgctgctcacatgtctttatttatttttttcatctgtgcaatcagatctggggctcacctgatgggcctgccttaaacaggcccatcaggtgagtttgatgtgaaaaaaagctggcgatgaccgaagtcatcgccagttttctatcagataacgtttaagccatgctggattaacagcttgacagtggtgtcatcattattggtatagacgtcataattaacgccattttcagtttgtgcggctgaagccgtccattctgattttccaatattaacggtatcagttgcattactattgtttgaacttcccacatctcccgtaatatgtaatgtgttcgcttcactaccattatctttagtaatttcgagcacatcgctgacgctgataaataatgtctgcgccgtgttattacccagatggatagcttcaattccactaatttttcctgataccgttccgagttctaaatcgttattagaatcccagaccagcgtatcgtgaccttctcctcctttcacactgctaaaatgagtactgttaatgacgatagtatcatcgccctcttttgcatcgacggaattcgcgccgcgtgcatccagtacatcattacctgaagtgccattaagatcgtactgagcaggttgatactcaatatgcgtcgatcccgtttcagacgtcagtcccagtgtctcgttcagatcaactaagcggccttttattgctgagccatcgccgtcgcccacgccctgatcggtccaggtcacgtagagctgaccgcccgccaggaaggtcgcatcgacttcaacctgctcaccataggtcagctggttgatctggatctgctgacccactttattacccgcagcatcaaagtactgtgcgtagataccgctggtacctgcacccggcgcgatgtcggttgttgacaggaaaacggcaataaagctgccgtcagcctgactgaccaccctcgccatgtgctgatcgccagccgtcgtggtgttgatcaggaattcgctggtcagcgccgtaccgtctgccgcgtagatgcggccccagacgctgtaaccattctgatccggtccgctggtatcgttagagtcccaggtcaccacgtagttaccgttttgcagcgcactgactgcggatgacgcctgattgttagtcagggtctggttcgctacgaagctgcctgttacagcatgcgttgacggatcataaactgacacaccaacatcatatccggtggctttaatcgcataagtaatcgcaacctggccattttccagcgttgtaacagatggcaacggctcccattcaggaatgatggcatttgcgttcagggtcgtggttgccagcacggtctccgccgtgaccggcgtgccgtttgcgtcatactgacggccataaaccgtccagttgccgttcaggctcgcttcccaaaccaccagataaccgccgtcttccagcgaagtgatcaccggaacgcgcattttgctggcggcggtgctggagtccacattgtactctgcgccattagtcacgacgccgtttcacgttacccgcaccgtcgtagctataggtataaccctgacccttgatatgcgcaccggaatccgtgctccacaccacctggaaagtgccatctgacagcacggtaacctgcggcgtgatctggtcgcccgctgtggtggtgttcaccgtgaactccgccccgaccggctgacctttcgcatccagcagctgacccttgacgcagctgccggagccgtctccgctcgccgactgccacaccacgatggcgccgccgtccggcaggctggctaccgacgagaccgtctgcgctcccgtggtggtggtgttcaccgtgtactcggagtagaacgccgcatccacgtcaatcacgataccttcaatgccggttcccgagccgtccacgttgtccgactgccacgtcacgtatacgctgccgtccgcggtcagcacggcgtcaaagatgtgcgttgcatccaccgagtcgccaccggtaccctggttgccgctcgtggtggtgttcaccaggaactcgcgtcccaccctgttatcgttcgcatcaaagcgctgtgcgtagatggccgagccatccccgtcgccgccttcggagccccagataagcaggtagccgccatcatccagcgccacgccgaccggcttatactgcttgccgctggtgtagctgttgacgatgaagtcaccgctgccgaccagcgtcagcgttccggtggcggcatccacgcggtagtgcactgcgcggatgtcagagccgctggtgccgctgtcgctgctgtcccagaacaccacgatgctgccgtcgttcagggtgataacgtccggatagttctgggagctgtccgtggtggtgttcacctggaagttaccccccagtggcgtgccatctgcggcaaaaatctgcccgacaaccccgctgccgctggtgtcacccggaccgctggtggcgttccacacggtcacgtacatgccgccgtgcgccgcatcggtaaaggccgccatttccggcccgccggagctgcccatgcccttgccggttgccaccgtcacttcgcccgtcaccggctggttatccgccccgtagctgcgctgcacgatgcctgtgccctggtcttcccagctgatgatgtagccgccgtcggcggttgccatcgcacccggacggttctgcgcaccgctgtaggtggtgttcacctggaactcgtcggtcaccgcctggccgtcggcgccgtagcggcgcgccatcacaccgtcgccgctgttgtccagtccgttaacgttggactcgtagacaatcagaaagccgccgtcggtcagcgcgatcacctgcgggctgtcctgattgttggccgtgcgctggttcacctgctgctcggtgccgattttatgcacaccgtctgcctcgtacagctgcatgtaaacctcggtgccggaggtgccgtcaccctgccacgtcaccacgatgcggccgtccgccagccgggtgaccgacgggttgagctgatcgcctgtggtagtggtattcacctgcgcgctttcattcagcagatcgtaagcactcagtgcggctccggagatcaatactggctggctctggttacctgccgcgtcaatagccgagagcgttccgttttcaccgacactgagtgggttaggtacaatactccatacaccctcagcatctgccaccgtggagtaaaccgttccagccgcattcgttacgataacagtagcgcctgcttcggtctggccacccagagtctccttagtattggtagagaggcccacgtttcggcggcagtacatcggtgtcgctcgacgctggtgtcgtcgcaggctgatagtcaatggtcgtcggatcgttgttgtccggcgtcatttgctccagtcccagcgtttcaaccagatccacaacgcgtcctttaatcgccgagccttcgccgtcacccacacctttgtcagtccaggtcacgtagagctgaccgcccgcaaggaaggtcgcatcgacttcaacctgctcgccataggtcagctgatggatctgcatctgctggcccactttgttacctgctgcatcaaagtactgcgcgtagatgccgctggtacctgcacccggtgccgtatctgttgcagacataaagagcgcaacgaaactgccatcaggacggctcacgactttcgccagatgttgatcgcctgctgttgccgtgttgatcaggaactcactggtcagcgccgtaccgtctgccgcatagatgcggccccagacgctgtaaccgttctgatccggtccgctggtatcgttagagtcccaggtcaccacgtagttgccgttatccagcgcgcttactgcaggtgatgcctgattattagtcagggtctggttcgctacgaagctgccgattacctcatgcagtgaaggatcgtagatcgacacgcctgcgtcatacccggtacctttaacggtataggcgatagcgacctggccatttttcagtaacgtaacagacggcagcggctcccagtcagcgccaaagcccagcacgccgtttacgctcagcgaagtcgtaatcagtacagtctccggcgtgaccggcgtgccgtttgcatcatactggcggctgtaaatcgcccagttaccgttcaggcttgcctgccatacaaccagatagccgccatcttccagcgaggtaatggcgggttcagtcagtttacttgccgtggtaccggtgttaacgctgaactctgtgccatcagccaccagaccatttacgttacccgcaccgtcatagctgtaggtataaccctgacccttgatatgcgcaccggaatccgtgctccacaccacctggaaagtgccatctgacagcacggtaacctgcggcgtgatctggtcgcccgctgtggtggtgttcaccgtgaactccgccccgaccggctgacctttcgcatccagcagctgacccttgacgcagctgccggagccgtctccgctcgccgactgccacaccacgatggcgccgccgtccggcaggctggctaccgacgagaccgtctgcgctcccgtggtggtggtgttcaccgtgtactcggagtagaacgccgcatccacgtcaatcacgataccttcaatgccggttcccgagccgtccacgttgtccgactgccacgtcacgtatacgctgccgtccgcggtcagcacggcgtcaaagatgtgcgttgcatccaccgagtcgccaccggtaccctggttgccgctcgtggtggtgttcaccaggaactcgcgtcccaccctgttatcgttcgcatcaaagcgctgtgcgtagatggccgagccatccccgtcgccgccttcggagccccagataagcaggtagccgccatcatccagcgccacgccgaccggcttatactgcttgccgctggtgtagctgttgacgatgaagtcaccgctgccgaccagcgtcagcgttccggtggcggcatccacgcggtagtgcactgcgcggatgtcagagccgctggtgccgctgtcgctgctgtcccagaacaccacgatgctgccgtcgttcagggtgataacgtccggatagttctgggagctgtccgtggtggtgttcacctggaagttaccccccagtggcgtgccatctgcggcaaaaatctgcccgacaaccccgctgccgctggtgtcacccggaccgctggtggcgttccacacggtcacgtacatgccgccgtgcgccgcatcggtaaaggccgccatttccggcccgccggagctgcccatgcccttgccggttgccaccgtcacttcgtccgtcaccggctggttatccgccccgtagctgcgctgcacgatgcctgtgccctggtcttcccagctgatgatgtagccgccgtcggcggttgccatcgcacccggacggttctgcgcaccgctgtaggtggtgttcaccaggaactcgtcggtcaccgcctggccgtcggcgccgtagcggcgcgccatcacgccgtcgccgctgttgtccagtccgttaacgttggactcgtagacgatcagaaagccgccgtcggtcagcgcgatcacctgcgggctgtcctgattgttggccgtacgctggttcacctgctgctcggtgccgattttacgtataccgtcggcctcaaagagctgcatgtaaacctcggtgccggagacacctgcgccctgccacgtcaccacgatgcggccgtccgccagccgggtcgtcgacgggttaagctggtctccagtggtagtagtgttcacctgcatactttcattcagcaagctatacgtagccagtgcagatccctggaaggccactgtatcgcccttgttccctgctggatcgatagcgtagatctctcctgactcgccagctgagattgggttaggtgctatcacccacttaccctgctgatcggctactacgctatattccgtgccgttcttatcgacaatgacaaccacaacgccaggctcagtaacaccgctcagtgactcctctgagtttcctgaaatcccaacgttaggcgctgtgatatcgataataaaatcccagctactgctgatttcactgacgttacctgcagcatccgttgccgtcgccgtaataccgtgtgtcccttccagcaggttagtagtcggcgtatagctccactcaccctgtgcatctgccgtcactgtcgcaagcaggatgccattgtcataaagcgtaaccagcgagcctttttccgccttgccggtaaaggtcggcgccggatcgtcaatggcattacctgccactggtgaggtgaactgcaatgtaccgacgtcatcctgtaatgactggatgatcactggttctggcggtgtggtatccacattcagggtaaatttcgcctcgctgctgttgcccgctgcgttagttaccgatgccgtaaagacgtgctcaccgtctgccagctccgccaccgcgaacgtccacacgccgctgctgtttgccgtgctgctgcccaccaccgcgcccgatttgtcgctgatggtcaccaccgcgcccgctgccgccgtgcccttcagctccggcgtgttgtcgtcggtcaggccgccgttcagtaccgcgccggtgatgcttcccgcatcgtcgttcgcctggtcaatgctcagctccacgctgctgctgtccagcctgaaggttgcgcgctcgccgcgggtttcgttccccgccgcgtccgtcaccttcacctgccagctgtaatcgcggtccgtcagcgtgcccagcgccagtgtccagttgccgtccgcgtccgccaccgtgctgcctgccggcgtgctgctgtcgtccagatataccgtcaccgtcgcgcccgcttccgccgtgccattcagcaccggcgcgcggtcgtcggttaccccgccgctggcgacttcgccctgcacctcaccctgggcgtccatcagcgccgccacggccgcctccggtgccacggtgtccagcaccacgttaaacgcgccggtctccgccgaggaaacccccgccgcgttaaccgccgtcgccgtcaggtcatagcggccgtcctcgcccagcgccgccgtggtaatgctccagcggccgttgtcatccgccacgcccgaccccgcgtttacccggttgccgtccgcatccgtggcccacacgatgaccgtcagccccgcgcccgcggtgccgttcagcgtcagcgtgccgtcgttggtgaactggcccttctgcaggaagccgctgtccgcgtcttcaccctggctgtagtcgtccaccacgtttccaatcgccggctgcgccggggcgctggtcaggacgctgaagtcccatgccgcatccgccgtaccgcttacctgcgggccttcattgcccgccgcgtccaccgccgcaaccgtcagggcgtgcgccccgctgctcatcgcgctgtccggcgtccagctccacttgccgtccgcgtccaccgctgcgctgccgatcagcttgccactgtcatagatattgacgctgaccacaccctgcgctattcctgccgtgctcacgctaccgctgtaggtcgggcgtgcatcatcagtcgttgcaccgtcggcgatctcgccccgtaccggaccgacgtcatcggtcagcgtgatgctgctgtctgtaaaggcgtcgatatccggcgcagtggtgtcgacggtaaagctccagccatcgtcatcagtgccgctcacctgcgggccttcgttacccgccgcgtccaccgccgcaaccgtcaggtcgtgtgaggatccgtccgccatatcctgctccggcgtccagctccacttgccgtccgcgcccaccgctgcgctgccgataagctggccgttgtcatagatattgacgtgatcgatgtcggcggttgcgtcgccggagaaggtcggccgtgcgtcgtcggtgacgctgccatccaggatctcgccggtaatcgcaccgacgtcgtcggtcagggtgatgctgtcgatgaccaggcccgaggtctggttatccggcggcgtgctgtctgtcgggccgtcgatcacaacgctgttgctgttgcccgcctcgtcggtggcttccaccacgacgtctttggcgtccacgcccgccggattcggctggatgctccagtgaccgtcagcatctgccaccgtgctggtcacgctgtcgctgaccggatcggtgattacgatcaccgcgcccggctcggcgttaccggccagctcgtcttcggtgttgttcgtgacttccggagccgccgtgctggtatccagcttaaacggccattctgcgccaggcgcggagatgtttcctgccgcgtccgtgctaacggctttgatactatgatcgccgtctaccatattggtggtcggcgtatagctccagttgccctgcgcatccgcccgaacgctgcccagcacgctgtcgccgtcatacagcgtaaccagcgaacctttttccgccttgccggtaaaggtcggcgacggatcgtccgttacgccaccactggtcgtagacgtgccctgtacagtgcctacatcgtcaatcatcccggtgatggtcggcaggacaggtgcgatggtgtcaacggtcagggtaaatttcgcctcgctgctgttgcccgccgcattggttaccgatgccgtaaagacgtgctcaccatcagccagctccgccaccgcgaacgtccatacgccgctgctgtttgccgtgctgctgcccagcaccgcgcccgatttgtcgctgatggtcaccaccgcgcccgctgccgccgtgcccttcagctccggcgtgttgtcgtcggtcaggccgccgttcagtaccgcgccggtgatgcttcccgcatcgtcgttcgcctggtcaatgctcagctccacgctgctgctgtccagcctgaaggtcgcgcgctcgccgcgggtttcgttccccgccgcgtccgtcaccttcacctgccagctgtgctccccgtccgtcagcgtgcccagcgccagtgtccagttgccgtccgcgtccgccaccgtgctgcctgccggcgtgctgctgtcgtccagatataccgtcaccgtcgcgcccgcttccgccgtgcccttcagcaccggcgcgcggtcgtcggttaccccgccgctggcgacttcgccctgcacctcaccctgggcgtccatcagcgccgccacggccgcctccggtgccacggtgtccagcaccacgttaaacgcgccggtctccgccgaggaaacccccgccgcgttcaccgccgtcgccgtcaggtcatagcggccgtcctcgcccagcgccgccgtggtaatgctccagcggccgttgtcatccgccacgcccgaccccgcgtttacccggttgccgtccgcatccgtggcccacacgatgaccgtcagccccgcgcccgcggtgccgttcagcgtcagcgtgccgtcgttggtgaactggcccttctgcaggaagccgctgtccgcgtcttcgccctggctgtagtcgtccaccacgttttcaatcgccggctgcgccggggcgctggtcaggacgctgaagtcccacgccgcatccgccgtgccgcttacctgcgggccttcattgcccgccgcgtctaccgccgcgaccgtcagggcgtgcgccccgctgctcatcgtgctgtccggcgtccagctccacttgccgtccgcctccaccgctgcgctgccgatcagcttgccactgtcgtagatattgacgtaactgatgtctgcggtagtcgtgcctgagtaggtcggacgtgcatcgtcagtgacagagccatcttcaatcttgccctgtaccggaccgacgtcatctgtcagtgtgatgctgtccgccactaaacccgatgtctggttatccggcaccgaggtgtcaacggtaaagctccagtcgccgtctgcctgcgggccctcattgcccgccgcgtccaccgccgaaaccgtcaggtcgtgagaggtgccgtccgccatatcctgctccggcgtccagctccacttgccgtccgcctccaccgctgcgctgccgacgaactcgccgttgtcatagatattgacgtgatcgatgtcggcggttgcgtcgccggaaagagtcggccgcgcgtcatcggtgaccgagccgctggcaatttcgccggtgatcgcaccgacgtcgtccgtcagggtgatgctgtcgatgaccaggcctgaggtctggttatccggcggcgtgctgtcgccggggccgtcgatcacaacgctgttgctgttgcccgcctcgtcggtggcttccaccacgacgtctttggcgtccacgcctgccggattcggctggatgctccagtgaccatccgcgtccgccaccgtgctggtcacgctgtcgctgaccggatcggtgatcacgatcaccgcgcccggctctgcgttaccggccagctcgtcctcggtgttgttcgtgatttccggagccgccgtgctggtgtcaacggtaaagctccagtcgccgtctgcctgcgggccttcgttgcccgccgcgtccaccgccgcaaccgtcaggtcgtgagaggtgccgtccgccatatcctgctccggcgtccagctccacttgccgtccgcgtccaccgctgcgctgccgacgagctcgccgttgtcatagatgttgacgtgatcgatgtcggcggttgcgtcgccggaaagggtcggctgcgcgtcgtcagtgaccgagccgctggcaatctcgccggtaatcgcaccgacgtcgtcggtcagggtgactgagtcactgacaatgccggagttgatgttatctggaggagttatgtccggtcgggaaaccgttggacggcggagagacattacccgcaggatcgacgaccacgatagttacgtcggtatccccttcattgacagggttaggctggatactccagtcaccattttcatcaactacaaccgtggtggtttcaccggtactgccatcggaaataaccactgttgaaccaggttctgctttacctgagatttgttcatcatcattgctatttataaccgccgcttctggcgaagaggtgtcagtaaactcttcagtcaggctaccgctattgcccgcactatcagttaccgtaacagtgacggtgccatttggttgtgaagtcggtgcttccacataccagttaccttcactgtccgtctgggttgtgatctgggtgccatcaggcagttgaatgacaacctgtgagttagggctattcgatgttccggaaaactctggacgaccatcattatcactgtccgcaacaggatcaagtgtcaccgatacactcttagcggaagagtcatggccactgctaccacgcccggacgcaccaatagcaacgccgcctgccgcgccgcccagcagcataaagggcaaccaaccaaaattgttgtcactggcagtcagcggatcggcactggcatatccttcaccacctaatacctgttcaccgctctgaccttcagttaaagctggcgggtattcagccacatcgccggaagtcggcacatattcataaaattgaccgttttcgcccagcccaatcagatgaacgttttcattatcataataatcatccagcacaatatcaggatgctgagaatcatcctggctaaagaaaagctgcagattattgccaacgcgcctggttacaaccatttgcggagcatgtcctgtagcgctatcgatcagttctatatttaatgcaccctgatgcggaactttgatcgttgtaggattttcagattttgtatcaacagtgtatgaagagataacacccttcacaccacgcaagttcactttcaacataacaaccttcttaattaacgaggattgattaaattcaatagaaataaggctttcacaaacccttaatctctatattcatatatttcgaataaccgtgattttatgacgagataatctgcaatcctgacattgcttccagcacaactcttgattctggagtcagtgaacggcattatcagaactgattaataaaaaatatggtgccagattgcatcaatgcagtgagtatgcagcgccctgagctttactgcttttatcagctatcttcatagcattgctctgagcatgactactgtcagaatttaatagtgaagaagccaccgggtgattcaatagttttgactcgcccgcttcagaacaagaacgttcattcactacacgcgataacgtacgtgattgtgctttgagactggttaaaacagattcagcttcctttgcaggcaccagacgcgccgtgattttctgctgatcatttaccgctaactgatagtaatagcgctcacctgatttcagctctggtgtgggtacttcaatttttgctggctggacaaaatcatgctggctgaacataacttccagttttttctggccaggacacacactaatttcagtccctctatcacctgacattacgctagtatagtattgattattaacaaatacgttaacgacgcgttttgatgcggcaggatttttttcatcaatacggtagacaataatgtgcgcacgcgggtcgcgtatctgctccggcgccttgtcagtgttgacctctttaaacaacgatggcgcaggagcgttctgcaatggcgccgcctgaacataattgcagtacaggtagcctgtaagtaataaaaccatactcagcattgctccctgcataaatttaaagggactatccgatgctttgcatgttaaacgtgaattattttccatataactctccttaaggtgcttaatcactatatttaaaacaccttatatccgatattgaacaggagttgacaactccttaaaaaataaaaaatgggaaatttaaacagcgcagaagggtgagcctacgcctctggataacgttaaatctcatttacattgataactcctttgtaaagttcaagcaacgagacatcattgataaatgcattaaattctttatctcctttcagagcgaactttctcatcacattatatttatgtgcatagattgttttaactgacaaatctaacctttttgctgtctggattacactgtatcctttcttcaaaaaactaagcacctgaagttgcaccacggtgatacgtgcaaattcgcaccgtaaacagtctgaaggcagatatcccataactcttccctgagtgtttaaccaggccttggttattttctcagttattaaacgtaccgaatccctttttgacacttcaagcaaagattgataacaaaatggtaacgggtttttaattttctctccgaaatcatcggtaaataccaatatgatacggccaggctttcgctcgcgataagcgggttgacacatataaagacgccattgcgaaacattgatcaggatgaagtcagcctgccgcaggttatgactatcaaaacctgataaaaattttacttctgcatcagacagcagtgcctcctcaattacctttgatatgcccagtctgaagaagtaattgtcatccgtacaaaccacattaacatccattttttcccttcagcatcacaaaattcacgatgacaaatattatattcaggtgaacttaccgttaatcagtaccaattcgcctttctcttttagttccttgagcactctgcaaatggaactttttgataaatgagaactattttcaataagatatagtgctgaaaatcgtttctttaaatgagtcggcagttttttccatctttcaatcaaagaaataacttcatcatatgagttactttttggtaactgaatgtaattcatcagatcagaatactgtcctgataaaatagacattgcgtcattaaaaagatctttctcaaaaaccaatcgccagaacacgtcatagtcaatgaaactgacttttccataatcgactcgttccagatagactggcggctcgtctaaagctggagtgacgccgacaacaaacggagcggataagatattcaaaaccttattctcgcctttaagtttaagtaaaaaatcgccgtcaagaatgaacataacgcgacgtacattatctttagtcaaatgataacggcgcttgcctcttgaaatttcatctggattagcaatctgcgtaaatcctgctaatgcatcgatgatccgttcatgattttcagtcactctatacatattaattaactcaatctaactgacgtattggtcagtgattagcaacaattcgtaaaatcagttttttatagtctctttctctttcgcctggtgtactcgcttacctgagctcgcctccataactcgggcagttaaaaatagtctttatcggttccactataataaaaccgtcccaacaaaattcaaaaccgcaaatacaaacaaataaagacattcaggctaataaaagaaacaataaccagatcttacaccatttaaatgctgtttagttagcacataaatctactttgtggcaccttacgggcagtgttataacttttttcctaaaaaaagaatttcccattaccatttgaaagatgatgttatgagcatgctattttaaaagcccgtatttaaacacctctctcaattttccagcatggctgaaaagaaacaaatcaaattggcatcaatgttaatgctccttactaaagttacgctgtcaggcagcattgcatggaaggaattaaaccacggcacccatcgaacagacacttaaattgattatctttaaatatttagttttttatcctgacatatatgatttaattagctcaaatcaccagaaactggcaaatgggatttttccctttttaattccacttctcaaatgacatcacattcaggcaagtgaaatcattaactcatgactttatgcacaagcttattcatagataaatcagtttcactgaaccgcgttcatggcatgcgcttcccggatgccagataattttaagcatcaggcataagcagtgctgttaatggttaaatcacgcataagaataatgtacgctcaaaaaattccagaataccaacagcagttaatattatgtaaaaatataatagccatatccttgcttacgataacaaaagaagaattatggatgttttactatttcattttttatgaccacccattctaatagtgccgttcgctagaagcggcataaataataatattgaaaaaatgatacatggagatatcgatgagagagttaacatcttttgaaatgcaaaacgtttcaggagcaggtttttttgactttattggcgctgtagttgtcggtgccgttacgggtattagttcttttggtcttaaatggggaatgagtggcggaagcaccggtggcgtgttaggcgttggtattgtctctgccggtgtaggtctgattgtcggcgcagtccttggtcttgttgatggtgctttatatggtgctatgaatggctgggatagcacggcaggctggtttaacgcggtcgttgaaaaccagtttgatcctaatgcatctgtaattacagcttaaggaaacaacatgcgtgaattgaacaataaagaaatcgaaggcgttagcggtggttcattaacttcggtgatcctggatttctttaagcagctaggcgcaagctcagaagagaaaactgaatggacgcgcccagactcaattccagcagcgaacccggttagtgggtctgcctttggcatgggtattgttggtgtcgcagcagcagtcgtatttggattgctgattttctaattctcttgtgaggaatgaatcctccagggaagtgaacgattattaaatcgttcattaattgatgttattaattattttatacaaaggaaagtatatgaaaaagttatctatggttgctcttggtctgatgctggctgctgctcacgttaatgctgctgaagcttcagatggcaccattaacttcacaggaaatattgcgtctcagacttgtactgtaagcgtaaacggcggcggcagcactgcaaccgttacactgcctaaagtagcaagtagtattttaagcacatctggtcagactgcaggtaacactcgcttcactatggcgctgagcaattgctcagctacgactggtgacgtgtacgcttactttgaacaaggtgccaacgtcaatgctgatggtcgtttgaccaatactggtactgcaacgaatgttgacctgcagctgctggatagcggaaatggcgtgttgaacgcgggtagcactgagcagaccacctctccaaaaactgtcgctctgactgctggtgcaggtactctgacctattctgctcagtactatgcaactggtgcagctactgctggtaccgtcttatcagctgtgaactattcaatcaattacctgtaattgattatggtgggagcatctgttcccacctctcttcctctatcatcatttctgtcaaaatcatgaaaaaaaaagttttaaatttttgatctcctgtctgctggcttttacggtgacctcatcggcttttgccagcgtgacgattatcggcacccgggtaatctaccccgcaacagaaaaagaagtcacagtccgcttagataaccatggcaatcaacctgcgctggtacaggcctggattgacaatggaaatcctgatgaagcactggataaaataaacgtaccgtttgtcttgctaccgcctgttttccgtatggaggctaacaaaggacagacattacgtatcgtttataccggttcaaacctgcccaaagataaagagtcggtattctggcttaacgtactcgacatccctcctcgcgataaaagccttgcgaatcaaaatcagttgcaaatggctattcgtagccgcatcaaaattttctttcgcccagcccggttcgatgcgatgcaagccacagaagcagcgtcgggtcttatctggcatcaaggggagaaagcgaatcagctgacagcaaccaataactcttcgttttacgtcaacgtttcacagatcaatgccgaggataacgcggggcgaaaagtagtcagtgaaaagggagatatgcttgcaccaggcgaaacaaaaagcttctccctaaaaggattgaacgcaaatcaaataaaaacaaactttcattatcaatatctggatgattatggcgctgcacgcaatgtagacgccaaaattagtcagtaactttggtaactcatcaggggtaataatgatggcaaggatgattaaaaataataaaccaacgggcaaaatattttaccgatcttttctggcgctttttttaactgcatcaacaggcgccgcatttgcagaaaattcgtatgattttgacgaatcatttgtgaagaatctaccgggcgttaaagttgatgtggcacgctatgcaaccggtaaccctattgatcctggtacttatacgctggatattttcctgaatggtcgtcagattggtcgggaaaatattcaggtcattcgtgaaggggcgggaaccaaagcgtgcctttcctatgatctggtcaaaagcttgtcccttaaggacacaatttttagcccgggacaagctgaagatttgcgctctggtaaacagtgtatggcgctggaggaggtggttaaagagagtcatgccgctatcaattctgccgatatgcagatggatatctcaattccgcaaatttatctgttgcgatctgcgcgcggctacgttgcgccagaattctgggataagggtgaaacagcactcacgctaacctataacaccaactattatcgctctgtaaatcacggtcagccatatgactcattttatggccgtgcgctggcgggctttaaccttggcggatggatgttccgtcacgatggtttctctcagctggcaacgtcaaaaaaacaacgagtatcatcattacgatgcaattaatacctatgtccagcgtgatattccgcaaataaaatcacggctgttattaggtgaaggcaataccagtggcgaaattttcgatacgctttcttttcgtggtgcgcaaatatctacagttgaccagatgtggccagactctcagcgaggctatgcaccagaaatccgcggcgtagcccgaaccaacgctcaggtaactgtatcgcaaaatggcaacaaaatttatgaaacgacggtttcaccaggcccttttaatatcaccgatctttatcctacaggctacggtggtgatttagacgtgaccgtgaaagaagctgacggcggtgagacccgtttctcagttccttacgcagcgatgacgcgtctgaaacgtccgggcatgactttttatagtctgaccggtggtgtatcccgaaaagacaatatggtttatacaccttcggtctatcagggcactattcagcatggttttagcaatagtctgaccggttactcaggtattctgggatcagataactacacctctgtgctgttgggaggtgcatttggtttacctgttggtgcgatctcactggatattactggggctcagacaaaatatggtgatgagaaaaagcaaggtgtaagttatcgggcaacttatagtaagaaggtttctcagactaacacgaattttactctggcggcttaccgcttctcatcatccggttattacagttttgataatgcattacaaatcaataactattataaaaaaaatcataaaaacagttcgtcaaattatctttcgcgccccaaacaacgtttttctatgacggcaagccaaaattttggggagtcatatgggaatatctatcttactggtttcgttcagaattactgggattctgccggaacaaatacgcaatttcagctgggttacaataatacaattggtcgggtctcctatactttatcagcaaaccgattattatattcaaccggcgggcatgacactcaactgtcactcgacttctcggtgccaattggtagcgatagtcaaagttatgtaaccggaagtgcgacacataataaacaaggtgtgaatgcacaaacagctgtcaatggagttctgggtgaacatgaccaatataactataacgttggaatagcgcgcgatactgataatgagaagtccggttcagttagtgggcaataccgttcgccctacagtatgctgacggcgtcttatactaaaggggaaaactattattctgcctcgggtggtatcagcggtgcggtagtcgctttacctgatagcattaatttcagcgcttatcagtctacgacttatgctgttgttaccgcagaagatgcagagggcgcgcgtgtacttggctatcccaatattgtgttaaacggcagcggcaaagctattgtgccaaaccttaacccgtaccggataaacgaactggccatcgacccaaaaggaattccactggatgttgagcttgaatcaactcagcagcgcgttattcctgttgagggtgcagtcgtcagacttgattataaaaccagcaaaggaaagccactgttaattcgggctaatcagccgaaacggaaacgccttgccatttggtgcaacggttaatgatgaagacggtaaccttatcaccactgtttcacagggtggtcagatttatgtgaggttaaataaagatgtcagccgcctgcatatttcctggggtaaagcagccagtgataagtgtctggttaacctggagtctggtgttgttaattccagtgaaaacaacacacttgcaaggctcacaacaacatgcagcagcgatcaatcaaaacctgttcgctacgtgtctaacggcgaaatgaacaaagataatcagggttaatcgggtgacattatgatgtttattaactttagaaggacactgaccagaatagtcagcatcatgactatagtatctggtttcgtcatgctagcaccaattaatgcgaacgcggcagatgatgtcacactgacgtgcaaaaaatctctttctgatgcggtattagatttccgctcactagggataaacatttcggcagctgttccggttggcacggtcgtttatagtggcaatttaacagtcacgttcaaatgtgccctggataatctgcaacagtttttagatggattaacagcagaggtttacttaaagcgtaaaacaatagctgaagatgcacttggttatggattgaccatttataccggttacggtggtgaaatgtccaccgacgctgcaaatattcctaccggcaacaagatcgctacttacgcgttaaccagtggcggtacagtcggtgcttatactgatgtcacattgaatgtgccttttcagattgtgcggacgtcaaactcgatggctggccccaatttgcttccggactatgtcaacgtatttgatgtaggctcattggtaccaggaaatgacctgaaactttatgtcagatatattaaaagcggcatcactgtgagggatcaaacctgctcagcagcaggcgatgttaacccgaaggtgtcattagggagttacacagcgaataccagtagtgggttgggtttccggtattggacaaaccagcccatctaccgctttcaatcttcagcttaactgtgaggcacttctttcaggtacctttgacgttatgatgcagttggatggggatgcggctgatgggctatcggatgtcggcgtagtttctctgaattcgacctcaactgccagcggagtgggtgttcagattctgaatgaaagccagcaacctgttgcactggcagcaccatacagagttgcagcttatccactgtcgtctgcattgataacagtgcccttatatgcacgttattaccagactgctgccacaataactcctggtagtgctaacgcagttgctacctataccattagttatcagtaaccatatgggctcttcggagccctttaccagactttataaactgagaaaggattttatcagtggataggccattaaaaggaaggaggtttaaagttggtgtctctgatgagagtccttttattttttattcaatacaaaaaatactctcaaccggatttcacaacctggacattgcagcatacccggtagaagcagaaaacctttttgtaaaactgaatagcgatcctcctgatatattaattactgatttttgctttaactttgaacgtaatgatttgaacggcgttagaaaactagaagaaatttacaaccataatgctaaccttaaaatcattatctttacggcacagaatagcccggccattttgaaaagaatattgcaaattccggtaaatgcaatagtgagcaaacgtgatgatatacgggatctggtagaagctttgcactgggtttgctcatcgaattctaaaatattttattcagaaaagatgaaagatctggcgcattctgcttcagaggagcccgcacagactcttttatcacccgcagaagttgaagtaatcagactttttgctatcgggtacagtttaatggagatagctaaagcacgtaaacgtagtatcagtacggttgcaacgcagaaatataacgccatgcgtaaacttcagctgcagtctaatactgatttgattaaatatgtctttgcccagcaactcatttaatttcgggcttaatttttaagaaacagcgagcatcatgaaattttataattttaaaattgcatttattgtactgtcctgcgtgccatttggatcttatgcgaccagcttacagcaggctgcccgagccgcattaacctatgactctgcattgcaatccagccagatgaccagtgaagccgatcagcaaaaatactggcagggtatggccggaatgttgcccacattgacgctcgaaggaaactgggatcgtcaggaacagccggataaaaaatatcaaagtggtgtaacaaatcacagttacgatctcagtgtcagacaacccctgtttgatatgagtaaatatgctggctggcgtaaaggcgttgctattgccaataccgctgaagctcagtcaaaaaaagctgaagaaaagttattaaatgcgatcagtaatgcctacttttcggtgctctatcagcaggaagttttacaggctgcgaaagctgccagtcacaacttcaaacaacagcagcaaaaactgcaggccggtattctgaatggacaaaacactcgtacagagctggatgaagctaaggccaattacgctcttgctcaggccaaagaaatagaggcgagtagtcagttattgctggctggagaagcatttcgtcgcttatcgggtgtcagcccggacactgtcgagccggtaaactttcagtgccttaacgcttcgccctacgcttctttaactgatgcgattaatgccagccagcaacgtaacactgaaatcaaaattgccctgtttcagaatgatcaggccgatgctgatgtattggctgcagatggcgcacatatgcctgtcgtgtcactttacgccagatatggcaaaaactggagccgtaacgataacgacgacaatttactttatgatgctatttttggcactaactctaaaagtaataatctgcagtatggcgttaacgtttctattccattattcgcgggtggcagccagatttcacaatcttatgaagcagcctatcgccgtcaggcagcgaaatattccaccatggaagcacaacgcaaagcggctacagatacacgttcagcatggcttagtcttacgaatggaaaagcgttaatcaacgcgcagaaaaatgccgtcgagtcttcacgcgaaaaagtggtgtctgttcaatatggccgggaaatgggtttccgtacggtaaatgatgagcttgatgcccagcaaaaatattttagtgcgcttaaagatcaggctgaagctcgcttcaattacctgaacgccctcattaatctggcacaaagtaccggatcactatcaatcgacatgctgaatttttttcagtgccgttaatcccttactcatgatgattatataaatggaacagtcactattccgtcaggaggcacttgatgcagccaaccgtggaaacctgggcattgtggcactctattgcccaccttatcgctggttagttatttccgttgtagtgctgatcactgccgcgacagcgctgttttttatatttggcagttatacaaaatatgaatcctctaccggagaaactgctgcctaaaaatggcatgctgatcattccgccccccgtaagcgctacggtggtcgatattccggtaaaagagggccagcatgttgaaaaagacgatgtgctgatggtgttgtcatcagaggtttcaacgcagttaggtcagactcgtcaggttattgccgagaatctgaaaggccagcgtgaaaggcttcaacaggatctggtgacgcttgaaaagcttcatcaggttgaaatgaagggcctgaccgacactatcgccagcctgaaactgcaacaggagcagttgaagctgcaactgacacaccgtcggaaacaggtttccctggcgaaaatgcagttggacaagctggaagccatgcacaacgaagggtatgcctcaagccgtcagatggaagagcaggagtctaatctgctcgatagccaggcgcgctaccaggaatatcaacgtcagctgttggacatctcgcaaaaaattgttcagaccgagcaacagctgcatgaaaaaccgctggatgacgagaaaaagcgtaacgatatcgagcgccaactggctgataaccgtcagtcgatggctgaaaatgaagcgcgccgctcgtttgaattacgtgcgcctaaaagcgggtatgtcggcatgattatggtcaaaaatggacagatgatcaccgccggtcagtcagccatagcagttttgccaagcaatactgaactggtcgcccgcatcatggtaaacacgcagtccattggttttatccaaccgggacagcgggtggtgctgcgctataaagcgtttccttatcaaaagtttggtcaacagtatggaaaagttatcgaggtttcacgcaccgctctgtctcctcaggaagtcactacgttaaccggcaaaaacaatattcaggaacagcagtaccgcgtgctggtctccctggacaaacaatcaattactgcttatgcgcagaatgaaaaactcaagccgggtatggcgctggatgctgattttatcgtcgacaaacgtcgtctttatgaatgggtgctggagccaatttttgcgcttggacacaaaatctctctctgattaaaaggtctgttctgtgttgttattagagaaactcaattttaaatggtttaaccgcctgccgatgattcgtcagtcacaggcgacggaatgtggtcttgcttgtctggggatgattgccaattatcacggtcatgaaatcgacatgatcaccctgcgtcgcaggttcgcaacgtcgcttaagggtgcaacacttagtgatgtcattgccatggcacaacaactcaatatgagttcccgtgcgttacgcgttgatatggaagagctgtctaaattacgcatgccctgcattctgcactgggaattgaaccatttcgttgtgctaaaaaaagtgcgcggcaataagatcacgcttcacgatcctgcacgcggcattcgggaactgacatttaaagaagcatcaccggcgttcaccggcgttgcactggagctggttccctcctccacttttgaggtcaaaaaagaaaaagaaagcatctcgatgatgaagctggtgggcagtgtgacaggggtgaaatctgcctttgcccaggtgcttatcctgtccatcgctctggagcttttcggcgtactctcccccttctttatgcagtgggtgatggatatggtgctggtctccgcagattactcactactctccttgctcgggatcggctttatcatgattgcgttgtttcagaccatgattacagcgctgcgctcatgggtgatgagctggttctcaagccagctcagcgtgcagtggacggtcaatgtctgtcaccatatgttaaagctgccacttgaatggttcgaatcccgtcacgttggtgacattctgtcccgctatggctcgctgaacaccatccaaagtacgctgaccagccgcttcattagtactgtgctggatgggataatgtcgatcgtgacagtagtgatgctgtttatctataacgctaagcttgcctggctggtaattggcctttttgtcgcctatgcactgttacgcttcatggcttatgatcctgttcgccgcgccaacgaagagcaaatcatcagttcagcccgcacgcaatcttcattactggaaacgcttcgcggtatccaggcggtaaaaaccaataacaagcaggtgcctcgtctctccgcctacatgaatttcctggtggatacgaccaacaaaggcattgtgattcagaagcttaatattttgtttggttccgcccagggattgctcacttctgtaggcagggtcgtactggtctggctggctgcgctgcaagtactggatggcaacttctctgcaggtatgcttaccgcctttattagcttctcagatcagtttatgagccgcggtgcaggtctgatcaacgccgtaatcgacttcagaatgctgcgtatgcatggtgaacgactggccgatatcgtgttgtcagaaactgaagtcagctcagaagccagtccggtactggtgagtaaagatacgcatgatgagacagaaacgccgcaggatatcgaactaacggatatccgcttccgctatgcacctaccgaaaccctgggtagtaaatggtgccagtctggaaattaaggctggcgaaagcgttgcgattgtcggcccttcaggtcagggaaagaccaccatggccaaaatcattctgggtctgctgcacccggaaggtggaacaatcaccgtgggcggaatggacattacccagacaggacttgaacaccatcgtaaccgcatcggctgtgttatgcaggatgacatcctgttctcaggctcgatcagtgaaaatattagcttctttgataataatcctgaccacgcaaaaattacccgtgtagcacgcctggcgcaaattcacggcgatatcatgaaaatgccgatgaactatcaaagccttgtcggtgatatgggatcgtttctctctggcgggcagctgcagcgtattctgctagctcgcgccctctaccgcgaaccaaaaatactggtactggacgaagcaaccagtcatctggatatctataacgaagcgcagatcaacaatgcaataaagcaaatgaaaatcacccgaatcatgattgcacatcgcccggaaaccataagaagtgcagataaaatcgtcctgttaaataacggtacgctcagtgaagttaccgcagagcagttatttggccagacagaaaaaactaaaaaaatggagattacacatggataaaaatatttgccggtttagcgaaggtatgattactttaccggaaggctactgcgagcgaaccctgaacacgctggcggatccccgttcagcgatgccacccgtcactatttctcgtgataaactggccaatcacaacaatccagaagaatatatcagcagccagctcgctattctgcagagacaaatgaaagactggcaacagcaagaaaatcaacccgtggtgttgggcgataatctgagcaaaggcatcatgattacttatgattttctgcgcccggataatatccggctttatcaaaaacaggcgattttcaccttaaacctggaggatgtattaattttctctttgtcaaaggctgcccccctgaccgatgaagaaattcagctgtttaataatatcctgaagagtttccagagctggccctgatgcttttcctcagcaaagcctgacgacataacgttaaaagaaaaaccgggcaggataaacccttcccggtttcatgcattctgaacaccgctaaattagccgtttacagagcttagtaacgctggcaggtaaagagataggagatcggcccaccgataatataggtatttttatcaatcttatcgacatccaactgcagatgcgttggatccagcgtgatctctgctaacaacttattaaagatgacatcaggagtagtatcagtattcgaagtgacaactttgctgatctgataccggtaagtatcatcggaaattttagcgccattgattaatgcaacccttctgttaagaatagtaacaccgtcattgctcgttgcctgcccattcagcaaaagatagcctgaatcctttttatcaaaacgtaaatcctgggcaacagcgaactcaattcgtttatcatcattacgactgagatcgtaacggctaaacgctgagcatcgaaaaggaaaatctttggcctgatgtgttaagtaataaacccctgcaaaagtcaccattaatagcgcagccagcatgaagataatattaacaccaatgctccgcttcatcccattctccagtcaagataataaaaattgtcgcatgagatgatatgaccatcgctattaattttacacgatgaaagaatcgttcttccgaaattcttagtagtaaaagatgtgtttttatcaaaaataatccggtgacccgcatcgcaggtttgattattttcccttagaatttgcactatttgcttacccaatgcctgtcgttcaacctcatccagaccctgcaataatactgcttcgcagccaccttcaagtttaatggcactcattggaataatttgctcgtcaggacgcgataccgtgaaataccagagcaccatgcccagcaatatcagagcaacagaagcaaaccagtatcgccgggtgacgttaacggacgtagctggcagctgattaccgggcggagtggcaggcagaacaacgttttcagcagacccttcagttatacttccttccgatatgtcatcagttaaaacctccgtcccccccatgaccggggctgattgacgttcaattttaatatcggtattcaggcgtataccaattttcgggatggtgataatcagattttcacaaccataagccgcgagtgccctgcgcacaatactcagatattgattcagattactattcgatccacgcaggccatatttatcccagacctcggtcagcaacgtatcacgcgccagtatttctcccccggaattcagtaactgctcaaaaagccgacctgaagaaatactgaggctcagcgactcctgagtaggaatgtggctaagcgtgcagtcatcagaattgtaagaaacctgatcatcgattatgtaaatcattaagaaatcactgaatttccgctcatttatcgacagtataattcagcttatatgaagaagcactacagacgcgttaatcaggcgattaaggaaatttttacagattagccagcagaacgggccgggcagagtccgcccctgcccggcagctggttaataatttaagaaacgacaaagaatcataaggttagcggcgatttttatggctgattagcggcagcaaactccgcataattactttgagtaatgattttataggggatccagttcagtgattcgactttctgtttatccagtaacgctttcacgactttcacagcgcctgtcgcctgctctttcgcatcctggaaaatagtcagcgtcatctttccatttttgacgaactgctgaccatcaggcgtgccatcgatcccggcaaccagaatgtggctgtttttcgcctgattcagcgccataatagccccgatagccatttcatcattattggcggcgattgcatcgatcggtcgctgattaagcagccagcccgaaactacgtctaccgcttcattacgctgccagcgtgcagtctgtttttcgattaccgccatttgcttatatttagcgatcaccgcttcaacggcacgcgtccgttcccgcgcttcttcatttgataatgcgcccattaaaatggcgacattgccccgatagttcatctgttttgccagcgcttccatctgcatctcaccccccagggcagagtcagaaccgacataggccatactggacggtaatttcacttccggtttacggttaacaaacaccagcggaatgcccgccgcttctgccgctttcaccatcggcagtacgccctgtgtatcgaccgggttgagaataatggcatccacgccctgattgataaagtcttcaacctgctgtacctgaagagctacatcccctttggcatcgacgaactgcacatccattttcagcgcttttatctcatccaccatctgcgtccgcagaatcgatacgaagttaagatcgaaattagccagtgcgacaccaattttaggtgttttagcccaggcggtaacgctgatcatcaggctgagcagcagtgctaacattttggttttcatcgcgtaatcctgtagggtttattattgatagaaccgccgggcaacaggcaaatacccggcggcagagctcacaacgtaaagtgatcgcggaactgtgccagggctgtttcgctgtcgccttcggcccagccctccagcgcaacgacgccgcaatagccgacctgctccagcgcacgggcaatggcgcgatagttaatttccccggtgccaggctgcatgcgccccggcacatcagccacctggatttcaccgatagcggggccgcagcgtcgtatcagctctatcaggttgccctctccaatctgggcgtgatagaggtccagattcatcttcagtgccgggctgttgaccgcttcgaccagcgccagcgtatcggcagcccgtgcgaacggcgtacccggatgatcaactgccagattcaggttttcgagagtaaatacccgcccggcctgctcgccgagcgcagcgacacgccgcagggtgtcggccgctttaagccacatctcaccggtaaccacctcaaccggacgaaccgcctggccgtgagcatccagcccggtgccatgcagattcaggctcgggcagttcagacgatctgcaatcgccagtgaggtttctgcgctatgcagcaactctgcaatctcatcatcatcagtcaggttaccgttgaggtagccggtcatggaggtaaaacgcgcacctgtcgccaccaacgcgtcgatatctttgttggcccagttccagatctccacgccaaatcccagcgcatgaatccgctcaacacgcgcgataaaaggcagttcgagaaacaccatctccgcacagactgaaagctgataaccggccattagcgttctcccaacagaatgggtttgcgttgctgcaccgattcaatacaggccagcgcaatttccagcgcgttacgcgcatcagtgccagtagcgcgcggcgtgtcaccgtgcagaatcgcgcgggcgaattctgccatttcagcaacataggcctcacgcagcagatcggtatccattcgagacgttgcgatggcaataccctcggcgtgatagcgcacacagttgtcctgattgatgttgccagcctgcagcatacctttactgccaaagacctcaccgcgaacgtcataaccgtaaactgcctggaagttggcttccgcagtggcaatggcaccgttatcaaagcggatggtcaccaccgcggtatcaagtaatcccttatctttaaaatcgggacgcaccagcgcatcagccagcgcatagacctcaaccggccgggaacccggattgaagtgcagcagggtgtcgaagtcatggattaaggtttcaaggaagatggtccactgcgggatcggggccggatcgcgcaggccagggtcgcgtgtcaccgaacggcttagctgggtggtgccattggtgcctgctctgacagcttcaatagctgcggcgaagcctgcactgaatcgacgattgaagccgacctgcaacacaacgcccgcatcctgtgcggcggcaatagcccgatctgcctcatccagcgttaccgccatcggtttttcgcagaacacgtgcttgccagcccgggctgcagcgatcaccagttcggcgtgagtgcgagccggcgtagcaatagcaacggcatcgatttcgctgtcattgagtaacgcctggatatcggtatagtctttctccacccccagccggtctgccagttgctgcgctgcgccgggttgtaggtcggcgaccgctgtcagccgtgccccaggcacccgcagcgccagattctctgcatgaaaactgcccatgcggccagcaccgatcaatcccactcgtactgttttaaggttcataactgctcctgttttttgttgtcagcccagtcaggctgaatagggtgtccggatgtcgcctgcgctttggcggcaaaacgacgggattttgaaagcatcagcggctcgatgtgctccagtgagatgcctcgggtttcaggcagaaaacgttttacaaaccagaaggccaccaggcagccagcggcgcagagcatcagtggaaaagcaccatggaagtgatccatcagcaaacggctacggttcatcatcgggaaagtctgagtaacgatgaaattggcgagatacatcgaagaaaaggcgtagcccatcgcgacggcacgaatccggttgggaaatatttcagagatcagtagccaggcacccagactccatgacataccaaaaatcagtacgaacgccaccaggcccacgaccggcagcaggccaccgatctgcgctataaaggcccaggccgtaatcaccaggctgacagcgcaacccagcgctccccagcgcagcagacgcgtccgtccccagcgatccactgcgttcagacaaaacgctactccgaccagcagcgccagtccgaggaaaatgctgtgatagagggaggtctgtgtatccggtgagatgttctgcagcagcgacggtgcgtaatacagcaggatgttgatgcccgaaacctgctgcagaattgcaatcgcgcagccgatcaacaggatgtaacgcattctggcgtcgcggagcagacgggttccctgctgacgggtaacagaatccgcgtccggcgcactgatttctgccagcagacgccgcgcatgttcaggcgtcgaaagccgggtcagcactgccagcgcgcgttcacgcttgccgtttaacgccagccagcgtggtgattccggcataaagggcaccagtgccagaaacagcaggcaaggcaccacacccgacgccagcatccagcgccagccttcactgactatccaggcatggggcataccgcgtgcaatcaggtaattcaccacatagaccgtgacctgaccgccaaccatcagcatctgctgcagcccaagcatgcgccctcgccagtccttaggtgagacctctgcgatatagagcggcgtaattgccgacgccatcccgaccgccaggccacccaccagtcggtaaatcacaaaaccggttagtgaatctgccagcgcagaacccaccgcagacacggcaaacaacagcgcggtgatcaccagtgtaggtttacgcccgatccgatctgagatcgcgccgacacagccagcgccgacgatacagccgagaatgacatttgaaacagcccatccactttgccacggcgttagcgcaaggtgttccgttaatggctcaataacgccggaaatcactgaggcgtcataaccgaggatcaccccgctcaatgaggcgatggaacagatgaacagcaacaacttcagattatgtttacgcataacaccttaactttcccattgtttttgacaggtgagagttaatgtcagcgttgcaaagtggatgccagttttaaagcgggcttttatgtgaacgcgctcgcagatgacgcgtcctgattgaaaataaaatttacatgtcaacttaacatgtcattaaaatggacattccatcgaccacgggagagtgaaatgcaatctctgcatgatttgctgcctaataaagaagagagcgatgccatattcagcctgccggaaggcggtgatgcggcacagtgggaagctcggtttgcccggggctggcaggcatttagccagggtgaacagccgcactggatccgccgcagtattttgcagtcatggaaccgctcgcacgaacatggcatcgatccggtatcttttgagtacagtgcctccgatccaacggagctggccgccgtttctgcgccataacagtgagctgattactgtggcgcatagcgtgatggagaacctgctggcttacaatcccgacggtcatatcaatcttacagatgcgcaaggcattgtactgagtttttgcggcagcgacctgactccggtcggcagcatcctgcgtgaggaggtgctcggcaccaactgcaccgcgcgctgcctgcgagagcagcggctggtctatgtactcagcggagaaaactggaaaatcgcgctgcgtgaacgtaaccggcagtgcgctgcagctcctatccgtgatgccagcggtcgtatgactggcgtactgacgctgaccgccacgcctgacaatttcagtgcccatacgctgggcaccgtgcaggctgccgcagaggcaattggccagcaactcaccttacgccgtctgctggccgagcagcagtcgatactggagaccctgaatgagggcgttgtggtctgcgaccgcgacggacgcatcaaaaccctgaatcgctacgctcgtcagatctttgccggtattgataccgacaacgccctgattgatcaggtgctgcagccccagtccggttcattgctcacactgccctgctgtaatgaccgcgagatggtgttccgccccgatggcagacccagtgtttcatgcctggtctcgctgatgccggcaccggacggcggtcgcatcctgtcgctgcgggaaaatcagcgcatccgtgccattacccgtcgtgtgcttggcgtcagcgccagctatacctttgagatgattcgtggtcaggcacccacgctgcagaaggctcttcaggatgcccgcgccagcagtcgcagtgacagtaccgttctgctaaccggtgaaagcggaaccggtaaagagctgtttgctcaggcgatccacaatgccagcagccgggcgcatgagtcctttgtcgcggttaactgcggcgcactgccgcgtgacctggtgcagagtgagctattcggctacgtcgatggcgcgttcaccggctcacggcgcggcggttcggcaggtaaatttgagctggccgacggtggcacgctgtttctggatgagattggcgagatgccactggaggcacagaccagcctgctgcgcgtgctgcaggagagtgaggtgctgcgcatcggagcggcgcatccgctgaaagtggatgtccgcatcgtggcggcaacccattgcgatctgctcagtgcagtggaacagggtgctttccgccgtgacctgttctatcgcctcaatgttatctccctgaccatccctgccctgcgtgaacgccagagcgacattcctgatctggtgaataccttcattcacgccctgtgtcagcggctgaataaaacgcctccgcaggtgagcattgaagcaatgaacgccctgcaggcatggcactggcccggcaacgtgcgcgagctggaaaatctggtcgagcggatcgttaatctttgccagagcagcatcatcgaccttgccgatttgccgccagcgatggtgacgcgcgcagccgaaaacagaccagcggccagcagcctgttgcaggataatgaacgagcctgcatcctgcagacccttcgcgcgcaggggggtaatctgcggcagtccgctaagctgctgggcatttctcgcacggcgctctataacaagctcaatcactggaatatctctatagatacgctgcgccaataaccggctggtggcactcagcaacaccagcatacattcagttcgttcaaaatatggcttttgatcgcaacagggcctaaaatgtgaccacccttaacagtggtcactgaattttttcacccacctttgatctgccaggttctgacaatgactcaatccgtaacggaaaatggcacacgcggcccggccgggcacaatgtgcgtgaccagattgtcgatgctgccatgcagcacttcgcgcattatggttacgaaaaaaccaccgtctccgatctcgcccgtgctataggcttttccaaagcgtatatctacaaattttttgaatcaaaacaggcgattggcgaagtgatttgctccacccggcttgcgatgattatgcagcacgtcgaagtcgctatcgccgatgcgcctggagcatcggaacaactgcggcgactgttccgcacgctttccgtcaccggcactgaactcttttttcacgaacgtaaactctatgatattgctgccgtcgcgtcgcgtgaccgctggccgtcggcgatggcgcatgaagaacgactgctcagcctgattcagcagatcctgcgccgggggcgtgaagcaggtgagtttgagcgtaaaaccccggctgacgaagcggcggaggcaatctatcgggtgatcaaaccctacgccagtccggtactgctgcagtacagccttgatgacgctgaagaagcctctgcacaactggcagcgctggtgttacgtagccttgcgccctgaacaatgcgcatgatgtgactattgacttatttagtcacaagagcaacgatagcactctgtctggttatcgctcaggattctgatgctgctaagcttatctctctctgctctattccatccctgcgttcgtccatcgcaccattctacgcagggtctcaccttccgcgctcaaggcgtgtatccattgtctgcggcagcatttcaattactgtccggactctctacgggagtaatccaatgagtcacttagcctcatcacaacgcattgtcattaccggcgcgggcatcgtttcgccactgggttgtggcgttgaaaccgtctggcggcgattaacggctggagaatcaggtatacgtacccttcccgatacgcttactgctggcaccggtatttcagtaggtggcagcgtgccgggcatcgatgaagatccgctggcaggttacgaccccgaagcgttcattgcgccgaaagagcgtaaaaagatgtcgcgctttatagaattcgcgctgctggcagcagaagaagcgctgaatcaggcagcctggcatcctgaagatgaggcgacgcgcgaacgtaccgcgacgattattgcttcaggcgtcggcggctttggtgccattgccgacgcggtgcgcaccaccgatgcacgcggcccgcgcaggctctcaccctttacagcaccttcgtttctggccaacatggccgcgggtcatgtctcgatcaaacacggcttcaccggcccgctgggtgcgcccgttaccgcctgtgcggcgggagttcaggcaattggtgatgcagccaggttgatcagaagcggtgaagcggacattgctatttgtggcggcacagaagcggcgctggatcgcgtcacgctgggctgtttcgcggctgcacgtgcgctatgtgtgggctatgaagatcagccgcaccatgcctcacgtccgtttgatcgtgacagaaacggctttgtgatggccgaaggtgcaggcctgctggtgattgagtcactggcccatgccgaagcacgcggcgcgacaccgctggcggagattgtcggctatggcaccagcgccgatgcataccacttaaccgcgggtccggaggatggcagcggggctgcgcgggcgatgagaaaccgccctgcgccaggcgggcatcagcccggaagacgtccagcatatcaacgcacacgcaacctcaactcaggttggcgatcacggtgagctggcggctattcgcgcagtgtttggcgatgattcgcaggtcgcgatcgcctcaactaaatccgccaccggccatctgctgggtgcggcaggcggcgttgaggcgatattcaccctgatggcactgcggcagcagcttattccgccgacgctgaacctccatcatcccgatgaagccgcaggcaatcttgacctggtggcgctcaatgcacgtcccacggcgctgacttatgccatgtcgaacggttttggttttggcggcgtcaacgccagtctcctgttgcgtaagtggcaatgactgcagtgtgacgattaagcccgcgctgccagacaccctcttagcgcgggtattacatcggacgtcctgaaaaatcatgcacagctgttccctgtgtgccggggtttatcaaaacaccctctgtacaacactcgctttataaatctgtacctttcctgacaaaattgcctccgccagccctcctgccctttttctttcagcactacaattaatcggatgaaaacaacctcagagaacgttaatgaagattgcagctttcgatattggtggtacctctttaaaaatgggcgtgattgatgagcagggaaatattctgaccagtgagagtgctgatatttcccataattcacgcgacaaaatacttgatgagatcctggcctggctggagaaaaatcccggctgtgctggcatcgccgtcagcacgcccggttatattgatgcagaagccggatatatcgccatgggtggcaccattcgggactttgaccagtttcatctgagccagtggctgacggaaaaaacctcactgcctgccacggtcgaaaatgacgcccactgcgccttactggctgaacagtggctgggcaaagcaaaaaaactcagtgattttctgatgttaactatcggcacaggattaggcggagcggccttctgcaacggcgcgctgatccggggcggtcgtaaccgcgcgggcgagtttggctgtctgctgacttcgcgccccaccagcagcaatattgaacgccataccatgagccagagttgtaccatgacggcgcttcgggagaattacagccagctcatcgaaaaatcttccgacgacgtcacgggtaaagatgtctttgacgcatacgatcgcaaagaagaagccgcgcagcaggtggtgaataaattctaccaggatcttgcagcctgcttatataacctcttcagcgtgttcgatccgcagatgatatttatcggtggtggaattaccgagcgggagccgttcctcgaggaactggcagagcaactggcaaaatatgatcttgatatccgcattgataccgcgacctacggcaacgactccggcatgttgggcgcaacctggaatttcctgcagcgtcagccagacaaataatggcttgtagttcaggacgtatgcaggttacacctttctgataattatgatgatttatctggtgcggtattcaaaacgataacccggtcatgaccgggtttactcttgtttatattaatgtcgtatttgcgccagatcgtctgacgtcaggccggtcatttctatgacagttttacgatcaaggccgttttgtagcatagtgcgcgcaattttcagggtagcttcacgctgtccttcagtacgacctttctcaataccacgccgttcaccaagctcaataccttctgcgcgacctttttcgatccctttttgttcaagctgctgtgcgatggtcatcagtgcgtctccgtgttgtggcacccgctgtgccagttcgcgaacgaaagcttcgtagtcagctgactcaccagcctgcagtaaatagtgtatcagcgtcatcacctggggtgaagaaagataatcggccatgagtagcgtgaccagatggtcagtcaggcttgcaatgtcgcgttgatgaatatgtttctgcaaaagcgtcagggcggccatactgcgatgagtcatgatctcatcatccgggatgaccgtaatgtccaccagcgggaaggcgcctctataaaggctttccgccactaccggatcatcaaattcgtcgaaccagcgggtcgaccacggatagggagtgcgcttaccggtatagaacagtacaggtatgactaaaggcagctttttatggccagcttcaaggtggcgctgcatagcggctaccgcataacgtatcaggcggaatgccatatgcctgtcaggggtggattggtgttcaatcagaacatgaatatatccgtcaccggttgaggttctgagactgtacaaaacgtcactgaagtattgacgcaaatcgtcttcaacaaatgatccggactcaagcttcagtgtggtgagatcgcagattttaagcaatttctccggaaggtggatctgcataaaatctctggcaacatccggatgcgtaagaaactgtctaaaagtagcatcatgaggtgtagcactatttttatttttcatcagttcagcccctgtaaattccatgcgctgctaccacagcgaagaggctatcttaatagatcacattttaatttataatatttaaatcctgcccaatccatatagattaactacaccaatgctcttttaaaaaatttattagcaagatgcattatgacgcaatctaaattaaccaccttaatcaatttatatagcgataattaaaacatccggatgtacccgaaacttctaacgctgaccattaatgtctgaaccgctttacgaaaagttaattttctatttaagtcacggcataaccagcccgatcacgctgtttataccgctcgctccctatccccgtcccggcgcatccaacaggctaagcgccacgcctgtcagggtatagaccacgacatacaacagaatcagtgccgcaagcaaaaggcggtggctgcgcatctcacttttcttcatggtgccattcagaaggtgtagctcaatgccagggtggccgatgcgccgttgtgccgtgcaacgatggggctatctgaagcatgcttatccagccagctgtagtcaccgatcacactggcagcccaggcaggcgtgaactgatggctccaggtcaggctggtatcggtgccataaaatccacccgcggcgtcgtaccgttcaaatccgctgcgcgcactttgcttgctgttaacgccataccaggtattcatataacgcccgtcgccaaacagtcccgccacctgcagtgccacggtatcgtcactggtctgccaggggatcagggttacggaagtccggtactgcacaccctgactatcgcttaatggcagcgtcgctttgccctccagcaccagccacggcgttaccgaccatcccagcgccagcgcggtgttcatcgttgcgtcgatgttccccatgcctctgagccggtcatccccatctcgccaggatgaattctggtcagaaacggcccagcccgtagcccagcgtatgttccagatacagtccattatctgcctgcaggtcatagccaatgcctttctgtgagtctaaaaagaaggccccgtcgcgtgcctggatcaccggcatcagctgccagtgctgcttatcggcgccgctatagcgtggtgcattgatacctgcaatgcccagcgtgacgcttggcggcggcgtagtctcatcagctatggcagtcgcggcactgaatcccagcgaaaaacagaccatgtgcagcgttatttttccggttatcatcacgtttcctcattatcacatcaggtgcggagctgaggggttcagagccgcgtcaatggccggagtatgcgaggcgagtgtcaattaacgaccagggatttatgaagaaacagtcaaggtgatccgaaaatgcagtcaaaacgtgtactgattattgaagatgatgctgatgcggcgggcgtacttgaggcctacctgaaacgtgaaaattatgaggtcatgattgccggtgatgggccaggcgggctggatgccgccagacgctggcagcccgatctgatcctgctggatatcatgctgcccggcatgaacggcactgaagtgctggcagcgctacgacgtcgtgacgataccccggtgatcatggtaaccgcgatgggtgatgcgccggaccgcatcggcgcactgcgctatggcgcggatgactacgtggtcaaaccctatcatccgggcgaagtggtggcgcgcgttcaggcagtactgcgccgtagccagcagagtcaggtacccgctgcagaaaccctgcgctgggcgggtttagtggtggacccggtggcgctcaccgcagtggtcgatagcgacagtgcttcaccgcgccgcctcgatctgacaccgaccgaattttccctgttggtcaccctgatgcgcgctccgacgcgtccgtttacccgcctgtttctgctggagcactgtctgccggaaagcgatgcgcttgagcgggtggtcgatacccacgtctataacctgcgtcgcaaactggaagccgcgggcatctctgatgtcttaccggcagtgcgcagcgtcggttaccggttcagacagccatgaagaacgatacgcatacttcattgtggcgctggatctgcatccgggtgctgtttctggcgattggcagcgtggtgctcattgccatctgtatgtggctgcgcttcgcagtgcaagcgtactgggtctattaccggatgccgcccgcgctgctggatgagttcacccggttgcgccaccaccctgccagcgatcctgtgcgctttcatcagattatggaccagtggtggggcatcaacttctccgatccgtcgctggcctcgtcggactggcttaccgtgatcgtgctggtcgtggtaacgattccgtttatggtgctgatggcgctgcgtttcgcccgtccgctgtcggcgcagttcagccagctggctaccgcggcgcgagcggtttcaaaaggcgaatttggccgatcggcggtaatcgtaaaagaagccccacaggagctggtacgttttactgaagattttaatcagatgacgcagcagctggcgcgttacgagcgtgagctgcgcacctcgcatgtggcgatggcgcatgagcttcgctcgccacttacggcggcgatgggccgcctgcaggggattctggatggcgtctttcctgccgaaccgcaacagctggcaatgatcatgaagcaactgacgcagctcagtcgcctgacagacgaactgcatctcttgtcgctggcggatgccgggcagcttaccctgaaccgcgagtggtttaatctcagcgagttactgcgcgagcgctccggctggcttctgccgcaggcagaacaggcggggattgccatcagcgtgacatcacccaacgatctgcggctgtatgccgataccttccggctgggccaggtagtgaccatcatctgtgagaatgcaatgcgctacgctgccgacggtggcgcgttgctgatcacggccagccagaacgatcaggcgatcataatgaccttccgcgattatggtcagggtgtggagccggacttcctgccgcaattgtttgaccgctttacccgcgctgactcctcacgcgcccgccactccggcggcagcggtctgggactgtcgattgccaaagcgattgtcgaggcgcacggcgggtcgcttcacgccacactgcccgccgacggcggtctgctgatcgggataacgctgccgacgagataaattgttctggcttgaccatttcttgatggttcatggaacgtttctggacacatgccgggttcaatgagcacaactcattaaaggaacccggttatgacagacttcttatcggatgctgcccgccaggtgtggcgtcatctcttcggtattcacatctttgcgccgatcatcttcgtgctgctcggggtattcatcatgaccggttgccgggacaatagttctgctccgcctgccgccccgctccgcccggttaaatcggtgattgctccaccgctcagcagtgatgcatcgctggtgctgactggcgaaatccgcgctcatgaagaggtcgcgctggccttcagactggatggccgggtggtgagccgtgcggttgagctgggcgatcgcgtcagcgccgggcaatcgctggcagcgctggaaaatgatcagtcacgcaatcagctaagcagcgcacgggccgatctcgacagcgcatgcgccgccgaacgggtcgccgcgcttaacctgcatcggatgcggctgctgatgcccggaggggccatcgcccgcagccagctggacagcgcacaggcggactggcagagcgcacagtcccgccgtctcagcagcgaagcggctctgaaaaatgcccaggataacctcagctggactcagctgactgcgcctgcagcaggccggatcaccgccatcacggttcagccaggtcaggtggtcagcgccggacaaaatgtgatgacgctggcagcaggggatgcacgcgatgcggtgtttgacctgacaacgcctgcgctgctgcatcctgatgatcggacaccgctgaaagtgacgctgctcgccgatcccggcgtgcaggccagtggcacagtgcgtgacatcagcccgcaggccgatccacagacccgcacatggcggctgcgcatctcactgaatcagccgcctgaggcgatggcacccggtgccacagtcattgtcacccttcccgatgcgcagccgccggtcatcgccctgcccgccagcgccctgacccgctccgcagacaaacccgcgctgctggtcgttgatgcggcgtcacgcctgcagcttcgtccggtagtgctggcccgctttaacgcgcagcaaatcttcgtcactgccgggatcaagccgggagagcgcgtcgtcaccgccggcgtcagcaccctgcaacctggcgaaaaagtggcgctttcgcaggaggctccatgaaaaaaacgtctggctttaacctctccggctgggcgctggcgcatcagcaactggtgatctttttcatgctgctggtcatggcggcgggtgtgctgagctatgaacatctgtcacgcaatgaagacccggcgtttactatcaaaaccgccgtaatatcagcccaatggccaggcgctgatgtgaacaccacggtgcaactgctcactgacgtactggaacagaaggtgcaggagatcccgtcgctggatgcggttgagagcgaaacccgtgccggacaaaccgtcatctatgtcaacctgcgcgatgacacgccgccctctcaggtggccggcatctggtaccagctgcgtaaaaagatgcaggatgttgccccttcactgccgcagggcgtgcagggtccggccgttaacgatgagtttgacgacaccttcggcaccatttatggcttcacggcggagggttttaccgccagagagctacgcgaccgggtcgataacctgcgtcgcaatctggccagtctgcccgacatcggtaaaaccagcctgttaggtgtacaggagcagcaggtggttatcgccttttcgccgcgcaagctgaacggcatggggctcgatttacagcaggtcagcgacgccattaaagctcagaacgatgtcgtcccggcgggcagcctgcgtaccgaccgcgagaatattgcgctgcgggtcagcggcaccctgacttcggttgaaaatctgcgggcgattaccctgcatatcggtgagcgttttattccgctgaccgatctggccaccatcagcctgcaacctgccgaacctccggcgccgacgtttagagttaacggcgttccggctatcgggctggcgatctccatggccggcagcggcaacatgctcgatttcggtcagcagctcagtcagcgcatgcagatgctggccagtcagttaccgcacggtattactatgacccgcgtggccgaccagtcttccgtggtgaaaaacgcggtcagcggctttgtccggatactgggcgaagcagtcgtcatcgtgttagccgtctcctttgtctcactgggactgcgtgccggtctggtcgttgcggcggcgatcccgctggtactggcaatgacctttaccggcatgttaatggcaggcatcggactccagcgcatctcgcttggcgcactaatcatcgcgctggggctgctggtggatgatgccatgatcaccgtcgaggcaatggtggcgcgactggaagcgggcgacagcaagtggcaggccgccacctatgcgtttaaaaccaccgcatttccgatgctgaccggtacgctggtaatgatcgccgggttcattccggtcgggttcgccgcctccagtgccggagaatattgctactcattgtttgtggtgattaccctggcgctgctctgctcgtgggtcgtcgcggtcatcttctctccgctcaccggctgctggctgctgtcggccaggcacatcaaggccgataagccgccgggcgtgctgacgcgcagctatcaccggctgctggagatgattctgcgtcaccggctggtgacgattggcacagcgatggcggtgctgctggtcagcctttacgccaccacttttatgcagggtgagtttttccctgcgtcggatcggcccgagctgctggtcagcctgacgcttcccgccagtgcagcccaggctgaaaccacccgccgaaccgcacagctggaacagatgctgcgcaacgatcgggatgtggcgaactacaccagctacgttggctcgggcgcaatacgcttttatctgccgatggatgtgctgctggataatgaaaacatcgcgcagctggtggtggtggcgaaagatctggcggcacgcgatcggctgcgcagcaggctggagcagaagctggcggtggatttcagtgatatcactacccgggtatcgccgctggagctgggtccaccggtcggctggccgctgaaatatcgcatcaccggcccggataatgccagggtgcggcaggcggccgatcggctggcggcgctgatcgcccgctcaccgctgactcgcgaggtcaatcttaccgccggagagccagaacgggtcatgacgctggcggtgaaccagactgcagcccgcgcagccggactctcttccgagacgatagccaccgcgctgaatactctgatgtccggcagcgtggtgaccaccctgcgcgatcgtaaccgcctgatcgacgtcgtgctgcgcagcaatgacccggagcggcaggacactgacacactggcaggattgatgatcaccaatgccagcggacagaaaatcccgctgcgacaggtggcaaccctgaactggggagtggatgacccggtgatatggcgacgtcagcggctggcttacatcaccgtacagaccgatattgcgcccggtcagcgggctgaacaggtctcgcagcagctcgcaccagccgtcgccgccctgcgcgcctcgctgccggccggatacggtattgaagaaggtggcgtggcggccgaatcggacaaaggcaacggttcagtgtttgctctgctgccggtaacaatctgcgtcatgctggtcttgctgatgattcagctgcaacgcttctccggtatgctgctggcgctgagcatggcaccgtttggcctgcccggcatcgtatccgcgatgctgccggctggcacaccgctggggtttcgtggcgctgctggggattattgccctggcggggatcatcatccgcaacgcggtgatcatgatcagtgaagtcgatgcgaatagccgggccggcctgaccgcgggtgaggcaatccggcaggctgcccatcaccgtgcgcgtcccattctgctgaccgcctgtgcggcaatactcggcatgatccccatcgcccatcaggttttctgggggccaatggcactggcgattattggcggtctggtcagcggtacgctggtgacgctcacggtgctgcccgccgcgttaagtctgttgatgcagcgcggttcacgttaaaacaacatccggcgatcccgtgctgagaacggcgggatcgccggaaaggatcagttcatcacctcgaccagaatcagcgggcactttctgactttgcaggcctgactgtaggccagcgagcagaccgagcagagatcgcgcacgtcagactggtactcatactccatgaaatagcggaactggccgcccgccgaatctgttctccagaatcgctgcggctccagaatttcatccagttgcctgaatgtcagggctgacgggttgtgaaacccgactcttacgcggtatgtagtcatgcaccgattattggcatcccggtccctggccgccagttggttattgttttcagttcaatagctggcgcttatcaacccgcttcgcctggtgcggcaggctgttctgccagcagcgccagcaggtgcagtactgcttttgacgggtgaagccgacgccaggcaaaggcaacatccgtaaatagcgtgttgttttcgatatcgcagaagctgaccccggggttatcgacgcagcgcatcgactccggcaccagcgcaatcccgcagcccgccgccaccatgcccagcgacgtagtgatctgcggagcctgctgaaaagtgtggcgcgaaaagcccgctcgcagacaggctgtgacaatcaactcatacaggctgggcgagacgtcgcgcgggaagatcaccagggtttctcccgccagcgcggatagtgccacagtgggtgtgccgctgaggggatggcagcgcggcagcgcaatcagcattttctcggtggagatgacgcgcagattaaatgacttgctgctttcacacggcagccggataaaagcggcatccagtaatccctcctgtaaatcctgcatcagcagagacatattctcttcgcgggtcagaagctccatcgccggataacgttctttaaactggcggatcagggtgaagatgcgtggattaaacgccaccgagctggcaaagcccagcgacagctgaccactgatcccgcgcgcaataccgcgtgcgttctccagcgcctgatcggccagttgcacaatctgccgggcatccgccagaaacgcttcgcccgcttcggtgagttccactccgcgcgtcaggcgcttcagcaacggtgtgccaatttcctgctccagccgcagtatctgctgactcagcggcggctgcgatatgcccagtatctcggcggcacgagtgaagtgaagtgtctcggctacggcaacaaaataacgcaggtggcgaagttccatatcaaaaacgtctcaaagttaacaggtttcgctattggacccaccgactgaatcggttcaccattaggttaacacggcttaacggttaatcgatgaggcatcaaatgagcaattgtgtaactgattgttcctgtgaggatcaactaaaacatactgtcctgacgctttcacaggatgcaccagaaagcgttatctatcagacctctttaatgagtgcgctgctgagcggcgtttacgacggcaatgtccgtattgccgacctgctgcgtaaaggggatttcggcctgggtacctttaaccggctggatggcgagatgatcgcgtttgacagcaaggtctatcagctgcacgccgacggcagcgcgcacccggccgatccggcgcagaaaactccgttcgccgtgatgaccttttttaaaccgcagcatatgtatgaatttgaccggccgatgtcgcgtgaggcgatccatcaggtgatcgacaacgaaatcacctccgataaccagttctgcgcgctgcgcatcagcggtcgtttcagtcgcgtcgagacccgcaccgtgccatgccagtgccgtccctatcgctcaatgccggaagtgctgggcgatcagccgacctttgccttcagccagcgtgcgggcgaactgatcggattccgtacaccgcaatatatgcagggcattaacgttgcaggctatcacgaacattttattaccgacgaccgcgaaggcggcggccacattctcgactatgcgctggaacagggcaccctgacctttggtgccatcagcaagctggtcgtggatttgccgcaggacagcgattttctcaatgccgacctgaaccccgccaatcttgacgccgcgattcgtgcggtagaaagctaatcagaggaatgacgatgaaaactccaaccgataccacactctggacctgtggcgctgacctggtggtggcgcaacttgaggcacagggcgtccgccacgtctttggcattcctggcgcaaaaattgataaagtcttcgactcactgctggattcctccatccagaccatcccggttcgccacgaagctaacgctgcatttatggccgccgcagtgggccgccttaccggcaatgcgggcgtggcgctggtcacctccgggccgggctgctccaacctgatcaccggcatggccaccgccaccagcgaaggcgatccagtggtggctatcggcggtcaggtgaagcgctccgacagcgccaagcaggttcatcagagcatggacacggtttcaatgtttcgcccaatcactaaatatgcggttgaggtcaccgaccccgctgcactttctgaatgcctgtcgaatgcgtttcgccacgccgaacatggccggggcggcggtgcctttatcagcctgccacaggatattgtcgatcagccggttaccggcaaagcgttgagcagcaaaggccgccctgtactgggcgccgcacctgactcaatgatcgacgccgtcagcgaggccatcgccggggctaaaaatccggtcatcctgctgggattaatggcgagccagacagagaacagcgaagcgattcatgagctgctgacacgcagtcacattccggttaccagcacctatcaggcagcaggagcggtcagacaggatcacttctcacgcttcgccgggcgcgtcgggctgtttaacaaccaggcgggcgacaggctgctgcaacaggctgacctgatcgtcaccatcggctacagcccggtggaatatgaaccggcgatgtggaacagcggtaacgccaccctgattcatatcgacgtaatacccgctgagaccgacaaccgctatctgccggatgcagaaactggtgggtgatatcgccgccacggtgcgtaaactcgccgcgcgcatcactgcccccctccagctgaccccggaagccgccaccatccttgaggatcgtcagcagcagcgcaaattgctggcgatgcagggtgccagcctcaatcagtttgctctgcatccgctgcgcattgtgcgcgccatgcaggacatcattaacagtgacgtcagccttaccgtcgatatgggcagcttccacatctggatcgcccgctacctctacagcttccgcgcccgtcagatcatgatctccaacggtcagcagacgatgggtgtggccctgccgtgggcgattggtgcctggctggtcgagccgcagcgcaaagtggtttcagtttccggcgatggtggtttcctgcaatccagcatggagctggaaactgctgtccgcttaaaagccaacattctgcacatcgtctgggtcgataacgcctacaacatggtggcgatgcaggaagagaaaaaatatcaccgcgtttcgggcgtcaattttgggccggtcgatttcaaagcctatgccgaagcgtttggggcagcgggctttgcggtgaccagtgcggcagagctggagccgacgctgcgtaaagcgatggatgttcagggacccgccgtggtcgcggtgccggtcgattacaccgacaacccgctgctgatgggtcagctgcatctgagccagcttctttaatttctcaaaaaggaaatcatgatgaaaaacagagtggcatttgtgaccggcgcaggccagggcattggtgaagcgatcgccctgcgtctggcgaaagatggactggcggttgcagtagccgattttaatcaggagaccgcacgccaggtcgcggagaagatcattaagcatggtggcaaagcgattgcgctgaaagtcgatgtctcacagcgtgatcaggtgatggaagcggtagaagaggcgcgccgcacgctgggcggctttgacgtcatcgtcaataatgccggtattgcgccctccacgccgattgctgagatcaccgaagcggtggtcgacaaggtctacaacgtcaatgtcaaaggggtgatctggggcatgcaggccgcgattaaagcgtttgctgcagaaggccatggcggaaaaatcatcaacgcctgttctcaggcgggtcatgtcggtaatccggagctggcggtttacagttccagtaagtttgccgtgcgcggcctgacgcagaccgccgcgcgtgatctggcacctgccggcatcacggtcaacgccttctgccctggcattgtcagaacaccgatgtgggaagagatcgaccgccagatctctgaagcagccggcaagcccgccggctacggcaccgaggaatttgcgaaacgcattacgctgggacgtctttctgaaccggaagatgtggctgcctgcgtcgcctacctggccagtcctgactccgattacatgaccggtcagtcgctgttgattgatggcggcatggtgtttaactgatcttcgttcgcctgctgcgtcatcgcgtggcaggcatttttcctgaccgggttgaaccgttaattttttttatctgaaaagcggttaatcatcagcctcttgaccgtctgcccccgtatttcctgcctttttgtcgccacagagattaaagctgcttatcaccctgccgataaaacagagactcctctccctgttcgaagcgaccatgttaacgatcaaccataacgaaaccgccgcgattacgaacaaaacgcggtacagcactgactctgttctgggacgaacggttgaacggttatcatcagggatgagaattaacagtgccaaagatgacgcggcaggtcaggcgattgccaaccgcatgacggccaatattaatgccgatgcggtggtagcgcgtggcctcaatgacgccatcagctattcccagaccgccagtggcggccttggcagcatcgtcgatctgctgatccaggcgcgcaccctgtcggtccaggcagccaacggcacgctgtcggacgccgatcgacagagcatcaacggccagtatcagcagattatggcaggcatcaatgaagtggcagaccacaccgagatttttggccgctatccgctggcgacgaataatcccgatcttccccctgcaaaactgggtaacgttgaccctatcaacacgaagtttccggtgccgggcaagaattactcctttacctctggcgtgatcccgctggcctatatcccggcaggctcgacggcgataagcatcacgattgattcgctgggtatggatgacgatctccagctctttacccgcgacggtaagcacctggtcggtacaccactggacggcagtgcgcctgattacacctgggccagcaaaagcatcactaatgcggctacagcggatagtcgcctgctgaccagcagtaacggatttgccagcggtgcggcttatgacagctcgcagttactggagggcggcccgagctggacgctggcgggcagtaacagcagcacctacaacggcatgaacatcacttacagcggtgacggcgatcgctatgaggatgtcgccagcggcgatttcaacaacggcaccatcaccagtaaccggcttgagcgcatcacgctggataccgtcagcgaggatttgattgtggtggtggtgggcaatggctccttcaccggtaatctgacctggggaaatctgccggaacccaaaggtgtgcctgcgacgccgccgaagaagagcgaacctatggaggtggtcaccagcgccgattacggtcagccgatccagtcggatactattccggcaacgccatcggataccaaaacgctggggctgaacaacacaacgctgcttacagagggcgatatctcaaccaccatgaaggcactggatagcgcgctcgagaagatcagcggttatcagtcgatctatggcgcaaagatcaaccgctacgagtccaaccgtaatgtgttatcgcagcagggtgtggatacctcagcggctcgcagccgcatacaggatgcggactatgctgaagaagcaagccagctggcacgcagccagattattcagcagggtcagactgctgtcagcaaaatggcgaataaaacccctgaaataattattcagctgttaggcagctaataacgttaaccggctgagcatcaaggctcagccggttaccctgtttctccaccactctactacccgcctgattcagcccccagctggcccgaaaccccggttacacttcgacaccctttgatctcagtcacacaatctcgtttaagaaccgtttaaagatgatcatgatcacccttctttgttaaagaaatgctaaatactgacaactatttattatcatctttgaatgcagggttaattaaaacaacaggttaatcattaccacgctaagtaattacctgaattttcctgccgatatgtaactttttcattacttttccgccattgcgagggctgttaatttgctgacgatactgggtttttccatggttgtttgcttcatgtatctgatcatgaccaaacgcatgtcagccttgattgcgctgatcctgataccaaccatatttgcgctgattggcggtttttacgcaggcctgggtgccatgatgctggacggcgtcaaaaagctggcccctaccggcgtgatgctgaccttctccattctctatttcggtctgatgatcgatgccggattgtttgacccactggtgcgctttattcttcggatggtgcgcggtgaccccctgaaagtgctggtcggaaacggcggtactaacactactggtttctctggatggtgacagctctaccacttacatgatcgccattgccgcattcctgccgctctatcaccggctgggcatgaacgtgctgatgatgacctgtctggtgaaccttgccagcggcatcatgaacctctcaccctggggtggcccgacagcccgtgccgcggcggcactgcgcattgacgcccttgatatctttattccgatgctgccagccatgctgctggcctgtgccagcctggtggcgatggcggtgctgtttggcctgcgtgagcgtaagcgccttggcgtgatgaccatgaaagatcatcatctcgacaacattgagctggggctgggcgatgctgaagagtgcgcagccaatcgccgtccgaaaatgttctggcctaacttcatcctgaccaccgtgctgctggtgctgctggtgattggtttaatgccgattcagatcctgtttatgctggcgtttgcgatagcggtgatgctcaactatcccacgctggaggagcagaaagcccgcatcagctctcatgccggtaacgtgctggcggtgaccgcattaatttttgccgccggtattttcaccggcatcctctccggcaccggcatggttgacgccatggcgaagagcctgctggctgtgatcccgcccagcttcggaccttacctggcggtgttcaccgcgctggtcagtctgccgtttaccttctttatgtcgaatgatgccttttacttcggcattctgccggttatcgcccagacggcggccagctacggcattaccgcagaagagattgcccgcgcttctattgtcggccagccattccacctgctgagtccgctggtgccgtcagtctacctgctggtgggtctggcgaaagtcgacatcggcgaccaccagcgctttgcaattaagtgggggattctggtcagtctggtgctgatggcaggtggtctgctgaccggtgctttcccgctgttccacacctgataatcctctgctttctggcggataaccggcaattttgcccggttatccgcttcaccgctccgcctactgcgtcatccctctctacactctatagccaggctgatgtgctgcgcgccggacaggccgtagcctctcagagatatccccattgcccctatggaggcccgatgaaaattcaccaccttaactgtggctgtatgtgtccgctgggcggcgcgttctatgatggattcagtaaaggcctgaaagcacatctggtctgtcactgtctgttgattgagacggatcgcgacgggctggtgctggtggataccggctttggtcgccaggatatccatacgcccggcagccgcctgtccggctttttccgcgcattaaacaatattcagcgccgcgataatctcaccgcactgtcacaggttacgtcactgggtttccgggctgaggatgtgcggcatattattctgacccatctcgacttcgatcatgctggcggactaaccgattttccgcaggcgcgaatccatctgatgcagcaggaggttgataccgcgcatcagcgccatagctggctgtcacgggaacgataccggcccggacaatggggtgggatcagcaactgggaaacctatcagccgcagggagaaaagtggtttggttttgaggcggttaatcgcctgcgtgacttaccgccggagattttgttagttccgctggcgggccatacgccgggtcacgcgggtatcgcgattcagcaacccgatggctggctgctgcacggcggcgatgcctggttttaccgcggcgaaatgcggcagcagacgcggcactgcacgccaggactacgcttttaccagtggatgatgggcatggataacgtggccagacgacacaatcagcagcgactgcgtgagctctcctgccagcgcggcggcgaaatcacctttttttgcagtcacgacgcccgtgagctggatgcgttacaggttaatgcgccgctgcgctgataagataaaaggtttgttttggcgatgaggaaagccgcttcggggcgagaactataccgtctcgtcccgcaataatgatgctacgatccctggatgcagaggaacgccggaaacatctgtagtttctcgcgccttatgcagatcacatgcggcctgcatggataaccagagccgtgccgcaatacccagacccgcctccagccgtacagccatttccgggctgacggaggctttaccgctagccactttgctaagcgaagctgcggaaacgcccagctgtttagccagactgcgcaggctgatgtcgttatcttcgagatattccgctatcaggccaccagggtgtggcggattaaacattgccatcagtgataatcctcaaggttgagatttgacgggctttgaagccagcccctgagccctcagactacatcaccttcagcggaagatatctctaccgcccgcttactccggatcgcccgccctctttttcagctgtgcggaaagccagggtgcagtcagactctctgcagatgcgctgacctcttccggtgagccggaggagacaactcttcctcctttaagacccgagccgggacccagatcaatcacccagtccgcctctgccactatgcgcatgttgtgttccgccatgatcacggtgtgaccacgcttcaccagttcatccagcactaccagcagcttatccatgtcagacgggtgcaatcctgtcgaaggttcatcaagcagataaagcgtgggcgtacgctggacccgctgcagctcccaggcaagcttgatacgctggcactcgccgccagagagttcagtggcgggctgacccagggtcagatatcccagccccagcgacgtcagtgccttaagcgaaacgctggatcccgtcatgtccatgaaacaccttagtggcgtcgtccacggtcagatcaagcacatccgctatcgtcaggttgttccatttcacctccagcgtttcggggttataacggcttcccgcgcagacggaacaggttgcggtagcgctcggcatgaagagcagctcaatcgaaatctgtccctgcccttcacacgcaggacagcgtccggctggcagattgaaggaaaaccggctggcgctgaagcctttggctttcgccgcgtcggtgtctgcaaacagcctgcggacaatgtcgaaaaatccggtgtaagtggccagattcgagcgtggcgtccggccgataggacgctgatcgattctgaccaaccggccgatggcgtcacttccgctgacaacctgacccttaacgtccggcaccagatcctcttcctcgccctcctcgatgtcaggcgttttgtcaaaacgtccgagcatttccggaagcacgcgattcagcaacgtcgattttccggagccggacacgccggtgacggccgtcattctccccagagggatggcgatatccactccggcaatattgttgcaatagacctgttcaaagcagagccagctctctgcaggccggcgctggcgcagcccggtatagcttcgtgagaaaagataggccgaggtgggtgacgcactgacttcttcaagccctgctggttcgccgttataaacgatctcaccgccatgcgttcccggaccggggccgacctcaatgagccagtctgcctcggcgatgaggtcaatattatgttcgacgaccaccagagaattaccggcacgcaccaggttcttcagggatgcgagcagcgatttgacatcatcgggatgcagcccggctgacggctcatccagcacataaagcacgccaaacagccgcgatatcagctgggtggccagacgcacgcgctgcagctcgccggatgagagtacggtggtacggcgtcccggcgccagatgacccagacccagcgtttccagctgctcaagccgcatacagatatccgacgccatccggatgaccgcctcacgcagtgccgcctctgccggcaggtccggtgatgcgccacgcgcataaggcttcagcagttcagcgagctctgagaccgacagctcactcaggctggcaatgtcatgcccggcaaaggtcacggacagcgcatcccggtttagccttttaccgtggcattcagaacagggagtgaccgtcacaaagcgcgccagccgtttcttcgtcgtctcgctgccacccgaataactctgcagcacgatttttgctgcactggtgtacgtgccggtataagccggctcttcgcccgccgccagcgcgttttcgcgctgctcagcattcagaccgacaaaaattggcaccgatggctgttcgtcagtcagcagtatccactgctgatcacgggctgaaagtgtattccagggcgcatcgacatcgtagccgagcgtctcaaggatgctgcgcagatttttgttatgccagcctctgggccaggaagcgatagctccctggcggatgctcagtgagctatccggcaccatcgactcggttttaacggtgtgcactcttcccagtccctggcaatgcggacaggcaccttcaggattgttaggcgagaaaaaatcagcggtcataaagggaacgccttcaggccttacgcccgcacgggaaaacagcagacgcagcgtgacagaaatccgggtgaggctgcccaccgttgaacgctcctgcgcgccagcccggctctgctgaagcgccaccgcgggtggaagtccgtcaatattatccacatccggtgcagcagcctgatcgatcagacgacgcgcatgtggcgacaccgactcgataaaccggcgctgggcttccgcatagagggtatcaaaggcgagggacgatttaccggagcctgaaaccccggtgaacaccaccatggcgttgcgaggaaatcgcaacgaaacatctttgagattatgtgttcttgcaccctgtaccgagatataaggatcaatgtgctcatcagcgcggtaatgatcggcgttgcgttgttctgtcatgatttccctgattgataatgcacggcagattcacgatcgcctgccgttaatgactaaaaattgcagatgctaatccggcgttcaggctatccggcccgctttgggaatagaaacaacagcaagggtagtcagggatcgcggtctgcacaacgcgaggggggttcatcgcttcgtggcagcacagactggtaaccagcatgtacaggaagccttcttatctcttaagaaaaccctggagaaaacttaaacaagccaaagctgtcactagcgaattgcttatgtgactctaatgtagattccggtggtatcgataaatgcaggtctatgtaaggtatggatataaagaatgggaaatgtttaataccccacgaacctttctataacctttatctctctatggccaggtatgcactccagagtgcctggtgccgtcccgctcccgttattcagcgtgctgacggcataaaaaaatcatttaattcataaggatagcgaaaccatgcccatttctgaaatgatgccgcgaatgccttcagggagatgaggtgaaattaccgttttttattatcctgtcccagaccatcaggttgtcaagcatgaacgcgcgaggtattgtttaagaagcatcaggatgatgaatgaagtgaacttgtgggagctggcagtggatacgactgaagaactcaataacacctatttctacgcaggcagaccgaacctcaccgctggtgagctctttttcatgattttctgtgaagaagtcgctgaacagctgggcattgatgacttcggagcgatcgtggccatcctgtctggacgtaatgtcctgactacccgcaccaaaccgcgcgatgctctcaagggtacctcctatgcctcacgggcagcacgcagagtattccctaacgccaagtttcctttcggcataaagctccccaccatcgtagggggatacccgccccggaccgcgcgtatactttttacgcataagctcagcacctttgtcggtcgggcgatacccgtcgtgggctgggtgattctggccagagacgttgccgatatcagtttcaattcggtcagactgtacaatgccatcgctcgcggggaggataagttatggtagatgacacacaggcacgcgtaatggcactcattgagccgtggaacggccgatcgctgcttacgttccggaaaaaaacacttacgccagagatgtcgcttaatcaggacatgaagcttgacccggaggacgctgcggaatgccttcagaacgtcttcgatgcgtttggaatagattctgatcaggtgactttcagcctctactatccaaaaaacccgcgcgaggccatccctcttactatcgggatggtaatcgagtcagcccgtgccaggcgatggtgctatgactgatatgacctgctccccgttgattagtacaccccgatgttagtaatgtcttcataagccacatgagggcatccccatgaagaagcgttttcctacgaacagatcatcagtatcctccgcgaggccgaagccggggtttctgcacgggaaaactctgccgtaagtatgctatttcagacgctactttctacacctggcgcaagaagtttggcggcatggaagtccctgaggtaaagcggcttaagttacttgaagaggagaacgtccgccttaagaagctgctcgccgaagccatgctggataaggaggcgcttcaggtggctttgggtcgaaagttctgacgacagaccagaagcgggaagccgtggaagtcatatgtgatgcaacgggtctgtcgcaacgtcgtgcctgcaggctggcaggtctgtctctttcaacctgccgttattcagctcagcgtccggctgctgacgcgcagctatctctacgcatcacagagctggcacctgaacgccgtcgctttggttaccggcggatctggcagttattgcatcgtgagggccttcacgtcaaccacaagcgggtataccgcatttatcaccttaacggcctgagtgtgaagcgcagacgatgccgtaagggtctggcgaatgaacgacttccgctgcttcatccggatgcgcccaatctgacatggtcgatagattttgtcatggatgcacttgccagcggccgccggattaagtgcctgacctgcgtggatgatttcacgaaggagtgtctgacgatcaccgccgctttcggtatttcaggcgttcaggtcgctcgtattctggacagcatcgcgctttttcgtggctacccggcaatgataagaaccgatcagggcccggaatttacctgccgcgcactcgatcaatgggcttttgagcatggcgtagagctgcgacttatccagccgggtaagcgaacgcagaatggatttattgagagtttcaatggccgctttcgggatgaatgtctgaataagcactggttcagcgatgttcttcatgcccggaaaatcattaatgaccggcggcaggactataacgagtccagacctcattcatcgctgaattaccagactacagctgaatttgcagcaggctggggaattggaaaatcagaaggtaaacaaaccgacattactaactgatcgttgtatctaatactgggggcaggtcacgaataacgtacatacacttaagacgagagctctatataactttcaatgtggccattcaccatcaacgggtgccaggtctaagtgattccattaaattgccttcggaatttcagtgtgatttatgaaaaaaacccgtctgcgacgggttttcaggcatagaaggcgacagtcaccgctccggcattacggctttttaaacttgtcttcgactttctcttccgcttccgcgattttatcaccggccttttccgcgaaaccctctttatgcgctggctcgctgcctggcgttaccggacgggtgtcgtggtcagcgcgggcctgacgtgtgctttcaagcaacggatcggccacagtacgattcccggtcagccggtctgcgccgagaggatctgtactggcatggtcaatatccacttcctgacggcgtaccgaatcgttgatagtttcaacccgatcgcttgtctctttgcgtaacaccacctcttcaatgatctccgcggtcttattaatcacgggctgctcatgcgtctcttccacttcgacagttttttcagaccagtcaacatgagtgggtgaacctgattcattcaccggacgacggaagattgcggcgtgctgctcatgcagcgagacattttctgagacctgatcggtgacagtgtagcgacgaacgcgggttgaaccttcactgaccagacgtttacccacttccagtcgctcctcggccagacgcagtacatcctcgtcactttcgtcaccggtcagggcagtacgggcagcgccacgatgggcaggatcggtagagagcggatcgacggcggcattatcctgaagcgttccactggcaggtgcagtcagaccatcactggtcgcgtaaccgggcgcgtaatcatcgggcagcgccgcactgcgctcggtaagttcttcatgtgcatcaaggatgcccagggcgcgaggtaactcatcttcatcggcccgcagcgacagcactactccgccggttcgcatcgcgtcttcatacacttcggcctgatcctcctccagcgtattgccgaacaggcgttgccagaagccagggtgacgggcctcctgaccttcggtacgcaaacgatcaccggagatgatatcaatgtcatcatccaggaacccggccttgatcaggttacgctttgcaccctctgccagtgagatattgctgaacattgttacgattgtttcacgcgccatgttgtgttcctcggtgatggattcggacggctctgaatagggtgttcgggtcaggtgagcgtgctgtttgcgcagggagacgacctgttctgtcgcttcctcactgacaactttgcggatatgccactcctctttcagcaccagatgacgaacgatctcgatttcctcttcaacgacaggaatgatcagaacgccattttcttcacggatctccggcatctcagccagccgttccgatttaggaatgcgttctatttccgccgtctggtgccggagcatcagcgcaatcttctgctgatgctcagtgacctgtcgggtaaccctgacatgaccgtcgatgacccgctgttttgagacctcaacggtttcctccgccaggcttatcacctggtcgctaccctctgaccctggtttttcaggaggttgattgttcatgtttaacctgcctgtgatacagagcgatcatttgtacttttctttaccttgagcataagtcactgcttttcggttagttaaagcctggcacaaacaatgccaaaagacaggaaaaagcagaaaaaagccattataagaagataacgtggtgctaaaatcgattaagcggtgcggcagataaaaatcagataacgaagcggcagacagtgaaatctcttttatcgcatacgcaaaaagaggatcaatcaggtgttaacccgacccgaagtgaatcaggcatatcgggtcaggggttgagccattcgctttcctgcaactcgccgttagccgaatagcgaaacagggcgcgctgattttcgtttcgatgaagctgataggcgtccagcacactggcctgcaaaatcaccacgccaaaacgggattccccggtttccgctgccgtcgcatcagacgtctcgttagccgttgtccgcgcttccccaggaggtccgccggtgtaagtctgccgcgtgtgctgcggtaacgcacgccaggctgcccgggcaacatcacttcccgccgcataacacgcaacccgccctgccagccgcaactgcaggcgacgctgatggcaatatcccaccacggtgacctgcggattcgccgccatctcctgccacttcgggctgcgaacatccgtatgaaatgtcaacatccggcggtcgtcggcacactggcgcagaaccacggtgcgcgcctgaggttgcaacagagcatcgaccgtacagagcatcagataacgaaatccggcctgcggatcggtcgcagattcctgcagcccagcccaggctgctgcttcaaacgttttcaattccatggggattactctcatcaggatcaattttcagccatctggctaaaagcgtagcaatgaagtggacagaaggcctgacagcgcagcgataagagcaaatgtggcaagcgggagctggacaatgcacgagagcaggagctgttgagataacgtcggtattgcgggatacctcgcagagcggcgaaagcgcgtcccgccagtcagccactctgtgttatttttgcgccatcgccacagagatccgatccgcagggagttgcacgatgacaactgaagagtctgctaaagtaccggctgaaataccgctgaaagtcacctcgccgcgcctgacttatcggccacttcggcaggaagactggcccttctatctggcagtcagtcaggatagatcggtgatgcagtacatcagcgatccgcgcagcgctgaaaagatcagaacccactcatttgatgtccgcctgcccgcctggtacaagggctgcaggcactggctctgtctggttatcggagaaaaaacattcggtgctccggctggcttttgcgggtttatcgatcgtggagagggtattgcggagtttggctttattctggccgcagatgcgcagggcaaaggctacggcagcgagtctctgcatgccattatcacgttctgctttgagcaacaggaataccgcaaactgatcgcgacggtgacagcaggcaatgcggcctcacgccggaccctgatttcagcgggctttgtgcaggaggggacgttgcggcagaacttcttcctcaacggccagtggcaggatgactggatcttcggcttgctgaaacaggaataccagcccgcacactcaccctgaggcgcagactatcagcgtcgggcatcctccgctacgctcgccacaatcagaccgattagcgtggcgtaacgtcataaccgctggcgatagcgatagcgggcgcactgtgctcctctccgcacagcatcgcctcaaagtccgccggcgtcagtggctggcacaggccattgccctgcataatgtcgcatccggcggcagtaacaaaagcgatctgctctttgtcttccaccccttcggcggccacccggatacccaggcttttgccgagcgcggtaatggcccggaacatcatacgcacccgcatgctggaacccagctcgtgcgtcatcgacttatcgattttaaaacccgtcacaacgctatagcgcagcaggttaatcgcccctagcgtacgcccgtaatgatcgataacgaacgaggctcccgttcggcgtacggcgtcaacctgaaccggcatatcctgcatcagcacggccagcagtggctcatccacttccagctcaacaaaaccggcatcgcctccggcactctcacgtatcaccgtctccaggctgttccctgccagctggcgcggaaacaggttaatgctgacgcgaagctgaggagagcgaacctgccactgccggacctgtgccagagcactgcggatgatccattcacccagcgtgactgaaagcggacttttaaccagcatgccgataaattcagccggcaacagcagcccgcgcgtcggatgctgccagcgcaccagcgtctcgcagccaataagctttccgctttcaacgtcgtagcggggctgatagtaaagagtgaactgctgctgccgcaccgccgtttccagttcgcgctcaaaacggcgccgctgctgctccgcttcacgaaacgcgggcataaacagcatgctgcagcctttacccgacgctttggcgcgatagagcgccagatctgcggcggacatcaccgaagagggatccctaccgtgctccggataggaggcgatgccggtgctggcaccgaccaccaccggtgagtcgtgatagcggaacggcgtctgaacggccgcaatcagtttctccgccgtgatcgccgcctctgcgctgccgcctgctaacaggatcacaaattcatcaccacccaggcgcgcagccgtcacggcactggcgcagaccgcacgaatctgttcggcaacgtggcacaacaacgcatcgcctgcagcatgccccagcgtatcgttaacctctttaaaaccatcgagatcggtcatcagtaacgtataggggacgcccgccctggtcagctggccgacctgatccataaacgcgctgcggctggcgagacgtgtcagcatatccagtgaggccagctcacagagccgcgcctcactctcatagcgggccgtgacatcgcggatgatcatgcccaccagccgttcgccctcttcacgccagcccgaaaaagagacctctgccggaaattcacgaccttcacgcgtgacaccccatatctgcaaagagcgagggtgcgagatagccgcttcgtcagaggtaatccggaccagttcattacggtagtcagcctggcagcgagcagggatcagctcgctgatatactggccgcgcatctcctctgcgctgtagccgaacagcgcggtggcggccgggttccagaaggttatgccacgccgaaggtcggtgcagacaatggcgtcaggcgaagtggatgagatcgcctcgagtcgctgctggctggtgtagcgcaataactccagacgatgcatctccatgcgatccatcaccagtgcagcaatatcgttcagatgctttcgatcctctgcagttaacggctcacgaggatggctgtcggtcaggcagaccgtgccaatatgatgcccatccggggtcgaaagcgggatccccgcgtaaaagcggataaaggggtagccgtgaaccagcggactgtcgcggaagcgcggatctttcagcgtatcgggcacgcagaggatatcgccctgcgccagcgtatggtggcagaaggcgacgttgcgtgccgtacctgaaatatttaaaccgtaccgggaggcgaagaactgccgcttttcgtcgataagcgagacaaaagcgaccggcacccgaaacagccgcgcggcaagcgtagtgaggcgatccagcgcatcggtcggcggtgaatccatcagatgatactgcttaagtgcgtcgaggcgagccgcctcggcatcatgataaactggacgtttcagcgtaactctcctctggtgttatctgctgtggctggcctgacacagcataaagaggacacgttcaatcagacagaaacgcgcagagttcgctgccgatccgttgccggaagaaaggcccgtcagtaaacccggcagcaacaggttgccgcgctgagtccgataaagctgacaccgcagacagcgaggcatcagttaacacgttatgcctgccagagagagtgcggcggaccgcccaggattatctggccagagcagatcagacaggcggtaatgcgcctcgcttagctctctatatcggcccgacatgactttacttaagagaaaacagaggatgaacgccttactttttcagctttggtaccagttgatagtgcggatgctctccggcgagcagcatcagcagttcatactctccctgactgagcagcgcaggatttttcgatgcttctttcgtctgccagacacgctggctaagatcgaaacgctcggctgcaatctcctgagagagaccggccgcaaggcgcagctcacgcacgttgtgctggacggcgacaggccgctgtaaaatctgatttcccatataaacgctccgcatacggtgccccggcgagatggccgggcggaagtacacgcctgcggccaaaacataaatttgagttaagttttaacagcccggcgttttacacttatcaggaaagcgtaacgcaccagtaaaaacagagaaaataacctgaattatatttaaatcgctgcccggataatttttgcaccgctgagaatagtaattgccattctgaatggtggcgttgatcgaatgatgatcaacgtcaatcacagtcacaaaaaatgaccgtttcatccctcttttaaaaagagtgaatattaatcgttattccgtgccggacagacattatctacagttcagaaaaaatacgttcaggctatgcccgcgcaaacgttgcccagccgcctttttcagcaggcatgacgcgtttaggctctacggcaagagggcgatgcggcagggtaaagcgcgtaatcacgctgcccagcttttcagtctgtccactgagactgcctgctgtcgccgaaacctgctgaaccagcgtcgcattctgctgcgttacgcggtcaagttctgcaacggcgaccgtgacctgggcaatccctttgctctgttcatccgaagccagcgcaatctgtccgatcagttcattcacgccgccgacgccgcgcagcacggcctccatggtggttcctgcgctctcagccgcccgccggccatcgtcaacgcgtgccacggtatcggcaatcagctcttcgatctctttagaggcagcagcacttcgctgtgccagtgagcgtacctcactggcgactaccgcgaagccgcggccctgttcacccgcacgggcggcttctacagcggcgtttaacgccagaatgttggtctgaaacgcaataccattaatagtggtggtgaactgccggattttttctgatccctgagcgatgctggtgatggctgccgataccaactgaaccagttccacgccctgctgagtcgtatccgtggtgctggcagccagttcacgtgcctcacgggcattctctgcattgtgacgcacggtgacggtaatctcctccatactggctgcggtctgctccagcgcagcagcctgagtggatgtccggtcggagagatcggcgttacccgcagcaatgtcccccgcttcacgatgaagaatggctgcgttgtcacggatagcgctgaccgtctgcaacagactgtgctgcatctctttgaccagcggcaccagttgcccgacacagttgcgccccagatcttccggctcgcgcgtcagatcgccatcggcaataatttttaaatgaccgcgaattttacctaccggacgcaccagatgaacgaccagatagcggtcacaaaacagcagcaacgccactgccgccagcagtgctgccagcaatacgccctcaagccgatgccggtcagccttcaggggtgcctgattccgggccagctgctgcgtcaccttgtccagctgcgcacgtgcaaccgttgcgtattctgagggggttgtcgtaagtgccgcgcggacgttatcccagtcagcatcggccggggttgaggcgacgagcgcgtttttatcggctgacgtaccgctctgcatgacgatagcgctgtgcgccagaaagctcagttgctgcgtcagaacggctgaacgatcggtttgacgaaagatatcgcgcacgacctggctgctgtagccaccggccagcacgacgatgcccagtgagacgatcatcatccacagcacaacgcggcggatagtgaaatgcctgagtgaattcatgaggtttccccgatgttgtcattggtgtagttaaaattaaacaaaaataagttatgtcatctactttagtgcgttattatatagtgcactatgtttatactctgtatactggcaggatatttaagaaattaaaagtttttaacgacaaaataatagaatcgtgattactaaaatatttcgttaaagaaaagtgatttgctattctgaccagcaatggcgtgcagtgggataaaaaataaatggtcatgactctttctttttgcagaatttgcctgtagtcatgacatcatacccttcaatttttctgtttaatttcgcgccgtaaccagccggtgcggaggaatccatgcttatgagtctcagcggcggcgacgattgccgcacgcgaaccctgcacgcgctgcgcagtaacgacgaaagtcgtgacgatgtgttgcgacagtttcgtccggctggccagccaggcactcggtatacccggcagctttatctccgtactggatgatgagatgcagcatgttaaggctgcgcaaaatttcacactcactcaatcctcccggcaggactcgctctgccggcatgcagtggacagtgacagcaccgtggtagtacccgatacgttgctggatacccgctttgctgagcatccgctgattgttggcgcgccttttatccgcttttatgccggcgtaccgcttaaaagcagcacaggtctgatactgggtacgctgtgcgtgactgacaccgcgcctcatccctttaatgcggatcaggtcgccatgctaaagatgctggcggcactagtgatgtcatttcttgaggcctggtactcggctggctttgccgacccggtaaccggtctgcccaaccgccagcgtctgattcgcgacctgcagtttcttgccgcctccggtgacaccacgccacggcggctggtgctgattgactgtatcgatatgccgcgcgcctacgagcttgcgcgctcaatgggcatgggaccggttgaaagcctgttgaaagatgtggcgacactgctgccgctgcgcctgaggcctgcgccaggagagatgctctacaccgtagccaccgggcgctttgccctgctgacacgtcaggagagcagactcactgctaactgggtggcaaacaagctggccgggatcagcgcggatctcggcgatgggctgtcggttgcactgatgacccacaccggtgaggcgagtttcaataccggggagatgcctgcccaggagatcctgcggcgtgcggtcagcgcgctgcacgaggccatcacacgcgacgtcgcctcgatgcctttcagcgaggccactgatacgcgccatacgcaggactttaccctgatgcatgacctggccatcgcgatacgccaggataagggattgtggctggcgtatcagcctaaaatctgtctgcacagcggcaagccgattggcctggaggccctgatccgctggcagcatccgcagcgcggcgaactgtcacctgcacagtttttaccctttgccgtgcaaaccgagctgctcagcgaactgaccacctgggtgacagagcacgccatcgcccggctctcccggctgcgcaacagctatattcagttgcccatcaccattaacgtcagcagcagcgatttttcacgtgacggttttgccgacgagctggaagagcagatgatcagggcgaagctcccggtttcgctgctgggcattgagtgtctggagacggaacggattctggagagcgcgaccgcaatgcgggggcttgagatgctgaaacttcgtggattcggtatttcactggatgactttggtaccggctacagcaacatcagttatctgcggcgcattccgctggatgtgatcaagctggaccgttcactgatcagcgaaatttcatctgacaccgcatcgcgcgtcatcgcccgcagtattattgcgatgcttaaagatctcgattatatggtgctggctgagggcgtggagaatgcggaaaccgttacggcgctgaccgagtttcggctgcgaccaggcgcagggctttttctactccaggccgctgccggaagcggcactggatgagtggctcggctggcgattacgcagtaagtgctgagcctgtcccactcaccccggaatcttacccggccgacccagacgcgctgaactcctcagctccggcaatgatgacggtattacgcccggcggcttttgcttcgtaaagcgcttcatcggcacgccgcagcagagagtcgcgatcgctatcctgatcgctccgcgaagccaccccggctgagatggtcatcgttccggcaaacggaaaggtggtggcgctgacggtctcacggatgcgttccgcggtgcggacggcatcagccagcgtggtatgcggcagcagcagaataaactcctcgccgccaaaccggctgacgatatcgccggtacgacaagcttgacgcagcaacgctgccaggctcaccagaaccgcatcgcccgcgtcatgcccgtaccagtcgtttatcttcttaaaatggtcaatatcaatggcgatggcacactgttcatgctcactgtctgactgcgccgccagcgccgaaaatccgcgtcggttgcagagcccggtcagcggatcggtcatcgcttcatcgtttagcgcggcaagatgacccgcaacggcgtgccgatgagcctgcacggcttctttgagtcgatcagcctcgtaataccaggttttaaccgtggcgagagattccgcctgggcttcgctgccgccatcgcgcactctgtccgccagcttttccagtggagaggcgattcgaccggccataaaggcaataatggccgctgttacggcaataatgcccagaacgaaccagacggcgctttctgccgtgcgcatcagaatatgcctgaccgtttcagaggtgccggtaataaaaacgttccagccggttttatgcagtgtgccatagccagtcagatagtgctgtccctcactctccagcgtgaaatgcccgctttctgtcgtggcgagccgtttctgcagtgccagactcagcagcatctttgttccgacgcgcgctgcgtcatgactgaaaataatcagcccttcattgctgaccacgctgaccgttgaaccattggaatagaaatgctggctcaggatttcgctcagcatgctctgtttcttgagataaatagtcccgccaatgtagcccagatagcggccatcttcgctgaacagaggttgtgataaaaacaccacatagttaccggccgcggaggtaaaaggagcagagataaaaggcttttgggtcgctatggcctgcaggctggcaagtgagtgcagcttcacgccaataagattcagactatcgggtgaggttgctgcaataatggcatcatgatttaccaccaccaccgagttgaaaaaacccgactgcattcgcaggcgatcgctctctccttccagtcgtttaatatcactaagccccttgatctgcgacgcactccaggccagttcacgttgtgctgtcgccaggtaacgatcggtggtatcagccagcttgcgggcataggcaatgttcccttcaagcagactgtcttcgatgttggccttctgaaacagcagcagcgcactcagcagcagaccggaggtcagaatgacgcccccgatggaaagcaaagtcagcagcgagcgaaggcgcattttttcatggggcattgcagtcgggatccggattaagtgtcatctgagtgtaacagtagacgtttcacgtcaagggccgaacagaagatgatttacacaggatcacggcgcattgccgggcgcagcacacaaccgtccagccctgcataaaggattgtttagcgtttcgatagccctgataagcaacagcagaaaatgattaagcggtaataatgatactgagcaggccggtatctgtgcagatgacgcactattattaccgctgaccgtgataacaacgccatatggtcgctgaaaataacggggcaggctctgccccgtttatcattacgttaaaaatatgcgtagaacagttaaataaaacctgcatcaataataagtaattgtgcatcagccttatcttttaagcgaatttaacgccagaacgatttaatataagagcggctgctgagccttttaataaaatgatgcggacaggtaaagcggcgcccttcccactccagattaaaccactgaaattcatcatctttaattttttccagcagggtcattgcctgcatcggcgtctgaaaagcataagctttcatcacgccctcctgggtgcataaatcaatatgaaccatgtaacccccgggtgttaaaaagatcggacattttataattattgaaaagcctctttatcataatccatttatcggctgccgattatctgattccgtaatatttacgtaaaaatttcacctctatttcccatttaaatttttgggcaaccccgccttatttcatcaattaatttgaccatgtatacgaaatccagccagacccgaatagatcgtaacccatgtttaatgcagctcagagggtggcgacgataagcgatcgcagaagatgacgtatacctgctcacattgtcagcattgcaccgtctggcaggtccagagccgtcatgcagaggggatgtaatggtgctggctgagaggttgagatggtcataaacagagcacatcgtttacactctcatcagcctcatctgcaatccggcaaaggtacagatgtatcgcggagagaggcaggagatcactgacggcgggcaataaggaatcttatgctggattatatggtgtcgctctaccgtactgttcctgtctcatctgaacgtctcagcgactggcttgccagctggctggcgcagcagcagacacgatgccacgatcaccatttttctgccgcctttccatggcgtgaaaccggtctgccccagcacgcctttttgcagcgagaaaactgacgataaacggccagcgttatctcaccgggccgcgctatctgggtggcgatcctgcacagccctttattgaggttgttgcgcgtgacggcatcatcgattacagggtcgctagcgccattatgcaggcatggcagccgctgaaacccctgaagctgcgcatcctgttgcctgcgacttatcctgacatcggtataaccgatcaactgcttttcctcagcgacctggcttcactctctgttcctgtcgacgaagatatttcactggtgacagcctgccggaaggattatcccgcctgtatcacggcgattaaccgcgcctatcgtgccagcaggcacacgctgccgcatctgcgcgatcagctactggcaaccagcaggcaggaattacgggaggatatcgccgcgggacatgtgtttctgattgtctggcagggcatagtggcagggctgatgatttgtgtgccccggcgactgacctttattgaggggtttcagattatggatgaagtgattatgcccgcttatcagggccgtggactcgccgcgcgcgctcagcagcgtttgctgcagcagcttcatcatcattatggtgagaaggcactgctgaccggtaccattctgcccggtaacaccccttcactgcgcagcgcgcaaaatgccgggcgacgctgcgtgctgaaatatcagttttttacccctgtcgatttacgagccggccgacaggcaatttaaatcaccataaagccagctcaatcaacttatcctgcacactgtaaacgcgctgcttaaggctcaggctctcgtctgcgctgatccattttgcagcaaacgcaccattaattttttccagtgcgattttggtgctgcttttcagaccttcgtgccagttcgcgtctgaacgttttgccgcctgtttttccaggctctcaactaactccgcgacacttttaccaccggtagtagcttcggatacagacatacctacctcgttttgctgctaaaaaacggccacactcgcggaacatattatacctgaaccctgatcggcatggcgctttcctgtgcgcactacccggcatgcctcgtaaactcattctggcatcacagagatgacgtaaatggcgcaacgccacctgcatcaggggggaatccattcaaacgtcatatccaatcaacccgccagcattgcaaattaatgtgaatttttgatgaccataaagataaaaaataactttaaaattaatgacctgttctcatttcactgacccgccttgtgattcacattttgaaaacaaaataatcacacatagttattttttcatgcataaattagtgccagttttcatttatggagcaggcaaatgactcactttgtggcaatttttttctcttcactgtttatgtgcagtaacgtttttgcaggtacagtctcatccgtctctcttggggcgctttctacctcgctcaacgaacggatgcaggtgatgaaagcggtggcgggttataaagcactgcatcatttacctattgaggatctgccacgggaacaggtggtgctggataacatgctgcaaaacgcacaacaggccgggcttgaaccccactccttggagccgtttgttcacgctttgatgaacgccagcaaggcgatccagtatcgctatcgggctgactggctctcatcaccagacagcgctgttcctgtcagggatctgaccgagaccagacagcagatacaacagctggatacccagctcctgacggcgatcagccagcggctgatgaccggcgccttctcgcaggaggacaaagaatttctgatgtcacacctcacggcacctcacctcagtgagagtgataaaaacagcctgttcgcttccctctcccgcattcagcgccagcactaatcctctatcagcggagtacgctatgcagcttcatgaactcatggaccccgactactctgacaatccctttcccctttatcgaaaactgcatcagcagggaccgcttatccctgccggagataagatcatcatcagcggcagtcacgcggtggtggacgccctgctgaacgaccggcgggtcggtaaaaattatatggaaagtgtcagagtaagatttggtgatgatgcagccggactgccgctgtttcagggtatcagcagaatgtttctggtgctgaacccacccgatcataaccggttaagaggactggttatgaaggcgttcagcggccgggagattaaatctcttcgggagatggcgctgacgatagccaatgaactggttgatgaactggaagggcgtcgtgcctgcgatctggctcaggcattcgcttttccgctaccggtgcgcattatctgccggatgctggatgtttcagaatctgatgcaccagaactgggtcgccttacctctgcgctggtcagggttttcgatcctcaaatcagtcagccagatttgctgaaagccgctgaagcttttgccgtactggaaagttacttcagtgccgtgatcgtatcccgacgtgatagcaccgccagcgatctggtgtcactttttctgcgcagcgacagtgacggcgaccagctggatcacgatgagatcatcgccaatgtgatactgctgtttcttgccggtcatgagacaacgtcaaacatgctgtgcaacaccattctggccctgcatgctcatccgcaggaacttgcgagcctgaaacagaatcatgcgctgatacccgatgccatagaggaatgtctgcgctacgacagttcggtccagatgctttaccgcacgactctggaagagattgagctggcaggagagctcatcccgcccggaacccgcttcttccttagccttggtgcagccaatcacgacccgctggtatttacctctccggaacggctgaatatccggcggcatgaggggcgctgtctggcattcggtggcggtatacatcactgtatgggctaccggctggc
